US012686889B2

(12) United States Patent
Gore et al.

(10) Patent No.: US 12,686,889 B2
(45) Date of Patent: Jul. 21, 2026

(54) COMPOSITIONS AND METHODS FOR CANCER AND NEOPLASIA ASSESSMENT

(71) Applicant: SINGLERA GENOMICS, INC., La Jolla, CA (US)

(72) Inventors: Athurva J. Gore, La Jolla, CA (US); Jeffrey A. Gole, La Jolla, CA (US); Rui Liu, La Jolla, CA (US)

(73) Assignee: SINGLERA GENOMICS, INC., La Jolla, CA (US)

( * ) Notice: Subject to any disclaimer, the term of this patent is extended or adjusted under 35 U.S.C. 154(b) by 861 days.

(21) Appl. No.: 17/066,144

(22) PCT Filed: Apr. 8, 2019

(86) PCT No.: PCT/US2019/026395
§ 371 (c)(1),
(2) Date: Oct. 8, 2020

(87) PCT Pub. No.: WO2019/199696
PCT Pub. Date: Oct. 17, 2019

(65) Prior Publication Data
US 2021/0388445 A1    Dec. 16, 2021

Related U.S. Application Data

(60) Provisional application No. 62/656,820, filed on Apr. 12, 2018.

(51) Int. Cl.
*C12Q 1/6886*          (2018.01)
(52) U.S. Cl.
CPC ..... *C12Q 1/6886* (2013.01); *C12Q 2600/154* (2013.01); *C12Q 2600/16* (2013.01)
(58) Field of Classification Search
CPC ............ C12Q 1/6886; C12Q 2600/154; C12Q 2600/16; C12Q 2531/113
See application file for complete search history.

(56) References Cited

U.S. PATENT DOCUMENTS

| | | | |
|---|---|---|---|
| 7,620,386 B2 | 11/2009 | Wood, III | |
| 9,365,902 B2 | 6/2016 | Huang et al. | |
| 9,719,131 B2 * | 8/2017 | Olek .................... | C12Q 1/6827 |
| 11,965,157 B2 | 4/2024 | Gole et al. | |
| 2006/0134643 A1 | 6/2006 | Berlin et al. | |
| 2009/0108917 A1 | 4/2009 | Chellappa | |
| 2010/0297067 A1 | 11/2010 | Herman et al. | |
| 2011/0223180 A1 | 9/2011 | Aldape et al. | |
| 2015/0152505 A1 | 6/2015 | Lapointe et al. | |
| 2016/0355885 A1 | 12/2016 | Weinhausel et al. | |
| 2017/0283887 A1 | 10/2017 | Wielscher et al. | |
| 2017/0335401 A1 | 11/2017 | Allawi et al. | |
| 2020/0048697 A1 | 2/2020 | Liu | |
| 2020/0123538 A1 | 4/2020 | Gole et al. | |
| 2023/0193395 A1 | 6/2023 | Liu et al. | |

FOREIGN PATENT DOCUMENTS

| | | |
|---|---|---|
| CN | 103014155 A | 4/2013 |
| CN | 105339507 A | 2/2016 |
| CN | 107592885 A | 1/2018 |
| WO | 20090108917 A2 | 9/2009 |
| WO | 20100094040 A1 | 8/2010 |
| WO | 2016/115530 A1 | 7/2016 |
| WO | 2016138105 A2 | 9/2016 |
| WO | 20160138105 A2 | 9/2016 |
| WO | 20170048932 A1 | 3/2017 |

OTHER PUBLICATIONS

International Search Report for international patent application PCT/US2019/026395, dated Sep. 12, 2019, 5 pages.
Written Opinion of the International Searching Authority for international patent application PCT/US2019/026395, dated Sep. 12, 2019, 6 pages.
International Preliminary Report on Patenability for international patent application PCT/US2019/026395, dated Oct. 13, 20120 7 pages.
Office Action for ROC (Taiwan) Pat. Appln. No. 108112820, dated Jun. 8, 2023, 22 pages.
Office Action (Translation) for ROC (Taiwan) Pat. Appln. No. 108112820, dated Jun. 8, 2023, 6 pages.
Search Report (Translation) for ROC (Taiwan) Pat. Appln. No. 108112820, dated Jun. 8, 2023, 1 page.
Notice of reasons for Rejection (Translation) for Japanese patent application JP2020-555453, dated May 1, 2023, 6 pages.
Office Action for Japanese patent applicatio JP2020-555453, May 1, 2023, 3 pages.
Filling Argument for Japanese patent application JP2020-555453, dated May 2, 2023, 13 pages.
Amended Claims for Japanese patent application JP2020-555453, dated Oct. Oct. 2, 2023, 3 pages.
Filing an Argument for Japanese patent application JP2020-555453, dated Oct. 2, 2023, 3 pages.
Claims (clean) for European patent application EP19785565, dated Jun. 24, 2022, 4 pages.
The Extended Search Report for European patent application EP19785565, dated Nov. 29, 2021, 9 pages.
Communication pursuant to Rules 70(2) and 70a(2) EPC for European patent application EP19785565, 1 page.
Additional Test Data for European patent application EP19785565, dated Jun. 24, 2022, 2 pages.

(Continued)

*Primary Examiner* — Nelson B Moseley, II

(57)          ABSTRACT

The present disclosure relates to certain compositions, kits, devices, systems and methods, e.g., certain compositions, kits, devices, systems and methods for assessing cancer or neoplasia in a subject. In particular aspects, provided herein are compositions, kits, devices, systems and methods for assessing cancer or neoplasia in a subject based on assessing methylation status of selected target polynucleotide sequences, e.g., target genomic DNA sequences, from the subject.

18 Claims, 204 Drawing Sheets

Specification includes a Sequence Listing.

(56) References Cited

OTHER PUBLICATIONS

Claims for European patent application EP19785565, dated Jun. 24, 2022, 4 pages.
Response to Office Action for European patent application EP19785565, dated Jun. 24, 2022, 14 pages.
Request for Examination and Amendment for Korean patent application KR10-2020-7032480, dated Mar. 28, 2022, 23 pages.
Asakawa et al., "Human BAC library construction and rapid screening", Gene 191(1997) 69-79.
Chen et al., "Non-invasive early detection of cancer four years before conventional diagnosis using a blood test", Nature Communication (2020) 11:3475 https://doi.org/10.1038/s41467-020-17316-z.
International Search Report for international patent application WO2019199696, dated Oct. 17, 2019, 5 pages.
Written Opinion of the International Searching Authority for international patent application WO2019199696, dated Oct. 17, 2019, 6 pages.
International Preliminary Report on Patenability for international patent application WO2019199696, dated Oct. 22, 2019, 7 pages.
Office Action for Japanese patent application JP2020-555453, dated Mar. 19, 2022, 22 pages.
Office Action (Translation) for Japanese patent application JP2020-555453, dated Mar. 19, 2022, 6 pages.
Search Report (Translation) for Japanese patent application JP2020-555453, dated Mar. 19, 2022, 1 page.
Penultimate Official Action for Japanese patent application JP2020-555453, dated Nov. 2, 2023, 4 pages with extra 7 pages of English language equivalent or summery.
Benjamini et al., "Controlling the False Discovery Rate: a Practical and Powerful Approach to Multiple Testing", Journal of the Royal Statistical Society Series B (Methodological) (1995)57, No. 1, pp. 289-300.
Gansauge et al., "Single-stranded DNA library preparation for the sequencing of ancient or damaged DNA" Nature Protocols, 2013, vol. 8, No. 4, pp. 737-748 doi:10.1038/nprot.2013.038.
Osborn et al., "Stool screening for colorectal cancer: molecular approaches", Gastroenterology 2005;128:192-206 doi:10.1053/j.gastro.2004.10.041.
Smyth, "Linear Models and Empirical Bays Methods for Assessing Differential Expression in Microarray Experiments", 2004, Stat. Appl. Genet. Mol. Biol. vol. 3, Iss. 1, Article 3, 28 pages Doi: 10.2202/1544-6115.1027.
Taiwan App. No. 108112820, Response dated Dec. 12, 2023.
Taiwan App. No. 108112820, Amended claims dated Dec. 12, 2023.
Australia App. No. 2019253569, Examination Report dated Jul. 30, 2024.
Canada App. No. 3,096,668, Examiner's Report dated Mar. 8, 2024.
Canada App. No. 3,096,668, Response to Examiner's Report dated Jul. 4, 2024.
Canada App. No. 3,096,668, Amended claims dated Jul. 4, 2024.
China App. No. 201980039559.6, First Office Action dated Jan. 26, 2024.
China App. No. 201980039559.6, Search Report dated Jan. 26, 2024.
China App. No. 201980039559.6, Response to First Office Action dated Jun. 26, 2024.
Yin Shuhui et al., "Research progress on the relationship between DNA methylation and renal cancer" Journal of Baotou Medical College, Dec. 9, 2014, vol. 30; Issue 6; pp. 162-164.

Yang Lanhui et al., "Research progress on methylation of cancer suppressor genes in lung cancer," International Journal of Respiration, S1, Dec. 3, 2005; vol. 25; pp. 72-75.
Shuichi Asakawa et al., "Human BAC library: construction and rapid screening," Gene, Dec. 5, 2015, vol. 191, Issue 1; pp. 69-79.
Japan App. No. 2020-555453, Final Office Action dated Jul. 23, 2024.
Japan App. No. 2020-555453, Amendment to Final Office Action dated May 2, 2024.
Japan App. No. 2020-555453, Argument to Final Office Action dated May 2, 2024.
Japan App. No. 2020-555453, Amended claims dated May 2, 2024.
Malaysia App. No. PI2020005330, Substantive Examination—Adverse Report dated May 15, 2024.
Malaysia App. No. PI2020005330, Search Report dated May 15, 2024.
Taiwan App. No. 108112820, Decision of Rejection of application dated Apr. 18, 2024.
Taiwan App. No. 108112820, Rejected Claims dated Apr. 18, 2024.
European Patent Application 19 785 565.3, Examination Report dated Sep. 4, 2024.
Xingdong Chen et al: "Non-invasive early detection of cancer four years before conventional diagnosis using a blood test", Nature Communications, vol. 11, No. 1, Jul. 21, 2020 (Jul. 21, 2020), XP055755888, Doi: 10.1038/S41467-020-17316-z.
Singapore Patent Application No. 11202009866X; Supplementary Examination Written Opinion.
Notice for failure to gain acceptance for Australian Patent Application No. 2019253569.
Second Office Action for Chinese National Phase Application No. 201980039559.6.
Response to the second office action filed on Nov. 4, 2024 for Chinese National Phase Application No. 201980039559.6.
Decision of Rejection issued on Dec. 31, 2024 for Chinese National Phase Application No. 201980039559.6.
Request for re-examination filed on Mar. 27, 2025 for Chinese National Phase Application No. 201980039559.6.
Filing Receipt for Reexamination Request issued by the China National Intellectual Property Administration (CNIPA) on Apr. 7, 2025 for Chinese National Phase Application No. 201980039559.6.
Response to the Sep. 4, 2024 Examination Report filed on Feb. 27, 2025 for European Patent Application 19 785 565.3.
Experimental Data submitted with the response to the Examination Report filed on Feb. 27, 2025 for European Patent Application 19 785 565.3.
Amended claims submitted with the response to the Examination Report filed on Feb. 27, 2025 for European Patent Application 19 785 565.3.
Examination Report dated Jul. 24, 2025 for European Patent Application 19 785 565.3.
Office Action dated Nov. 20, 2024 for Korean Patent Application No. 10-2020-7032480.
English translation of the Office Action dated Nov. 20, 2024 for Korean Patent Application No. 10-2020-7032480.
Asakawa et al., Gene, 191(1): 69-79 (May 20, 1997).
A Examiner's Report dated Jan. 23, 2026 for Canadian Patent Application No. 3,096,668.
Reply to examination report filed on Jan. 22, 2026 for European Patent Application 19 785 565.3.
Claim amendments filed with the Reply to examination report filed on Jan. 22, 2026 for European Patent Application 19 785 565.3.

* cited by examiner

Figure 2

Python Code:

```python
from sklearn import svm training_set = ['BC Colon Healthy 1', 'BC Colon Healthy 2', 'BC Colon Healthy 3', 'BC Colon Healthy 4',
                'BC Colon Cancer 1', 'BC Colon Cancer 2', 'BC Colon Cancer 3', 'BC Colon Cancer 4',
                'BC Colon Cancer 5', 'BC Colon Cancer 6', 'BC Colon Cancer 7', 'BC Colon Cancer 8',
                'BC Colon Cancer 9', 'BC Colon Cancer 10', 'BC Colon Cancer 11', 'BC Colon Cancer 12',
                'BC Colon Cancer 13', 'BC Colon Cancer 14', 'BC Colon Cancer 15', 'BC Colon Cancer 16',
                'BC Colon Cancer 17', 'BC Colon Cancer 18', 'BC Colon Cancer 19', 'BC Colon Cancer 20']
test_set = ['BC Colon Healthy 5', 'BC Colon Healthy 6', 'BC Colon Healthy 7', 'BC Colon Healthy 8',
            'BC Colon Cancer 21', 'BC Colon Cancer 22', 'BC Colon Cancer 23', 'BC Colon Cancer 24',
            'BC Colon Cancer 25', 'BC Colon Cancer 26', 'BC Colon Cancer 27', 'BC Colon Cancer 28',
            'BC Colon Cancer 29', 'BC Colon Cancer 30', 'BC Colon Cancer 31', 'BC Colon Cancer 32',
            'BC Colon Cancer 33', 'BC Colon Cancer 34', 'BC Colon Cancer 35', 'BC Colon Cancer 36',
            'BC Colon Cancer 37', 'BC Colon Cancer 38', 'BC Colon Cancer 39', 'BC Colon Cancer 40']
X = data_matrix.loc[training_set].values
y = np.array(['Healthy']*4 + ['Cancer']*20)
clf = svm.SVC(C=10, kernel='linear', gamma='auto')
clf.fit(X, y)
predictions = clf.predict(data_matrix.loc[test_set].values)
results = pd.DataFrame(zip(test_set, predictions))
results.columns = ['Sample', 'Predicition']
results.set_index('Sample')
print "Specificity: %s" % (float(results.loc[test_set[:4]].query('Prediction == "Healthy"').count()) / 4)
print "Sensitivity: %s" % (float(results.loc[test_set[4:]].query('Prediction != "Healthy"').count()) /
20)
```

Code Results:

```
Specificity: 1.0
Sensitivity: 1.0
```

Figure 3a

Python Code:

```
col_colors = [sns.color_palette()[1]] * len(healthy_plasma [0:5]) + \
             [sns.color_palette()[0]] * len(healthy_plasma [5:10]) + \
             [sns.color_palette()[2]] * len(lung_cancer_plasma) + \
             [sns.color_palette()[3]] * len(BC_Lung_Cancer)

to_plot = data_matrix.loc[:, healthy_plasma+lung_cancer_plasma+BC_Lung_Cancer]

z = sns.clustermap(to_plot.fillna(0),
              mask=to_plot.isnull(),
              cmap='viridis', yticklabels=False,
              col_cluster=True, row_cluster=True,
              col_colors=col_colors)
```

Figure 3b

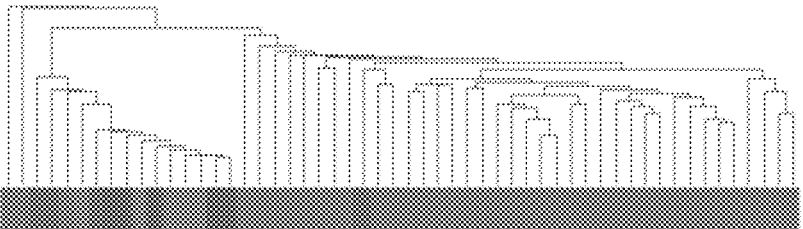

Figure 4

Python Code:

```python
from sklearn import linear_model filter_matrix = data_matrix >= 0.1
methylation_sums = data_matrix[filter_matrix].sum()

clf = linear_model.LogisticRegression(C=5)

# Fit to training set
X = np.array([methylation_sums.loc[healthy_plasma[:10]+cancer_plasma[:6]+cancer_plasma[:6]].values]).T
y = [0]*len(healthy_plasma[:10]) + [1]*len(cancer_plasma[:6]+cancer_plasma[:6])
clf.fit(X, y)

# Predict on test set
print "Sample\tP(Cancer)\tCall"
for i, methylation_sum in enumerate(methylation_sums.loc[healthy_plasma[10:]]):
    probability_cancer = min(1, max(0, model(float(clf.coef_)*methylation_sum + float(clf.intercept_))))
    if probability_cancer > 0.5:
        call = 'Cancer'
    else:
        call = 'Healthy'
    print "Healthy Sample %s\t%s\t%s" % (i+1, probability_cancer, call)

for i, methylation_sum in enumerate(methylation_sums.loc[cancer_plasma[6:]]):
    probability_cancer = min(1, max(0, model(float(clf.coef_)*methylation_sum + float(clf.intercept_))))
    if probability_cancer > 0.5:
        call = 'Cancer'
    else:
        call = 'Healthy'
    print "Cancer Sample %s\t%s\t%s" % (i+1, probability_cancer, call)
```

Code Results:

| Sample | P(Cancer) | Call |
|---|---|---|
| Healthy Sample 1 | 0.48991419229 | Healthy |
| Healthy Sample 2 | 0.402222997727 | Healthy |
| Healthy Sample 3 | 0.362647868404 | Healthy |
| Healthy Sample 4 | 0.291360093105 | Healthy |
| Healthy Sample 5 | 0.666083361246 | Cancer |
| Healthy Sample 6 | 0.444135105722 | Healthy |
| Healthy Sample 7 | 0.404667407834 | Healthy |
| Healthy Sample 8 | 0.674616468424 | Cancer |
| Healthy Sample 9 | 0.248090390611 | Healthy |
| Healthy Sample 10 | 0.270796583956 | Healthy |
| Cancer Sample 1 | 0.860345212988 | Cancer |
| Cancer Sample 2 | 0.613016848532 | Cancer |
| Cancer Sample 3 | 0.682635445446 | Cancer |
| Cancer Sample 4 | 0.59569270394 | Cancer |
| Cancer Sample 5 | 0.562216154423 | Cancer |
| Cancer Sample 6 | 0.475035178964 | Healthy |
| Cancer Sample 7 | 0.966879847323 | Cancer |

| Target Name | Target Region | Example Primers |
|---|---|---|
| Target1 | chr1:1098736-1098773 | TAGGGGGAGGCGGTTTTTTGTAGGGGG (SEQ ID NO:1), AATTTGTCGGGGTAGGTAAGGGCGGGT (SEQ ID NO:2), GCGTAGGGGGAGGCGGTTTTTTGTAGG (SEQ ID NO:3), GGCGTAGGGGGAGGCGGTTTTTTGTAG (SEQ ID NO:4), GGGGAGGCGGTTTTTTGTAGGGGGGTT (SEQ ID NO:5), TTTTTTGGACGTTGGTTAGGTTGGCGA (SEQ ID NO:6), TTTTTTGGACGTTGGTTAGGTTGGCGAT (SEQ ID NO:7), TTTTTTGGACGTTGGTTAGGTTGGCGATAG (SEQ ID NO:8), TTTTTTGGACGTTGGTTAGGTTGGCGATAG (SEQ ID NO:9), AGGATTCGTTTTAGTTTGTGTTTGTAGTGATCGGA (SEQ ID NO:10) |
| Target2 | chr1:1098787-1099554 | AAGGGTTTGGTCGGGTGCGAGGATGAT (SEQ ID NO:11), GGGTTTTGGAGTTTGCGGTGGGAAGGG (SEQ ID NO:12), AGGTCGGTCGAGTTTATGGGCGGTGAG (SEQ ID NO:13), AGAGGTCGGTCGAGTTTATGGGCGGTG (SEQ ID NO:14), GAGGTCGGTCGAGTTTATGGGCGGTGA (SEQ ID NO:15), GCGCGGGGTTTGGGAATCGGTTTTAGT (SEQ ID NO:16), AGCGCGGGGTTTGGGAATCGGTTTTAG (SEQ ID NO:17), AGGACGGCGGTGGTTGTTTTTGGAGAG (SEQ ID NO:18), GGACGGCGGTGGTTGTTTTTGGAGAGA (SEQ ID NO:19), ATAGCGCGGGGTTTGGGAATCGGTTTT (SEQ ID NO:20) |
| Target3 | chr1:1474968-1474978 | TGGTAGTTTTTAAGGGTGGAAGGCGGT (SEQ ID NO:21), TGGTAGTTTTTAAGGGTGGAAGGCGGTT (SEQ ID NO:22), TTGGTAGTTTTTAAGGGTGGAAGGCGGT (SEQ ID NO:23), TGGTAGTTTTTAAGGGTGGAAGGCGGTTC (SEQ ID NO:24), GGTAGTTTTTAAGGGTGGAAGGCGGTTC (SEQ ID NO:25), GGTTTATTCGGGGCGCGGGGGAATTAG (SEQ ID NO:26), TTCGGGGCGCGGGGGAATTAGTTTTAC (SEQ ID NO:27), GGGTTTATTCGGGGCGCGGGGGAATTA (SEQ ID NO:28), CGTGAGCGTATATGTGTGGCGGGGTTT (SEQ ID NO:29), TCGGGGCGCGGGGGAATTAGTTTTACG (SEQ ID NO:30) |
| Target4 | chr1:1474994-1475002 | GCGGTTTGCGTGGGGTTGGTTTTTTCG (SEQ ID NO:31), GCGGTTTGCGTGGGGTTGGTTTTTTC (SEQ ID NO:32), CGGTTTGCGTGGGGTTGGTTTTTTCG (SEQ ID NO:33), TGGTAGTTTTTAAGGGTGGAAGGCGGT (SEQ ID NO:34), GCGGTTTGCGTGGGGTTGGTTTTTT (SEQ ID NO:35), CGTGAGCGTATATGTGTGGCGGGGTTT (SEQ ID NO:36), ATATGTGTGGCGGGGTTTATTCGGGGC (SEQ ID NO:37), TATGTGTGGCGGGGTTTATTCGGGGCG (SEQ ID NO:38), ATATGTGTGGCGGGGTTTATTCGGGGCG (SEQ ID NO:39), TATGTGTGGCGGGGTTTATTCGGGGC (SEQ ID NO:40) |
| Target5 | chr1:1475031-1475165 | GCGGTTTGCGTGGGGTTGGTTTTTTCG (SEQ ID NO:41), CGGTTTTCGTTTCGTAGGTGCGGGAGG (SEQ ID NO:42), GGTTTTCGTTTCGTAGGTGCGGGAGGA (SEQ ID NO:43), CGTAGGTGCGGGAGGATGTAGTTGTGG (SEQ ID NO:44), CGGTTTTCGTTTCGTAGGTGCGGGAGGA (SEQ ID NO:45), TGTGGTCGGTGAGTTTATAATCGGCGT (SEQ ID NO:46), CGTTTCGTTTCGTTCGTTTTTTGGCGT (SEQ ID NO:47), TCGTTTCGTTTCGTTCGTTTTTTGGCGT (SEQ ID NO:48), TCGTTTCGTTTCGTTCGTTTTTTGGCGG (SEQ ID NO:49), TGTGGTCGGTGAGTTTATAATCGGCGTC (SEQ ID NO:50) |
| Target6 | chr1:2375223-2375249 | GTAGGGGGTGTGGTGCGGGCGGTAC (SEQ ID NO:51), GGTAGGGGGTGTGGTGCGGGCGGTAC (SEQ ID NO:52), TAGGGGGTGTGGTGCGGGCGGTAC (SEQ ID NO:53), GTAGGGGGTGTGGTGCGGGCGGTA (SEQ ID NO:54), GGGTAGGGGGTGTGGTGCGGGCGGTAC (SEQ ID NO:55), CGGGGTTCGGGGTTGGGGTTTCGGTTTTC (SEQ ID NO:56), CGGTATCGTTTCGTTAGTTCGGGCGGT (SEQ ID NO:57), CGGGGTTCGGGGTTGGGGTTTCGGTTTT (SEQ ID NO:58), CGGTATCGTTTCGTTAGTTCGGGCGGTT (SEQ ID NO:59), CGGGGTTCGGGGTTGGGGTTTCGGTTT (SEQ ID NO:60) |
| Target7 | chr1:2375267-2375277 | TCGTTCGAGTTGGCGGGGCGATGTC (SEQ ID NO:61), CGTTCGAGTTGGCGGGGCGATGTC (SEQ ID NO:62), TCGTTCGAGTTGGCGGGGCGATGT (SEQ ID NO:63), CGTTCGAGTTGGCGGGGCGATGT (SEQ ID NO:64), TCGTTCGAGTTGGCGGGGCGATG (SEQ ID NO:65), CGGGTTCGGGGTTGGGGTTTCGGTTTTC (SEQ ID NO:66), CGGGTTCGGGGTTGGGGTTTCGGTTTT (SEQ ID NO:67), CGGGGTTCGGGGTTGGGGTTTCGGTTT (SEQ ID NO:68), GGGTTCGGGGTTGGGGTTTCGGTTTTC (SEQ ID NO:69), CGGGTTCGGGGTTGGGGTTTCGGTT (SEQ ID NO:70) |
| Target8 | chr1:2705891-2705920 | TCGGATTGCGGTTCGGTCGATGGAAGT (SEQ ID NO:71), TTCGGATTGCGGTTCGGTCGATGGAAG (SEQ ID NO:72), TTTCGGATTGCGGTTCGGTCGATGGAA (SEQ ID NO:73), TTTTCGGATTGCGGTTCGGTCGATGGA (SEQ ID NO:74), TTCGGATTGCGGTTCGGTCGATGGAAGT (SEQ ID NO:75), TGGGGTCGTTGTTTTTTGCGGGTTTTT (SEQ ID NO:76), AGGAATGAACGGAGGTAGTGGTTGGTG (SEQ ID NO:77), GGAATGAACGGAGGTAGTGGTTGGTGA (SEQ ID NO:78), AGGAATGAACGGAGGTAGTGGTTGGTGA (SEQ ID NO:79), TGGGGTCGTTGTTTTTTGCGGGTTTTT (SEQ ID NO:80) |
| Target9 | chr1:2706004-2706027 | TCGGATTGCGGTTCGGTCGATGGAAGT (SEQ ID NO:81), TTCGGATTGCGGTTCGGTCGATGGAAG (SEQ ID NO:82), TTTCGGATTGCGGTTCGGTCGATGGAA (SEQ ID NO:83), TTTTCGGATTGCGGTTCGGTCGATGGA (SEQ ID NO:84), TTCGGATTGCGGTTCGGTCGATGGAAGT (SEQ ID NO:85), CGTAGGAGGGGTGAGGATTCGTTCGGG (SEQ ID NO:86), GAGCGTAGGGTCGGAGGGAGGTCGTAG (SEQ ID NO:87), ACGTAGGAGGGGTGAGGATTCGTTCGG (SEQ ID NO:88), CGTTGGGGTCGTTGTTTTTTGCGGGTT (SEQ ID NO:89), AGGAGGGGTGAGGATTCGTTCGGGTAC (SEQ ID NO:90) |

FIGURE 5

| | | |
|---|---|---|
| Target10 | chr1:2706076-2706092 | TTTTTTGCGTGGTGGGGTCGTTCG (SEQ ID NO:91), TTTTTGCGTGGTGGGGTCGTTCG (SEQ ID NO:92), TTTTGCGTGGTGGGGTCGTTCG (SEQ ID NO:93), TTTGCGTGGTGGGGTCGTTCG (SEQ ID NO:94), GCGGGAGGAGGTTCGTGGGATGTTGTA (SEQ ID NO:95), GTTGTTGTTGGTGGTGTTGCGGGAGGA (SEQ ID NO:96), GGTTGTTGTTGGTGGTGTTGCGGGAGG (SEQ ID NO:97), GGGTTGTTGTTGGTGGTGTTGCGGGAG (SEQ ID NO:98), TTGTTGGTGGTGTTGCGGGAGGAGGTT (SEQ ID NO:99) |
| Target11 | chr1:2706118-2706138 | TGGTGGGGTCGTTCGTTTTTGCGGTTT (SEQ ID NO:100), GTGGTGGGGTCGTTCGTTTTTGCGGTT (SEQ ID NO:101), TTGCGTGGTGGGGTCGTTCGTTTTTGC (SEQ ID NO:102), GGTGGGGTCGTTCGTTTTTGCGGTTTT (SEQ ID NO:103), TGGTGGGGTCGTTCGTTTTTGCGGTTTT (SEQ ID NO:104), GCGGGAGGAGGTTCGTGGGATGTTGTA (SEQ ID NO:105), GTTTGTAGGTTGCGGTTCGAGGAGGCG (SEQ ID NO:106), CGTTTGTAGGTTGCGGTTCGAGGAGGC (SEQ ID NO:107), TAGGTTGCGGTTCGAGGAGGCGTTGTT (SEQ ID NO:108), TTGTAGGTTGCGGTTCGAGGAGGCGTT (SEQ ID NO:109) |
| Target12 | chr1:2706146-2706174 | TGGTGGGGTCGTTCGTTTTTGCGGTTT (SEQ ID NO:110), GTGGTGGGGTCGTTCGTTTTTGCGGTT (SEQ ID NO:111), GGTTCGGCGCGTGGAGATCGTTGTAGT (SEQ ID NO:112), TTGCGTGGTGGGGTCGTTCGTTTTTGC (SEQ ID NO:113), GGTGGGGTCGTTCGTTTTTGCGGTTTT (SEQ ID NO:114), GCGGGAGGAGGTTCGTGGGATGTTGTA (SEQ ID NO:115), GTTTGTAGGTTGCGGTTCGAGGAGGCG (SEQ ID NO:116), CGTTTGTAGGTTGCGGTTCGAGGAGGC (SEQ ID NO:117), TAGGTTGCGGTTCGAGGAGGCGTTGTT (SEQ ID NO:118), TTGTAGGTTGCGGTTCGAGGAGGCGTT (SEQ ID NO:119) |
| Target13 | chr1:2706213-2706262 | GGTTCGGCGCGTGGAGATCGTTGTAGT (SEQ ID NO:120), GGTTCGGCGCGTGGAGATCGTTGTAGTA (SEQ ID NO:121), GTTCGGCGCGTGGAGATCGTTGTAGTA (SEQ ID NO:122), CGGTTCGGCGCGTGGAGATCGTTGTAG (SEQ ID NO:123), GGTTCGGCGCGTGGAGATCGTTGTAG (SEQ ID NO:124), ACGGTAGTGGAGTAGGGGGCGTCGTAT (SEQ ID NO:125), TAGACGGTAGTGGAGTAGGGGGCGTCG (SEQ ID NO:126), GTTTGTAGGTTGCGGTTCGAGGAGGCG (SEQ ID NO:127), CGTTTGTAGGTTGCGGTTCGAGGAGGC (SEQ ID NO:128), TAGGTTGCGGTTCGAGGAGGCGTTGTT (SEQ ID NO:129) |
| Target14 | chr1:2706277-2706336 | TTCGGGTCGTAGTTTGTAGGCGGTGAT (SEQ ID NO:130), TCGGGTCGTAGTTTGTAGGCGGTGATA (SEQ ID NO:131), TCGGGTCGTAGTTTGTAGGCGGTGAT (SEQ ID NO:132), CGGGTCGTAGTTTGTAGGCGGTGATAT (SEQ ID NO:133), TCGGGTCGTAGTTTGTAGGCGGTGATAT (SEQ ID NO:134), ACGGTAGTGGAGTAGGGGGCGTCGTAT (SEQ ID NO:135), TAGACGGTAGTGGAGTAGGGGGCGTCG (SEQ ID NO:136), GACGGTAGTGGAGTAGGGGGCGTCGTA (SEQ ID NO:137), CGGTAGTGGAGTAGGGGGCGTCGTATT (SEQ ID NO:138), ACGGTAGTGGAGTAGGGGGCGTCGTA (SEQ ID NO:139) |
| Target15 | chr1:2706355-2706422 | TTTCGGGTCGTAGTTTGTAGGCGGTGA (SEQ ID NO:140), GCGTATATAGTTTTTCGGGTGCGGCGT (SEQ ID NO:141), TTCGGGTCGTAGTTTGTAGGCGGTGAT (SEQ ID NO:142), AGTTTTTCGGGTGCGGCGTTTTTTGTT (SEQ ID NO:143), TTTTCGGGTCGTAGTTTGTAGGCGGTG (SEQ ID NO:144), GGATTTTGCGGGGGATCGTGTAGGGGA (SEQ ID NO:145), AGGATTTTGCGGGGGATCGTGTAGGGG (SEQ ID NO:146), GGATTTTGCGGGGGATCGTGTAGGGGAT (SEQ ID NO:147), TGAGGATTTTGCGGGGGATCGTGTAGGG (SEQ ID NO:148), GAGGATTTTGCGGGGGATCGTGTAGGG (SEQ ID NO:149) |
| Target16 | chr1:2706423-2706476 | GCGTAGAGTTAGGAGAGGTGCGCGGTT (SEQ ID NO:150), GGAGAGGTGCGCGGTTTTTTGTACGGT (SEQ ID NO:151), AGGAGAGGTGCGCGGTTTTTTGTACGG (SEQ ID NO:152), GCGTAGAGTTAGGAGAGGTGCGCGGT (SEQ ID NO:153), GCGTAGAGTTAGGAGAGGTGCGCGGTTT (SEQ ID NO:154), GGATTTTGCGGGGGATCGTGTAGGGGA (SEQ ID NO:155), AGGATTTTGCGGGGGATCGTGTAGGGG (SEQ ID NO:156), GTGTTTGTTGTTGGTAGGGGACGCGGC (SEQ ID NO:157), AGTGTTTGTTGTTGGTAGGGGACGCGC (SEQ ID NO:158), GGATTTTGCGGGGGATCGTGTAGGGGAT (SEQ ID NO:159) |
| Target17 | chr1:2706491-2706525 | CGTGCGGGTCGTAGTAGGCGTTCGTAT (SEQ ID NO:160), GCGTAGAGTTAGGAGAGGTGCGCGGTT (SEQ ID NO:161), GGAGAGGTGCGCGGTTTTTTGTACGGT (SEQ ID NO:162), TTCGTAGGGTTTTTAGGGCGTGCGGGT (SEQ ID NO:163), TAGGGTTTTTAGGGCGTGCGGGTCGTA (SEQ ID NO:164), GTGTTTGTTGTTGGTAGGGGACGCGGC (SEQ ID NO:165), AGTGTTTGTTGTTGGTAGGGGACGCGG (SEQ ID NO:166), TGTTTGTTGTTGGTAGGGGACGCGGC (SEQ ID NO:167), TTCGGGTTATGTGCGAGCGTTTGTTGC (SEQ ID NO:168), CGAGTGTTTGTTGTTGGTAGGGGACGCG (SEQ ID NO:169) |
| Target18 | chr1:2706532-2706583 | CGTGCGGGTCGTAGTAGGCGTTCGTAT (SEQ ID NO:170), GCGTAGAGTTAGGAGAGGTGCGCGGTT (SEQ ID NO:171), GGTATTCGGCGAGGCGGGTTTTTAGCG (SEQ ID NO:172), GGCGTTCGTATATGGTTCGGGCGTTCG (SEQ ID NO:173), GGAGAGGTGCGCGGTTTTTTGTACGGT (SEQ ID NO:174), GTGTTTGTTGTTGGTAGGGGACGCGGT (SEQ ID NO:175), AGTGTTTGTTGTTGGTAGGGGACGCGG (SEQ ID NO:176), CGAGTGTTTGTTGTTGGTAGGGGACGCG (SEQ ID NO:177), AGTGTTTGTTGTTGGTAGGGGACGCGGT (SEQ ID NO:178), GAGTGTTTGTTGTTGGTAGGGGACGCGG (SEQ ID NO:179) |
| Target19 | chr1:2706587-2706602 | CGTGCGGGTCGTAGTAGGCGTTCGTAT (SEQ ID NO:180), GGTATTCGGCGAGGCGGGTTTTTAGCG (SEQ ID NO:181), GGCGTTCGTATATGGTTCGGGCGTTCG (SEQ ID NO:182), TAGGGTTTTTAGGGCGTGCGGGTCGTA (SEQ ID NO:183), TTTTAGGGCGTGCGGGTCGTAGTAGGC (SEQ ID NO:184), CGAGTTGTTGGTTTCGGTAATTCGCGCG (SEQ ID NO:185), |

FIGURE 5 CONTINUED

|  |  |  |
|---|---|---|
|  |  | AGTTGTTGGTTTCGGTAATTCGCGCGT (SEQ ID NO:186), CGAGTTGTTGGTTTCGGTAATTCGCGCGT (SEQ ID NO:187), GAGTTGTTGGTTTCGGTAATTCGCGCGT (SEQ ID NO:188), GAGTTGTTGGTTTCGGTAATTCGCGCG (SEQ ID NO:189) |
| Target20 | chr1:2706608-2706621 | CGTGCGGGTCGTAGTAGGCGTTCGTAT (SEQ ID NO:190), GGTATTCGGCGAGGCGGGTTTTTAGCG (SEQ ID NO:191), GGCGTTCGTATATGGTTCGGGCGTTCG (SEQ ID NO:192), GCGTTCGTATATGGTTCGGGCGTTCGT (SEQ ID NO:193), AGGTATTCGGCGAGGCGGGTTTTTAGC (SEQ ID NO:194), CGAGTTGTTGGTTTCGGTAATTCGCGCG (SEQ ID NO:195), AGTTGTTGGTTTCGGTAATTCGCGCGT (SEQ ID NO:196), CGAGTTGTTGGTTTCGGTAATTCGCGCGT (SEQ ID NO:197), GAGTTGTTGGTTTCGGTAATTCGCGCGT (SEQ ID NO:198), GAGTTGTTGGTTTCGGTAATTCGCGCG (SEQ ID NO:199) |
| Target21 | chr1:2706629-2706667 | GGTATTCGGCGAGGCGGGTTTTTAGCG (SEQ ID NO:200), GGCGTTCGTATATGGTTCGGGCGTTCG (SEQ ID NO:201), GCGTTCGTATATGGTTCGGGCGTTCGT (SEQ ID NO:202), AGGTATTCGGCGAGGCGGGTTTTTAGC (SEQ ID NO:203), AGGCGTTCGTATATGGTTCGGGCGTTC (SEQ ID NO:204), GCGTTCGGGTTTAGGCGTAGGAGGTCG (SEQ ID NO:205), GCGTTCGGGTTTAGGCGTAGGAGGTC (SEQ ID NO:206), CGTTCGGGTTTAGGCGTAGGAGGTCG (SEQ ID NO:207), TCGTTCGTTTTTAGGAAGTCGTGCGGA (SEQ ID NO:208), GCGTTCGGGTTTAGGCGTAGGAGGT (SEQ ID NO:209) |
| Target22 | chr1:2706668-2706691 | GGTATTCGGCGAGGCGGGTTTTTAGCG (SEQ ID NO:210), AGGTATTCGGCGAGGCGGGTTTTTAGC (SEQ ID NO:211), AGTAGTAGGTATTCGGCGAGGCGGGTT (SEQ ID NO:212), TCGCGGAGTTTAGGGTGGTTTCGTACG (SEQ ID NO:213), AGTAGGTATTCGGCGAGGCGGGTTTTT (SEQ ID NO:214), TTGGGGCGCGGAGGTAGTTTTAGGTCG (SEQ ID NO:215), GCGTTCGGGTTTAGGCGTAGGAGGTCG (SEQ ID NO:216), GGGGCGCGGAGGTAGTTTTAGGTCGTG (SEQ ID NO:217), TTTGGGGCGCGGAGGTAGTTTTAGGTC (SEQ ID NO:218), TGGGGCGCGGAGGTAGTTTTAGGTCG (SEQ ID NO:219) |
| Target23 | chr1:2706721-2706734 | CGCGGAGTTTAGGGTGGTTTCGTACGG (SEQ ID NO:220), TCGCGGAGTTTAGGGTGGTTTCGTACGG (SEQ ID NO:221), GCGGAGTTTAGGGTGGTTTCGTACGGT (SEQ ID NO:222), CGCGGAGTTTAGGGTGGTTTCGTACGGT (SEQ ID NO:223), TCGCGGAGTTTAGGGTGGTTTCGTACG (SEQ ID NO:224), CGTTCGGGTTTAGGCGTAGGAGGTCGT (SEQ ID NO:225), GGGCGCGGAGGTAGTTTTAGGTCGTGT (SEQ ID NO:226), TTGGGGCGCGGAGGTAGTTTTAGGTCG (SEQ ID NO:227), GCGTTCGGGTTTAGGCGTAGGAGGTCG (SEQ ID NO:228), GGGGCGCGGAGGTAGTTTTAGGTCGTG (SEQ ID NO:229) |
| Target24 | chr1:6125159-6125201 | GGCGTTGTAGTTAGGGTGGATTTTGCGGG (SEQ ID NO:230), AGGGTGGATTTTGCGGGTTGGATGTTT (SEQ ID NO:231), GGGTGGATTTTGCGGGTTGGATGTTTG (SEQ ID NO:232), GCGTTGTAGTTAGGGTGGATTTTGCGGG (SEQ ID NO:233), GGCGTTGTAGTTAGGGTGGATTTTGCGG (SEQ ID NO:234) |
| Target25 | chr1:6125229-6125498 | GGTGTCGTTGGGTATGCGTTAGGGAGGT (SEQ ID NO:235), GGTGTCGTTGGGTATGCGTTAGGGAGG (SEQ ID NO:236), AGGTGTCGTTGGGTATGCGTTAGGGAGG (SEQ ID NO:237), GTGTCGTTGGGTATGCGTTAGGGAGGT (SEQ ID NO:238), AGGTGTCGTTGGGTATGCGTTAGGGAG (SEQ ID NO:239), AGGGTGGATTTTGCGGGTTGGATGTTT (SEQ ID NO:240), GGATTGGTTTGAGGTTTGGGTAGGCGT (SEQ ID NO:241), GGGTGGATTTTGCGGGTTGGATGTTTG (SEQ ID NO:242), AGGATTGGTTTGAGGTTTGGGTAGGCGT (SEQ ID NO:243), TTGGTTTGAGGTTTGGGTAGGCGTTGT (SEQ ID NO:244) |
| Target26 | chr1:7728694-7728716 | CGTTTGGTTGCGTTGAATTGGTGGTGACG (SEQ ID NO:245), TTTGGTTGCGTTGAATTGGTGGTGACG (SEQ ID NO:246), CGTTTGGTTGCGTTGAATTGGTGGTGA (SEQ ID NO:247), TCGTTTGGTTGCGTTGAATTGGTGGTG (SEQ ID NO:248), TCGTTTGGTTGCGTTGAATTGGTGGTGA (SEQ ID NO:249) |
| Target27 | chr1:7728839-7729031 | TGGATGTTGAGTTGTTTTGCGGCGGTT (SEQ ID NO:250), ATGGATGTTGAGTTGTTTTGCGGCGGT (SEQ ID NO:251), GGATGGATGTTGAGTTGTTTTGCGGCGG (SEQ ID NO:252), TGGATGGATGTTGAGTTGTTTTGCGGCGG (SEQ ID NO:253), GATGGATGTTGAGTTGTTTTGCGGCGGT (SEQ ID NO:254), GGGTATTGGGGGGGAGTGGGTGTTTGGT (SEQ ID NO:255), GTTTCGTGGAAGTGGCGGGGTATTGGG (SEQ ID NO:256), TGGGGGGAGTGGGTGTTTGGTTGAGAA (SEQ ID NO:257), TTGGGGGGAGTGGGTGTTTGGTTGAGA (SEQ ID NO:258), GGGGTATTGGGGGGGAGTGGGTGTTTGG (SEQ ID NO:259) |
| Target28 | chr1:8137417-8137568 | CGTGGTTGGGTTGTAGGGTCGTAGGGT (SEQ ID NO:260), ACGTGGTTGGGTTGTAGGGTCGTAGGG (SEQ ID NO:261), TGGGTTGTAGGGTCGTAGGGTTGTGGT (SEQ ID NO:262), GACGTGGTTGGGTTGTAGGGTCGTAGGG (SEQ ID NO:263), CGTGGTTGGGTTGTAGGGTCGTAGGGTT (SEQ ID NO:264) |
| Target29 | chr1:9377821-9377886 | GGGATTATAGGCGTGAGTTATCGTGTTTGGT (SEQ ID NO:265), TGGGATTATAGGCGTGAGTTATCGTGTTTGG (SEQ ID NO:266), GTGTTGGGATTATAGGCGTGAGTTATCGTGT (SEQ ID NO:267), TGGGATTATAGGCGTGAGTTATCGTGTTTGGT (SEQ ID NO:268), AGTGTTGGGATTATAGGCGTGAGTTATCGTG (SEQ ID NO:269), CGGAGCGAATGGTGTGTTAAGGAAGTAAGA (SEQ ID NO:270), CGGAGCGAATGGTGTGTTAAGGAAGTAAGAA (SEQ ID NO:271), CGGAGCGAATGGTGTGTTAAGGAAGTAAGAAA (SEQ ID NO:272), |

FIGURE 5 CONTINUED

CGGAGCGAATGGTGTGTTAAGGAAGTAAGAAAT (SEQ ID NO:273),
CGGAGCGAATGGTGTGTTAAGGAAGTAAGAAATT (SEQ ID NO:274)

| | | |
|---|---|---|
| Target30 | chr1:9377977-9378177 | AGATTGGCGGGTCGTTTTGGTGGGAGT (SEQ ID NO:275), GATTGGCGGGTCGTTTTGGTGGGAGTT (SEQ ID NO:276), TGGCGGGTCGTTTTGGTGGGAGTTTTT (SEQ ID NO:277), TTGGCGGGTCGTTTTGGTGGGAGTTTT (SEQ ID NO:278), ATTGGCGGGTCGTTTTGGTGGGAGTTT (SEQ ID NO:279), TGTATTCGTGGTGGAGGATTTGGGGGT (SEQ ID NO:280), CGGTTGTATTCGTGGTGGAGGATTTGGGG (SEQ ID NO:281), GGTTGTATTCGTGGTGGAGGATTTGGGGG (SEQ ID NO:282), GGTTGTATTCGTGGTGGAGGATTTGGGGGT (SEQ ID NO:283), TTGTATTCGTGGTGGAGGATTTGGGGGT (SEQ ID NO:284) |
| Target31 | chr1:9378325-9378377 | GGGAAGGTGGGTGTGGGTATTCGGAGG (SEQ ID NO:285), GGGGAAGGTGGGTGTGGGTATTCGGAG (SEQ ID NO:286), GTGGGGGAAGGTGGGTGTGGGTATTCG (SEQ ID NO:287), AGTGGGGGAAGGTGGGTGTGGGTATTC (SEQ ID NO:288), GGAAGGTGGGTGTGGGTATTCGGAGGT (SEQ ID NO:289), AGTAAGGGAGGCGTGGGTGGGTAGAGA (SEQ ID NO:290), AAGGGAGGCGTGGGTGGGTAGAGATTT (SEQ ID NO:291), GCGTGGGTGGGTAGAGATTTAAGCGGG (SEQ ID NO:292), GGCGTGGGTGGGTAGAGATTTAAGCGG (SEQ ID NO:293), GTAAGGGAGGCGTGGGTGGGTAGAGAT (SEQ ID NO:294) |
| Target32 | chr1:9378451-9378489 | TGCGGATAGATAGGGAATGGGGATAGCGT (SEQ ID NO:295), GCGGATAGATAGGGAATGGGGATAGCGT (SEQ ID NO:296), TGCGGATAGATAGGGAATGGGGATAGCG (SEQ ID NO:297), GCGGATAGATAGGGAATGGGGATAGCG (SEQ ID NO:298), GCGGATAGATAGGGAATGGGGATAGCGTT (SEQ ID NO:299), TGGGAGTGGAGGAAGGAGGGTGGTTTT (SEQ ID NO:300), TTGGGAGTGGAGGAAGGAGGGTGGTTT (SEQ ID NO:301), TTTGGGAGTGGAGGAAGGAGGGTGGTT (SEQ ID NO:302), ATTTGGGAGTGGAGGAAGGAGGGTGGT (SEQ ID NO:303), GGAATATGGTAGGGGGGTTTCGTGGGC (SEQ ID NO:304) |
| Target33 | chr1:15672463-15672644 | TGATTTAGATGTGTGAAAATAGGGGCGTTCGT (SEQ ID NO:305), ATGATTTAGATGTGTGAAAATAGGGGCGTTCGT (SEQ ID NO:306), TGATTTAGATGTGTGAAAATAGGGGCGTTCGTA (SEQ ID NO:307), GATGATTTAGATGTGTGAAAATAGGGGCGTTCG (SEQ ID NO:308), GATGATTTAGATGTGTGAAAATAGGGGCGTTCGT (SEQ ID NO:309), ATAAGGGCGTTTGGGTTCGGGGAGGAG (SEQ ID NO:310), TATTTTGTGGGAGCGTAGGGGAGGGCG (SEQ ID NO:311), AGCGTAGGGGAGGGCGGAGGATTGATA (SEQ ID NO:312), GGCGTTTGGGTTCGGGGAGGAGTAGAT (SEQ ID NO:313), AATAAGGGCGTTTGGGTTCGGGGAGGA (SEQ ID NO:314) |
| Target34 | chr1:29586062-29586108 | GCGTCGTTTTAGTGTATGGTCGCGGGT (SEQ ID NO:315), GCGTCGTTTTAGTGTATGGTCGCGGGTA (SEQ ID NO:316), CGGGAGCGGTGATTTTGGTTGGGGGG (SEQ ID NO:317), GGGAGCGGTGATTTTGGTTGGGGGC (SEQ ID NO:318), GGAGCGGTGATTTTGGTTGGGGGCG (SEQ ID NO:319), GCGTAGAGTAGAGTTAGGGGAGGGTCGGG (SEQ ID NO:320), AGAGTAGAGTTAGGGGAGGGTCGGGAC (SEQ ID NO:321), GCGTAGAGTAGAGTTAGGGGAGGGTCGG (SEQ ID NO:322), AGCGTAGAGTAGAGTTAGGGGAGGGTCGG (SEQ ID NO:323), CGTAGAGTAGAGTTAGGGGAGGGTCGG (SEQ ID NO:324) |
| Target35 | chr1:29586281-29586300 | TTATGTTCGCGCGGTGTAGTAGGGACG (SEQ ID NO:325), TTTATGTTCGCGCGGTGTAGTAGGGACG (SEQ ID NO:326), TATGTTCGCGCGGTGTAGTAGGGACG (SEQ ID NO:327), TTTATGTTCGCGCGGTGTAGTAGGGAC (SEQ ID NO:328), ATGTTCGCGCGGTGTAGTAGGGACG (SEQ ID NO:329), GAGAGTGAGGGGGTTAGGGGCGTTTCG (SEQ ID NO:330), AGGGAAGAGAGTGAGGGGGTTAGGGGC (SEQ ID NO:331), AGAGAGTGAGGGGGTTAGGGGCGTTTC (SEQ ID NO:332), GAAGAGAGTGAGGGGGTTAGGGGCGTT (SEQ ID NO:333), GGAAGAGAGTGAGGGGGTTAGGGGCGT (SEQ ID NO:334) |
| Target36 | chr1:29586324-29586346 | GTTCGCGCGGTGTAGTAGGGACGGTTA (SEQ ID NO:335), TATGTTCGCGCGGTGTAGTAGGGACGG (SEQ ID NO:336), TCGCGCGGTGTAGTAGGGACGGTTAAA (SEQ ID NO:337), TTCGCGCGGTGTAGTAGGGACGGTTAA (SEQ ID NO:338), TTATGTTCGCGCGGTGTAGTAGGGACGG (SEQ ID NO:339), GAGAGTGAGGGGGTTAGGGGCGTTTCG (SEQ ID NO:340), AGCGTCGGTGGTTGATGTGTCGTACGT (SEQ ID NO:341), AGGAAGCGTCGGTGGTTGATGTGTCGT (SEQ ID NO:342), AGGGAAGAGAGTGAGGGGGTTAGGGGC (SEQ ID NO:343), AGCGGGAAAGTGGTTAGGAAGCGTCGG (SEQ ID NO:344) |
| Target37 | chr1:29586382-29586522 | GTTCGCGCGGTGTAGTAGGGACGGTTA (SEQ ID NO:345), TATGTTCGCGCGGTGTAGTAGGGACGG (SEQ ID NO:346), CGTTGTGTGTTTTAGGTTTCGCGCGGC (SEQ ID NO:347), TCGCGCGGTGTAGTAGGGACGGTTAAA (SEQ ID NO:348), TTCGCGCGGTGTAGTAGGGACGGTTAA (SEQ ID NO:349), GCGGTATAGGTTTTGTTCGGCGCGGTT (SEQ ID NO:350), AGCGTCGGTGGTTGATGTGTCGTACGT (SEQ ID NO:351), AGGAAGCGTCGGTGGTTGATGTGTCGT (SEQ ID NO:352), AGCGGGAAAGTGGTTAGGAAGCGTCGG (SEQ ID NO:353), GCGTCGGTGGTTGATGTGTCGTACGTT (SEQ ID NO:354) |
| Target38 | chr1:29586539-29586574 | CGTTGTGTGTTTTAGGTTTCGCGCGGC (SEQ ID NO:355), TCGTTGTGTGTTTTAGGTTTCGCGCGG (SEQ ID NO:356), TCGTTGTGTGTTTTAGGTTTCGCGCGGC (SEQ ID NO:357), ATCGTTGTGTGTTTTAGGTTTCGCGCGG (SEQ ID NO:358), ATCGTTGTGTGTTTTAGGTTTCGCGCGGC (SEQ ID NO:359), CGAGGGTGAGGTTTCGGCGTTTTTC (SEQ ID NO:360), CGAGGGTGAGGTTTCGGCGTTTTT (SEQ ID NO:361), CGAGGGTGAGGTTTCGGCGTTTT (SEQ ID |

FIGURE 5 CONTINUED

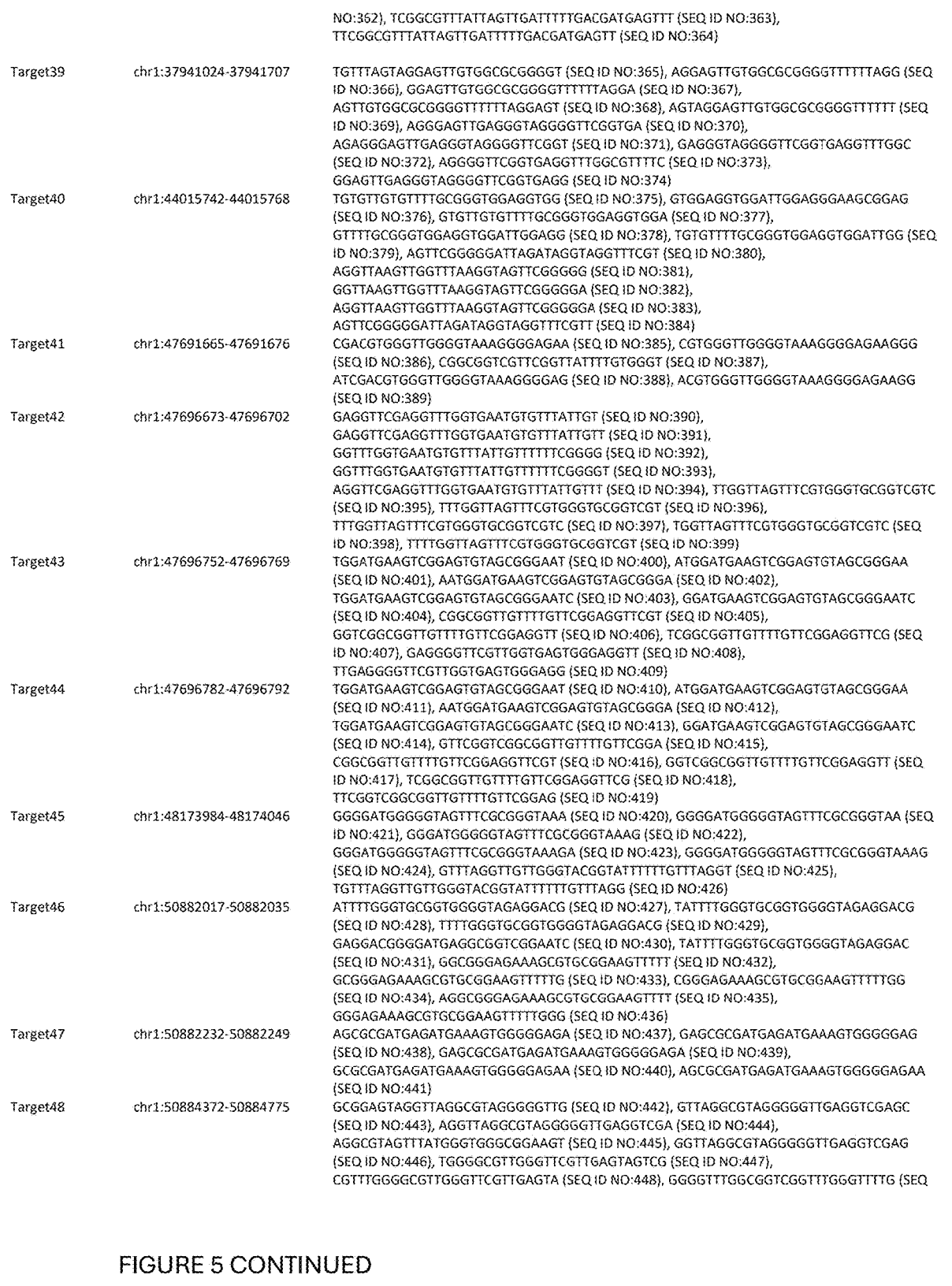

NO:362), TCGGCGTTTATTAGTTGATTTTTGACGATGAGTTT (SEQ ID NO:363),
TTCGGCGTTTATTAGTTGATTTTTGACGATGAGTT (SEQ ID NO:364)

| Target39 | chr1:37941024-37941707 | TGTTTAGTAGGAGTTGTGGCGCGGGGT (SEQ ID NO:365), AGGAGTTGTGGCGCGGGGGTTTTTTAGG (SEQ ID NO:366), GGAGTTGTGGCGCGGGGGTTTTTTAGGA (SEQ ID NO:367), AGTTGTGGCGCGGGGGTTTTTTAGGAGT (SEQ ID NO:368), AGTAGGAGTTGTGGCGCGGGGGTTTTTT (SEQ ID NO:369), AGGGGAGTTGAGGGTAGGGGTTCGGTGA (SEQ ID NO:370), AGAGGGAGTTGAGGGTAGGGGTTCGGT (SEQ ID NO:371), GAGGGTAGGGGTTCGGTGAGGTTTGGC (SEQ ID NO:372), AGGGGTTCGGTGAGGTTTGGCGTTTC (SEQ ID NO:373), GGAGTTGAGGGTAGGGGTTCGGTGAGG (SEQ ID NO:374) |
| Target40 | chr1:44015742-44015768 | TGTGTTGTGTTTTGCGGGTGGAGGTGG (SEQ ID NO:375), GTGGAGGTGGATTGGAGGGAAGCGGAG (SEQ ID NO:376), GTGTTGTGTTTTGCGGGTGGAGGTGGA (SEQ ID NO:377), GTTTTGCGGGTGGAGGTGGATTGGAGG (SEQ ID NO:378), TGTGTTTTGCGGGTGGAGGTGGATTGG (SEQ ID NO:379), AGTTCGGGGGGATTAGATAGGTAGGTTTCGT (SEQ ID NO:380), AGGTTAAGTTGGTTTAAGGTAGTTCGGGGG (SEQ ID NO:381), GGTTAAGTTGGTTTAAGGTAGTTCGGGGGA (SEQ ID NO:382), AGGTTAAGTTGGTTTAAGGTAGTTCGGGGGA (SEQ ID NO:383), AGTTCGGGGGGATTAGATAGGTAGGTTTCGTT (SEQ ID NO:384) |
| Target41 | chr1:47691665-47691676 | CGACGTGGGTTGGGGTAAAGGGGAGAA (SEQ ID NO:385), CGTGGGTTGGGGTAAAGGGGAGAAGGG (SEQ ID NO:386), CGGCGGTCGTTCGGTTATTTTGTGGGT (SEQ ID NO:387), ATCGACGTGGGTTGGGGTAAAGGGGAG (SEQ ID NO:388), ACGTGGGTTGGGGTAAAGGGGAGAAGG (SEQ ID NO:389) |
| Target42 | chr1:47696673-47696702 | GAGGTTCGAGGTTTGGTGAATGTGTTTATTGT (SEQ ID NO:390), GAGGTTCGAGGTTTGGTGAATGTGTTTATTGTT (SEQ ID NO:391), GGTTTGGTGAATGTGTTTATTGTTTTTTCGGGG (SEQ ID NO:392), GGTTTGGTGAATGTGTTTATTGTTTTTTCGGGGT (SEQ ID NO:393), AGGTTCGAGGTTTGGTGAATGTGTTTATTGTTT (SEQ ID NO:394), TTGGTTAGTTTCGTGGGTGCGGTCGTC (SEQ ID NO:395), TTTGGTTAGTTTCGTGGGTGCGGTCGT (SEQ ID NO:396), TTTGGTTAGTTTCGTGGGTGCGGTCGTC (SEQ ID NO:397), TGGTTAGTTTCGTGGGTGCGGTCGTC (SEQ ID NO:398), TTTTGGTTAGTTTCGTGGGTGCGGTCGT (SEQ ID NO:399) |
| Target43 | chr1:47696752-47696769 | TGGATGAAGTCGGAGTGTAGCGGGAAT (SEQ ID NO:400), ATGGATGAAGTCGGAGTGTAGCGGGAA (SEQ ID NO:401), AATGGATGAAGTCGGAGTGTAGCGGGA (SEQ ID NO:402), TGGATGAAGTCGGAGTGTAGCGGGAATC (SEQ ID NO:403), GGATGAAGTCGGAGTGTAGCGGGAATC (SEQ ID NO:404), CGGCGGTTGTTTTGTTCGGAGGTTCGT (SEQ ID NO:405), GGTCGGCGGTTGTTTTGTTCGGAGGTT (SEQ ID NO:406), TCGGCGGTTGTTTTGTTCGGAGGTTCG (SEQ ID NO:407), GAGGGGTTCGTTGGTGAGTGGGAGGTT (SEQ ID NO:408), TTGAGGGGTTCGTTGGTGAGTGGGAGG (SEQ ID NO:409) |
| Target44 | chr1:47696782-47696792 | TGGATGAAGTCGGAGTGTAGCGGGAAT (SEQ ID NO:410), ATGGATGAAGTCGGAGTGTAGCGGGAA (SEQ ID NO:411), AATGGATGAAGTCGGAGTGTAGCGGGA (SEQ ID NO:412), TGGATGAAGTCGGAGTGTAGCGGGAATC (SEQ ID NO:413), GTTCGGTCGGCGGTTGTTTTGTTCGGA (SEQ ID NO:414), CGGCGGTTGTTTTGTTCGGAGGTTCGT (SEQ ID NO:415), GGTCGGCGGTTGTTTTGTTCGGAGGTT (SEQ ID NO:416), TCGGCGGTTGTTTTGTTCGGAGGTTCG (SEQ ID NO:417), TCGGCGGTTGTTTTGTTCGGAGGTTCG (SEQ ID NO:418), TTCGGTCGGCGGTTGTTTTGTTCGGAG (SEQ ID NO:419) |
| Target45 | chr1:48173984-48174046 | GGGGATGGGGGTAGTTTCGCGGGTAAA (SEQ ID NO:420), GGGGATGGGGGTAGTTTCGCGGGTAA (SEQ ID NO:421), GGGGATGGGGGTAGTTTCGCGGGTAAAG (SEQ ID NO:422), GGGGATGGGGGTAGTTTCGCGGGTAAAGA (SEQ ID NO:423), GGGGATGGGGGTAGTTTCGCGGGTAAAG (SEQ ID NO:424), GTTTAGGTTGTTGGGTACGGTATTTTTTGTTTAGGT (SEQ ID NO:425), TGTTTAGGTTGTTGGGTACGGTATTTTTTGTTAGG (SEQ ID NO:426) |
| Target46 | chr1:50882017-50882035 | ATTTTGGGTGCGGTGGGGTAGAGGACG (SEQ ID NO:427), TATTTTGGGTGCGGTGGGGTAGAGGACG (SEQ ID NO:428), TTTTGGGTGCGGTGGGGTAGAGGACG (SEQ ID NO:429), GAGGACGCGGGGATGAGGCGGTCGGAATC (SEQ ID NO:430), TATTTTGGGTGCGGTGGGGTAGAGGAC (SEQ ID NO:431), GGCGGGAGAAAGCGTGCGGAAGTTTTT (SEQ ID NO:432), GCGGGAGAAAGCGTGCGGAAGTTTTTG (SEQ ID NO:433), CGGGAGAAAGCGTGCGGAAGTTTTTGG (SEQ ID NO:434), AGGCGGGAGAAAGCGTGCGGAAGTTTT (SEQ ID NO:435), GGGAGAAAGCGTGCGGAAGTTTTTGGG (SEQ ID NO:436) |
| Target47 | chr1:50882232-50882249 | AGCGCGATGAGATGAAAGTGGGGGAG (SEQ ID NO:437), GAGCGCGATGAGATGAAAGTGGGGGAG (SEQ ID NO:438), GAGCGCGATGAGATGAAAGTGGGGGAGA (SEQ ID NO:439), GCGCGATGAGATGAAAGTGGGGGAGAA (SEQ ID NO:440), AGCGCGATGAGATGAAAGTGGGGGAGAA (SEQ ID NO:441) |
| Target48 | chr1:50884372-50884775 | GCGGAGTAGGTTAGGCGTAGGGGGTTG (SEQ ID NO:442), GTTAGGCGTAGGGGGTTGAGGTCGAGC (SEQ ID NO:443), AGGTTAGGCGTAGGGGGTTGAGGTCGA (SEQ ID NO:444), AGGCGTAGTTTATGGGTGGGCGGAAGT (SEQ ID NO:445), GGTTAGGCGTAGGGGGTTGAGGTCGAG (SEQ ID NO:446), TGGGGCGTTGGGTTCGTTGAGTAGTCG (SEQ ID NO:447), CGTTTGGGGCGTTGGGTTCGTTGAGTA (SEQ ID NO:448), GGGGTTTGGCGGTCGGTTTGGGTTTTG (SEQ |

FIGURE 5 CONTINUED

ID NO:449), GGGCGTTGGGTTCGTTGAGTAGTCGTT (SEQ ID NO:450),
CGTTTGGGGCGTTGGGTTCGTTGAGT (SEQ ID NO:451)

Target49     chr1:50884780-50884810     CGGGTTTCGTTTGTAGCGGCGTAGGTA (SEQ ID NO:452), GCGTCGGTTAGTAAGGGTTTGTGGTGCG
(SEQ ID NO:453), TAGTAAGGGTTTGTGGTGCGGAGGTGC (SEQ ID NO:454),
GGCGTCGGTTAGTAAGGGTTTGTGGTGC (SEQ ID NO:455), GGCGTTATGGCGTCGGTTAGTAAGGGT
(SEQ ID NO:456), TATTATCGTGGGGGTTTGGCGGTCGGT (SEQ ID NO:457),
GGTCGGTTTGGGTTTTGCGGCGTTTTT (SEQ ID NO:458), ATTATCGTGGGGGTTTGGCGGTCGGTT (SEQ
ID NO:459), TTATCGTGGGGGTTTGGCGGTCGGTTT (SEQ ID NO:460),
GGGGTTTGGCGGTCGGTTTGGGTTTTG (SEQ ID NO:461)

Target50     chr1:50884820-50884826     CGGGTTTCGTTTGTAGCGGCGTAGGTA (SEQ ID NO:462), GCGTCGGTTAGTAAGGGTTTGTGGTGCG
(SEQ ID NO:463), TAGTAAGGGTTTGTGGTGCGGAGGTGC (SEQ ID NO:464),
GGCGTCGGTTAGTAAGGGTTTGTGGTGC (SEQ ID NO:465), CGTCGGTTAGTAAGGGTTTGTGGTGCGG
(SEQ ID NO:466), TATTATCGTGGGGGTTTGGCGGTCGGT (SEQ ID NO:467),
GGTCGGTTTGGGTTTTGCGGCGTTTTT (SEQ ID NO:468), ATTATCGTGGGGGTTTGGCGGTCGGTT (SEQ
ID NO:469), TTATCGTGGGGGTTTGGCGGTCGGTTT (SEQ ID NO:470),
GGGGTTTGGCGGTCGGTTTGGGTTTTG (SEQ ID NO:471)

Target51     chr1:50884849-50884886     GCGGTTTTATTTGGGGGCGTCGTAGGG (SEQ ID NO:472), TTTGGGGGCGTCGTAGGGTTTAGGTCG (SEQ
ID NO:473), CGGTTTTATTTGGGGGCGTCGTAGGGT (SEQ ID NO:474),
TTGGGGGCGTCGTAGGGTTTAGGTCG (SEQ ID NO:475), ATTTGGGGGCGTCGTAGGGTTTAGGTCG (SEQ
ID NO:476), GGCGAGGCGTTTTGGAGTTGGTGTTGT (SEQ ID NO:477),
TATTATCGTGGGGGTTTGGCGGTCGGT (SEQ ID NO:478), GGTCGGTTTGGGTTTTGCGGCGTTTTT (SEQ
ID NO:479), ATTATCGTGGGGGTTTGGCGGTCGGTT (SEQ ID NO:480),
TTGGAGTTGGTGTTGTAGGGTTGCGGC (SEQ ID NO:481)

Target52     chr1:50884939-50884946     GGCGTCGTAGGGTTTAGGTCGGTCGTT (SEQ ID NO:482), GCGGTTTTATTTGGGGGCGTCGTAGGG (SEQ
ID NO:483), GGCGGTTTTATTTGGGGGCGTCGTAGG (SEQ ID NO:484),
TTTGGGGGCGTCGTAGGGTTTAGGTCG (SEQ ID NO:485), CGGTTTTATTTGGGGGCGTCGTAGGGT (SEQ
ID NO:486), TAGGGTTGGGCGGAGGTTCGGGTTTAC (SEQ ID NO:487),
TTGGGCGGAGGTTCGGGTTTACGGTAG (SEQ ID NO:488), GGCGAGGCGTTTTGGAGTTGGTGTTGT (SEQ
ID NO:489), GTTGGGCGGAGGTTCGGGTTTACGGTA (SEQ ID NO:490),
TTGGAGTTGGTGTTGTAGGGTTGCGGC (SEQ ID NO:491)

Target53     chr1:50885018-50885048     CGTCGGTGGTTTGGGAATACGCGTGTT (SEQ ID NO:492), TCGTCGGTGGTTTGGGAATACGCGTGT (SEQ
ID NO:493), TTCGTCGGTGGTTTGGGAATACGCGTG (SEQ ID NO:494),
TTTCGTCGGTGGTTTGGGAATACGCGT (SEQ ID NO:495), CGTTTCGTCGGTGGTTTGGGAATACGCG (SEQ
ID NO:496), TAGGGTTGGGCGGAGGTTCGGGTTTAC (SEQ ID NO:497),
TAAAGAAGAGGGTGAGGTCGCGTCGGC (SEQ ID NO:498), GTTGGGCGGAGGTTCGGGTTTACGGTA
(SEQ ID NO:499), GGAGGTTCGGGTTTACGGTAGCGGACG (SEQ ID NO:500),
CGGAGGTTCGGGTTTACGGTAGCGGAC (SEQ ID NO:501)

Target54     chr1:50885060-50885069     CGTCGGTGGTTTGGGAATACGCGTGTT (SEQ ID NO:502), TCGTCGGTGGTTTGGGAATACGCGTGT (SEQ
ID NO:503), TTCGTCGGTGGTTTGGGAATACGCGTG (SEQ ID NO:504),
TTTCGTCGGTGGTTTGGGAATACGCGT (SEQ ID NO:505), CGTTTCGTCGGTGGTTTGGGAATACGCG (SEQ
ID NO:506), TTTAGGTAGCGTTGGTTTTGGCGGCGG (SEQ ID NO:507),
TAAAGAAGAGGGTGAGGTCGCGTCGGT (SEQ ID NO:508), GTTTAGGTAGCGTTGGTTTTGGCGGCG (SEQ
ID NO:509), TGTTTAGGTAGCGTTGGTTTTGGCGGCG (SEQ ID NO:510),
TTAGGTAGCGTTGGTTTTGGCGGCGG (SEQ ID NO:511)

Target55     chr1:50885146-50885156     TCGGATTTAGAGTTTAGAGGGTTAGCGGAGT (SEQ ID NO:512),
CGGATTTAGAGTTTAGAGGGTTAGCGGAGTT (SEQ ID NO:513),
TCGGATTTAGAGTTTAGAGGGTTAGCGGAGTT (SEQ ID NO:514),
ATCGGATTTAGAGTTTAGAGGGTTAGCGGAGT (SEQ ID NO:515),
CGGATTTAGAGTTTAGAGGGTTAGCGGAGTTC (SEQ ID NO:516),
TTTAGGTAGCGTTGGTTTTGGCGGCGG (SEQ ID NO:517), AGGTGCGGTTCGGTTTAGGTTCGGAGA (SEQ
ID NO:518), AGAGGTGCGGTTCGGTTTAGGTTCGGA (SEQ ID NO:519),
GAGGTGCGGTTCGGTTTAGGTTCGGAG (SEQ ID NO:520), GTTTAGGTAGCGTTGGTTTTGGCGGCG (SEQ
ID NO:521)

Target56     chr1:50885205-50885295     TGAGTCGGGTCGTATTTTTGGGGACGA (SEQ ID NO:522), TTGAGTCGGGTCGTATTTTTGGGGACGA (SEQ
ID NO:523), TTGAGTCGGGTCGTATTTTTGGGGACGA (SEQ ID NO:524),
TTTTTTGGAGGTTCGAGTTAGGGGCGA (SEQ ID NO:525), TTTGAGTCGGGTCGTATTTTTGGGGACG (SEQ
ID NO:526), AGGTGCGGTTCGGTTTAGGTTCGGAGA (SEQ ID NO:527),
AGAGGTGCGGTTCGGTTTAGGTTCGGA (SEQ ID NO:528), GAGGTGCGGTTCGGTTTAGGTTCGGAG (SEQ
ID NO:529), AGAGGTGCGGTTCGGTTTAGGTTCGGAG (SEQ ID NO:530),
GAGGTGCGGTTCGGTTTAGGTTCGGAGA (SEQ ID NO:531)

Target57     chr1:50885302-50885309     TGAGTCGGGTCGTATTTTTGGGGACGA (SEQ ID NO:532), TTGAGTCGGGTCGTATTTTTGGGGACG (SEQ
ID NO:533), TTGAGTCGGGTCGTATTTTTGGGGACGA (SEQ ID NO:534),
TTTTTTGGAGGTTCGAGTTAGGGGCGA (SEQ ID NO:535), TTTGAGTCGGGTCGTATTTTTGGGGACG (SEQ
ID NO:536), ACGTTGTTGTAGGTAGGTCGTTCGGGT (SEQ ID NO:537),
AGGTAGGTCGTTCGGGTAGTTCGTTGT (SEQ ID NO:538), GACGTTGTTGTAGGTAGGTCGTTCGGGT (SEQ

FIGURE 5 CONTINUED

ID NO:539}, GACGTTGTTGTAGGTAGGTCGTTCGGG {SEQ ID NO:540},
GGTAGGTCGTTCGGGTAGTTCGTTGTC {SEQ ID NO:541}

| | | |
|---|---|---|
| Target58 | chr1:50885327-50885349 | TGAGTCGGGTCGTATTTTTGGGGACGA {SEQ ID NO:542}, TTGAGTCGGGTCGTATTTTTGGGGACG {SEQ ID NO:543}, TTGAGTCGGGTCGTATTTTTGGGGACGA {SEQ ID NO:544}, TTTGAGTCGGGTCGTATTTTTGGGGACG {SEQ ID NO:545}, TTTGAGTCGGGTCGTATTTTTGGGGACGA {SEQ ID NO:546}, ACGTTGTTGTAGGTAGGTCGTTCGGG {SEQ ID NO:547}, AGGTAGGTCGTTCGGGTAGTTCGTTGT {SEQ ID NO:548}, GACGTTGTTGTAGGTAGGTCGTTCGGGT {SEQ ID NO:549}, GACGTTGTTGTAGGTAGGTCGTTCGGG {SEQ ID NO:550}, GGTAGGTCGTTCGGGTAGTTCGTTGTC {SEQ ID NO:551} |
| Target59 | chr1:50885369-50885429 | TAGCGGGTTGTTCGGGCGGTTTGTTTG {SEQ ID NO:552}, GTAGCGGGTTGTTCGGGCGGTTTGTTT {SEQ ID NO:553}, GCGGGTTGTTCGGGCGGTTTGTTTGTA {SEQ ID NO:554}, GTAGCGGGTTGTTCGGGCGGTTTGTT {SEQ ID NO:555}, CGGGTTGTTCGGGCGGTTTGTTTGTAG {SEQ ID NO:556}, AGGGTTGTGGGGTTGAGGGAGAGGAAA {SEQ ID NO:557}, AAGGGTTGTGGGGTTGAGGGAGAGGAA {SEQ ID NO:558}, TAAGGGTTGTGGGGTTGAGGGAGAGGA {SEQ ID NO:559}, AAGGGTTGTGGGGTTGAGGGAGAGGAAA {SEQ ID NO:560}, GGGTTGTGGGGTTGAGGGAGAGGAAAT {SEQ ID NO:561} |
| Target60 | chr1:63785937-63785947 | GGGTCGTGGTAGAGGGAGGGTAGGAGG {SEQ ID NO:562}, GGTCGTGGTAGAGGGAGGGTAGGAGGT {SEQ ID NO:563}, TGGGTCGTGGTAGAGGGAGGGTAGGAG {SEQ ID NO:564}, AGGTTGGGTCGTGGTAGAGGGAGGGTA {SEQ ID NO:565}, TAGGTTGGGTCGTGGTAGAGGGAGGGT {SEQ ID NO:566}, GGTTTTGGTGGTTGGGTTCGCGTGGAT {SEQ ID NO:567}, TGCGCGTCGGAGGATGGTGGTTATAGG {SEQ ID NO:568}, AGTATGTGTGGATGCGCGTCGGAGGAT {SEQ ID NO:569}, TTGTCGCGGTTTTGGTGGTTGGGTTCG {SEQ ID NO:570}, CGCGTCGGAGGATGGTGGTTATAGGGT {SEQ ID NO:571} |
| Target61 | chr1:63786016-63786079 | CGGGTTTAGTTATTAAGGTCGCGGTAGGG {SEQ ID NO:572}, CGGGTTTAGTTATTAAGGTCGCGGTAGGGT {SEQ ID NO:573}, GGGTTTAGTTATTAAGGTCGCGGTAGGGT {SEQ ID NO:574}, CGGGTTTAGTTATTAAGGTCGCGCGGTAGGGTT {SEQ ID NO:575}, GGGTTTAGTTATTAAGGTCGCGGTAGGGTT {SEQ ID NO:576}, GGTTTTGGTGGTTGGGTTCGCGTGGAT {SEQ ID NO:577}, TTGTCGCGGTTTTGGTGGTTGGGTTCG {SEQ ID NO:578}, GGTTTTGTCGCGGTTTTGGTGGTTGGG {SEQ ID NO:579}, CGTTGGTTTTGTCGCGGTTTTGGTGGT {SEQ ID NO:580}, GGTTTTGGTGGTTGGGTTCGCGTGGA {SEQ ID NO:581} |
| Target62 | chr1:63795446-63795472 | TAGTTCGGCGATGAGTGGTTTTGCGGG {SEQ ID NO:582}, TTCGGCGATGAGTGGTTTTGCGGGGAT {SEQ ID NO:583}, TCGGCGATGAGTGGTTTTGCGGGGATC {SEQ ID NO:584}, AGTTCGGCGATGAGTGGTTTTGCGGG {SEQ ID NO:585}, ACGCGTCGGGCTCGGTGGAATTTAGTTT {SEQ ID NO:586}, CGAGGTAAGAAGGAAATGGGGTCGTCGG {SEQ ID NO:587}, CGAGGTAAGAAGGAAATGGGGTCGTCGGT {SEQ ID NO:588}, AGGTAAGAAGGAAATGGGGTCGTCGGT {SEQ ID NO:589}, GGGGAGTTTCGGGTTTGTAGTTGTCGT {SEQ ID NO:590}, CGAGGTAAGAAGGAAATGGGGTCGTCG {SEQ ID NO:591} |
| Target63 | chr1:68025026-68025081 | TAGGGACGGTTAGAGGGGCGTGTGAGA {SEQ ID NO:592}, TAGGTAGGGACGGTTAGAGGGGCGTGT {SEQ ID NO:593}, GGGACGGTTAGAGGGGCGTGTGAGATT {SEQ ID NO:594}, GTAGGGACGGTTAGAGGGGCGTGTGAG {SEQ ID NO:595}, AGGGACGGTTAGAGGGGCGTGTGAGAT {SEQ ID NO:596} |
| Target64 | chr1:68025115-68025305 | TTTGGTCGTTTTTGTTTGGGATATCGAGTTGAA {SEQ ID NO:597}, TTTTGGTCGTTTTTGTTTGGGATATCGAGTTGA {SEQ ID NO:598}, TTTTGGTCGTTTTTGTTTGGGATATCGAGTTGAA {SEQ ID NO:599}, TGGTCGTTTTTGTTTGGGATATCGAGTTGAATTT {SEQ ID NO:600}, TTGGTCGTTTTTGTTTGGGATATCGAGTTGAATT {SEQ ID NO:601}, TAGGGACGGTTAGAGGGGCGTGTGAGA {SEQ ID NO:602}, TAGGTAGGGACGGTTAGAGGGGCGTGT {SEQ ID NO:603}, GGGACGGTTAGAGGGGCGTGTGAGATT {SEQ ID NO:604}, GTAGGGACGGTTAGAGGGGCGTGTGAG {SEQ ID NO:605}, AGGGACGGTTAGAGGGGCGTGTGAGAT {SEQ ID NO:606} |
| Target65 | chr1:91183133-91183416 | GCGGTTGCGGTAATTCGAGGAGGAGGA {SEQ ID NO:607}, AGGAGGAGGAGGAAGAGGAGGACGACG {SEQ ID NO:608}, CGAGGAGGAGGAGGAAGAGGAGGACGA {SEQ ID NO:609}, TCGAGGAGGAGGAGGAAGAGGAGGACG {SEQ ID NO:610}, AGGCGGCGGGAAGTTACGTTAAAGTCG {SEQ ID NO:611}, GTTGTGGGTAGATTTCGGTAGCGGCGG {SEQ ID NO:612}, GGTTGTGGGTAGATTTCGGTAGCGGCG {SEQ ID NO:613}, AGGTTGTGGGTAGATTTCGGTAGCGGCG {SEQ ID NO:614}, AGGTTGTGGGTAGATTTCGGTAGCGGC {SEQ ID NO:615}, CGTTGTCGTTCGGTGTTAGGTTGTGGGT {SEQ ID NO:616} |
| Target66 | chr1:91183444-91183454 | GCGGTTGCGGTAATTCGAGGAGGAGGA {SEQ ID NO:617}, GGAGGAGGAGGAAGAGGAGGACGACGA {SEQ ID NO:618}, AGGAGGAGGAAGAGGAGGACGACGAGA {SEQ ID NO:619}, CGGTTGCGGTAATTCGAGGAGGAGGAGG {SEQ ID NO:620}, GGAGGAGGAGGAAGAGGAGGACGACGAG {SEQ ID NO:621}, GAGCGGCGGTAGTGGTCGTGACGTTAC {SEQ ID NO:622}, GAGCGGCGGTAGTGGTCGTGACGTTA {SEQ ID NO:623}, AGCGGCGGTAGTGGTCGTGACGTTAC {SEQ ID NO:624}, GGAGCGGCGGTAGTGGTCGTGACGTTA {SEQ ID NO:625}, AGCGGCGGTAGTGGTCGTGACGTTA {SEQ ID NO:626} |

FIGURE 5 CONTINUED

| | | |
|---|---|---|
| Target67 | chr1:91183455-91183523 | GCGGTTGCGGTAATTCGAGGAGGAGGA (SEQ ID NO:627), CGGTTGCGGTAATTCGAGGAGGAGGAGG (SEQ ID NO:628), CGGTTGCGGTAATTCGAGGAGGAGGAG (SEQ ID NO:629), GCGGTTGCGGTAATTCGAGGAGGAGGAG (SEQ ID NO:630), GGTTGCGGTAATTCGAGGAGGAGGAGG (SEQ ID NO:631), GAGCGGCGGTAGTGGTCGTGACGTTAC (SEQ ID NO:632), GAGCGGCGGTAGTGGTCGTGACGTTA (SEQ ID NO:633), AGCGGCGGTAGTGGTCGTGACGTTAC (SEQ ID NO:634), GGAGCGGCGGTAGTGGTCGTGACGTTA (SEQ ID NO:635), AGCGGCGGTAGTGGTCGTGACGTTA (SEQ ID NO:636) |
| Target68 | chr1:91183553-91183587 | CGCGTTCGTTTGTAATTCGGTTGTTGGCG (SEQ ID NO:637), GCGTTCGTTTGTAATTCGGTTGTTGGCGG (SEQ ID NO:638), CGTTCGTTTGTAATTCGGTTGTTGGCGGG (SEQ ID NO:639), GCGTTCGTTTGTAATTCGGTTGTTGGCG (SEQ ID NO:640), CGCGTTCGTTTGTAATTCGGTTGTTGGC (SEQ ID NO:641), GCGGTTAATAGGGGCGCGGGGTC (SEQ ID NO:642), TGCGTTTATTGGTTTTTTGGTACGTCGGC (SEQ ID NO:643), GCGTTTATTGGTTTTTTGGTACGTCGGC (SEQ ID NO:644), CGAGCGTTGCGTTTATTGGTTTTTTGGT (SEQ ID NO:645), GCGGTTAATAGGGGCGCGGGGT (SEQ ID NO:646) |
| Target69 | chr1:91183598-91183770 | CGTTTGTAATTCGGTTGTTGGCGGGCGG (SEQ ID NO:647), GTTTGTAATTCGGTTGTTGGCGGGCGG (SEQ ID NO:648), TCGTTTGTAATTCGGTTGTTGGCGGGCG (SEQ ID NO:649), TCGTTTGTAATTCGGTTGTTGGCGGGC (SEQ ID NO:650), CGTTTGTAATTCGGTTGTTGGCGGGCGG (SEQ ID NO:651), GTTGCGGGTTTAGGGATGTGCGGGGTTT (SEQ ID NO:652), TAGGGGTTGCGGGTTTAGGGATGTGCGG (SEQ ID NO:653), TGCGGGGTTTAGGGATGTGCGGGGTTTTT (SEQ ID NO:654), TTGCGGGTTTAGGGATGTGCGGGGTTTT (SEQ ID NO:655), TTAGGGGTTGCGGGTTTAGGGATGTGCG (SEQ ID NO:656) |
| Target70 | chr1:110334826-110334876 | TGGGATTTAGGTGGGTTGGGGGGGTTGG (SEQ ID NO:657), GGGTTGGGGGGGTTGGGGGAATGTAGAT (SEQ ID NO:658), GTGGGTTGGGGGGGTTGGGGGAATGTAG (SEQ ID NO:659), GATTTAGGTGGGTTGGGGGGGTTGGGGG (SEQ ID NO:660), GGATTTAGGTGGGTTGGGGGGGTTGGGG (SEQ ID NO:661), GTGGGGTTTGAGTGTTGTAGAGTAGGAAGT (SEQ ID NO:662), AGTGGGGTTTGAGTGTTGTAGAGTAGGAAGT (SEQ ID NO:663), GTGGGGTTTGAGTGTTGTAGAGTAGGAAGTT (SEQ ID NO:664), AGTGGGGTTTGAGTGTTGTAGAGTAGGAAGTT (SEQ ID NO:665), TAGTGGGGTTTGAGTGTTGTAGAGTAGGAAGT (SEQ ID NO:666) |
| Target71 | chr1:110612365-110612398 | GCGCGGGGAAGTTAAGATTGTTAGAAGGGC (SEQ ID NO:667), CGCGGGGAAGTTAAGATTGTTAGAAGGGCG (SEQ ID NO:668), GCGGGGAAGTTAAGATTGTTAGAAGGGCGG (SEQ ID NO:669), GCGGGGAAGTTAAGATTGTTAGAAGGGCGGT (SEQ ID NO:670), AGCGCGGGGAAGTTAAGATTGTTAGAAGGGC (SEQ ID NO:671), GGTCGGTTGGGGATTGCGGTTTGGTTT (SEQ ID NO:672), CGGTTGGGGATTGCGGTTTGGTTTTGG (SEQ ID NO:673), GGTCGGTTGGGGATTGCGGTTTGGTT (SEQ ID NO:674), TCGGTTGGGGATTGCGGTTTGGTTTTGG (SEQ ID NO:675), GGTCGGTTGGGGATTGCGGTTTGGTTTT (SEQ ID NO:676) |
| Target72 | chr1:110612544-110612555 | AGGTTAGGTTCGGGGAGGAGAGACGGG (SEQ ID NO:677), GGTTAGGTTCGGGGAGGAGAGACGGGT (SEQ ID NO:678), GTTAGGTTCGGGGAGGAGAGACGGGTT (SEQ ID NO:679), AGGTTCGGGGAGGAGAGACGGGTTAAG (SEQ ID NO:680), AAGGTTAGGTTCGGGGAGGAGAGACGG (SEQ ID NO:681), GTTTAGATTCGGTCGAGGGTTGTGGAGT (SEQ ID NO:682), AGTTTAGATTCGGTCGAGGGTTGTGGAGT (SEQ ID NO:683), AGTTTAGATTCGGTCGAGGGTTGTGGAG (SEQ ID NO:684), TTTAGATTCGGTCGAGGGTTGTGGAGTT (SEQ ID NO:685), AAGTTTAGATTCGGTCGAGGGTTGTGGA (SEQ ID NO:686) |
| Target73 | chr1:110612670-110612689 | CGGTCGGGTTTGGGTTTTAGGGTAGGT (SEQ ID NO:687), TCGGTCGGGTTTGGGTTTTAGGGTAGGT (SEQ ID NO:688), TCGGTCGGGTTTGGGTTTTAGGGTAGG (SEQ ID NO:689), CGGTCGGGTTTGGGTTTTAGGGTAGGTG (SEQ ID NO:690), GGTCGGGTTTGGGTTTTAGGGTAGGTGGT (SEQ ID NO:691), AGTGTGGGGCGGGAGGGTGAATTATCG (SEQ ID NO:692), TGTGGGGCGGGAGGGTGAATTATCGTT (SEQ ID NO:693), GGTTAGTGTGGGGCGGGAGGGTGAATT (SEQ ID NO:694), GGTAAAGGTTAGTGTGGGGCGGGAGGG (SEQ ID NO:695), GAATGGAAGGCGGGAGGTCGAGGGAAG (SEQ ID NO:696) |
| Target74 | chr1:110612735-110612742 | AGTGTGGGGCGGGAGGGTGAATTATCG (SEQ ID NO:697), TGTGGGGCGGGAGGGTGAATTATCGTT (SEQ ID NO:698), GGTTAGTGTGGGGCGGGAGGGTGAATT (SEQ ID NO:699), GGTAAAGGTTAGTGTGGGGCGGGAGGG (SEQ ID NO:700), GTGTGGGGCGGGAGGGTGAATTATCGT (SEQ ID NO:701) |
| Target75 | chr1:110612790-110612823 | TGGTTTTTGTTTGGTTCGGGTTAGCGT (SEQ ID NO:702), TGGTTTTTGTTTGGTTCGGGTTAGCGTT (SEQ ID NO:703), TTGGTTTTTGTTTGGTTCGGGTTAGCGT (SEQ ID NO:704), TGTTTGGTTCGGGTTAGCGTTAATTCGG (SEQ ID NO:705), TTGGTTTTTGTTTGGTTCGGGTTAGCGTT (SEQ ID NO:706), GGAAGTCGGGTTGGCGTTGGTTT (SEQ ID NO:707), GGAAGTCGGGTTGGCGTTGGTT (SEQ ID NO:708) |
| Target76 | chr1:110612834-110612867 | TGGTTTTTGTTTGGTTCGGGTTAGCGT (SEQ ID NO:709), TGGTTTTTGTTTGGTTCGGGTTAGCGTT (SEQ ID NO:710), TTGGTTTTTGTTTGGTTCGGGTTAGCGT (SEQ ID NO:711), TGTTTGGTTCGGGTTAGCGTTAATTCGG (SEQ ID NO:712), CGGTTTTCGTGGAAGTCGTGGCGA (SEQ ID NO:713) |

FIGURE 5 CONTINUED

Target77    chr1:110626175-110626311    TGGGTTTTCGTTTGGGGAGGGATTTGGT (SEQ ID NO:714), GGGTTTTCGTTTGGGGAGGGATTTGGTTGG (SEQ ID NO:715), GGGTTTTCGTTTGGGGAGGGATTTGGTTGGT (SEQ ID NO:716), TGGGTTTTCGTTTGGGGAGGGATTTGGTTGG (SEQ ID NO:717), TGGGTTTTCGTTTGGGGAGGGATTTGGTT (SEQ ID NO:718), TACGGTTTTGGCGGAGGGGGAATCGAA (SEQ ID NO:719), ATACGGTTTTGGCGGAGGGGGAATCGA (SEQ ID NO:720), GCGGAGGGGGAATCGAAGTTGGGGAAT (SEQ ID NO:721), TTTGGCGGAGGGGGAATCGAAGTTGGG (SEQ ID NO:722), GGTTTTGGCGGAGGGGGAATCGAAGTT (SEQ ID NO:723)

Target78    chr1:110626375-110626397    TGGTTGGAGATAGAGATAAGGAGAGTTAGAAAGCG (SEQ ID NO:724), GGTTGGAGATAGAGATAAGGAGAGTTAGAAAGCGA (SEQ ID NO:725), TGGTTGGAGATAGAGATAAGGAGAGTTAGAAAGCGA (SEQ ID NO:726), ATGGTTGGAGATAGAGATAAGGAGAGTTAGAAAGCG (SEQ ID NO:727), GGTTGGAGATAGAGATAAGGAGAGTTAGAAAGCGAT (SEQ ID NO:728), TTATACGGTTTTGGCGGAGGGGGAATT (SEQ ID NO:729), ATTATACGGTTTTGGCGGAGGGGGAAT (SEQ ID NO:730), ATTATACGGTTTTGGCGGAGGGGGAATT (SEQ ID NO:731), TCGGGGTAGGAGGTAAGTTTTTAGGGGT (SEQ ID NO:732), TATACGGTTTTGGCGGAGGGGGAATT (SEQ ID NO:733)

Target79    chr1:110626480-110626703    GCGGTAGTGGCGGCGGTTTTTAGTTTT (SEQ ID NO:734), CGGGGATTGCGGAGGGAGGGTTTAGG (SEQ ID NO:735), GGGGATTGCGGAGGGAGGGTTTAGGC (SEQ ID NO:736), GGGGATTGCGGAGGGAGGGTTTAGGCG (SEQ ID NO:737), GCGGGGATTGCGGAGGGAGGGTTTAG (SEQ ID NO:738), TTAGGGCGTTCGGAGGTATAGGGTGCG (SEQ ID NO:739), CGGGGAGATTAGGGCGTTCGGAGGTAT (SEQ ID NO:740), GCGGGGAGATTAGGGCGTTCGGAGGTA (SEQ ID NO:741), ATTAGGGCGTTCGGAGGTATAGGGTGCG (SEQ ID NO:742), TAGGGCGTTCGGAGGTATAGGGTGCG (SEQ ID NO:743)

Target80    chr1:111813478-111813500    TGACGTCGTTTTTGGTTGTTTGGTCGT (SEQ ID NO:744), TGACGTCGTTTTTGGTTGTTTGGTCGTT (SEQ ID NO:745), ATGACGTCGTTTTTGGTTGTTTGGTCGT (SEQ ID NO:746), TGACGTCGTTTTTGGTTGTTTGGTCGTT (SEQ ID NO:747), ATGACGTCGTTTTTGGTTGTTTGGTCGTT (SEQ ID NO:748), TCGTAGGTTGTGTGGGTGTGAGGTGGT (SEQ ID NO:749), GTGGGTGTGAGGTGGTTTTCGGTTCGT (SEQ ID NO:750), TGTGGGTGTGAGGTGGTTTTCGGTTCG (SEQ ID NO:751), GGTTGTGTGGGTGTGAGGTGGTTTTCGG (SEQ ID NO:752), TGGGTGTGAGGTGGTTTTCGGTTCGTT (SEQ ID NO:753)

Target81    chr1:111813562-111813604    ATAAGGTGAGGGTAGTTCGCGCGGGG (SEQ ID NO:754), TCGGGTGGTTTAGGGTAAGGCGGATCG (SEQ ID NO:755), GGGTGGTTTAGGGTAAGGCGGATCGGG (SEQ ID NO:756), GGTGGTTTAGGGTAAGGCGGATCGGGA (SEQ ID NO:757), CGGGTGGTTTAGGGTAAGGCGGATCGG (SEQ ID NO:758), GGATATTTTTTGGCGAGGGGGTCGGAGCG (SEQ ID NO:759), CGGATATTTTTTGGCGAGGGGGTCGGAGC (SEQ ID NO:760), ATATTTTTTGGCGAGGGGGTCGGAGCGA (SEQ ID NO:761), TCGGATATTTTTTGGCGAGGGGGTCGGA (SEQ ID NO:762), GATATTTTTTGGCGAGGGGGTCGGAGCG (SEQ ID NO:763)

Target82    chr1:111813667-111813827    ATAAGGTGAGGGTAGTTCGCGCGGGG (SEQ ID NO:764), CGATAAGGTGAGGGTAGTTTCGCGCGGG (SEQ ID NO:765), GATAAGGTGAGGGTAGTTTCGCGCGGG (SEQ ID NO:766), TATTGAGTTGATGTGACGGCGCGGAGG (SEQ ID NO:767), TCGATAAGGTGAGGGTAGTTTCGCGCGG (SEQ ID NO:768), GGATATTTTTTGGCGAGGGGGTCGGAGCG (SEQ ID NO:769), CGGATATTTTTTGGCGAGGGGGTCGGAGC (SEQ ID NO:770), ATATTTTTTGGCGAGGGGGTCGGAGCGA (SEQ ID NO:771), TCGGATATTTTTTGGCGAGGGGGTCGGA (SEQ ID NO:772), GATATTTTTTGGCGAGGGGGTCGGAGCG (SEQ ID NO:773)

Target83    chr1:119522444-119522487    GGGTTTCGGGTTTTTAGGGTTTCGGGT (SEQ ID NO:774), GGGTTTCGGGTTTTTAGGGTTTCGGGTT (SEQ ID NO:775), AGGGTTTCGGGTTTTTAAGGTTTCGCG (SEQ ID NO:776), GGTTTCGGGTTTTTAGGGTTTCGGGTT (SEQ ID NO:777), GGGTTTCGGGTTTTTAGGGTTTCGGGTTT (SEQ ID NO:778), TTTTCGGTTCGGTTTTGGAGGCGTCGC (SEQ ID NO:779), CGGTTTTTCGGTTCGGTTTTGGAGGCG (SEQ ID NO:780), TCGGTTTTTCGGTTCGGTTTTGGAGGCG (SEQ ID NO:781), CGGTTTTTCGGTTCGGTTTTGGAGGCGT (SEQ ID NO:782), TTTCGGTTCGGTTTTGGAGGCGTCGC (SEQ ID NO:783)

Target84    chr1:119522500-119522638    GGTGGGGTTAGCGCGGAGTTTTAGGC (SEQ ID NO:784), GGGTTTCGGGTTTTTAGGGTTTCGGGT (SEQ ID NO:785), GCGGAGTTTTAGGCGCGAGAATAGGAA (SEQ ID NO:786), GGGTTTCGGGTTTTTAGGGTTTCGGGTT (SEQ ID NO:787), AGGGTTTCGGGTTTTTAAGGTTTCGCG (SEQ ID NO:788), TTTTCGGTTCGGTTTTGGAGGCGTCGC (SEQ ID NO:789), CGGTTTTTCGGTTCGGTTTTGGAGGC (SEQ ID NO:790), TCGGTTTTTCGGTTCGGTTTTGGAGGCG (SEQ ID NO:791), CGGTTTTTCGGTTCGGTTTTGGAGGCGT (SEQ ID NO:792), TTTCGGTTCGGTTTTGGAGGCGTCGC (SEQ ID NO:793)

Target85    chr1:119526848-119526885    TAGTTGAGTTGACGGGTGCGTGCGAGA (SEQ ID NO:794), AGTAGTTGAGTTGACGGGTGCGTGCGA (SEQ ID NO:795), GTTGAGTTGACGGGTGCGTGCGAGAAT (SEQ ID NO:796), TTGAGTTGACGGGTGCGTGCGAGAATG (SEQ ID NO:797), GTAGTTGAGTTGACGGGTGCGTGCGAG (SEQ ID NO:798), TTTAGAGGTTTGGGGATGTGGTGGCGC (SEQ ID NO:799), TTAGAGGTTTGGGGATGTGGTGGCGCG (SEQ ID NO:800), TTTTAGAGGTTTGGGGATGTGGTGGCGC (SEQ ID NO:801), GCGCGCGGGTGGGTATTTAGATAGGTA (SEQ ID NO:802), TAGAGGTTTGGGGATGTGGTGGCGCG (SEQ ID NO:803)

FIGURE 5 CONTINUED

| | | |
|---|---|---|
| Target86 | chr1:119526915-119527309 | AGGGGTTGAGGTTCGAGCGTAGATGGC (SEQ ID NO:804), GGGTGGAGTAGGGGTTGAGGTTCGAGC (SEQ ID NO:805), GGTGGAGTAGGGGTTGAGGTTCGAGCG (SEQ ID NO:806), TCGGGTGGAGTAGGGGTTGAGGTTCGA (SEQ ID NO:807), GTTTTGGGAGAGGGCGGGGGAGAGTAG (SEQ ID NO:808), TCGGCGGCGTTATTTGCGTTCGGATT (SEQ ID NO:809), TTCGGCGGCGTTATTTGCGTTCGGATT (SEQ ID NO:810), GTTCGGCGGCGTTATTTGCGTTCGGAT (SEQ ID NO:811), CGGCGGCGTTATTTGCGTTCGGATTTT (SEQ ID NO:812), TCGGCGGCGTTATTTGCGTTCGGATT (SEQ ID NO:813) |
| Target87 | chr1:119527311-119527546 | GGCGGGTTTTGGGGTTTTTCGGGGTTA (SEQ ID NO:814), GTTTTGGGAGAGGGCGGGGGAGAGTAG (SEQ ID NO:815), TGTTTTAAGTTGCGGGTGTTCGGGCGT (SEQ ID NO:816), TTTGTTGTTTTGGGAGAGGGCGGGGGA (SEQ ID NO:817), TTTTGTTGTTTTGGGAGAGGGCGGGGG (SEQ ID NO:818), GGGGGATTAGTTCGGTTTGCGCGTTGT (SEQ ID NO:819), CGGGGGATTAGTTCGGTTTGCGCGTTG (SEQ ID NO:820), TAACGGGGGATTAGTTCGGTTTGCGCG (SEQ ID NO:821), ACGGGGGATTAGTTCGGTTTGCGCGTT (SEQ ID NO:822), AACGGGGGATTAGTTCGGTTTGCGCGT (SEQ ID NO:823) |
| Target88 | chr1:119532785-119533029 | ATTTGGGGAGTTCGGATGGAGAGGCGT (SEQ ID NO:824), GGGGAGTTCGGATGGAGAGGCGTAGGA (SEQ ID NO:825), TTGGGGAGTTCGGATGGAGAGGCGTAG (SEQ ID NO:826), TGGGGAGTTCGGATGGAGAGGCGTAGG (SEQ ID NO:827), TTTGGGGAGTTCGGATGGAGAGGCGTA (SEQ ID NO:828), AGTCGTTGGGGAAGGAAATTGCGGGTT (SEQ ID NO:829), TAGTCGTTGGGGAAGGAAATTGCGGGT (SEQ ID NO:830), GTCGTTGGGGAAGGAAATTGCGGGTTT (SEQ ID NO:831), AGTCGTTGGGGAAGGAAATTGCGGGTTT (SEQ ID NO:832), AGTCGTTGGGGAAGGAAATTGCGGGT (SEQ ID NO:833) |
| Target89 | chr1:119535725-119535751 | GGGGTAAGAGGAGAGCGAAAAGGGGGG (SEQ ID NO:834), TGGGGTAAGAGGAGAGCGAAAAGGGGG (SEQ ID NO:835), GTCGTCGCGGTGTGGTCGGTAGAGTC (SEQ ID NO:836), TTGGGGTAAGAGGAGAGCGAAAAGGGGG (SEQ ID NO:837), TGGGGTAAGAGGAGAGCGAAAAGGGGG (SEQ ID NO:838), TGGGGAAAGAGAAGTTGGGTTTGGGGG (SEQ ID NO:839), TGGGGAAAGAGAAGTTGGGTTTGGGGGA (SEQ ID NO:840), GGGGAAAGAGAAGTTGGGTTTGGGGGA (SEQ ID NO:841), GTGGGGAAAGAGAAGTTGGGTTTGGGGG (SEQ ID NO:842), GTGGGGAAAGAGAAGTTGGGTTTGGGGGA (SEQ ID NO:843) |
| Target90 | chr1:119535812-119535824 | TTTTGTGTGGTTAGGTCGGAGCGGTCG (SEQ ID NO:844), GTTTTGTGTGGTTAGGTCGGAGCGGTCG (SEQ ID NO:845), GTCGTCGCGGTGTGGTCGGTAGAGTC (SEQ ID NO:846), AGTTTTGTGTGGTTAGGTCGGAGCGGT (SEQ ID NO:847), GGAGTTTTGTGTGGTTAGGTCGGAGCGG (SEQ ID NO:848), TGGAACGGCGGGCGTATTTTGTAGTCG (SEQ ID NO:849), CGGCGGGCGTATTTTGTAGTCGAAGGT (SEQ ID NO:850), ACGGCGGGCGTATTTTGTAGTCGAAGG (SEQ ID NO:851), GGAACGGCGGGCGTATTTTGTAGTCGA (SEQ ID NO:852), TGGAACGGCGGGCGTATTTTGTAGTCGA (SEQ ID NO:853) |
| Target91 | chr1:119535884-119535902 | TTTTGTGTGGTTAGGTCGGAGCGGTCG (SEQ ID NO:854), GTTTTGTGTGGTTAGGTCGGAGCGGTCG (SEQ ID NO:855), AGTTTTGTGTGGTTAGGTCGGAGCGGT (SEQ ID NO:856), GGAGTTTTGTGTGGTTAGGTCGGAGCGG (SEQ ID NO:857), GGGAGTTTTGTGTGGTTAGGTCGGAGCG (SEQ ID NO:858), TGGAACGGCGGGCGTATTTTGTAGTC (SEQ ID NO:859), CGGCGGGCGTATTTTGTAGTCGAAGGT (SEQ ID NO:860), ACGGCGGGCGTATTTTGTAGTCGAAGG (SEQ ID NO:861), GGAACGGCGGGCGTATTTTGTAGTCGA (SEQ ID NO:862), GCGAAGGTAGGTAGGATCGGAGTTGGCG (SEQ ID NO:863) |
| Target92 | chr1:119535921-119535963 | TTTGTGTGGTTAGGTCGGAGCGGTCG (SEQ ID NO:864), TTGTGTGGTTAGGTCGGAGCGGTCG (SEQ ID NO:865), TGTGTGGTTAGGTCGGAGCGGTCG (SEQ ID NO:866), GTTCGTCGTTTTAGGCGTTAGTTTCGGT (SEQ ID NO:867), TTTGTGTGGTTAGGTCGGAGCGGTC (SEQ ID NO:868), GCGAAGGTAGGTAGGATCGGAGTTGGCG (SEQ ID NO:869), TGCGAAGGTAGGTAGGATCGGAGTTGGC (SEQ ID NO:870), GCGAAGGTAGGTAGGATCGGAGTTGGC (SEQ ID NO:871), CGAAGGTAGGTAGGATCGGAGTTGGCGT (SEQ ID NO:872), CGAAGGTAGGTAGGATCGGAGTTGGCG (SEQ ID NO:873) |
| Target93 | chr1:119542854-119542943 | CGGAAGGATTGGGGGAGATTTAGATTATTTGGG (SEQ ID NO:874), CGGAAGGATTGGGGGAGATTTAGATTATTTGGGA (SEQ ID NO:875), TCGGAAGGATTGGGGGAGATTTAGATTATTTGGG (SEQ ID NO:876), TCGGAAGGATTGGGGGAGATTTAGATTATTTGGGA (SEQ ID NO:877), TCGGAAGGATTGGGGGAGATTTAGATTATTTGG (SEQ ID NO:878), GGAAAGCGTAGTGGGGATAGAGGTAATTTTTGT (SEQ ID NO:879), AGGAAAGCGTAGTGGGGATAGAGGTAATTTTTG (SEQ ID NO:880), AGGAAAGCGTAGTGGGGATAGAGGTAATTTTTGT (SEQ ID NO:881), AAGGAAAGCGTAGTGGGGATAGAGGTAATTTTT (SEQ ID NO:882), GGAAAGCGTAGTGGGGATAGAGGTAATTTTTGTT (SEQ ID NO:883) |
| Target94 | chr1:119542959-119543008 | GGTTAGCGGGGTATAGAGGTTAGCGGGT (SEQ ID NO:884), GGTTAGCGGGGTATAGAGGTTAGCGGG (SEQ ID NO:885), AGGTTAGCGGGGTATAGAGGTTAGCGGGT (SEQ ID NO:886), AGGTTAGCGGGGTATAGAGGTTAGCGGG (SEQ ID NO:887), AGCGGGGTATAGAGGTTAGCGGGTTTT (SEQ ID NO:888), GGAAAGCGTAGTGGGGATAGAGGTAATTTTTGT (SEQ ID NO:889), AGGAAAGCGTAGTGGGGATAGAGGTAATTTTTG (SEQ ID NO:890), AGGAAAGCGTAGTGGGGATAGAGGTAATTTTTGT (SEQ ID NO:891), |

FIGURE 5 CONTINUED

AAGGAAAGCGTAGTGGGGATAGAGGTAATTTTT (SEQ ID NO:892),
GGAAAGCGTAGTGGGGATAGAGGTAATTTTTGTT (SEQ ID NO:893)

| | | |
|---|---|---|
| Target95 | chr1:119543057-119543271 | GGGTTTGGGGAGTTTTTTGCGGCGGAAG (SEQ ID NO:894), CGTAGGGTTTGGGAGTTTTTTGCGGCG (SEQ ID NO:895), GGGTTTGGGGAGTTTTTTGCGGCGGAAGA (SEQ ID NO:896), AGGGTTTGGGGAGTTTTTTGCGGCGGAAG (SEQ ID NO:897), GTAGGGTTTGGGAGTTTTTTGCGGCGG (SEQ ID NO:898), AAGGTCGTTGGGAGTTCGGTGAGGACG (SEQ ID NO:899), GAGTTCGGTGAGGACGTGGCGGTTTTT (SEQ ID NO:900), GTCGTTGGGAGTTCGGTGAGGACGTGG (SEQ ID NO:901), GGTCGTTGGGAGTTCGGTGAGGACGTG (SEQ ID NO:902), AGTTCGGTGAGGACGTGGCGGTTTTTT (SEQ ID NO:903) |
| Target96 | chr1:145030711-145031192 | CGGGTTTGTTGGTAATAATGTTGTTTTTGTGGTGT (SEQ ID NO:904), TCGGGTTTGTTGGTAATAATGTTGTTTTTGTGGTGT (SEQ ID NO:905), AGGTAAGGTTAGATGTGTAGGTGGGAATAATTGGT (SEQ ID NO:906), CGGGTTTGTTGGTAATAATGTTGTTTTTGTGGTGTT (SEQ ID NO:907), TCGGTTTTTTGGGGAATGTTTTTTGGAAAGTTTTT (SEQ ID NO:908), CGGGGAGTTGGTTGGAGAGTTATTGCG (SEQ ID NO:909), CGGGGAGTTGGTTGGAGAGTTATTGCGA (SEQ ID NO:910), TCGGGGAGTTGGTTGGAGAGTTATTGCG (SEQ ID NO:911), TCGGGGAGTTGGTTGGAGAGTTATTGCGA (SEQ ID NO:912), GGGGGAGTTGGTTGGAGAGTTATTGCGA (SEQ ID NO:913) |
| Target97 | chr1:145075536-145075651 | GTTCGGGGTTTTAGTTTTTCGCGCGGT (SEQ ID NO:914), AGTTCGGGGTTTTAGTTTTTCGCGCGGT (SEQ ID NO:915), AGTTCGGGGTTTTAGTTTTTCGCGCGG (SEQ ID NO:916), AGGCGTCGGGATTTTTAGTTCGGGGTTT (SEQ ID NO:917), TTCGGGGTTTTAGTTTTTCGCGCGGTT (SEQ ID NO:918), GCGTTCGGAGTTAGTCGGGAGTTGGGT (SEQ ID NO:919), CGAGGAGGAAGAAGTAGTTGCGGCGGT (SEQ ID NO:920), TCGAGGAGGAAGAAGTAGTTGCGGCGG (SEQ ID NO:921), AGTCGGGAGTTGGGTAGTAGCGGTCGA (SEQ ID NO:922), GTCGGGAGTTGGGTAGTAGCGGTCGAG (SEQ ID NO:923) |
| Target98 | chr1:145075691-145075709 | TGTTTAGTTTTCGGTTGGTTTCGGGCGT (SEQ ID NO:924), GTTTAGTTTTCGGTTGGTTTCGGGCGT (SEQ ID NO:925), TGTTTAGTTTTCGGTTGGTTTCGGGCG (SEQ ID NO:926), TTTAGTTTTCGGTTGGTTTCGGGCGTC (SEQ ID NO:927), GTTTAGTTTTCGGTTGGTTTCGGGCGTC (SEQ ID NO:928), CGATTTTGGTTGTTGTTGTCGCGCGTT (SEQ ID NO:929), CGATTTTGGTTGTTGTTGTCGCGCGTTT (SEQ ID NO:930), CGATTTTGGTTGTTGTTGTCGCGCGT (SEQ ID NO:931), CGATTTTGGTTGTTGTTGTCGCGCGTTC (SEQ ID NO:932), ATTTTGGTTGTTGTTGTCGCGCGTTTC (SEQ ID NO:933) |
| Target99 | chr1:145075722-145075928 | TCGGCGGCGGTAGTAGGATTCGTTGTT (SEQ ID NO:934), GTTTGTCGTGGGGATTGAGGGGTTCGC (SEQ ID NO:935), CGTATCGGCGGCGGTAGTAGGATTCGT (SEQ ID NO:936), ATCGGCGGCGGTAGTAGGATTCGTTGT (SEQ ID NO:937), TTTTTCGGTTCGGGGTTTGTCGTGGGG (SEQ ID NO:938), AGGTGGTAGAGGTAGTCGCGGAGGAGG (SEQ ID NO:939), GGTGGTAGAGGTAGTCGCGGAGGAGGT (SEQ ID NO:940), GCGGAGTAGGTGGTAGAGGTAGTCGCG (SEQ ID NO:941), GGCGGAGTAGGTGGTAGAGGTAGTCGC (SEQ ID NO:942), CGGAGTAGGTGGTAGAGGTAGTCGCGG (SEQ ID NO:943) |
| Target100 | chr1:145562692-145562810 | TGGGGAAGTTGGAGGAAGAGTTGCGGG (SEQ ID NO:944), GGGGAAGTTGGAGGAAGAGTTGCGGGT (SEQ ID NO:945), TTGGGGAAGTTGGAGGAAGAGTTGCGGG (SEQ ID NO:946), TTGGGGAAGTTGGAGGAAGAGTTGCGG (SEQ ID NO:947), GGGGAAGTTGGAGGAAGAGTTGCGGGTA (SEQ ID NO:948), CGTGTTGTCGTAGGTTGGTTGTTTTTCGGG (SEQ ID NO:949), CGTGTTGTCGTAGGTTGGTTGTTTTTCGGGT (SEQ ID NO:950), TGTTGTCGTAGGTTGGTTGTTTTTCGGGT (SEQ ID NO:951), GTTGTCGTAGGTTGGTTGTTTTTCGGGT (SEQ ID NO:952), TGTTGTCGTAGGTTGGTTGTTTTTCGGG (SEQ ID NO:953) |
| Target101 | chr1:145562817-145562835 | AGTGGTTGAGTTAAGGGTTCGGGAGGT (SEQ ID NO:954), TGAGCGGGAAGAGTTAGGAGATCGGAA (SEQ ID NO:955), ATGAGCGGGAAGAGTTAGGAGATCGGA (SEQ ID NO:956), AAGTGGTTGAGTTAAGGGTTCGGGAGGT (SEQ ID NO:957), AAGTGGTTGAGTTAAGGGTTCGGGAGG (SEQ ID NO:958) |
| Target102 | chr1:145562897-145563019 | TACGGTTTGTCGGGAAGTGGGTCGGTT (SEQ ID NO:959), ATACGGTTTGTCGGGAAGTGGGTCGGT (SEQ ID NO:960), ACGGTTTGTCGGGAAGTGGGTCGGTTG (SEQ ID NO:961), GGTTTGTCGGGAAGTGGGTCGGTTGC (SEQ ID NO:962), CGGTTTGTCGGGAAGTGGGTCGGTTG (SEQ ID NO:963), TGAGCGGTTAGGTTTTCGTTTCGGCGG (SEQ ID NO:964), CGGTTAGGTTTTCGTTTCGGCGGCGTT (SEQ ID NO:965), GAGCGGTTAGGTTTTCGTTTCGGCGGC (SEQ ID NO:966), TTGAGCGGTTAGGTTTTCGTTTCGGCGG (SEQ ID NO:967), GGTTAGGTTTTCGTTTCGGCGGCGTTT (SEQ ID NO:968) |
| Target103 | chr1:155265010-155265083 | CGTCGTTAATGTAGATGCGGTTTTTTATCGGT (SEQ ID NO:969), TCGTCGTTAATGTAGATGCGGTTTTTTATCGG (SEQ ID NO:970), TCGTCGTTAATGTAGATGCGGTTTTTTATCGGT (SEQ ID NO:971), TTCGTCGTTAATGTAGATGCGGTTTTTTATCGG (SEQ ID NO:972), GATGAGTTCGTCGTTAATGTAGATGCGGTTTTT (SEQ ID NO:973), CGGCGTTTGTAGGGTTGGGTTTAGGCG (SEQ ID NO:974), GGCGGCGTTTGTAGGGTTGGGTTTAGG (SEQ ID NO:975), GTCGGAAAGGCGGCGTTTGTAGGGTTG (SEQ ID NO:976), |

FIGURE 5 CONTINUED

GAAAGGCGGCGTTTGTAGGGTTGGGTT (SEQ ID NO:977), GCGGCGTTTGTAGGGTTGGGTTTAGGC (SEQ ID NO:978)

| | | |
|---|---|---|
| Target104 | chr1:155265132-155265147 | AGGAGGGAGTTAGAGGAGATGTGAGTTTTGA (SEQ ID NO:979), AGAGGAGATGTGAGTTTTGAGTTTCGGAGTT (SEQ ID NO:980), GGAGGGAGTTAGAGGAGATGTGAGTTTTGAGT (SEQ ID NO:981), AGGAGGGAGTTAGAGGAGATGTGAGTTTTGAG (SEQ ID NO:982), AGGAGGGAGTTAGAGGAGATGTGAGTTTTGAGT (SEQ ID NO:983), CGGCGTTTGTAGGGTTGGGTTTAGGCG (SEQ ID NO:984), GGGGGTGAGTAGTGGGGTTGGGATTCG (SEQ ID NO:985), GGCGGCGTTTGTAGGGTTGGGTTTAGG (SEQ ID NO:986), TGTAGGGGGTGAGTAGTGGGGTTGGGA (SEQ ID NO:987), GTCGGAAAGGCGGCGTTTGTAGGGTTG (SEQ ID NO:988) |
| Target105 | chr1:155265158-155265276 | GGCGTCGTTTTTTCGGTTTTGGTTTAGC (SEQ ID NO:989), AGGCGTCGTTTTTTCGGTTTTGGTTTAGC (SEQ ID NO:990), GCGGATTTTCGGTTTTTTGGTGTTTAGGGCG (SEQ ID NO:991), GCGGATTTTCGGTTTTTTGGTGTTTAGGGC (SEQ ID NO:992), TGCGGATTTTCGGTTTTTTGGTGTTTAGGGCG (SEQ ID NO:993), GGGGGTGAGTAGTGGGGTTGGGATTCG (SEQ ID NO:994), CGGGAGGCGGTGGAGAGTTTTGTAGGT (SEQ ID NO:995), GGCGGCGTTTGTAGGGTTGGGTTTAGG (SEQ ID NO:996), TGTAGGGGGTGAGTAGTGGGGTTGGGA (SEQ ID NO:997), GTCGGAAAGGCGGCGTTTGTAGGGTTG (SEQ ID NO:998) |
| Target106 | chr1:155265331-155265342 | TGGTTACGGGTCGGTAGTTGAGTGGGG (SEQ ID NO:999), GGTTACGGGTCGGTAGTTGAGTGGGGA (SEQ ID NO:1000), TGGTTACGGGTCGGTAGTTGAGTGGGGA (SEQ ID NO:1001), TGGTGTTTAGGGCGATGGTTACGGGTC (SEQ ID NO:1002), ATGGTTACGGGTCGGTAGTTGAGTGGGG (SEQ ID NO:1003), TCGGGTAGTGGGTGGGGTAGGAGGATG (SEQ ID NO:1004), GTCGGGTAGTGGGTGGGGTAGGAGGAT (SEQ ID NO:1005), CGGGTAGTGGGTGGGGTAGGAGGATGT (SEQ ID NO:1006), GGGTGGGGTAGGAGGATGTTTCGAGGT (SEQ ID NO:1007), TGGGTGGGGTAGGAGGATGTTTCGAGG (SEQ ID NO:1008) |
| Target107 | chr1:155265438-155265468 | GGAGCGAGGGTTTTAGGGGAAGGTGGT (SEQ ID NO:1009), CGGAGCGAGGGTTTTAGGGGAAGGTGG (SEQ ID NO:1010), GGAGCGAGGGTTTTAGGGGAAGGTGGTT (SEQ ID NO:1011), AGTATGGTATTGGGGGAGGGAGCGGAG (SEQ ID NO:1012), GAGCGAGGGTTTTAGGGGAAGGTGGTT (SEQ ID NO:1013), GGAGCGTTTTAAGGAGATGATTAAGGTCGGG (SEQ ID NO:1014), TGGAGCGTTTTAAGGAGATGATTAAGGTCGGG (SEQ ID NO:1015), GGAGCGTTTTAAGGAGATGATTAAGGTCGGGA (SEQ ID NO:1016), TGGAGCGTTTTAAGGAGATGATTAAGGTCGGGA (SEQ ID NO:1017), TGGAGCGTTTTAAGGAGATGATTAAGGTCGG (SEQ ID NO:1018) |
| Target108 | chr1:156092302-156092455 | TTTTTTGGACGGTGGAAAGGGTTGTGTT (SEQ ID NO:1019), TGGACGGTGGAAAGGGTTGTGTTATAGAGT (SEQ ID NO:1020), GGACGGTGGAAAGGGTTGTGTTATAGAGT (SEQ ID NO:1021), TGGACGGTGGAAAGGGTTGTGTTATAGAG (SEQ ID NO:1022), TTGGACGGTGGAAAGGGTTGTGTTATAGA (SEQ ID NO:1023), GTTTAGAAGGGAGAGGTATCGAAAACGAGTTGT (SEQ ID NO:1024) |
| Target109 | chr1:156092497-156092579 | TTGATTCGGGTTGGGGGTTAGGGCGAA (SEQ ID NO:1025), ATTGATTCGGGTTGGGGGTTAGGGCGA (SEQ ID NO:1026), CGGGTTGGGGGTTAGGGCGAAGGTTTA (SEQ ID NO:1027), TGATTCGGGTTGGGGGTTAGGGCGAAG (SEQ ID NO:1028), AGTGTTTGGAATCGGGGGGAGGGGTAC (SEQ ID NO:1029), TGGGTGTTGGAAGGGTAGAAGGTGGGT (SEQ ID NO:1030), ATGGGTGTTGGAAGGGTAGAAGGTGGGT (SEQ ID NO:1031), ATGGGTGTTGGAAGGGTAGAAGGTGGG (SEQ ID NO:1032), TGGGTGTTGGAAGGGTAGAAGGTGGGTA (SEQ ID NO:1033), GGGTGTTGGAAGGGTAGAAGGTGGGTA (SEQ ID NO:1034) |
| Target110 | chr1:156406194-156406230 | CGTAGTGTTTGGGTTCGCGGCGTTAAG (SEQ ID NO:1035), GCGTGTGTTTTCGGTTGCGAGGTTTTG (SEQ ID NO:1036), GCGTGTGTTTTCGGTTGCGAGGTTTTGT (SEQ ID NO:1037), CGTGTGTTTTCGGTTGCGAGGTTTTGT (SEQ ID NO:1038), CGTAGTGTTTGGGTTCGCGGCGTTAA (SEQ ID NO:1039), GTTGGGGTTTCGAACGGTTGGCGGG (SEQ ID NO:1040), TTGGGGTTTCGAACGGTTGGCGGGGAG (SEQ ID NO:1041), GTTGGGGTTTCGAACGGTTGGCGGGGA (SEQ ID NO:1042), TTGGGGTTTCGAACGGTTGGCGGG (SEQ ID NO:1043), GGGTTTCGAACGGTTGGCGGGGAG (SEQ ID NO:1044) |
| Target111 | chr1:156406255-156406284 | CGTAGTGTTTGGGTTCGCGGCGTTAAG (SEQ ID NO:1045), GCGTGTGTTTTCGGTTGCGAGGTTTTG (SEQ ID NO:1046), GCGTGTGTTTTCGGTTGCGAGGTTTTGT (SEQ ID NO:1047), CGTGTGTTTTCGGTTGCGAGGTTTTGT (SEQ ID NO:1048), CGTAGTGTTTGGGTTCGCGGCGTTAA (SEQ ID NO:1049), GTTGGGGTTTCGAACGGTTGGCGGG (SEQ ID NO:1050), TTGGGGTTTCGAACGGTTGGCGGGGAG (SEQ ID NO:1051), GTTGGGGTTTCGAACGGTTGGCGGGGA (SEQ ID NO:1052), TTGGGGTTTCGAACGGTTGGCGGG (SEQ ID NO:1053), GGGTTTCGAACGGTTGGCGGGGAG (SEQ ID NO:1054) |
| Target112 | chr1:156406318-156406350 | CGTAGTGTTTGGGTTCGCGGCGTTAAG (SEQ ID NO:1055), CGTAGTGTTTGGGTTCGCGGCGTTAA (SEQ ID NO:1056), AGTCGTTCGGGATTTTAGTTTGGGGGA (SEQ ID NO:1057), CGTAGTGTTTGGGTTCGCGGCGTTA (SEQ ID NO:1058), GTAGTGTTTGGGTTCGCGGCGTTAAG (SEQ ID NO:1059), AGTTTAGGTTGTCGCGTGGAGTTTGC (SEQ ID NO:1060), |

FIGURE 5 CONTINUED

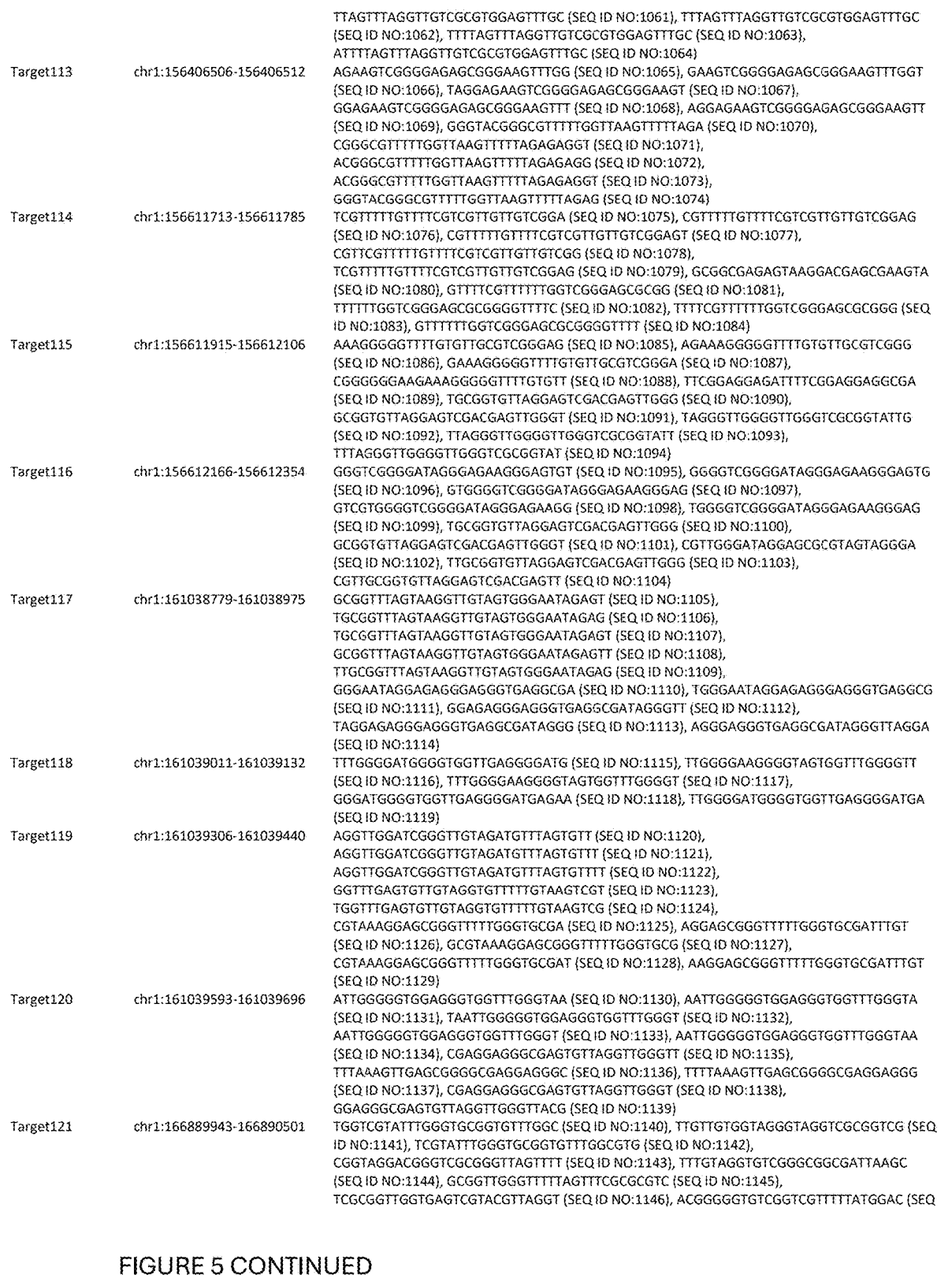

|  |  | TTAGTTTAGGTTGTCGCGTGGAGTTTGC (SEQ ID NO:1061), TTTAGTTTAGGTTGTCGCGTGGAGTTTGC (SEQ ID NO:1062), TTTTAGTTTAGGTTGTCGCGTGGAGTTTGC (SEQ ID NO:1063), ATTTTAGTTTAGGTTGTCGCGTGGAGTTTGC (SEQ ID NO:1064) |
|---|---|---|
| Target113 | chr1:156406506-156406512 | AGAAGTCGGGGAGAGCGGGAAGTTTGG (SEQ ID NO:1065), GAAGTCGGGGAGAGCGGGAAGTTTGGT (SEQ ID NO:1066), TAGGAGAAGTCGGGGAGAGCGGGAAGT (SEQ ID NO:1067), GGAGGAAGTCGGGGAGAGCGGGAAGTTT (SEQ ID NO:1068), AGGAGAAGTCGGGGAGAGCGGGAAGTT (SEQ ID NO:1069), GGGTACGGGCGTTTTTGGTTAAGTTTTTAGA (SEQ ID NO:1070), CGGGGCGTTTTTGGTTAAGTTTTTAGAGAGGT (SEQ ID NO:1071), ACGGGCGTTTTTGGTTAAGTTTTTAGAGAGG (SEQ ID NO:1072), ACGGGCGTTTTTGGTTAAGTTTTTAGAGAGGT (SEQ ID NO:1073), GGGTACGGGCGTTTTTGGTTAAGTTTTTAGAG (SEQ ID NO:1074) |
| Target114 | chr1:156611713-156611785 | TCGTTTTTGTTTTCGTCGTTGTTGTCGGA (SEQ ID NO:1075), CGTTTTTGTTTTCGTCGTTGTTGTCGGAG (SEQ ID NO:1076), CGTTTTTGTTTTCGTCGTTGTTGTCGGAGT (SEQ ID NO:1077), CGTTCGTTTTTGTTTTCGTCGTTGTTGTCGG (SEQ ID NO:1078), TCGTTTTTGTTTTCGTCGTTGTTGTCGGAG (SEQ ID NO:1079), GCGGCGAGAGTAAGGACGAGCGAAGTA (SEQ ID NO:1080), GTTTTCGTTTTTTGGTCGGGAGCGCGG (SEQ ID NO:1081), TTTTTTGGTCGGGAGCGCGGGGTTTTC (SEQ ID NO:1082), TTTTCGTTTTTTGGTCGGGAGCGCGGG (SEQ ID NO:1083), GTTTTTTGGTCGGGAGCGCGGGGTTTT (SEQ ID NO:1084) |
| Target115 | chr1:156611915-156612106 | AAAGGGGGTTTTGTGTTGCGTCGGGAG (SEQ ID NO:1085), AGAAAGGGGGTTTTGTGTTGCGTCGGG (SEQ ID NO:1086), GAAAGGGGGTTTTGTGTTGCGTCGGGA (SEQ ID NO:1087), CGGGGGGGAAGAAAGGGGGTTTTGTGTT (SEQ ID NO:1088), TTCGGAGGAGATTTTCGGAGGAGGCGA (SEQ ID NO:1089), TGCGGTGTTAGGAGTCGACGAGTTGGG (SEQ ID NO:1090), GCGGTGTTAGGAGTCGACGAGTTGGGT (SEQ ID NO:1091), TAGGGTTGGGGTTGGGTCGCGGTATTG (SEQ ID NO:1092), TTAGGGTTGGGGTTGGGTCGCGGTATT (SEQ ID NO:1093), TTTAGGGTTGGGGTTGGGTCGCGGTAT (SEQ ID NO:1094) |
| Target116 | chr1:156612166-156612354 | GGGTCGGGGGATAGGGAGAAGGGAGTGT (SEQ ID NO:1095), GGGGTCGGGGATAGGGAGAAGGGAGTG (SEQ ID NO:1096), GTGGGGTCGGGGATAGGGAGAAGGGAG (SEQ ID NO:1097), GTCGTGGGGTCGGGGATAGGGAGAAGG (SEQ ID NO:1098), TGGGGTCGGGGATAGGGAGAAGGGAG (SEQ ID NO:1099), TGCGGTGTTAGGAGTCGACGAGTTGGG (SEQ ID NO:1100), GCGGTGTTAGGAGTCGACGAGTTGGGT (SEQ ID NO:1101), CGTTGGGATAGGAGCGCGTAGTAGGGA (SEQ ID NO:1102), TTGCGGTGTTAGGAGTCGACGAGTTGGG (SEQ ID NO:1103), CGTTGCGGTGTTAGGAGTCGACGAGTT (SEQ ID NO:1104) |
| Target117 | chr1:161038779-161038975 | GCGGTTTAGTAAGGTTGTAGTGGGAATAGAGT (SEQ ID NO:1105), TGCGGTTTAGTAAGGTTGTAGTGGGAATAGAG (SEQ ID NO:1106), TGCGGTTTAGTAAGGTTGTAGTGGGAATAGAGT (SEQ ID NO:1107), GCGGTTTAGTAAGGTTGTAGTGGGAATAGAGTT (SEQ ID NO:1108), TTGCGGTTTAGTAAGGTTGTAGTGGGAATAGAG (SEQ ID NO:1109), GGGAATAGGAGAGGGAGGGTGAGGCGA (SEQ ID NO:1110), TGGGAATAGGAGAGGGAGGGTGAGGCG (SEQ ID NO:1111), GGAGAGGGAGGGTGAGGCGATAGGGTT (SEQ ID NO:1112), TAGGAGAGGGAGGGTGAGGCGATAGGG (SEQ ID NO:1113), AGGGAGGGTGAGGCGATAGGGTTAGGA (SEQ ID NO:1114) |
| Target118 | chr1:161039011-161039132 | TTTGGGGATGGGGTGGTTGAGGGGATG (SEQ ID NO:1115), TTGGGGAAGGGGTAGTGGTTTGGGGTT (SEQ ID NO:1116), TTTGGGGAAGGGGTAGTGGTTTGGGGT (SEQ ID NO:1117), GGGATGGGGTGGTTGAGGGGATGAGAA (SEQ ID NO:1118), TTGGGGATGGGGTGGTTGAGGGGATGA (SEQ ID NO:1119) |
| Target119 | chr1:161039306-161039440 | AGGTTGGATCGGGTTGTAGATGTTTAGTGTT (SEQ ID NO:1120), AGGTTGGATCGGGTTGTAGATGTTTAGTGTTT (SEQ ID NO:1121), AGGTTGGATCGGGTTGTAGATGTTTAGTGTTTT (SEQ ID NO:1122), GGTTTGAGTGTTGTAGGTGTTTTTGTAAGTCGT (SEQ ID NO:1123), TGGTTTGAGTGTTGTAGGTGTTTTTGTAAGTCG (SEQ ID NO:1124), CGTAAAGGAGCGGGTTTTTGGGTGCGA (SEQ ID NO:1125), AGGAGCGGGTTTTTGGGTGCGATTTGT (SEQ ID NO:1126), GCGTAAAGGAGCGGGTTTTTGGGTGCG (SEQ ID NO:1127), CGTAAAGGAGCGGGTTTTTGGGTGCGAT (SEQ ID NO:1128), AAGGAGCGGGTTTTTGGGTGCGATTTGT (SEQ ID NO:1129) |
| Target120 | chr1:161039593-161039696 | ATTGGGGGTGGAGGGTGGTTTGGGTAA (SEQ ID NO:1130), AATTGGGGGTGGAGGGTGGTTTGGGTA (SEQ ID NO:1131), TAATTGGGGGTGGAGGGTGGTTTGGGT (SEQ ID NO:1132), AATTGGGGGTGGAGGGTGGTTTGGGT (SEQ ID NO:1133), AATTGGGGGTGGAGGGTGGTTTGGGTAA (SEQ ID NO:1134), CGAGGAGGGCGAGTGTTAGGTTGGGTT (SEQ ID NO:1135), TTTAAAGTTGAGCGGGGCGAGGAGGGC (SEQ ID NO:1136), TTTTAAAGTTGAGCGGGGCGAGGAGGG (SEQ ID NO:1137), CGAGGAGGGCGAGTGTTAGGTTGGGT (SEQ ID NO:1138), GGAGGGCGAGTGTTAGGTTGGGTTACG (SEQ ID NO:1139) |
| Target121 | chr1:166889943-166890501 | TGGTCGTATTTGGGTGCGGTGTTTGGC (SEQ ID NO:1140), TTGTTGTGGTAGGGTAGGTCGCGGTCG (SEQ ID NO:1141), TCGTATTTGGGTGCGGTGTTTGGCGTG (SEQ ID NO:1142), CGGTAGGACGGGTCGCGGGTTAGTTTT (SEQ ID NO:1143), TTTGTAGGTGTCGGGCGGCGATTAAGC (SEQ ID NO:1144), GCGGTTGGGTTTTTAGTTTCGCGCGTC (SEQ ID NO:1145), TCGCGGTTGGTGAGTCGTACGTTAGGT (SEQ ID NO:1146), ACGGGGGTGTCGGTCGTTTTTATGGAC (SEQ |

FIGURE 5 CONTINUED

ID NO:1147), TATTCGTATTTGGGTAGCGCGCGGGAG (SEQ ID NO:1148),
AGAATTTCGTTACGGGGGTGTCGGTCG (SEQ ID NO:1149)

| | | |
|---|---|---|
| Target122 | chr1:166890503-166890517 | GCGTTTCGTGATTGTTGTCGTTTGTTCGG (SEQ ID NO:1150), GCGTTTCGTGATTGTTGTCGTTTGTTCG (SEQ ID NO:1151), GGAGTCGTTTTGGTAGAAGTCGTTGTGC (SEQ ID NO:1152), AGGAGTCGTTTTGGTAGAAGTCGTTGTGC (SEQ ID NO:1153), CGTTTCGTGATTGTTGTCGTTTGTTCGG (SEQ ID NO:1154), ACGGGGGTGTCGGTCGTTTTTATGGAC (SEQ ID NO:1155), AGAATTTCGTTACGGGGGTGTCGGTCG (SEQ ID NO:1156), AAGAATTTCGTTACGGGGGTGTCGGTCG (SEQ ID NO:1157), ACGGGGGTGTCGGTCGTTTTTATGGA (SEQ ID NO:1158), GAAGAATTTCGTTACGGGGGTGTCGGTCG (SEQ ID NO:1159) |
| Target123 | chr1:166890584-166890611 | GCGTTTCGTGATTGTTGTCGTTTGTTCGG (SEQ ID NO:1160), GCGTTTCGTGATTGTTGTCGTTTGTTCG (SEQ ID NO:1161), CGTTTCGTGATTGTTGTCGTTTGTTCGG (SEQ ID NO:1162), TGGAGTTTTAGGGAGGGATCGGTCGTT (SEQ ID NO:1163), TTGGAGTTTTAGGGAGGGATCGGTCGT (SEQ ID NO:1164), TGGAGTTTTAGGGAGGGATCGGTCGTTT (SEQ ID NO:1165), TTGGAGTTTTAGGGAGGGATCGGTCGTT (SEQ ID NO:1166), TTTGGAGTTTTAGGGAGGGATCGGTCGT (SEQ ID NO:1167) |
| Target124 | chr1:180904425-180904463 | GGTGGGTATAGGTCGAGGCGGGGTTTT (SEQ ID NO:1168), TTTAGCGGTGGGTATAGGTCGAGGCGG (SEQ ID NO:1169), TTAGCGGTGGGTATAGGTCGAGGCGGG (SEQ ID NO:1170), GTTTAGCGGTGGGTATAGGTCGAGGCGG (SEQ ID NO:1171), GGTGGGTATAGGTCGAGGCGGGGTTTTT (SEQ ID NO:1172), CGTAGGGGGTTTTGGTTCGCGGTTTGT (SEQ ID NO:1173), GTCGGGTTTGGAGCGTAGGGGGTTTTG (SEQ ID NO:1174), TCGGGTTTGGAGCGTAGGGGGTTTTGG (SEQ ID NO:1175), GGTCGGGTTTGGAGCGTAGGGGGGTTTT (SEQ ID NO:1176), CGGGGAGTTTCGTTGATGTAGTCGGCG (SEQ ID NO:1177) |
| Target125 | chr1:180904552-180904566 | TGTAGGTCGCGGATTAGGGTTTTTTGC (SEQ ID NO:1178), TTGTAGGTCGCGGATTAGGGTTTTTTGC (SEQ ID NO:1179), GTTGTAGGTCGCGGATTAGGGTTTTTTGC (SEQ ID NO:1180), TGTTGTAGGTCGCGGATTAGGGTTTTTTGC (SEQ ID NO:1181), GTGTTGTAGGTCGCGGATTAGGGTTTTTTGC (SEQ ID NO:1182), CGGTGTCGGGTGTTTTTTGCGGTTTAGG (SEQ ID NO:1183), CGGTGTCGGGTGTTTTTTGCGGTTTAGGT (SEQ ID NO:1184), CGGTGTCGGGTGTTTTTTGCGGTTTAG (SEQ ID NO:1185), GGTGTCGGGTGTTTTTTGCGGTTTAGGT (SEQ ID NO:1186), GGTGTCGGGTGTTTTTTGCGGTTTAGG (SEQ ID NO:1187) |
| Target126 | chr1:180904606-180904626 | TGTAGGTCGCGGATTAGGGTTTTTTGC (SEQ ID NO:1188), GGTTTGTGGGTAGTTTGGATCGTAGGGG (SEQ ID NO:1189), AGGTTTGTGGGTAGTTTGGATCGTAGGGG (SEQ ID NO:1190), GGTTTGTGGGTAGTTTGGATCGTAGGGA (SEQ ID NO:1191), GGGACGCGGGGTAGGGGATATTTTATAGG (SEQ ID NO:1192), GTTTTTTGGAGGGTTTTGGGGACGGGGG (SEQ ID NO:1193), AGTTTTTTGGAGGGTTTTGGGGACGGGG (SEQ ID NO:1194), TTTTTTGGAGGGTTTTGGGGACGGGGGG (SEQ ID NO:1195), GGTTTTTGGGGACGGGGGGGCGTTTTT (SEQ ID NO:1196), GAGTTTTTTGGAGGGTTTTGGGGACGGGG (SEQ ID NO:1197) |
| Target127 | chr1:180904628-180904642 | GGTTTGTGGGTAGTTTGGATCGTAGGGG (SEQ ID NO:1198), AGGTTTGTGGGTAGTTTGGATCGTAGGGG (SEQ ID NO:1199), GGTTTGTGGGTAGTTTGGATCGTAGGGGA (SEQ ID NO:1200), GGGACGCGGGGTAGGGGATATTTTATAGG (SEQ ID NO:1201), GGGACGCGGGGTAGGGGATATTTTATAGGT (SEQ ID NO:1202), GTTTTTTGGAGGGTTTTGGGGACGGGGG (SEQ ID NO:1203), AGTTTTTTGGAGGGTTTTGGGGACGGGG (SEQ ID NO:1204), TTTTTTGGAGGGTTTTGGGGACGGGGGG (SEQ ID NO:1205), GGTTTTTGGGGACGGGGGGGCGTTTTT (SEQ ID NO:1206), GAGTTTTTTGGAGGGTTTTGGGGACGGGG (SEQ ID NO:1207) |
| Target128 | chr1:180904682-180904704 | AGCGAGAGGAGGTGTTAGGTTTGCGGT (SEQ ID NO:1208), TCGGGTAGCGAGAGGAGGTGTTAGGTT (SEQ ID NO:1209), GCGAGAGGAGGTGTTAGGTTTGCGGTA (SEQ ID NO:1210), ATCGGGTAGCGAGAGGAGGTGTTAGGT (SEQ ID NO:1211), AGCGAGAGGAGGTGTTAGGTTTGCGGTA (SEQ ID NO:1212), GTTTTTTGGAGGGTTTTGGGGACGGGGG (SEQ ID NO:1213), AGTTTTTTGGAGGGTTTTGGGGACGGGG (SEQ ID NO:1214), TTTTTTGGAGGGTTTTGGGGACGGGGGG (SEQ ID NO:1215), GGTTTTTGGGGACGGGGGGGCGTTTTT (SEQ ID NO:1216), GAGTTTTTTGGAGGGTTTTGGGGACGGGG (SEQ ID NO:1217) |
| Target129 | chr1:180904786-180904863 | GTGGGATGGAGAGGGTGTTGGGTGGTT (SEQ ID NO:1218), TTGTGGGATGGAGAGGGTGTTGGGTGG (SEQ ID NO:1219), TGGGATGGAGAGGGTGTTGGGTGGTTT (SEQ ID NO:1220), TGTGGGATGGAGAGGGTGTTGGGTGGT (SEQ ID NO:1221), GGGATGGAGAGGGTGTTGGGTGGTTTG (SEQ ID NO:1222), AGTCGCGGGTTGTTGTTTTGGGTTCGT (SEQ ID NO:1223), GTCGCGGGTTGTTGTTTTGGGTTCGTT (SEQ ID NO:1224), AGTCGCGGGTTGTTGTTTTGGGTTCGTT (SEQ ID NO:1225), TCGCGGGTTGTTGTTTTGGGTTCGTTT (SEQ ID NO:1226), CGTAGTCGCGGGTTGTTGTTTTGGGTT (SEQ ID NO:1227) |
| Target130 | chr1:203598330-203598987 | TTAGGGGTCGATGTTGGTGGGTTCGGG (SEQ ID NO:1228), GCGTATCGGGTCGTTTGAGTTCGGGGT (SEQ ID NO:1229), CGTATCGGGTCGTTTGAGTTCGGGGTC (SEQ ID NO:1230), ATTAGGGGTCGATGTTGGTGGGTTCGG (SEQ ID NO:1231), TAGGGGTCGATGTTGGTGGGTTCGGG (SEQ ID NO:1232), AGGGGAAATTGGAGGTTAGACGGCGGG (SEQ ID NO:1233), CGTGTTGGGCGTTGGGAGTTTTAGGGG (SEQ ID NO:1234), GGGGAAATTGGAGGTTAGACGGCGGGT |

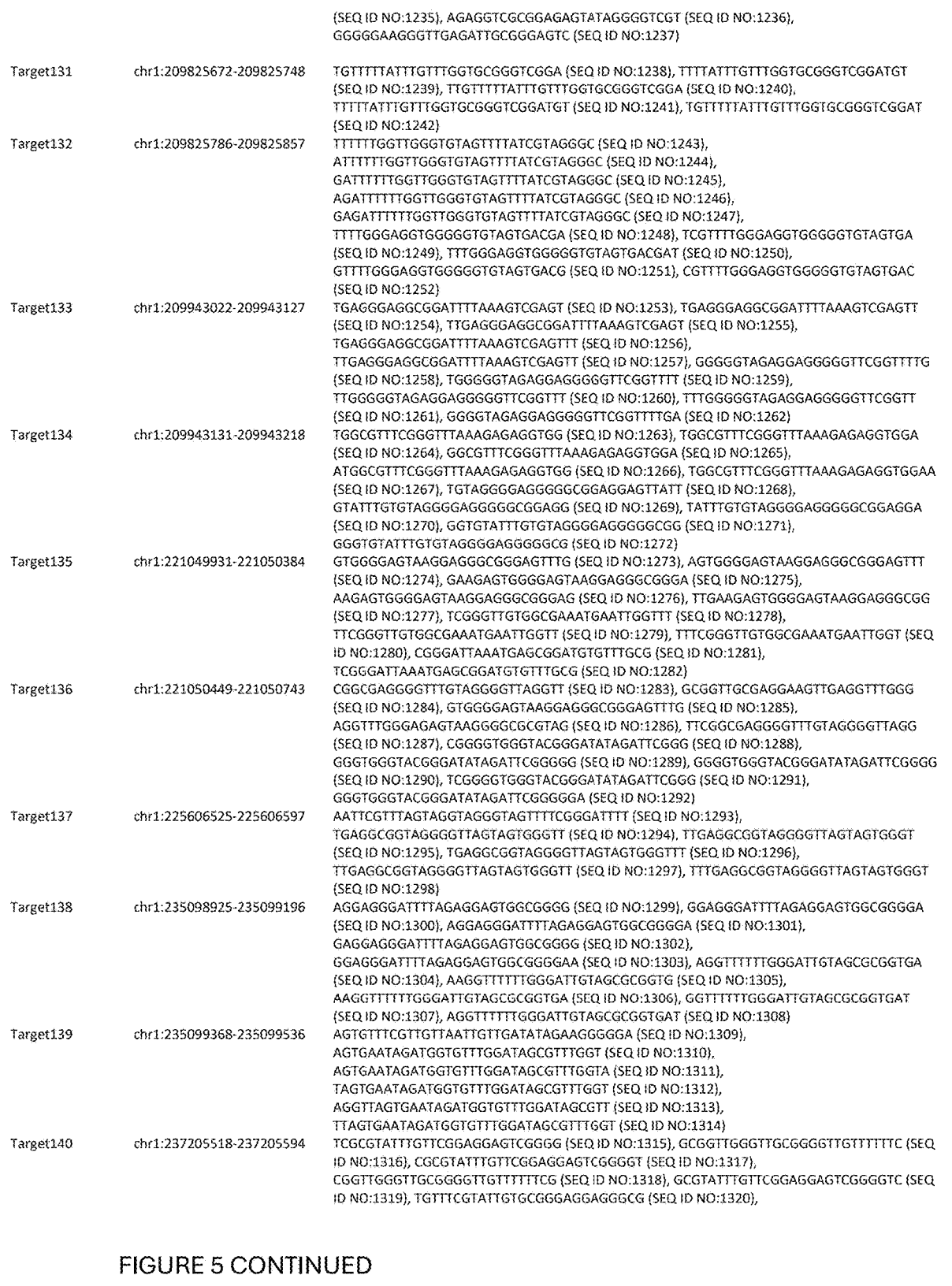

FIGURE 5 CONTINUED (SEQ ID NO:1235), AGAGGTCGCGGAGAGTATAGGGGTCGT (SEQ ID NO:1236),
GGGGGAAGGGTTGAGATTGCGGGAGTC (SEQ ID NO:1237)

Target131    chr1:209825672-209825748    TGTTTTTATTTGTTTGGTGCGGGTCGGA (SEQ ID NO:1238), TTTTATTTGTTTGGTGCGGGTCGGATGT (SEQ ID NO:1239), TTGTTTTTATTTGTTTGGTGCGGGTCGGA (SEQ ID NO:1240), TTTTTATTTGTTTGGTGCGGGTCGGATGT (SEQ ID NO:1241), TGTTTTTATTTGTTTGGTGCGGGTCGGAT (SEQ ID NO:1242)

Target132    chr1:209825786-209825857    TTTTTTGGTTGGGTGTAGTTTTATCGTAGGGC (SEQ ID NO:1243), ATTTTTTTGGTTGGGTGTAGTTTTATCGTAGGGC (SEQ ID NO:1244), GATTTTTTGGTTGGGTGTAGTTTTATCGTAGGGC (SEQ ID NO:1245), AGATTTTTTGGTTGGGTGTAGTTTTATCGTAGGGC (SEQ ID NO:1246), GAGATTTTTTGGTTGGGTGTAGTTTTATCGTAGGGC (SEQ ID NO:1247), TTTTGGGAGGTGGGGGTGTAGTGACGA (SEQ ID NO:1248), TCGTTTTGGGAGGTGGGGGTGTAGTGA (SEQ ID NO:1249), TTTGGGAGGTGGGGGTGTAGTGACGAT (SEQ ID NO:1250), GTTTTGGGAGGTGGGGGTGTAGTGACG (SEQ ID NO:1251), CGTTTTGGGAGGTGGGGGTGTAGTGAC (SEQ ID NO:1252)

Target133    chr1:209943022-209943127    TGAGGGAGGCGGATTTTAAAGTCGAGT (SEQ ID NO:1253), TGAGGGAGGCGGATTTTAAAGTCGAGTT (SEQ ID NO:1254), TTGAGGGAGGCGGATTTTAAAGTCGAGT (SEQ ID NO:1255), TGAGGGAGGCGGATTTTAAAGTCGAGTTT (SEQ ID NO:1256), TTGAGGGAGGCGGATTTTAAAGTCGAGTT (SEQ ID NO:1257), GGGGGTAGAGGAGGGGGTTCGGTTTTG (SEQ ID NO:1258), TGGGGGTAGAGGAGGGGGTTCGGTTTT (SEQ ID NO:1259), TTGGGGGTAGAGGAGGGGGTTCGGTTT (SEQ ID NO:1260), TTTGGGGGTAGAGGAGGGGGTTCGGTT (SEQ ID NO:1261), GGGGTAGAGGAGGGGGGTTCGGTTTTGA (SEQ ID NO:1262)

Target134    chr1:209943131-209943218    TGGCGTTTCGGGTTTAAAGAGAGGTGG (SEQ ID NO:1263), TGGCGTTTCGGGTTTAAAGAGAGGTGGA (SEQ ID NO:1264), GGCGTTTCGGGTTTAAAGAGAGGTGGA (SEQ ID NO:1265), ATGGCGTTTCGGGTTTAAAGAGAGGTGG (SEQ ID NO:1266), TGGCGTTTCGGGTTTAAAGAGAGGTGGAA (SEQ ID NO:1267), TGTAGGGGAGGGGGCGGAGGAGTTATT (SEQ ID NO:1268), GTATTTGTGTAGGGGAGGGGGCGGAGG (SEQ ID NO:1269), TATTTGTGTAGGGGAGGGGGCGGAGGA (SEQ ID NO:1270), GGTGTATTTGTGTAGGGGAGGGGGCGG (SEQ ID NO:1271), GGGTGTATTTGTGTAGGGGAGGGGGCG (SEQ ID NO:1272)

Target135    chr1:221049931-221050384    GTGGGGAGTAAGGAGGGCGGGAGTTTG (SEQ ID NO:1273), AGTGGGGAGTAAGGAGGGCGGGAGTTT (SEQ ID NO:1274), GAAGAGTGGGGAGTAAGGAGGGCGGGA (SEQ ID NO:1275), AAGAGTGGGGAGTAAGGAGGGCGGGAG (SEQ ID NO:1276), TTGAAGAGTGGGGAGTAAGGAGGGCGG (SEQ ID NO:1277), TCGGGTTGTGGCGAAATGAATTGGTTT (SEQ ID NO:1278), TTCGGGTTGTGGCGAAATGAATTGGTT (SEQ ID NO:1279), TTTCGGGTTGTGGCGAAATGAATTGGT (SEQ ID NO:1280), CGGGATTAAATGAGCGGATGTGTTTGCG (SEQ ID NO:1281), TCGGGATTAAATGAGCGGATGTGTTTGCG (SEQ ID NO:1282)

Target136    chr1:221050449-221050743    CGGCGAGGGGTTTGTAGGGGTTAGGTT (SEQ ID NO:1283), GCGGTTGCGAGGAAGTTGAGGTTTGGG (SEQ ID NO:1284), GTGGGGAGTAAGGAGGGCGGGAGTTTG (SEQ ID NO:1285), AGGTTTGGGAGAGTAAGGAGGCGCGTAG (SEQ ID NO:1286), TTCGGCGAGGGGTTTGTAGGGGTTAGG (SEQ ID NO:1287), CGGGGTGGGTACGGGATATAGATTCGGG (SEQ ID NO:1288), GGGTGGGTACGGGATATAGATTCGGGGG (SEQ ID NO:1289), GGGGTGGGTACGGGATATAGATTCGGGG (SEQ ID NO:1290), TCGGGGTGGGTACGGGATATAGATTCGGG (SEQ ID NO:1291), GGGTGGGTACGGGATATAGATTCGGGGGA (SEQ ID NO:1292)

Target137    chr1:225606525-225606597    AATTCGTTTAGTAGGTAGGGTAGTTTTCGGGATTTT (SEQ ID NO:1293), TGAGGCGGTAGGGGTTAGTAGTGGGTT (SEQ ID NO:1294), TTGAGGCGGTAGGGGTTAGTAGTGGGT (SEQ ID NO:1295), TGAGGCGGTAGGGGTTAGTAGTGGGTT (SEQ ID NO:1296), TTGAGGCGGTAGGGGTTAGTAGTGGGTT (SEQ ID NO:1297), TTTGAGGCGGTAGGGGTTAGTAGTGGGT (SEQ ID NO:1298)

Target138    chr1:235098925-235099196    AGGAGGGGATTTTAGAGGAGTGGCGGGG (SEQ ID NO:1299), GGAGGGGATTTTAGAGGAGTGGCGGGGA (SEQ ID NO:1300), AGGAGGGGATTTTAGAGGAGTGGCGGGGA (SEQ ID NO:1301), GAGGAGGGGATTTTAGAGGAGTGGCGGGG (SEQ ID NO:1302), GGAGGGGATTTTAGAGGAGTGGCGGGGAA (SEQ ID NO:1303), AGGTTTTTTGGGATTGTAGCGCGGTGA (SEQ ID NO:1304), AAGGTTTTTTGGGATTGTAGCGCGGTG (SEQ ID NO:1305), AAGGTTTTTTGGGATTGTAGCGCGGTGA (SEQ ID NO:1306), GGTTTTTTGGGATTGTAGCGCGGTGAT (SEQ ID NO:1307), AGGTTTTTTGGGATTGTAGCGCGGTGAT (SEQ ID NO:1308)

Target139    chr1:235099368-235099536    AGTGTTTCGTTGTTAATTGTTGATATAGAAGGGGGA (SEQ ID NO:1309), AGTGAATAGATGGTGTTTGGATAGCGTTTGGGT (SEQ ID NO:1310), AGTGAATAGATGGTGTTTGGATAGCGTTTGGTA (SEQ ID NO:1311), TAGTGAATAGATGGTGTTTGGATAGCGTTTGGT (SEQ ID NO:1312), AGGTTAGTGAATAGATGGTGTTTGGATAGCGTT (SEQ ID NO:1313), TTAGTGAATAGATGGTGTTTGGATAGCGTTTGGT (SEQ ID NO:1314)

Target140    chr1:237205518-237205594    TCGCGTATTTGTTCGGAGGAGTCGGGG (SEQ ID NO:1315), GCGGTTGGGTTGCGGGGTTGTTTTTTC (SEQ ID NO:1316), CGCGTATTTGTTCGGAGGAGTCGGGGT (SEQ ID NO:1317), CGGTTGGGTTGCGGGGTTGTTTTTTCG (SEQ ID NO:1318), GCGTATTTGTTCGGAGGAGTCGGGGTC (SEQ ID NO:1319), TGTTTCGTATTGTGCGGGAGGAGGGCG (SEQ ID NO:1320),

FIGURE 5 CONTINUED

|  |  | TTGTTTCGTATTGTGCGGGAGGAGGGC (SEQ ID NO:1321), GTTTCGTATTGTGCGGGAGGAGGGCGG (SEQ ID NO:1322), GTTTCGTATTGTGCGGGAGGAGGGCG (SEQ ID NO:1323), TTTGTTTCGTATTGTGCGGGAGGAGGGC (SEQ ID NO:1324) |
|---|---|---|
| Target141 | chr1:237205633-237206037 | GTGCGTCGCGTGTGTTGTTAGGGGAAG (SEQ ID NO:1325), GGGGCGAGGGGGTGTGTTTTTTGAGGATGC (SEQ ID NO:1326), CGAGGGGGTGTTTTTTGAGGATGCGGG (SEQ ID NO:1327), GTTGTTAGGGGAAGGGGGCGTTAGGGT (SEQ ID NO:1328), TGTTGTTAGGGGAAGGGGGCGTTAGGG (SEQ ID NO:1329), GTTTGTAGAGCGGAGGAGGAGGCGCG (SEQ ID NO:1330), CGTTTGTAGAGCGGAGGAGGAGGCGC (SEQ ID NO:1331), GTTTGTAGAGCGGAGGAGGAGGCGCGG (SEQ ID NO:1332), TTTGTAGAGCGGAGGAGGAGGCGCG (SEQ ID NO:1333), CGTTTGTAGAGCGGAGGAGGAGGCGCG (SEQ ID NO:1334) |
| Target142 | chr1:237206046-237206177 | GCGCGCGTGTGGAAAGTTAGAGGATGG (SEQ ID NO:1335), TTGTGCGCGCGTGTGGAAAGTTAGAGG (SEQ ID NO:1336), GGGCGAGGGGGTGTTTTTTGAGGATGC (SEQ ID NO:1337), CGAGGGGGTGTTTTTTGAGGATGCGGG (SEQ ID NO:1338), GAGGGAAGGTAAGGGCGCGTGTTTGTG (SEQ ID NO:1339), CGGTCGTTCGGGAGGTTTTAGTCGTGT (SEQ ID NO:1340), TCGGTCGTTCGGGAGGTTTTAGTCGTGT (SEQ ID NO:1341), TCGGTCGTTCGGGAGGTTTTAGTCGTG (SEQ ID NO:1342), TTCGGTCGTTCGGGAGGTTTTAGTCGT (SEQ ID NO:1343), CGGTCGTTCGGGAGGTTTTAGTCGTGTT (SEQ ID NO:1344) |
| Target143 | chr1:240161087-240161285 | GGGATTAGGGTTTCGGAGGGTGTCGG (SEQ ID NO:1345), CGGGATTAGGGTTTCGGAGGGTGTCGG (SEQ ID NO:1346), GGGAACGGGTTGGTGGCGGTTTTAAGC (SEQ ID NO:1347), GGATTAGGGTTTCGGAGGGTGTCGGGC (SEQ ID NO:1348), TCGGGATTAGGGTTTCGGAGGGTGTCG (SEQ ID NO:1349), GCGCGCGGGAGGAATTGTTTGAGTAGG (SEQ ID NO:1350), GGCGCGCGGGAGGAATTGTTTGAGTAG (SEQ ID NO:1351), CGTTTTTTGCGTAGGTGGGTGGGTGGG (SEQ ID NO:1352), CGTAAGGTCGTTAGGGGGGTCGCGTGTC (SEQ ID NO:1353), GTTTTTTGCGTAGGTGGGTGGGTGGGA (SEQ ID NO:1354) |
| Target144 | chr1:240161289-240161383 | GGGATTAGGGTTTCGGAGGGTGTCGG (SEQ ID NO:1355), CGGGATTAGGGTTTCGGAGGGTGTCGG (SEQ ID NO:1356), GGGAACGGGTTGGTGGCGGTTTTAAGC (SEQ ID NO:1357), GGATTAGGGTTTCGGAGGGTGTCGGGC (SEQ ID NO:1358), TCGGGATTAGGGTTTCGGAGGGTGTCG (SEQ ID NO:1359), TCGGAGTAGGGTCGTAATTTCGCGGTT (SEQ ID NO:1360), TTCGGAGTAGGGTCGTAATTTCGCGGT (SEQ ID NO:1361), CGGAGTAGGGTCGTAATTTCGCGGTTT (SEQ ID NO:1362), TCGGAGTAGGGTCGTAATTTCGCGGTTT (SEQ ID NO:1363), TTCGGAGTAGGGTCGTAATTTCGCGGTT (SEQ ID NO:1364) |
| Target145 | chr1:240161390-240161547 | GCGAGGTTGCGGTTTTGTTTCGAATTT (SEQ ID NO:1365), GGGGCGTCGCGGGTGTTAAAGGG (SEQ ID NO:1366), GCGAGGTTGCGGTTTTGTTTCGAATTTC (SEQ ID NO:1367), GGGCGTCGCGGGTGTTAAAGGGC (SEQ ID NO:1368), GAGTTTACGCGGATGTTACGGTCGTC (SEQ ID NO:1369), TTTTGCGGTTCGGGCGGTTGTATTTCG (SEQ ID NO:1370), TTAGTTTTTTGCGGTTCGGGCGGTTGT (SEQ ID NO:1371), AGTTTTTTGCGGTTCGGGCGGTTGTAT (SEQ ID NO:1372), TTTTTGCGGTTCGGGCGGTTGTATTTCG (SEQ ID NO:1373), TCGGAGTAGGGTCGTAATTTCGCGGTT (SEQ ID NO:1374) |
| Target146 | chr1:240161558-240161600 | TTGGGGATTCGCGGGGTGTAGTCGTTC (SEQ ID NO:1375), GGGGTGTAGTCGTTCGGGTCGTAGGAGG (SEQ ID NO:1376), GGGGTGTAGTCGTTCGGGTCGTAGGAG (SEQ ID NO:1377), GTTGGGGATTCGCGGGGTGTAGTCGTT (SEQ ID NO:1378), TTTCGGTTGGGGATTCGCGGGGTGTAG (SEQ ID NO:1379), TTTTGCGGTTCGGGCGGTTGTATTTCGT (SEQ ID NO:1380), TTTTTGCGGTTCGGGCGGTTGTATTTCG (SEQ ID NO:1381), TTTTTGCGGTTCGGGCGGTTGTATTTCGT (SEQ ID NO:1382), TTGCGGTTCGGGCGGTTGTATTTCGT (SEQ ID NO:1383), TTAGTTTTTTGCGGTTCGGGCGGTTGT (SEQ ID NO:1384) |
| Target147 | chr1:248020450-248020544 | TGTGACGGGGGCGGGGAATTATAACGT (SEQ ID NO:1385), TTGTGTAGATCGCGCGAGGGGGAGACGGTG (SEQ ID NO:1386), TTTGTGTAGATCGCGAGGGGGAGACGGTG (SEQ ID NO:1387), GGTCGGGAGCGTAGTTTTTCGGGAGGC (SEQ ID NO:1388), TGTGACGGGGGCGGGGAATTATAACGTT (SEQ ID NO:1389), TCGGGCGGCGTTAGGTTATGATTCGT (SEQ ID NO:1390), CGGGCGGCGTTAGGTTATGATTCGTT (SEQ ID NO:1391), TCGGGCGGCGTTAGGTTATGATTCGTT (SEQ ID NO:1392), TTCGGGCGGCGTTAGGTTATGATTCGT (SEQ ID NO:1393), TTCGGGCGGCGTTAGGTTATGATTCG (SEQ ID NO:1394) |
| Target148 | chr1:248020559-248020742 | TTGTGTAGATCGCGAGGGGGAGACGTG (SEQ ID NO:1395), GGAGCGTAGTTTTTCGGGAGGCGGGTT (SEQ ID NO:1396), TTTTCGGGAGGCGGGTTATGGTTTGGG (SEQ ID NO:1397), TTTGTGTAGATCGCGAGGGGGAGACGGT (SEQ ID NO:1398), GGTCGGGAGCGTAGTTTTTCGGGAGGC (SEQ ID NO:1399), AGGTTCGTTAGTTGTCGGTTGGGGCGA (SEQ ID NO:1400), GGTTCGTTAGTTGTCGGTTGGGGCGAA (SEQ ID NO:1401), AGGTTCGTTAGTTGTCGGTTGGGGCGAA (SEQ ID NO:1402), TAGGTTCGTTAGTTGTCGGTTGGGGCG (SEQ ID NO:1403), TCGTTAGTTGTCGGTTGGGGCGAAAGT (SEQ ID NO:1404) |
| Target149 | chr1:248020748-248020776 | CGGGTTTTCGTTTTAATCGGTAGTTGGCG (SEQ ID NO:1405), TCGGGTTTTCGTTTTAATCGGTAGTTGGCG (SEQ ID NO:1406), TCGGGTTTTCGTTTTAATCGGTAGTTGGC (SEQ ID NO:1407), TTCGGGTTTTCGTTTTAATCGGTAGTTGGCG (SEQ ID NO:1408), TTCGGGTTTTCGTTTTAATCGGTAGTTGGC (SEQ ID NO:1409), AGGTTCGTTAGTTGTCGGTTGGGGCGA (SEQ ID NO:1410), GGTTCGTTAGTTGTCGGTTGGGGCGAA (SEQ ID NO:1411), AGGTTCGTTAGTTGTCGGTTGGGGCGAA (SEQ ID NO:1412), TAGGTTCGTTAGTTGTCGGTTGGGGCG (SEQ ID NO:1413), TCGTTAGTTGTCGGTTGGGGCGAAAGT (SEQ ID NO:1414) |

FIGURE 5 CONTINUED

| | | |
|---|---|---|
| *Target150* | chr1:248020791-248021097 | TCGGTAGTTGGCGGGTTTGGTGGAGAG (SEQ ID NO:1415), ATCGGTAGTTGGCGGGTTTGGTGGAGA (SEQ ID NO:1416), TAGTTGGCGGGTTTGGTGGAGAGCGTG (SEQ ID NO:1417), GTAGTTGGCGGGTTTGGTGGAGAGCGT (SEQ ID NO:1418), AATCGGTAGTTGGCGGGTTTGGTGGAG (SEQ ID NO:1419), GGGGGAGGGGCGGACGGTGTAAAATAA (SEQ ID NO:1420), GGAGCGGTCGTGGGAGTCGTTTAGGAG (SEQ ID NO:1421), GATAGGAGAGTGTTTGGGGGAGGGGCG (SEQ ID NO:1422), CGATAGGAGAGTGTTTGGGGGAGGGGC (SEQ ID NO:1423), TAGCGTTCGTAGTTTTCGTCGGGGGGC (SEQ ID NO:1424) |
| *Target151* | chr2:467943-467958 | ACGTCGGGGGTTTAGGTAGGTAGAGAA (SEQ ID NO:1425), GGTCGAGTTATTTTAGGCGTTCGTGGGT (SEQ ID NO:1426), GGTCGAGTTATTTTAGGCGTTCGTGGG (SEQ ID NO:1427), AGGTCGAGTTATTTTAGGCGTTCGTGGGT (SEQ ID NO:1428), AGGTCGAGTTATTTTAGGCGTTCGTGGG (SEQ ID NO:1429), ACGAGGGTTTTGAATGTATAGCGCGGG (SEQ ID NO:1430), ACGAGGGTTTTGAATGTATAGCGCGGGA (SEQ ID NO:1431), CGAGGGTTTTGAATGTATAGCGCGGGA (SEQ ID NO:1432), AGCGCGGGAGTTTTAGGTTTAGGAGTG (SEQ ID NO:1433), GCGCGGGAGTTTTAGGTTTAGGAGTGA (SEQ ID NO:1434) |
| *Target152* | chr2:467982-468022 | AGGGTTTTCGTGGTTTTTAGAGGCGCG (SEQ ID NO:1435), TAGGGTTTTCGTGGTTTTTAGAGGCGCG (SEQ ID NO:1436), GGGTTTTCGTGGTTTTTAGAGGCGCG (SEQ ID NO:1437), ACGTCGGGGGTTTAGGTAGGTAGAGAA (SEQ ID NO:1438), GGTCGAGTTATTTTAGGCGTTCGTGGGT (SEQ ID NO:1439), CGCGGTTTTTTCGTTTTGGTTTTTGCGT (SEQ ID NO:1440), CGCGGTTTTTTCGTTTTGGTTTTTGCG (SEQ ID NO:1441), CGCGGTTTTTTCGTTTTGGTTTTTGCGTT (SEQ ID NO:1442), CGCGGTTTTTTCGTTTTGGTTTTTGCGTTT (SEQ ID NO:1443), CGCGGTTTTTTCGTTTTGGTTTTTGCGTTTT (SEQ ID NO:1444) |
| *Target153* | chr2:468061-468079 | GTTGGGTAGTTTCGTCGGGTTGTGGCG (SEQ ID NO:1445), TTGGGTAGTTTCGTCGGGTTGTGGCGA (SEQ ID NO:1446), GGTTGGGTAGTTTCGTCGGGTTGTGGC (SEQ ID NO:1447), GGGTTGGGTAGTTTCGTCGGGTTGTGG (SEQ ID NO:1448), TGGGTAGTTTCGTCGGGTTGTGGCGA (SEQ ID NO:1449), AGGTTTCGCGTTTATTTTGGTTCGGTGTC (SEQ ID NO:1450), TAGGTTTCGCGTTTATTTTGGTTCGGTGTC (SEQ ID NO:1451), TTAGGTTTCGCGTTTATTTTGGTTCGGTGTC (SEQ ID NO:1452), TTTAGGTTTCGCGTTTATTTTGGTTCGGTGTC (SEQ ID NO:1453) |
| *Target154* | chr2:468093-468192 | CGCGAGGGGTAGGACGAGGTTGTATGG (SEQ ID NO:1454), GTTGGGTAGTTTCGTCGGGTTGTGGCG (SEQ ID NO:1455), GCGAGGGGTAGGACGAGGTTGTATGGG (SEQ ID NO:1456), TTGGGTAGTTTCGTCGGGTTGTGGCGA (SEQ ID NO:1457), GGTTGGGTAGTTTCGTCGGGTTGTGGC (SEQ ID NO:1458), TTTTCGGTTTTTTGGGCGGGTTTTGCG (SEQ ID NO:1459), TTCGGTTTTTTGGGCGGGTTTTGCGT (SEQ ID NO:1460), CGCGGTTTAGTTCGGTGTAGTTGAGGG (SEQ ID NO:1461), TTTTTCGGTTTTTTGGGCGGGTTTTGCG (SEQ ID NO:1462), CGCGGTTTAGTTCGGTGTAGTTGAGGA (SEQ ID NO:1463) |
| *Target155* | chr2:468212-468304 | CGCGAGGGGTAGGACGAGGTTGTATGG (SEQ ID NO:1464), GCGAGGGGTAGGACGAGGTTGTATGGG (SEQ ID NO:1465), TCGAGTTAGAGTGAGCGCGGGGTTTGG (SEQ ID NO:1466), CGAGGTTGTATGGGTTAGCGAGGGGGT (SEQ ID NO:1467), ACGAGGTTGTATGGGTTAGCGAGGGGG (SEQ ID NO:1468), TCGGAGGCGCGCGTTGTTTTGTAGTTT (SEQ ID NO:1469), TTCGGAGGCGCGCGTTGTTTTGTAGTT (SEQ ID NO:1470), TTTCGGAGGCGCGCGTTGTTTTGTAGT (SEQ ID NO:1471), AGTTTCGGAGGCGCGCGTTGTTTTGTA (SEQ ID NO:1472), GTTTCGGAGGCGCGCGTTGTTTTGTAG (SEQ ID NO:1473) |
| *Target156* | chr2:468313-468383 | GGCGTAGAGTTCGTTTAGGGAGTCGGGA (SEQ ID NO:1474), GCGTAGAGTTCGTTTAGGGAGTCGGGA (SEQ ID NO:1475), GGCGTAGAGTTCGTTTAGGGAGTCGGGAG (SEQ ID NO:1476), GCGTAGAGTTCGTTTAGGGAGTCGGGAG (SEQ ID NO:1477), GCGTAGAGTTCGTTTAGGGAGTCGGGAGA (SEQ ID NO:1478), TTAAGGGGCGCGTAGGAGTTTCGGAGG (SEQ ID NO:1479), TCGGAGGCGCGCGTTGTTTTGTAGTTT (SEQ ID NO:1480), TTCGGAGGCGCGCGTTGTTTTGTAGTT (SEQ ID NO:1481), TTTCGGAGGCGCGCGTTGTTTTGTAGT (SEQ ID NO:1482), AGTTTCGGAGGCGCGCGTTGTTTTGTA (SEQ ID NO:1483) |
| *Target157* | chr2:468413-468458 | AGGGGTGCGTTTTTTAAGTTTCGGGTG (SEQ ID NO:1484), GGGGTGCGTTTTTTAAGTTTCGGGTGA (SEQ ID NO:1485), GGGGTGCGTTTTTTAAGTTTCGGGTGAGG (SEQ ID NO:1486), GGGGTGCGTTTTTTAAGTTTCGGGTGAGGT (SEQ ID NO:1487), AGGGGTGCGTTTTTTAAGTTTCGGGTGA (SEQ ID NO:1488), GGGAGGTAGGAGGTGGGAGTGCGTTTC (SEQ ID NO:1489), TTAAGGGGCGCGTAGGAGTTTCGGAGG (SEQ ID NO:1490), GGAGGTAGGAGGTGGGAGTGCGTTTCG (SEQ ID NO:1491), GAGGTAGGAGGTGGGAGTGCGTTTCGT (SEQ ID NO:1492), GTTTCGGGGAGGTAGGAGGTGGGAGTG (SEQ ID NO:1493) |
| *Target158* | chr2:1036257-1036451 | TTTTGGTTGGAGTTTTTGTCGGTTATTGTCGA (SEQ ID NO:1494), TTTTTGGTTGGAGTTTTTGTCGGTTATTGTCGA (SEQ ID NO:1495), TTTTTTGGTTGGAGTTTTTGTCGGTTATTGTCGA (SEQ ID NO:1496), AACGTTAAGGGTGGTAGGATAGGGAGGA (SEQ ID NO:1497), ACGTTAAGGGTGGTAGGATAGGGAGGAT (SEQ ID NO:1498), AAACGTTAAGGGTGGTAGGATAGGGAGGA (SEQ ID NO:1499), ACGTTAAGGGTGGTAGGATAGGGAGGATT (SEQ ID NO:1500), AACGTTAAGGGTGGTAGGATAGGGAGGAT (SEQ ID NO:1501) |
| *Target159* | chr2:2120400-2120800 | CGTGGAGAGGTTGTGTAGGGAGTGAGGG (SEQ ID NO:1502), AGGTTGTGTAGGGAGTGAGGGAGGTGT (SEQ ID NO:1503), AGAGGTTGTGTAGGGAGTGAGGGAGGT (SEQ ID NO:1504), ACGTGGAGAGGTTGTGTAGGGAGTGAGG (SEQ ID NO:1505), TGGAGAGGTTGTGTAGGGAGTGAGGGA |

FIGURE 5 CONTINUED

|  |  | {SEQ ID NO:1506}, TGGTTTGGTTTTTTCGGGGGCGGATTT {SEQ ID NO:1507}, ATGGTTTGGTTTTTTCGGGGGCGGATT {SEQ ID NO:1508}, TGTGGGTGTTTTGTAGGGGGAGAGGTT {SEQ ID NO:1509}, TTGTGGGTGTTTTGTAGGGGGAGAGGT {SEQ ID NO:1510}, TATGGTTTGGTTTTTTCGGGGGCGGAT {SEQ ID NO:1511} |
| Target160 | chr2:5832899-5832916 | GTGGGAGGGGGAGGGGGATTTTCGTAC {SEQ ID NO:1512}, GGAGGGGGGAGGGGGATTTTCGTACGAG {SEQ ID NO:1513}, GGGAGGGGGAGGGGGATTTTCGTACGA {SEQ ID NO:1514}, GGTGGGAGGGGGAGGGGGATTTTCGTA {SEQ ID NO:1515}, AGGCGGAGAGTTTGGAAGCGGAGAGTA {SEQ ID NO:1516}, CGTTTAGGGTTATCGGGTTGTAAGTTATGAATTCGT {SEQ ID NO:1517}, TCGTTTAGGGTTATCGGGTTGTAAGTTATGAATTCG {SEQ ID NO:1518} |
| Target161 | chr2:5832945-5832965 | AGGCGGAGAGTTTGGAAGCGGAGAGTA {SEQ ID NO:1519}, TAGGCGGAGAGTTTGGAAGCGGAGAGT {SEQ ID NO:1520}, AGTAGGCGGAGAGTTTGGAAGCGGAGA {SEQ ID NO:1521}, GTAGGCGGAGAGTTTGGAAGCGGAGAGT {SEQ ID NO:1522}, GTAGGCGGAGAGTTTGGAAGCGGAGAG {SEQ ID NO:1523} |
| Target162 | chr2:5832990-5833082 | GCGGAGAGTAATTTGTTTCGGGAGGCGT {SEQ ID NO:1524}, GCGGAGAGTAATTTGTTTCGGGAGGCG {SEQ ID NO:1525}, AGCGGAGAGTAATTTGTTTCGGGAGGCG {SEQ ID NO:1526}, AGCGGAGAGTAATTTGTTTCGGGAGGCGT {SEQ ID NO:1527}, GCGGAGAGTAATTTGTTTCGGGAGGCGTT {SEQ ID NO:1528}, TGGAGATTTCGGCGTTGTGTATGTTCGG {SEQ ID NO:1529}, GGAGATTTCGGCGTTGTGTATGTTCGG {SEQ ID NO:1530}, TGGAGATTTCGGCGTTGTGTATGTTCGGA {SEQ ID NO:1531}, GGAGATTTCGGCGTTGTGTATGTTCGGA {SEQ ID NO:1532}, CGGGGTAGTCGGTTATGTGTTTGAGTCGT {SEQ ID NO:1533} |
| Target163 | chr2:5833151-5833215 | AGCGTTGGAAAATGTTGAAGGATAGCGAG {SEQ ID NO:1534}, GCGTTGGAAAATGTTGAAGGATAGCGAGA {SEQ ID NO:1535}, GGTTGGGTAAGCGTTGGAAAATGTTGAAGG {SEQ ID NO:1536}, AGCGTTGGAAAATGTTGAAGGATAGCGAGA {SEQ ID NO:1537}, GGTTGGGTAAGCGTTGGAAAATGTTGAAGGA {SEQ ID NO:1538}, TTTGGTTGGCGTTGGGTTTGGTCGAGG {SEQ ID NO:1539}, TGGGTTTTGGTTGGCGTTGGGTTTGGT {SEQ ID NO:1540}, TGGCGTTGGGTTTGGTCGAGGGGGTTTA {SEQ ID NO:1541}, GGTTTTGGTTGGCGTTGGGTTTGGTCG {SEQ ID NO:1542}, GGGTTTTGGTTGGCGTTGGGTTTGGTC {SEQ ID NO:1543} |
| Target164 | chr2:8314701-8315101 | TGGGGTTGTTTTGAGGAGGAGAGTAGGG {SEQ ID NO:1544}, AGGTGGTATTAGGGGCGGTTTGTTGGAT {SEQ ID NO:1545}, GGGGTTGTTTTGAGGAGGAGAGTAGGG {SEQ ID NO:1546}, TGGGGTTGTTTTGAGGAGGAGAGTAGGGA {SEQ ID NO:1547}, GGGGTTGTTTTGAGGAGGAGAGTAGGGA {SEQ ID NO:1548}, AGTTATGGTGGGGTGGGGGTGGAAGTT {SEQ ID NO:1549}, TAGTTATGGTGGGGTGGGGGTGGAAGT {SEQ ID NO:1550}, GTTATGGTGGGGTGGGGGTGGAAGTTT {SEQ ID NO:1551}, TATGGTGGGGTGGGGGTGGAAGTTTTG {SEQ ID NO:1552}, AGTTATGGTGGGGTGGGGGTGGAAGTTT {SEQ ID NO:1553} |
| Target165 | chr2:10471440-10471578 | CGGGGAGTTCGGAGTTTTGTAGGTACGGG {SEQ ID NO:1554}, GGGGAGTTCGGAGTTTTGTAGGTACGGGG {SEQ ID NO:1555}, TCGGAGTTTTGTAGGTACGGGGTTGGT {SEQ ID NO:1556}, CGGGGAGTTCGGAGTTTTGTAGGTACGG {SEQ ID NO:1557}, GGGAGTTCGGAGTTTTGTAGGTACGGGGT {SEQ ID NO:1558}, TAGGTGGCGAGGTGAGGAAGGAGAGGG {SEQ ID NO:1559}, GATGCGTAGGTGGCGAGGTGAGGAAGG {SEQ ID NO:1560}, CGTAGGTGGCGAGGTGAGGAAGGAGAG {SEQ ID NO:1561}, CGATGCGTAGGTGGCGAGGTGAGGAAG {SEQ ID NO:1562}, GTAGGTGGCGAGGTGAGGAAGGAGAGG {SEQ ID NO:1563} |
| Target166 | chr2:10471621-10471748 | CGTTGGTTGGTGGTGGAGTTGCGTTGA {SEQ ID NO:1564}, TAAGCGTTGGTTGGTGGTGGAGTTGCG {SEQ ID NO:1565}, CGGTTAAGCGTTGGTTGGTGGTGGAGT {SEQ ID NO:1566}, ACGGTTAAGCGTTGGTTGGTGGTGGAG {SEQ ID NO:1567}, GCGTTGGTTGGTGGTGGAGTTGCGTTG {SEQ ID NO:1568}, TGATAGTCGGGCGTGTAGTGGGGGGTA {SEQ ID NO:1569}, TCGGGCGTGTAGTGGGGGGTAGATAGT {SEQ ID NO:1570}, AGTCGGGCGTGTAGTGGGGGGTAGATA {SEQ ID NO:1571}, TAGTCGGGCGTGTAGTGGGGGGTAGAT {SEQ ID NO:1572}, ATAGTCGGGCGTGTAGTGGGGGGTAGA {SEQ ID NO:1573} |
| Target167 | chr2:19550067-19550093 | GCGTGGTTTTGAGCGTGGAGGTTAGGG {SEQ ID NO:1574}, GGGTTGGTTAGTAGGGGGTAGCGTGGT {SEQ ID NO:1575}, AGGGTTGGTTAGTAGGGGGTAGCGTGG {SEQ ID NO:1576}, CGTGGAGGTTAGGGTTGGTTCGCGTCG {SEQ ID NO:1577}, CGTGGTTTTGAGCGTGGAGGTTAGGGT {SEQ ID NO:1578}, TATTGGAGGTTGGTTTTGTCGGCGCGG {SEQ ID NO:1579}, GGAGGTTGGTTTTGTCGGCGCGGATTA {SEQ ID NO:1580}, AGGTTGGTTTTGTCGGCGCGGATTAGT {SEQ ID NO:1581}, GGAGGTTGGTTTTGTCGGCGCGGATTAG {SEQ ID NO:1582}, GTATTGGAGGTTGGTTTTGTCGGCGCG {SEQ ID NO:1583} |
| Target168 | chr2:19550147-19550409 | GGAGGTGGGGATGGGGTGGTGAAAGTT {SEQ ID NO:1584}, GAGGAGGTGGGGATGGGGTGGTGAAAG {SEQ ID NO:1585}, GGGTTGGTTCGCGTCGGTAGGGTTAGT {SEQ ID NO:1586}, AGGGTTGGTTCGCGTCGGTAGGGTTAG {SEQ ID NO:1587}, AGGTTAGGGTTGGTTCGCGTCGGTAGG {SEQ ID NO:1588}, TGTTGGTTGAGAAAGCGGTAGGGGATGT {SEQ ID NO:1589}, GTTGGTTGAGAAAGCGGTAGGGGATGT {SEQ ID NO:1590}, TGTTGGTTGAGAAAGCGGTAGGGGATG {SEQ ID NO:1591}, CGGGTTTTGTTGGTTGAGAAAGCGGTAGGG {SEQ ID NO:1592}, TTTGTTGGTTGAGAAAGCGGTAGGGGA {SEQ ID NO:1593} |

FIGURE 5 CONTINUED

| Target169 | chr2:19556691-19556772 | CGAGTTTGCGTTTGGGGGAGTTTAGTAGT (SEQ ID NO:1594), CGAGTTTGCGTTTGGGGGAGTTTAGTAG (SEQ ID NO:1595), TGAGAACGGGAGCGAATTTTACGAGTTTG (SEQ ID NO:1596), TGGTTTATTCGGGGTTAATTGAGCGTGAGT (SEQ ID NO:1597), AGTGGTTTATTCGGGGTTAATTGAGCGTGA (SEQ ID NO:1598), CGGGGGGTTCGGACGTTTGTTATTATTCGT (SEQ ID NO:1599), CGGGGGGTTCGGACGTTTGTTATTATTCG (SEQ ID NO:1600), CGGGGGGTTCGGACGTTTGTTATTATTCGTT (SEQ ID NO:1601), CGGGGGGTTCGGACGTTTATTATTCGTTGG (SEQ ID NO:1602), CGGGGGGTTCGGACGTTTGTTATTATTCGTTG (SEQ ID NO:1603) |
| Target170 | chr2:19556789-19556914 | CGAGTGGTGATAGGCGTTCGGATTTTCG (SEQ ID NO:1604), CGAGTGGTGATAGGCGTTCGGATTTTCGT (SEQ ID NO:1605), ACGAGTGGTGATAGGCGTTCGGATTTTCG (SEQ ID NO:1606), ACGAGTGGTGATAGGCGTTCGGATTTTCGT (SEQ ID NO:1607), AGGCGTTCGGATTTTCGTGAAGAGGAT (SEQ ID NO:1608), GCGTTGGAGGGGATTAGTAGCGATCGG (SEQ ID NO:1609), AGCGTTGGAGGGGATTAGTAGCGATCGG (SEQ ID NO:1610), AGCGTTGGAGGGGATTAGTAGCGATCG (SEQ ID NO:1611), AAGCGTTGGAGGGGATTAGTAGCGATCGG (SEQ ID NO:1612), AGAAGCGTTGGAGGGGATTAGTAGCGA (SEQ ID NO:1613) |
| Target171 | chr2:19556981-19556988 | GGCGGTTATTCGGTTGTATTTAAATGTTCGTTGCG (SEQ ID NO:1614), GCGGTTATTCGGTTGTATTTAAATGTTCGTTGCG (SEQ ID NO:1615), GGCGGTTATTCGGTTGTATTTAAATGTTCGTTGCGT (SEQ ID NO:1616), GGCGGTTATTCGGTTGTATTTAAATGTTCGTTGC (SEQ ID NO:1617), GCGGTTATTCGGTTGTATTTAAATGTTCGTTGCGT (SEQ ID NO:1618), GCGTTGGAGGGGATTAGTAGCGATCGG (SEQ ID NO:1619), AGCGTTGGAGGGGATTAGTAGCGATCGG (SEQ ID NO:1620), AGCGTTGGAGGGGATTAGTAGCGATCG (SEQ ID NO:1621), AAGCGTTGGAGGGGATTAGTAGCGATCGG (SEQ ID NO:1622), AGAAGCGTTGGAGGGGATTAGTAGCGA (SEQ ID NO:1623) |
| Target172 | chr2:19556991-19557085 | GGCGGTTATTCGGTTGTATTTAAATGTTCGTTGCG (SEQ ID NO:1624), GCGGTTATTCGGTTGTATTTAAATGTTCGTTGCG (SEQ ID NO:1625), GGCGGTTATTCGGTTGTATTTAAATGTTCGTTGCGT (SEQ ID NO:1626), GGCGGTTATTCGGTTGTATTTAAATGTTCGTTGC (SEQ ID NO:1627), GCGGTTATTCGGTTGTATTTAAATGTTCGTTGCGT (SEQ ID NO:1628), TTTAGGGAAGAGAAGCGTTGGAGGGGA (SEQ ID NO:1629), AGGGAAGAGAAGCGTTGGAGGGGATTA (SEQ ID NO:1630), TAGGGAAGAGAAGCGTTGGAGGGGATT (SEQ ID NO:1631), TTAGGGAAGAGAAGCGTTGGAGGGGAT (SEQ ID NO:1632), GGGAAGAGAAGCGTTGGAGGGGATTAGT (SEQ ID NO:1633) |
| Target173 | chr2:30453420-30453497 | GCGGTAGCGTTGGGTTTCGAGTGAGAT (SEQ ID NO:1634), GCGGTAGCGTTGGGTTTCGAGTGAGATT (SEQ ID NO:1635), GCGGTAGCGTTGGGTTTCGAGTGAGA (SEQ ID NO:1636), TGTGGTTTTGGGGGGGTTGCGTAGTTTT (SEQ ID NO:1637), ATGTGGTTTTGGGGGGGTTGCGTAGTTT (SEQ ID NO:1638), GGGCGTTTGTTTAGGTAGTTAAAGTTGCGT (SEQ ID NO:1639), TGGGCGTTTGTTTAGGTAGTTAAAGTTGCG (SEQ ID NO:1640), TGGGCGTTTGTTTAGGTAGTTAAAGTTGCGT (SEQ ID NO:1641), TTGGGCGTTTGTTTAGGTAGTTAAAGTTGCG (SEQ ID NO:1642), TTGGGCGTTTGTTTAGGTAGTTAAAGTTGCGT (SEQ ID NO:1643) |
| Target174 | chr2:30453567-30453656 | TTTGGGTAGTGTGGGAGGCGTTCGGTT (SEQ ID NO:1644), TTTTGGGTAGTGTGGGAGGCGTTCGGT (SEQ ID NO:1645), GAGTTAAGGATGGGGGGCGGCCGTGTAT (SEQ ID NO:1646), AAGACGTGGGAGTTAAGGATGGGGGGC (SEQ ID NO:1647), TAAGGATGGGGGGCGGCCGTGTATATCG (SEQ ID NO:1648), TTTGTAGCGGGGGTAGAAGGTGTGGGC (SEQ ID NO:1649), GCGTTGGTTTGCGAAGGGTTGGTTTGT (SEQ ID NO:1650), TTGTAGCGGGGGTAGAAGGTGTGGGC (SEQ ID NO:1651), GTTTGTAGCGGGGGTAGAAGGTGTGGGC (SEQ ID NO:1652), GGTTTGTAGCGGGGGTAGAAGGTGTGG (SEQ ID NO:1653) |
| Target175 | chr2:30453758-30453913 | GGTTGCGGGCGAGGATTTTAGAGAGAGG (SEQ ID NO:1654), GGTTGCGGGCGAGGATTTTAGAGAGAGGT (SEQ ID NO:1655), TGCGGGCGAGGATTTTAGAGAGAGGTT (SEQ ID NO:1656), TTGCGGGCGAGGATTTTAGAGAGAGGT (SEQ ID NO:1657), AGGTTGCGGGCGAGGATTTTAGAGAGA (SEQ ID NO:1658), ATAGTTCGGCGGTTGTTTTGCGTCGGG (SEQ ID NO:1659), GAGTGTTTACGGGGCGCGTTGGTTTGT (SEQ ID NO:1660), AGAAGCGGTGGGAAGGTGGTAGAGACG (SEQ ID NO:1661), CGAGTGTTTACGGGGCGCGTTGGTTTG (SEQ ID NO:1662), ATCGAGTGTTTACGGGGCGCGTTGGTT (SEQ ID NO:1663) |
| Target176 | chr2:30453966-30454000 | AGAGGGGTTCGAGGTGGGTTGGGGATA (SEQ ID NO:1664), TAGAGGGGTTCGAGGTGGGTTGGGGAT (SEQ ID NO:1665), TTAGAGGGGTTCGAGGTGGGTTGGGGA (SEQ ID NO:1666), AGGGGTTCGAGGTGGGTTGGGGATAGT (SEQ ID NO:1667), GAGGGGTTCGAGGTGGGTTGGGGATAG (SEQ ID NO:1668), ATAGTTCGGCGGTTGTTTTGCGTCGGG (SEQ ID NO:1669), TTTCGAATTTTAGCGCGGCGGAGGTGG (SEQ ID NO:1670), GCGGTTGTTTTGCGTCGGGGTAGGGTA (SEQ ID NO:1671), ATTTCGAATTTTAGCGCGGCGGAGGTGG (SEQ ID NO:1672), CGGTTGTTTTGCGTCGGGGTAGGGTAT (SEQ ID NO:1673) |
| Target177 | chr2:31805327-31805336 | AGGTGAAGGAAGAAAGGGAAGCGGGGCGG (SEQ ID NO:1674), GTGAAGGAAGAAAGGGAAGCGGGGCGG (SEQ ID NO:1675), GGTGAAGGAAGAAAGGGAAGCGGGGCG (SEQ ID NO:1676), GTGAAGGAAGAAAGGGAAGCGGGGCG (SEQ ID NO:1677), GGTGAAGGAAGAAAGGGAAGCGGGGC (SEQ ID NO:1678), AGAGAAAGAGGTTTTGCGGGCGGGAGG (SEQ ID NO:1679), |

FIGURE 5 CONTINUED

GAGAGAAAGAGGTTTTGCGGGCGGGAG (SEQ ID NO:1680), CGAGAGAAAGAGGTTTTGCGGGCGGGA (SEQ ID NO:1681), CGAGAGAAAGAGGTTTTGCGGGCGGG (SEQ ID NO:1682), GAGAAAGAGGTTTTGCGGGCGGGAGG (SEQ ID NO:1683)

Target178     chr2:31805451-31805496     GGAGTGAAGGCGGCGTTTGTGTCGTAG (SEQ ID NO:1684), GTTTTGGGGGAGTGAAGGCGGCGTTTG (SEQ ID NO:1685), AGAGCGGATGAGGTTTTGGGGGAGTGA (SEQ ID NO:1686), TGAGAGCGGATGAGGTTTTGGGGGAGT (SEQ ID NO:1687), AGTGAAGGCGGCGTTTGTGTCGTAGTC (SEQ ID NO:1688), AGGAACGCGGAGGTTAGTTTGTTTGGC (SEQ ID NO:1689), GAGGAACGCGGAGGTTAGTTTGTTTGGC (SEQ ID NO:1690), TGAGGAACGCGGAGGTTAGTTTGTTTGGC (SEQ ID NO:1691), GTGAGGAACGCGGAGGTTAGTTTGTTTGGC (SEQ ID NO:1692), TGTGAGGAACGCGGAGGTTAGTTTGTT (SEQ ID NO:1693)

Target179     chr2:31805530-31805547     GGAGTGAAGGCGGCGTTTGTGTCGTAG (SEQ ID NO:1694), GTTTTGGGGGAGTGAAGGCGGCGTTTG (SEQ ID NO:1695), AGAGCGGATGAGGTTTTGGGGGAGTGA (SEQ ID NO:1696), TGAGAGCGGATGAGGTTTTGGGGGAGT (SEQ ID NO:1697), AGTGAAGGCGGCGTTTGTGTCGTAGTC (SEQ ID NO:1698), AGGAACGCGGAGGTTAGTTTGTTTGGC (SEQ ID NO:1699), GAGGAACGCGGAGGTTAGTTTGTTTGGC (SEQ ID NO:1700), TGAGGAACGCGGAGGTTAGTTTGTTTGGC (SEQ ID NO:1701), GTGAGGAACGCGGAGGTTAGTTTGTTTGGC (SEQ ID NO:1702), TGTGAGGAACGCGGAGGTTAGTTTGTT (SEQ ID NO:1703)

Target180     chr2:31805579-31805627     GGAGTGAAGGCGGCGTTTGTGTCGTAG (SEQ ID NO:1704), GTTTTGGGGGAGTGAAGGCGGCGTTTG (SEQ ID NO:1705), AGTGAAGGCGGCGTTTGTGTCGTAGTC (SEQ ID NO:1706), GAGTGAAGGCGGCGTTTGTGTCGTAGT (SEQ ID NO:1707), GGGAGTGAAGGCGGCGTTTGTGTCGTA (SEQ ID NO:1708), TGCGGGCGTTTAGTGTAGCGTATTGTT (SEQ ID NO:1709), TTGCGGGCGTTTAGTGTAGCGTATTGT (SEQ ID NO:1710), TGCGGGCGTTTAGTGTAGCGTATTGTTT (SEQ ID NO:1711), TTGCGGGCGTTTAGTGTAGCGTATTGTT (SEQ ID NO:1712), GCGGGCGTTTAGTGTAGCGTATTGTTT (SEQ ID NO:1713)

Target181     chr2:31805639-31805672     GGACGTCGGGAGTAGGGTAGTGCGTTG (SEQ ID NO:1714), TTTGGACGTCGGGAGTAGGGTAGTGCG (SEQ ID NO:1715), GACGTCGGGAGTAGGGTAGTGCGTTGT (SEQ ID NO:1716), TGGACGTCGGGAGTAGGGTAGTGCGTT (SEQ ID NO:1717), TTGGACGTCGGGAGTAGGGTAGTGCGT (SEQ ID NO:1718), GGTGTTCGCGGGGATTTTCGTTCGGTA (SEQ ID NO:1719), GGTGTTCGCGGGGATTTTCGTTCGGT (SEQ ID NO:1720), GGTGTTCGCGGGGATTTTCGTTCGGTAG (SEQ ID NO:1721), TGTTCGCGGGGATTTTCGTTCGGTAGT (SEQ ID NO:1722), CGGTGTTCGCGGGGATTTTCGTTCGGT (SEQ ID NO:1723)

Target182     chr2:31805762-31805779     GGAGAGGGGTTGTCGGGCGAGGATTTT (SEQ ID NO:1724), GGGTAGTGCGTTGTATTGGGCGTTCGT (SEQ ID NO:1725), AGGGTAGTGCGTTGTATTGGGCGTTCG (SEQ ID NO:1726), GAGAGGGGTTGTCGGGCGAGGATTTTC (SEQ ID NO:1727), GGAGAGGGGTTGTCGGGCGAGGATTT (SEQ ID NO:1728), GCGGTTATTCGTTTGTTAGTTCGCGTCG (SEQ ID NO:1729), GCGGTTATTCGTTTGTTAGTTCGCGTCGT (SEQ ID NO:1730), TCGTTTGTTAGTTCGCGTCGTTTGGTT (SEQ ID NO:1731), TTCGTTTGTTAGTTCGCGTCGTTTGGT (SEQ ID NO:1732), CGCGTCGTTTGGTTTTTGTAGGAGTTGT (SEQ ID NO:1733)

Target183     chr2:31805785-31805818     GGAGAGGGGTTGTCGGGCGAGGATTTT (SEQ ID NO:1734), GAGAGGGGTTGTCGGGCGAGGATTTTC (SEQ ID NO:1735), GGAGAGGGGTTGTCGGGCGAGGATTT (SEQ ID NO:1736), GGAGAGGGGTTGTCGGGCGAGGATTTTC (SEQ ID NO:1737), GAAGAGGGAGAGGGGTTGTCGGGCGAG (SEQ ID NO:1738), TGGGGTATTGGTTTTGTACGTCGCGAA (SEQ ID NO:1739), TTGGGGTATTGGTTTTGTACGTCGCGA (SEQ ID NO:1740), TGGGGTATTGGTTTTGTACGTCGCGAAGT (SEQ ID NO:1741), GGGGTATTGGTTTTGTACGTCGCGAAGT (SEQ ID NO:1742), TGGGGTATTGGTTTTGTACGTCGCGAAG (SEQ ID NO:1743)

Target184     chr2:31805820-31805872     GGAGAGGGGTTGTCGGGCGAGGATTTT (SEQ ID NO:1744), TAGGAATTAGGCGGCGCGGGTTGGTAG (SEQ ID NO:1745), TTTGTAGGAATTAGGCGGCGCGGGTTG (SEQ ID NO:1746), GTAGGAATTAGGCGGCGCGGGTTGGTA (SEQ ID NO:1747), TTTTGTAGGAATTAGGCGGCGCGGGTT (SEQ ID NO:1748), TGGGGTATTGGTTTTGTACGTCGCGAA (SEQ ID NO:1749), TTGGGGTATTGGTTTTGTACGTCGCGA (SEQ ID NO:1750), CGAGGAATACGGCGCGATGTAGGTTTA (SEQ ID NO:1751), TGGGGTATTGGTTTTGTACGTCGCGAAGT (SEQ ID NO:1752), GGGGTATTGGTTTTGTACGTCGCGAAGT (SEQ ID NO:1753)

Target185     chr2:31805886-31805916     TAGGAATTAGGCGGCGCGGGTTGGTAG (SEQ ID NO:1754), TTTGTAGGAATTAGGCGGCGCGGGTTG (SEQ ID NO:1755), GTAGGAATTAGGCGGCGCGGGTTGGTA (SEQ ID NO:1756), TTTTGTAGGAATTAGGCGGCGCGGGTT (SEQ ID NO:1757), TTTTTGTAGGAATTAGGCGGCGCGGGT (SEQ ID NO:1758), CGAGGAATACGGCGCGATGTAGGTTTA (SEQ ID NO:1759), ACGGCGCGATGTAGGTTTAGTGTTAGT (SEQ ID NO:1760), CGAGGAATACGGCGCGATGTAGGTTTAG (SEQ ID NO:1761), CGAGGAATACGGCGCGATGTAGGTTTAGT (SEQ ID NO:1762), CGAGGAATACGGCGCGATGTAGGTTT (SEQ ID NO:1763)

Target186     chr2:38301518-38301736     GCGGTGGATAGGGTGTTTTGGTTGGCG (SEQ ID NO:1764), CGCGGTGGATAGGGTGTTTTGGTTGGC (SEQ ID NO:1765), GCGCGGTGGATAGGGTGTTTTGGTTGG (SEQ ID NO:1766), AGCGCGGTGGATAGGGTGTTTTGGTTG (SEQ ID NO:1767), CGGTGGATAGGGTGTTTTGGTTGGCGT (SEQ ID NO:1768), GCGCGCGGTTGGATTTGGAGAACGTAT (SEQ ID NO:1769), CGGAAAAGAAGGCGGTCGGGGATTCGT (SEQ ID NO:1770), TTGCGGAAAAGAAGGCGGTCGGGGATT (SEQ ID NO:1771), TTTGCGGAAAAGAAGGCGGTCGGGGAT (SEQ ID NO:1772), TTTTGCGGAAAAGAAGGCGGTCGGGGA (SEQ ID NO:1773)

FIGURE 5 CONTINUED

Target187    chr2:38301748-38301774    TGTTGAAGTTGCGGTTGAGTTGTTCGA (SEQ ID NO:1774), TGTTGAAGTTGCGGTTGAGTTGTTCGAA (SEQ ID NO:1775), TTGTTGAAGTTGCGGTTGAGTTGTTCGA (SEQ ID NO:1776), GTTGTTGAAGTTGCGGTTGAGTTGTTCG (SEQ ID NO:1777), AGTTGTTGAAGTTGCGGTTGAGTTGTTCG (SEQ ID NO:1778), GCGGGTAGTTTGGTGGACGTGATGTTT (SEQ ID NO:1779), GTACGGTGGGCGCGGGTAGTTTGGTG (SEQ ID NO:1780), GTACGGTGGGCGCGGGTAGTTTGGTGG (SEQ ID NO:1781), TACGGTGGGCGCGGGTAGTTTGGTG (SEQ ID NO:1782), GTACGGTGGGCGCGGGTAGTTTGGT (SEQ ID NO:1783)

Target188    chr2:38301867-38301884    CGGTGCGTATCGGGTTGGGGAAGTATT (SEQ ID NO:1784), CGGTGCGTATCGGGTTGGGGAAGTATTG (SEQ ID NO:1785), CGGTGCGTATCGGGTTGGGGAAGTATTGT (SEQ ID NO:1786), GGTGCGTATCGGGTTGGGGAAGTATTGT (SEQ ID NO:1787), GGTGCGTATCGGGTTGGGGAAGTATTG (SEQ ID NO:1788), GCGAGTTGGTGGCGTTGTTGGTGC (SEQ ID NO:1789), GCGAGTTGGTGGCGTTGTTGGTGCG (SEQ ID NO:1790), CGAGTTGGTGGCGTTGTTGGTGCG (SEQ ID NO:1791), CGTTATGAGTGTCGTGTGTTTCGGTTGT (SEQ ID NO:1792), CGTTATGAGTGTCGTGTGTTTCGGTTGTC (SEQ ID NO:1793)

Target189    chr2:38301901-38301923    GGGGTCGTCGTGGTTGTAGCGGTAGTC (SEQ ID NO:1794), GGGGTCGTCGTGGTTGTAGCGGTAGT (SEQ ID NO:1795), CGGGGTCGTCGTGGTTGTAGCGGTAGT (SEQ ID NO:1796), CGGGGTCGTCGTGGTTGTAGCGGTAG (SEQ ID NO:1797), GGGTCGTCGTGGTTGTAGCGGTAGTC (SEQ ID NO:1798), TTCGAGGGTTACGTGTTGAGCGAGGCG (SEQ ID NO:1799), TTTCGAGGGTTACGTGTTGAGCGAGGC (SEQ ID NO:1800), TCGAGGGTTACGTGTTGAGCGAGGCG (SEQ ID NO:1801), TTTCGAGGGTTACGTGTTGAGCGAGGCG (SEQ ID NO:1802), TTTTCGAGGGTTACGTGTTGAGCGAGGC (SEQ ID NO:1803)

Target190    chr2:38301931-38301959    GGGGTCGTCGTGGTTGTAGCGGTAGTC (SEQ ID NO:1804), GGGGTCGTCGTGGTTGTAGCGGTAGT (SEQ ID NO:1805), CGGGGTCGTCGTGGTTGTAGCGGTAGT (SEQ ID NO:1806), CGGGGTCGTCGTGGTTGTAGCGGTAG (SEQ ID NO:1807), GGGTCGTCGTGGTTGTAGCGGTAGTC (SEQ ID NO:1808), TTCGAGGGTTACGTGTTGAGCGAGGC (SEQ ID NO:1809), TTTCGAGGGTTACGTGTTGAGCGAGGC (SEQ ID NO:1810), TCGAGGGTTACGTGTTGAGCGAGGCG (SEQ ID NO:1811), TTTCGAGGGTTACGTGTTGAGCGAGGCG (SEQ ID NO:1812), TTTTCGAGGGTTACGTGTTGAGCGAGGC (SEQ ID NO:1813)

Target191    chr2:38301974-38301983    GGGGTCGTCGTGGTTGTAGCGGTAGTC (SEQ ID NO:1814), GGGGTCGTCGTGGTTGTAGCGGTAGT (SEQ ID NO:1815), CGGGGTCGTCGTGGTTGTAGCGGTAGT (SEQ ID NO:1816), CGGGGTCGTCGTGGTTGTAGCGGTAG (SEQ ID NO:1817), GGGTCGTCGTGGTTGTAGCGGTAGTC (SEQ ID NO:1818), TTCGAGGGTTACGTGTTGAGCGAGGCG (SEQ ID NO:1819), TTTCGAGGGTTACGTGTTGAGCGAGGC (SEQ ID NO:1820), TCGAGGGTTACGTGTTGAGCGAGGCG (SEQ ID NO:1821), TTTCGAGGGTTACGTGTTGAGCGAGGCG (SEQ ID NO:1822), TTTTCGAGGGTTACGTGTTGAGCGAGGC (SEQ ID NO:1823)

Target192    chr2:45029057-45029072    GCGGTCGTTTGGGCGTGATTTTTTGGT (SEQ ID NO:1824), GGTGCGGTCGTTTGGGCGTGATTTTTT (SEQ ID NO:1825), TGCGGTCGTTTGGGCGTGATTTTTTGG (SEQ ID NO:1826), CGGTGCGGTCGTTTGGGCGTGATTTTTT (SEQ ID NO:1827), AGGGGCGTAGAGGGAAGGATTAGCGTT (SEQ ID NO:1828), GGAAAGGGCGGTGGTTGTGGGTAAAGC (SEQ ID NO:1829), GGGCGGTGGTTGTGGGTAAAGCGTTTT (SEQ ID NO:1830), GAAAGGGCGGTGGTTGTGGGTAAAGCG (SEQ ID NO:1831), AGGGCGGTGGTTGTGGGTAAAGCGTTT (SEQ ID NO:1832), AAGGGCGGTGGTTGTGGGTAAAGCGTT (SEQ ID NO:1833)

Target193    chr2:45029106-45029129    AGGGGCGTAGAGGGAAGGATTAGCGTT (SEQ ID NO:1834), TGGTTGGGGGTTGTAGGGGGTTCGTTTT (SEQ ID NO:1835), TTGGTTGGGGGTTGTAGGGGGTTCGTTT (SEQ ID NO:1836), TAGGGGCGTAGAGGGAAGGATTAGCGT (SEQ ID NO:1837), TGTAGGGGGTTCGTTTTTTAGGGGCGT (SEQ ID NO:1838), GGAAAGGGCGGTGGTTGTGGGTAAAGC (SEQ ID NO:1839), GCGCGGGTTTTCGTAGGGAGAAGAGGA (SEQ ID NO:1840), GGGCGGTGGTTGTGGGTAAAGCGTTTT (SEQ ID NO:1841), GAAAGGGCGGTGGTTGTGGGTAAAGCG (SEQ ID NO:1842), AGGGAGAAGAGGAGGAGAGTCGGCGTC (SEQ ID NO:1843)

Target194    chr2:45029176-45029190    AGAGCGAGGTTAAGGTTTGGGGGTAGT (SEQ ID NO:1844), GAGAGCGAGGTTAAGGTTTGGGGGTAGT (SEQ ID NO:1845), GAGAGCGAGGTTAAGGTTTGGGGGTAG (SEQ ID NO:1846), GAGCGAGGTTAAGGTTTGGGGGTAGTT (SEQ ID NO:1847), AGAGCGAGGTTAAGGTTTGGGGGTAGTT (SEQ ID NO:1848), GCGCGGGTTTTCGTAGGGAGAAGAGGA (SEQ ID NO:1849), CGGCGGTGGTTTAGTCGTTGGGTTTCG (SEQ ID NO:1850), AGGGAGAAGAGGAGGAGAGTCGGCGTC (SEQ ID NO:1851), TTTTTTAGGATTGGGTTCGGGCGGCGC (SEQ ID NO:1852), TAGGGAGAAGAGGAGGAGAGTCGGCGT (SEQ ID NO:1853)

Target195    chr2:45227645-45227657    GGGTGTCGGTTTGGGGGTTTTGGATTGG (SEQ ID NO:1854), GGTGTCGGTTTGGGGGTTTTGGATTGG (SEQ ID NO:1855), GGTGTCGGTTTGGGGGTTTTGGATTGG (SEQ ID NO:1856), GGGTGTCGGTTTGGGGGTTTTGGATTG (SEQ ID NO:1857), GTGTCGGTTTGGGGGTTTTGGATTGGT (SEQ ID NO:1858), GGGTTTTGAGGTTAGGGGAGCGTGGGA (SEQ ID NO:1859), TTTCGGTTCGTTGAGTCGGCGGTTTGG (SEQ ID NO:1860), TGGGTTTTGAGGTTAGGGGAGCGTGGG (SEQ ID NO:1861), TTCGGTTCGTTGAGTCGGCGGTTTGGT (SEQ ID NO:1862), TCGGTTCGTTGAGTCGGCGGTTTGGTC (SEQ ID NO:1863)

Target196    chr2:45227701-45227718    GCGTTTTGGGTTTTAGGTTTTTGTTTTACGGT (SEQ ID NO:1864), AGCGTTTTGGGTTTTAGGTTTTTGTTTTACGGT (SEQ ID NO:1865), GCGTTTTGGGTTTTAGGTTTTTGTTTTACGGTT (SEQ ID NO:1866),

FIGURE 5 CONTINUED

|  |  |  |
|---|---|---|
|  |  | TGGGTTTTAGGTTTTTGTTTTACGGTTAGGTCG (SEQ ID NO:1867), AAGCGTTTTGGGTTTTAGGTTTTTGTTTTACGG (SEQ ID NO:1868), GGGTTTTGAGGTTAGGGGAGCGTGGGA (SEQ ID NO:1869), TGGGTTTTGAGGTTAGGGGAGCGTGGG (SEQ ID NO:1870), GGCGGGGGCGGTTTTTTAGGGAGAGTA (SEQ ID NO:1871), GGGTTTTGAGGTTAGGGGAGCGTGGGAT (SEQ ID NO:1872), GCGGGGGCGGTTTTTTAGGGAGAGTAA (SEQ ID NO:1873) |
| Target197 | chr2:45227791-45227834 | GGCGGGGGCGGTTTTTTAGGGAGAGTA (SEQ ID NO:1874), GCGGGGGCGGTTTTTTAGGGAGAGTAA (SEQ ID NO:1875), GGCGGGGGCGGTTTTTTAGGGAGAGTAA (SEQ ID NO:1876), GGCGGGGGCGGTTTTTTAGGGAGAGT (SEQ ID NO:1877), GCGGGGGCGGTTTTTTAGGGAGAGTAAT (SEQ ID NO:1878) |
| Target198 | chr2:45227917-45227934 | TTTTTGGAGTCGGTTTGCGGTGAGGTCG (SEQ ID NO:1879), TTTTTGGAGTCGGTTTGCGGTGAGGTCG (SEQ ID NO:1880), TTTGGAGTCGGTTTGCGGTGAGGTCG (SEQ ID NO:1881), TTCGTCGGGGTAAGTGGGAGTTGTTGT (SEQ ID NO:1882), TTTTTGGAGTCGGTTTGCGGTGAGGTC (SEQ ID NO:1883), TCGGAGAGGTCGGTATAAAGGCGGATA (SEQ ID NO:1884), TCGGAGAGGTCGGTATAAAGGCGGAT (SEQ ID NO:1885), TCGGAGAGGTCGGTATAAAGGCGGATAT (SEQ ID NO:1886), CGGAGAGGTCGGTATAAAGGCGGATATG (SEQ ID NO:1887), CGGAGAGGTCGGTATAAAGGCGGATATGA (SEQ ID NO:1888) |
| Target199 | chr2:45227960-45228019 | GGAGTCGGTTTGCGGTGAGGTCGGTAT (SEQ ID NO:1889), TTTTGGAGTCGGTTTGCGGTGAGGTCG (SEQ ID NO:1890), TTTGGAGTCGGTTTGCGGTGAGGTCGG (SEQ ID NO:1891), GGAGTCGGTTTGCGGTGAGGTCGGTA (SEQ ID NO:1892), TGGAGTCGGTTTGCGGTGAGGTCGGTA (SEQ ID NO:1893), TCGGAGAGGTCGGTATAAAGGCGGATA (SEQ ID NO:1894), TCGGAGAGGTCGGTATAAAGGCGGAT (SEQ ID NO:1895), TCGGAGAGGTCGGTATAAAGGCGGATAT (SEQ ID NO:1896), CGGAGAGGTCGGTATAAAGGCGGATATG (SEQ ID NO:1897), CGGAGAGGTCGGTATAAAGGCGGATATGA (SEQ ID NO:1898) |
| Target200 | chr2:45231539-45231586 | GGGGGCGTTGTAGGTTAATTGATAGTTACGG (SEQ ID NO:1899), AGGGGGCGTTGTAGGTTAATTGATAGTTACGG (SEQ ID NO:1900), GGGGGCGTTGTAGGTTAATTGATAGTTACGGA (SEQ ID NO:1901), AGGGGGCGTTGTAGGTTAATTGATAGTTACGGA (SEQ ID NO:1902), AGGGGGCGTTGTAGGTTAATTGATAGTTACG (SEQ ID NO:1903) |
| Target201 | chr2:45231697-45231725 | GGTCGTCGGTTCGGTCGTTTTGAGTTCG (SEQ ID NO:1904), GTCGTCGGTTCGGTCGTTTTGAGTTCG (SEQ ID NO:1905), GGTCGTCGGTTCGGTCGTTTTGAGTTC (SEQ ID NO:1906), GGTCGTCGGTTCGGTCGTTTTGAGTT (SEQ ID NO:1907), TCGTCGGTTCGGTCGTTTTGAGTTCG (SEQ ID NO:1908), AAATCGGATTTAGGGCGGTCGGGTCGG (SEQ ID NO:1909), AATCGGATTTAGGGCGGTCGGGTCGG (SEQ ID NO:1910), TTTCGGTGTTGCGTGTGGTAGTGGAGT (SEQ ID NO:1911), AGTTTCGGTGTTGCGTGTGGTAGTGGA (SEQ ID NO:1912), GTTTCGGTGTTGCGTGTGGTAGTGGAGT (SEQ ID NO:1913) |
| Target202 | chr2:45231782-45232069 | GGTCGTCGGTTCGGTCGTTTTGAGTTCG (SEQ ID NO:1914), TCGTCGGTTCGGTCGTTTTGAGTTCGA (SEQ ID NO:1915), GTCGTCGGTTCGGTCGTTTTGAGTTCG (SEQ ID NO:1916), GGTCGTCGGTTCGGTCGTTTTGAGTTC (SEQ ID NO:1917), GTCGTCGGTTCGGTCGTTTTGAGTTCGA (SEQ ID NO:1918), TCGTTGTAGAAGCGGGGAGGGGTAGTT (SEQ ID NO:1919), TTCGTTGTAGAAGCGGGGAGGGGTAGT (SEQ ID NO:1920), TTTCGGTGTTGCGTGTGGTAGTGGAGT (SEQ ID NO:1921), AGTTTCGGTGTTGCGTGTGGTAGTGGA (SEQ ID NO:1922), GTTTCGGTGTTGCGTGTGGTAGTGGAGT (SEQ ID NO:1923) |
| Target203 | chr2:45232071-45232426 | GCGTCGTTGGTGTGGGGAGGGTAGTAG (SEQ ID NO:1924), CGTCGTTGGTGTGGGGAGGGTAGTAGG (SEQ ID NO:1925), GTCGTTGGTGTGGGGAGGGTAGTAGGT (SEQ ID NO:1926), GCGTCGTTGGTGTGGGGAGGGTAGTA (SEQ ID NO:1927), CGCGTCGTTGGTGTGGGGAGGGTAGTA (SEQ ID NO:1928), ATTTCGGGTGGGTCGTTTTGGTTGGCG (SEQ ID NO:1929), TTTCGGGTGGGTCGTTTTGGTTGGCGA (SEQ ID NO:1930), GCGGGTCGGGAGTGTAGTTGTGTTTGA (SEQ ID NO:1931), TCGTTGTAGAAGCGGGGAGGGGTAGTT (SEQ ID NO:1932), TTCGTTGTAGAAGCGGGGAGGGGTAGT (SEQ ID NO:1933) |
| Target204 | chr2:45232433-45232535 | CGGTGTGGCGGGGGTTTCGTTAAGAGAG (SEQ ID NO:1934), GCGGTGTGGCGGGGGTTTCGTTAAGAGA (SEQ ID NO:1935), GCGGTGTGGCGGGGGTTTCGTTAAGAG (SEQ ID NO:1936), CGGTGTGGCGGGGGTTTCGTTAAGAGAGA (SEQ ID NO:1937), GGTGTGGCGGGGGTTTCGTTAAGAGAGA (SEQ ID NO:1938), TGTGGGTTAGTGGGAGTTGTAGGTGTTAGT (SEQ ID NO:1939), CGTTTATGTGGGTTAGTGGGAGTTGTAGGT (SEQ ID NO:1940), TCGTTTATGTGGGTTAGTGGGAGTTGTAGG (SEQ ID NO:1941), TCGTTTATGTGGGTTAGTGGGAGTTGTAGGT (SEQ ID NO:1942), TGTGGGTTAGTGGGAGTTGTAGGTGTTAGT (SEQ ID NO:1943) |
| Target205 | chr2:45232541-45232569 | CGAGGCGGCCGTTTAGGGGTTTTTGTGG (SEQ ID NO:1944), CGGTGTGGCGGGGGTTTCGTTAAGAGAG (SEQ ID NO:1945), GAGGCGGCCGTTTAGGGGTTTTTGTGGC (SEQ ID NO:1946), GCGGTGTGGCGGGGGTTTCGTTAAGAGA (SEQ ID NO:1947), GCGGTGTGGCGGGGGTTTCGTTAAGAG (SEQ ID NO:1948), TGTGGGTTAGTGGGAGTTGTAGGTGTTAGT (SEQ ID NO:1949), CGTTTATGTGGGTTAGTGGGAGTTGTAGGT (SEQ ID NO:1950), TCGTTTATGTGGGTTAGTGGGAGTTGTAGG (SEQ ID NO:1951), TCGTTTATGTGGGTTAGTGGGAGTTGTAGGT (SEQ ID NO:1952), TGTGGGTTAGTGGGAGTTGTAGGTGTTAGTT (SEQ ID NO:1953) |

FIGURE 5 CONTINUED

| | | |
|---|---|---|
| Target206 | chr2:47270902-47271041 | AGGATGTGGTCGGGTTGAGAAAATTCGT (SEQ ID NO:1954), TGGTCGGGTTGAGAAAATTCGTTTTGGGT (SEQ ID NO:1955), GGTCGGGTTGAGAAAATTCGTTTTGGGT (SEQ ID NO:1956), TGGTCGGGTTGAGAAAATTCGTTTTGGG (SEQ ID NO:1957), GTGGTCGGGTTGAGAAAATTCGTTTTGGG (SEQ ID NO:1958), TGAGGGTCGGAATGGGTTTAGGGTAGA (SEQ ID NO:1959), TTTTGAGGGTCGGAATGGGTTTAGGGT (SEQ ID NO:1960), TTGAGGGTCGGAATGGGTTTAGGGTAGA (SEQ ID NO:1961), GGGTCGGAATGGGTTTAGGGTAGATTCG (SEQ ID NO:1962), TGAGGGTCGGAATGGGTTTAGGGTAGAT (SEQ ID NO:1963) |
| Target207 | chr2:66666251-66666865 | TTGGGTTTGGGGGAGGGGGAGGAAAAG (SEQ ID NO:1964), TGGATGTGTAGTGGAGGGGACGAGGGT (SEQ ID NO:1965), AGGGGAATGTGCGTGGAGTTGAGGAGG (SEQ ID NO:1966), AGGGAGGGGAATGTGCGTGGAGTTGAG (SEQ ID NO:1967), CGGTTATTTGGGTTTGGGGGAGGGGGA (SEQ ID NO:1968), GTTGGGGAGGGTTGGTTTTTGCGGGTT (SEQ ID NO:1969), GAGTTGGGGAGGGTTGGTTTTTGCGGG (SEQ ID NO:1970), AGGATTCGGTGGAGGAGAAAGGCGTCG (SEQ ID NO:1971), TTCGGGGGGATTTCGGTGGTAGGCGTTT (SEQ ID NO:1972), TAGGTTCGGGGGATTTCGGTGGTAGGC (SEQ ID NO:1973) |
| Target208 | chr2:69026808-69027254 | GTCGCGGTGGGAATTGGGTTGTGGTTT (SEQ ID NO:1974), GATGTCGCGGTGGGAATTGGGTTGTGG (SEQ ID NO:1975), GGATGTCGCGGTGGGAATTGGGTTGTG (SEQ ID NO:1976), CGAGGGGAAGTGTTGGGGGAAGAAGGG (SEQ ID NO:1977), GGTCGGGAGGGTTGGGGTAGGTGTAGA (SEQ ID NO:1978), TGGGGATGTGAGGTATGGTAGGGTCGA (SEQ ID NO:1979), TTGGGGATGTGAGGTATGGTAGGGTCG (SEQ ID NO:1980), TGGGGATGTGAGGTATGGTAGGGTCGAA (SEQ ID NO:1981), TTGGGGATGTGAGGTATGGTAGGGTCGA (SEQ ID NO:1982), GGGGATGTGAGGTATGGTAGGGTCGAA (SEQ ID NO:1983) |
| Target209 | chr2:71115936-71115963 | TATGGGTTTTGGTCGGGAGGAATGAGC (SEQ ID NO:1984), ATGGGTTTTGGTCGGGAGGAATGAGC (SEQ ID NO:1985), TTATGGGTTTTGGTCGGGAGGAATGAGC (SEQ ID NO:1986), TGGGTTTTGGTCGGGAGGAATGAGC (SEQ ID NO:1987), ATTATGGGTTTTGGTCGGGAGGAATGAGC (SEQ ID NO:1988) |
| Target210 | chr2:71115968-71116031 | CGCGTGGAGGGTTCGGTCGGTATTC (SEQ ID NO:1989), TATGGGTTTTGGTCGGGAGGAATGAGC (SEQ ID NO:1990), ATGGGTTTTGGTCGGGAGGAATGAGC (SEQ ID NO:1991), TTATGGGTTTTGGTCGGGAGGAATGAGC (SEQ ID NO:1992), CGCGTGGAGGGTTCGGTCGGTATT (SEQ ID NO:1993) |
| Target211 | chr2:71116036-71116068 | CGCGTGGAGGGTTCGGTCGGTATTC (SEQ ID NO:1994), TATGGGTTTTGGTCGGGAGGAATGAGC (SEQ ID NO:1995), GCGGGGAGGTTGTATCGGGAAGTTTAA (SEQ ID NO:1996), GCGGGGAGGTTGTATCGGGAAGTTTAAGT (SEQ ID NO:1997), ATGGGTTTTGGTCGGGAGGAATGAGC (SEQ ID NO:1998) |
| Target212 | chr2:71116096-71116227 | GCGGTCGTTAGAGGGCGCGGTTTATAT (SEQ ID NO:1999), GCGGTCGTTAGAGGGCGCGGTTTATATT (SEQ ID NO:2000), CGCGTTCGGAATTTGGGTTTTTCGGTGT (SEQ ID NO:2001), CGCGTTCGGAATTTGGGTTTTTCGGTG (SEQ ID NO:2002), GCGGTCGTTAGAGGGCGCGGTTTATA (SEQ ID NO:2003), TCGGATTGGGTTCGGGAAAGGTAGCGG (SEQ ID NO:2004), GGATTGGGTTCGGGAAAGGTAGCGGT (SEQ ID NO:2005), GGGTTCGGGAAAGGTAGCGGGTATTGC (SEQ ID NO:2006), CGGATTGGGTTCGGGAAAGGTAGCGGG (SEQ ID NO:2007), GGGTTTCGGATTGGGTTCGGGAAAGGT (SEQ ID NO:2008) |
| Target213 | chr2:71116233-71116330 | CGGGGATTTTGATTTCGCGCGGATTTC (SEQ ID NO:2009), CGGGGATTTTGATTTCGCGCGGATTT (SEQ ID NO:2010), TGGGTTTTTCGGTGTAGTTTTTTCGCGA (SEQ ID NO:2011), CGGGGATTTTGATTTCGCGCGGATT (SEQ ID NO:2012), TTGGGTTTTTCGGTGTAGTTTTTTCGCGA (SEQ ID NO:2013), GAGGTTCGCGCGAGGTTAAGGTTTTCG (SEQ ID NO:2014), AGGTTCGCGCGAGGTTAAGGTTTTCG (SEQ ID NO:2015), AGGGAGAGTTAAGTAAGGCGACGAGGT (SEQ ID NO:2016), GGGAGAGTTAAGTAAGGCGACGAGGTT (SEQ ID NO:2017), AGGGAGAGTTAAGTAAGGCGACGAGGTT (SEQ ID NO:2018) |
| Target214 | chr2:71116334-71116353 | CGGGGATTTTGATTTCGCGCGGATTTC (SEQ ID NO:2019), CGGGGATTTTGATTTCGCGCGGATTT (SEQ ID NO:2020), CGGGGATTTTGATTTCGCGCGGATT (SEQ ID NO:2021), CGGGGATTTTGATTTCGCGCGGAT (SEQ ID NO:2022), CGGGGATTTTGATTTCGCGCGGA (SEQ ID NO:2023), CGGGAAGTTTTTATTTTGGTTATAGTCGCGCG (SEQ ID NO:2024), CGGGAAGTTTTTATTTTGGTTATAGTCGCGCGA (SEQ ID NO:2025), GCGGAGAGAGGCGGCGGGG (SEQ ID NO:2026), GGGAAGTTTTTATTTTGGTTATAGTCGCGCGA (SEQ ID NO:2027), AGGCGGGAAGTTTTTATTTTGGTTATAGTCGC (SEQ ID NO:2028) |
| Target215 | chr2:71116373-71116394 | GCGGTAATTTTTCGTTTCGGTTTTGGCGC (SEQ ID NO:2029), CGCGGTAATTTTTCGTTTCGGTTTTGGCGC (SEQ ID NO:2030), GCGGTAATTTTTCGTTTCGGTTTTGGCGC (SEQ ID NO:2031), CGGTAATTTTTCGTTTCGGTTTTGGCGC (SEQ ID NO:2032), CGCGGTAATTTTTCGTTTCGGTTTTGGCG (SEQ ID NO:2033), CGGGTTGGGGATAATGCGGGGGTAGTA (SEQ ID NO:2034), CGGGTTGGGGATAATGCGGGGGTAGT (SEQ ID NO:2035), CGGGTTGGGGATAATGCGGGGGTAGTAG (SEQ ID NO:2036), GGGTTGGGGATAATGCGGGGGTAGTAGT (SEQ ID NO:2037), GGGTTGGGGATAATGCGGGGGTAGTAG (SEQ ID NO:2038) |
| Target216 | chr2:71116407-71116485 | TCGCGCGGTTGTGATTAGGATAAGGGT (SEQ ID NO:2039), CGTTCGCGCGGTTGTGATTAGGATAAGGG (SEQ ID NO:2040), CGCGCGGTTGTGATTAGGATAAGGGTT (SEQ ID NO:2041), TCGCGCGGTTGTGATTAGGATAAGGGTT (SEQ ID NO:2042), TTCGCGCGGTTGTGATTAGGATAAGGGT (SEQ ID NO:2043), CGGGTTGGGGATAATGCGGGGGTAGTA (SEQ ID NO:2044), TTTGTTTGGGTTTTGGGGGTGCGAGCG (SEQ ID NO:2045), ACGTTTTGTTTGGGTTTTGGGGGTGCG (SEQ |

FIGURE 5 CONTINUED

ID NO:2046), TTTTGTTTGGGTTTTGGGGGTGCGAGC (SEQ ID NO:2047),
CGGGTTGGGGATAATGCGGGGGTAGT (SEQ ID NO:2048)

| | | |
|---|---|---|
| Target217 | chr2:71116500-71116531 | TCGCGCGGTTGTGATTAGGATAAGGGT (SEQ ID NO:2049), CGTTCGCGCGGTTGTGATTAGGATAAGGG (SEQ ID NO:2050), CGCGCGGTTGTGATTAGGATAAGGGTT (SEQ ID NO:2051), TCGCGCGGTTGTGATTAGGATAAGGGT (SEQ ID NO:2052), TTCGCGCGGTTGTGATTAGGATAAGGGT (SEQ ID NO:2053), TTTGTTTGGGTTTTGGGGGTGCGAGCG (SEQ ID NO:2054), ACGTTTTGTTTGGGTTTTGGGGGTGCG (SEQ ID NO:2055), TTTTGTTTGGGTTTTGGGGGTGCGAGC (SEQ ID NO:2056), ACGTTTTGTTTGGGTTTTGGGGGTGCGA (SEQ ID NO:2057), CGTTTTGTTTGGGTTTTGGGGGTGCGA (SEQ ID NO:2058) |
| Target218 | chr2:73147283-73147306 | GGTTCGGAGGAGAGGGCGGGGTC (SEQ ID NO:2059), GGTTCGGAGGAGAGGGCGGGGT (SEQ ID NO:2060), GGGTTCGGAGGAGAGGGCGGGGTC (SEQ ID NO:2061), CGGAGTCGGTATTTTGGGTCGTATTTTCGG (SEQ ID NO:2062), CGGAGTCGGTATTTTGGGTCGTATTTTCGGT (SEQ ID NO:2063), AGGAAGCGGCGGTAATTTTTAAGAGGGT (SEQ ID NO:2064), GCGGCGGTAATTTTTAAGAGGGTTTTGCG (SEQ ID NO:2065), AGCGGCGGTAATTTTTAAGAGGGTTTTGCG (SEQ ID NO:2066), GCGGCGGTAATTTTTAAGAGGGTTTTGCGA (SEQ ID NO:2067), AGCGGCGGTAATTTTTAAGAGGGTTTTGCGA (SEQ ID NO:2068) |
| Target219 | chr2:73147350-73147383 | AGGGTCGGGGGCGTTTGGAGAGAAATT (SEQ ID NO:2069), GAGGGTCGGGGGCGTTTGGAGAGAAAT (SEQ ID NO:2070), GGGTCGGGGGCGTTTGGAGAGAAATTT (SEQ ID NO:2071), AGGGTCGGGGGCGTTTGGAGAGAAATTT (SEQ ID NO:2072), AGGGTCGGGGGCGTTTGGAGAGAAAT (SEQ ID NO:2073), AGGAAGCGGCGGTAATTTTTAAGAGGGT (SEQ ID NO:2074), GCGGCGGTAATTTTTAAGAGGGTTTTGCG (SEQ ID NO:2075), AGCGGCGGTAATTTTTAAGAGGGTTTTGCG (SEQ ID NO:2076), GCGGCGGTAATTTTTAAGAGGGTTTTGCGA (SEQ ID NO:2077), AGCGGCGGTAATTTTTAAGAGGGTTTTGCGA (SEQ ID NO:2078) |
| Target220 | chr2:73147432-73147445 | GGGTCGGGGGCGTTTGGAGAGAAATTT (SEQ ID NO:2079), TGAGCGTTTTTAGTTAGGCGAGGCGGA (SEQ ID NO:2080), GGGTCGGGGGCGTTTGGAGAGAAATT (SEQ ID NO:2081), TTGAGCGTTTTTAGTTAGGCGAGGCGG (SEQ ID NO:2082), GGGTCGGGGGCGTTTGGAGAGAAATTTA (SEQ ID NO:2083), TCGCGTTTAGATTCGGTTTTTGAGGGAAAA (SEQ ID NO:2084), TTCGCGTTTAGATTCGGTTTTTGAGGGAAA (SEQ ID NO:2085), TTTCGCGTTTAGATTCGGTTTTTGAGGGAA (SEQ ID NO:2086), TTTTCGCGTTTAGATTCGGTTTTTGAGGGA (SEQ ID NO:2087), TTCGCGTTTAGATTCGGTTTTTGAGGGAAAA (SEQ ID NO:2088) |
| Target221 | chr2:73147537-73147621 | TGGACGCGGAGATGGAGTTAAGTGTGGT (SEQ ID NO:2089), GGACGCGGAGATGGAGTTAAGTGTGGT (SEQ ID NO:2090), TGGACGCGGAGATGGAGTTAAGTGTGG (SEQ ID NO:2091), GGACGCGGAGATGGAGTTAAGTGTGGTT (SEQ ID NO:2092), TTGGACGCGGAGATGGAGTTAAGTGTGG (SEQ ID NO:2093), AGGTTTGGTCGGGATTGGAGGGCGTAG (SEQ ID NO:2094), GGTTTGGTCGGGATTGGAGGGCGTAGA (SEQ ID NO:2095), GAGGTTTGGTCGGGATTGGAGGGCGTA (SEQ ID NO:2096), GGCGTAGAGTCGTCGGGGAGCGTATTC (SEQ ID NO:2097), TAGAGGTTTGGTCGGGATTGGAGGGCG (SEQ ID NO:2098) |
| Target222 | chr2:73147668-73147679 | AGGTTTTTGGGTTGGGAGTCGAGTCGT (SEQ ID NO:2099), GGTTTTTGGGTTGGGAGTCGAGTCGTT (SEQ ID NO:2100), AGGTTTTTGGGTTGGGAGTCGAGTCGTT (SEQ ID NO:2101), CGGTTAGGTTTTTGGGTTGGGAGTCGA (SEQ ID NO:2102), TCGGTTAGGTTTTTGGGTTGGGAGTCG (SEQ ID NO:2103), TCGTTCGTGTGGGGTTTCGTTTGTTGT (SEQ ID NO:2104), TTCGTTCGTGTGGGGTTTCGTTTGTTGT (SEQ ID NO:2105), TTCGTTCGTGTGGGGTTTCGTTTGTTG (SEQ ID NO:2106), CGTTCGTGTGGGGTTTCGTTTGTTGTA (SEQ ID NO:2107), TTTCGTTCGTGTGGGGTTTCGTTTGTT (SEQ ID NO:2108) |
| Target223 | chr2:73147687-73147711 | AGGTTTTTGGGTTGGGAGTCGAGTCGT (SEQ ID NO:2109), GGTTTTTGGGTTGGGAGTCGAGTCGTT (SEQ ID NO:2110), AGGTTTTTGGGTTGGGAGTCGAGTCGTT (SEQ ID NO:2111), CGGTTAGGTTTTTGGGTTGGGAGTCGA (SEQ ID NO:2112), TCGGTTAGGTTTTTGGGTTGGGAGTCG (SEQ ID NO:2113), GCGTCGTTTAAGCGTTGCGTAGAGAGC (SEQ ID NO:2114), TCGTTCGTGTGGGGTTTCGTTTGTTGT (SEQ ID NO:2115), TTCGTTCGTGTGGGGTTTCGTTTGTTGT (SEQ ID NO:2116), TTCGTTCGTGTGGGGTTTCGTTTGTTG (SEQ ID NO:2117), CGTTCGTGTGGGGTTTCGTTTGTTGTA (SEQ ID NO:2118) |
| Target224 | chr2:73147720-73147968 | ATCGAGGCGTTGGAAGGGGAAAAGCGA (SEQ ID NO:2119), CGAGGCGTTGGAAGGGGAAAAGCGAAT (SEQ ID NO:2120), AATCGAGGCGTTGGAAGGGGAAAAGCG (SEQ ID NO:2121), TCGAGGCGTTGGAAGGGGAAAAGCGAA (SEQ ID NO:2122), CGAGGCGTTGGAAGGGGAAAAGCGAATG (SEQ ID NO:2123), GCGTCGTTTAAGCGTTGCGTAGAGAGC (SEQ ID NO:2124), TCGTTCGTGTGGGGTTTCGTTTGTTGT (SEQ ID NO:2125), TTCGTTCGTGTGGGGTTTCGTTTGTTGT (SEQ ID NO:2126), TTCGTTCGTGTGGGGTTTCGTTTGTTG (SEQ ID NO:2127), CGTTCGTGTGGGGTTTCGTTTGTTGTA (SEQ ID NO:2128) |
| Target225 | chr2:73148052-73148084 | CGGGTTTAGGAGTAACGTTTGGAGGGGG (SEQ ID NO:2129), CGGGTTTAGGAGTAACGTTTGGAGGGGGT (SEQ ID NO:2130), TCGGGTTTAGGAGTAACGTTTGGAGGGGG (SEQ ID NO:2131), GGGAGGAGTCGACGAAGATTAGGAGTGGG (SEQ ID NO:2132), |

FIGURE 5 CONTINUED

GGGGAGGAGTCGACGAAGATTAGGGAGTGG (SEQ ID NO:2133), GTCGGTTAGGGGGTTTAGGGTCGGACGG (SEQ ID NO:2134), CGTCGTCGGTTAGGGGGTTTAGGGTCGG (SEQ ID NO:2135), AGGGAGAGGGGAGAGGTAGGGATAGGCGGC (SEQ ID NO:2136), GGGGAGAGGTAGGGATAGGCGGCGGAGAT (SEQ ID NO:2137), ACGGTTGGGCGGAGGGTTTTAGGGGTTA (SEQ ID NO:2138)

| Target226 | chr2:74725894-74726747 | TAGAGGGTGTTCGGGGGATTATGCGCG (SEQ ID NO:2139), GCGGTTCGGTTGTTCGTTGCGTTAGGT (SEQ ID NO:2140), GGGGAGGATTAGGGTGGGTGGTTTGGG (SEQ ID NO:2141), GGGGGATTATGCGCGGGGTTAGGATGT (SEQ ID NO:2142), CGGCGTAGAGGGTGTTCGGGGGATTAT (SEQ ID NO:2143), GAGGTTGGGGGTTCGGATTGGGAGTCG (SEQ ID NO:2144), CGAGGTTGGGGGTTCGGATTGGGAGTC (SEQ ID NO:2145), GGTGGGGGCGTAGGAGGAGGGGTATAC (SEQ ID NO:2146), AGGTTGGGGGTTCGGATTGGGAGTCGA (SEQ ID NO:2147), AGGTGGGGGCGTAGGAGGAGGGGTATA (SEQ ID NO:2148) |

| Target227 | chr2:74726766-74726785 | GCGGTTCGGTTGTTCGTTGCGTTAGGT (SEQ ID NO:2149), GGCGGTTCGGTTGTTCGTTGCGTTAGG (SEQ ID NO:2150), GGGCGGTTCGGTTGTTCGTTGCGTTAG (SEQ ID NO:2151), GAGTTTATGGTCGGTCGGGTTGGGGCG (SEQ ID NO:2152), GCGGTTCGGTTGTTCGTTGCGTTAGGTT (SEQ ID NO:2153), GGTGGGGGCGTAGGAGGAGGGGTATAC (SEQ ID NO:2154), AGGTGGGGGCGTAGGAGGAGGGGTATA (SEQ ID NO:2155), GGTGGGGGCGTAGGAGGAGGGGTATA (SEQ ID NO:2156), GAGGTGGGGGCGTAGGAGGAGGGGTAT (SEQ ID NO:2157), GTGGGGGCGTAGGAGGAGGGGTATAC (SEQ ID NO:2158) |

| Target228 | chr2:74726809-74726893 | TCGGGTCGCGGTGGATTTGGAGTTTTT (SEQ ID NO:2159), TTCGGGTCGCGGTGGATTTGGAGTTTT (SEQ ID NO:2160), TTTCGGGTCGCGGTGGATTTGGAGTTT (SEQ ID NO:2161), ATTTCGGGTCGCGGTGGATTTGGAGTT (SEQ ID NO:2162), TATTTCGGGTCGCGGTGGATTTGGAGT (SEQ ID NO:2163), AGCGTTTGGAGGTATGGTTCGGTTTGA (SEQ ID NO:2164), TCGGTTTGATTGTGTACGGTGTAGCGT (SEQ ID NO:2165), CGGTTTGATTGTGTACGGTGTAGCGTT (SEQ ID NO:2166), GGTTCGGTTTGATTGTGTACGGTGTAGCG (SEQ ID NO:2167), GGTTCGGTTTGATTGTGTACGGTGTAGCGT (SEQ ID NO:2168) |

| Target229 | chr2:74726908-74727022 | GGTTGGGGTAGGCGCGGAGAGTAGAAG (SEQ ID NO:2169), TAGGTTGGGGTAGGCGCGGAGAGTAGA (SEQ ID NO:2170), AGGTTGGGGTAGGCGCGGAGAGTAGAA (SEQ ID NO:2171), GTTGGGGTAGGCGCGGAGAGTAGAAGT (SEQ ID NO:2172), GCGTTGCGGGGCGTTGTATCGTGTATA (SEQ ID NO:2173), AGCGTTTGGAGGTATGGTTCGGTTTGA (SEQ ID NO:2174), TCGGTTTGATTGTGTACGGTGTAGCGT (SEQ ID NO:2175), CGGTTTGATTGTGTACGGTGTAGCGTT (SEQ ID NO:2176), GGTTCGGTTTGATTGTGTACGGTGTAGCG (SEQ ID NO:2177), GGTTCGGTTTGATTGTGTACGGTGTAGCGT (SEQ ID NO:2178) |

| Target230 | chr2:85811382-85811589 | GGGGTCGTTGGTATTGCGGTCGTTTCG (SEQ ID NO:2179), CGGGGTCGTTGGTATTGCGGTCGTTTC (SEQ ID NO:2180), AGGTTTTTGGGGTTCGGGAGGGTTCGA (SEQ ID NO:2181), GGGTCGTTGGTATTGCGGTCGTTTCGT (SEQ ID NO:2182), CGGGGTCGTTGGTATTGCGGTCGTTT (SEQ ID NO:2183), TTTTGTTCGTCGTAGGGTTGGTCGGTT (SEQ ID NO:2184), TTTTTGTTCGTCGTAGGGTTGGTCGGT (SEQ ID NO:2185), TTCGGAGGAAGAGTAGGGGCGGGGC (SEQ ID NO:2186), TTCGGAGGAAGAGTAGGGGCGGGG (SEQ ID NO:2187), CGTTTTTTGTTCGTCGTAGGGTTGGTCGG (SEQ ID NO:2188) |

| Target231 | chr2:85811597-85811726 | GGGGTCGTTGGTATTGCGGTCGTTTCG (SEQ ID NO:2189), CGGGGTCGTTGGTATTGCGGTCGTTTC (SEQ ID NO:2190), AGTAGCGATGGTGAGGGTTTAGGCGGG (SEQ ID NO:2191), AGTGGCGAGGGTGGGAGAGAGGAGTTT (SEQ ID NO:2192), GTAGCGATGGTGAGGGTTTAGGCGGGG (SEQ ID NO:2193), GCGTAGGGAGTGGAGGGTTCGTTTCGT (SEQ ID NO:2194), GCGTAGGGAGTGGAGGGTTCGTTTCGTT (SEQ ID NO:2195), CGTAGGGAGTGGAGGGTTCGTTTCGTT (SEQ ID NO:2196), GCGTAGGGAGTGGAGGGTTCGTTTCG (SEQ ID NO:2197), GGGAGTGGAGGGTTCGTTTCGTTTTGT (SEQ ID NO:2198) |

| Target232 | chr2:85811743-85812024 | AGTGGCGAGGGTGGGAGAGAGGAGTTT (SEQ ID NO:2199), CGGGGTCGGTTAGTTTTGCGACGGGTA (SEQ ID NO:2200), AGTTTTGCGACGGGTAGAGGGCGAGTG (SEQ ID NO:2201), TAGTTTTGCGACGGGTAGAGGGCGAGT (SEQ ID NO:2202), GGTTAGTTTTGCGACGGGTAGAGGGCG (SEQ ID NO:2203), GCGTAGGGAGTGGAGGGTTCGTTTCGT (SEQ ID NO:2204), GCGTAGGGAGTGGAGGGTTCGTTTCGTT (SEQ ID NO:2205), GACGCGGAAAAGGAGGTTTAGGGAGGT (SEQ ID NO:2206), CGTAGGGAGTGGAGGGTTCGTTTCGTT (SEQ ID NO:2207), AGACGCGGAAAAGGAGGTTTAGGGAGGT (SEQ ID NO:2208) |

| Target233 | chr2:86163587-86163632 | TTGGGAGAAGGGTGTGGTTGGGGGTTGC (SEQ ID NO:2209), TTTGGGAGAAGGGTGTGGTTGGGGTTG (SEQ ID NO:2210), TTTTGGGAGAAGGGTGTGGTTGGGGTT (SEQ ID NO:2211), TTTTTGGGAGAAGGGTGTGGTTGGGGT (SEQ ID NO:2212), TGGGAGAAGGGTGTGGTTGGGGGTTGC (SEQ ID NO:2213), AGGAGGAATTTTGAGATGGGGTTAGAATAGGGT (SEQ ID NO:2214), GGAGGAATTTTGAGATGGGGTTAGAATAGGGTT (SEQ ID NO:2215), AGGAGGAATTTTGAGATGGGGTTAGAATAGGGTT (SEQ ID NO:2216), TAGGAGGAATTTTGAGATGGGGTTAGAATAGGGT (SEQ ID NO:2217), AGGAGGAATTTTGAGATGGGGTTAGAATAGGGTA (SEQ ID NO:2218) |

| Target234 | chr2:86163860-86163938 | CGGGAAGGGGTAGGAGTGGGAGGTTTT (SEQ ID NO:2219), GCGGGAAGGGGTAGGAGTGGGAGGTTT (SEQ ID NO:2220), CGGGAAGGGGTAGGAGTGGGAGGTTTTT (SEQ ID NO:2221), CGGGAAGGGGTAGGAGTGGGAGGTTT (SEQ ID NO:2222), GCGGGAAGGGGTAGGAGTGGGAGGTT (SEQ ID NO:2223), CGGGAGAATGGGCGTAGTTTTTTGGTT (SEQ ID NO:2224), CGGGAGAATGGGCGTAGTTTTTTGGTTT (SEQ ID NO:2225), CGGGAGAATGGGCGTAGTTTTTTGGTTTT |

FIGURE 5 CONTINUED (SEQ ID NO:2226), CGGGAGAATGGGCGTAGTTTTTTGGTTTTT (SEQ ID NO:2227),
TGGGCGTAGTTTTTTGGTTTTTGTATGGGG (SEQ ID NO:2228)

| | | |
|---|---|---|
| Target235 | chr2:86164076-86164203 | TTAGGTTTGGTCGGGGTTGGTAGCGGG (SEQ ID NO:2229), GGGGTACGGGGAGGTGGGAGTTGATTT (SEQ ID NO:2230), GTTTGGTCGGGGTTGGTAGCGGGGTAC (SEQ ID NO:2231), GTTAGGTTTGGTCGGGGTTGGTAGCGG (SEQ ID NO:2232), AGTTAGGTTTGGTCGGGGTTGGTAGCGG (SEQ ID NO:2233), TGTCGTGGGTTAGGGTTGGGTAAGAGT (SEQ ID NO:2234), TGTCGTGGGTTAGGGTTGGGTAAGAGTT (SEQ ID NO:2235), TTGTCGTGGGTTAGGGTTGGGTAAGAGT (SEQ ID NO:2236), GTCGTGGGTTAGGGTTGGGTAAGAGTT (SEQ ID NO:2237), TTGTCGTGGGTTAGGGTTGGGTAAGAG (SEQ ID NO:2238) |
| Target236 | chr2:89064644-89064868 | AGGGCGGCGTAGTTTGTGGGGTTTTTG (SEQ ID NO:2239), TTTCGGTTCGGGTTGTAGGAGGCGTGT (SEQ ID NO:2240), GTTGGTAAGGGCGGCGTAGTTTGTGGG (SEQ ID NO:2241), TGGGTTTCGGTTCGGGTTGTAGGAGGC (SEQ ID NO:2242), GAGCGTTGGGTATGGGTTTCGGTTCGG (SEQ ID NO:2243), GGGGTTCGTACGGTTGGAGGCGTAGTT (SEQ ID NO:2244), GGTTGGGGTTGGCGGGGTTTATTTGGG (SEQ ID NO:2245), TTTGGTTCGTGTGTTGGTGGCGGTTGT (SEQ ID NO:2246), GGGGTTGGCGGGGTTTATTTGGGATGG (SEQ ID NO:2247), GGTTGGAGGCGTAGTTTTGGTCGGGGA (SEQ ID NO:2248) |
| Target237 | chr2:89064904-89065163 | TTTCGGTTCGGGTTGTAGGAGGCGTGT (SEQ ID NO:2249), GGAGTCGGTGGAAGAGGAGAAGAGCGC (SEQ ID NO:2250), GAGTCGGTGGAAGAGGAGAAGAGCGCG (SEQ ID NO:2251), GGGAGTCGGTGGAAGAGGAGAAGAGCG (SEQ ID NO:2252), TGGGTTTCGGTTCGGGTTGTAGGAGGC (SEQ ID NO:2253), AGGCGGAAGGATTGGATTCGGGGTTGT (SEQ ID NO:2254), CGAGGCGGAAGGATTGGATTCGGGGTT (SEQ ID NO:2255), GAGGCGGAAGGATTGGATTCGGGGTTG (SEQ ID NO:2256), GGCGGAAGGATTGGATTCGGGGTTGTT (SEQ ID NO:2257), AGGCGGAAGGATTGGATTCGGGGTTGTT (SEQ ID NO:2258) |
| Target238 | chr2:95401381-95401629 | GGGGATATGGGGAGTTGGTTGAAGGCGT (SEQ ID NO:2259), GGGGATATGGGGAGTTGGTTGAAGGCG (SEQ ID NO:2260), CGGGGATATGGGGAGTTGGTTGAAGGC (SEQ ID NO:2261), TCGGGGATATGGGGAGTTGGTTGAAGGC (SEQ ID NO:2262), GGGAGTTGGTTGAAGGCGTAAAGGAGCG (SEQ ID NO:2263), GCGTGGTGGCGTTGTGTTTGGTTTGAG (SEQ ID NO:2264), CGGTGGTGGCGGGAAGTTTTAGGTCGT (SEQ ID NO:2265), CGTGGTGGCGTTGTGTTTGGTTTGAGG (SEQ ID NO:2266), GCGGTGGTGGCGGGAAGTTTTAGGTC (SEQ ID NO:2267), CGTGGTGGCGTTGTGTTTGGTTTGAGGT (SEQ ID NO:2268) |
| Target239 | chr2:99438970-99439638 | GTTGGTTCGTTTTAGCGGGCGGGAGAC (SEQ ID NO:2269), GGGGTTCGGGGAGATTTTGGAGGTCGT (SEQ ID NO:2270), GGTTAGGTTTCGCGTGTTGGGGTTCGG (SEQ ID NO:2271), GGGTTAGGTTTCGCGTGTTGGGGTTCG (SEQ ID NO:2272), TGGGGTTCGGGGAGATTTTGGAGGTCG (SEQ ID NO:2273), GGCGGAAAGTAGGATGGGGAGGCGTTT (SEQ ID NO:2274), ACGGATAAGGCGGAGGAGGTGGTTTGT (SEQ ID NO:2275), AGGAGAAGGGGTTTTTAGGGTCGGCGT (SEQ ID NO:2276), GGTTACGGATAAGGCGGAGGAGGTGGT (SEQ ID NO:2277), GCGGAAAGTAGGATGGGGAGGCGTTT (SEQ ID NO:2278) |
| Target240 | chr2:99439662-99439907 | TTTGGTACGGGTTTTTTCGGGTGGCGG (SEQ ID NO:2279), TGGTACGGGTTTTTTCGGGTGGCGGTA (SEQ ID NO:2280), AGGGCGTCGGTGGTTTAGGTTTAGGGT (SEQ ID NO:2281), GGTACGGGTTTTTTCGGGTGGCGGTAA (SEQ ID NO:2282), GCGGTAAGGGCGTCGGTGGTTTAGGTT (SEQ ID NO:2283), GTTTACGGTTAGCGTGGAGGAGGGGGG (SEQ ID NO:2284), GTTAGCGTGGAGGAGGGGGCGTTTTC (SEQ ID NO:2285), TTTACGGTTAGCGTGGAGGAGGGGGG (SEQ ID NO:2286), TTAGCGTGGAGGAGGGGGGCGTTTTC (SEQ ID NO:2287), TTTACGGTTAGCGTGGAGGAGGGGGGC (SEQ ID NO:2288) |
| Target241 | chr2:105459126-105459192 | CGAGGAGGGGGGTTGGGGTAGAATAAT (SEQ ID NO:2289), CGAGGAGGGGGGGTTGGGGTAGAATAATT (SEQ ID NO:2290), CGAGGAGGGGGGGTTGGGGTAGAATAA (SEQ ID NO:2291), TGTTTTGTTTTGTTTTGTTTTGCGCGCGT (SEQ ID NO:2292), GTTTTGTTTTGTTTTGTTTTGCGCGCGT (SEQ ID NO:2293), GAGGGTAGAGCGGCGGGGAATAGTGTG (SEQ ID NO:2294), TCGGTGAGCGCGTTTTAGAGGAGTCGT (SEQ ID NO:2295), GTTGGTTTGGGTCGGGTTGGGTCGTTT (SEQ ID NO:2296), TAGGTTGGTTTGGGTCGGGTTGGGTCG (SEQ ID NO:2297), AGAGGGTAGAGCGGCGGGGAATAGTGT (SEQ ID NO:2298) |
| Target242 | chr2:105459219-105459243 | TGTTTTGTTTTGTTTTGTTTTGCGCGCGT (SEQ ID NO:2299), GTTTTGTTTTGTTTTGTTTTGCGCGCGT (SEQ ID NO:2300), TGTTTTGTTTTGTTTTGTTTTGCGCGCG (SEQ ID NO:2301), TTGTTTTGTTTTGTTTTGTTTTGCGCGCG (SEQ ID NO:2302), TTGTTTTGTTTTGTTTTGTTTTGCGCGCGT (SEQ ID NO:2303), GTTGGTTTGGGTCGGGTTGGGTCGTTT (SEQ ID NO:2304), TAGGTTGGTTTGGGTCGGGTTGGGTCG (SEQ ID NO:2305), TTGGTTTGGGTCGGGTTGGGTCGTTTT (SEQ ID NO:2306), GGTTGGTTTGGGTCGGGTTGGGTCGTT (SEQ ID NO:2307), GTTGGTTTGGGTCGGGTTGGGTCGTTTT (SEQ ID NO:2308) |
| Target243 | chr2:105459288-105459368 | GTTGTTTTTGTGGGGAGGTAGCGCGGT (SEQ ID NO:2309), TCGTTGTTTTTGTGGGGAGGTAGCGCGC (SEQ ID NO:2310), CGTTGTTTTTGTGGGGAGGTAGCGCGCG (SEQ ID NO:2311), TGTTTTTGTGGGGAGGTAGCGCGCGGTT (SEQ ID NO:2312), TTGTTTTTGTGGGGAGGTAGCGCGCGTT (SEQ ID NO:2313), AGCGGGGTGGGTAGTCGGCGTTATTTT (SEQ ID NO:2314), AGAGAGGGTTATAGAGGGAGGCGCGGA (SEQ ID NO:2315), GAGCGGGGTGGGTAGTCGGCGTTATTT (SEQ ID NO:2316), GCGGGGTGGGTAGTCGGCGTTATTTTT (SEQ ID NO:2317), GAGAGGGTTATAGAGGGAGGCGCGGAG (SEQ ID NO:2318) |

FIGURE 5 CONTINUED

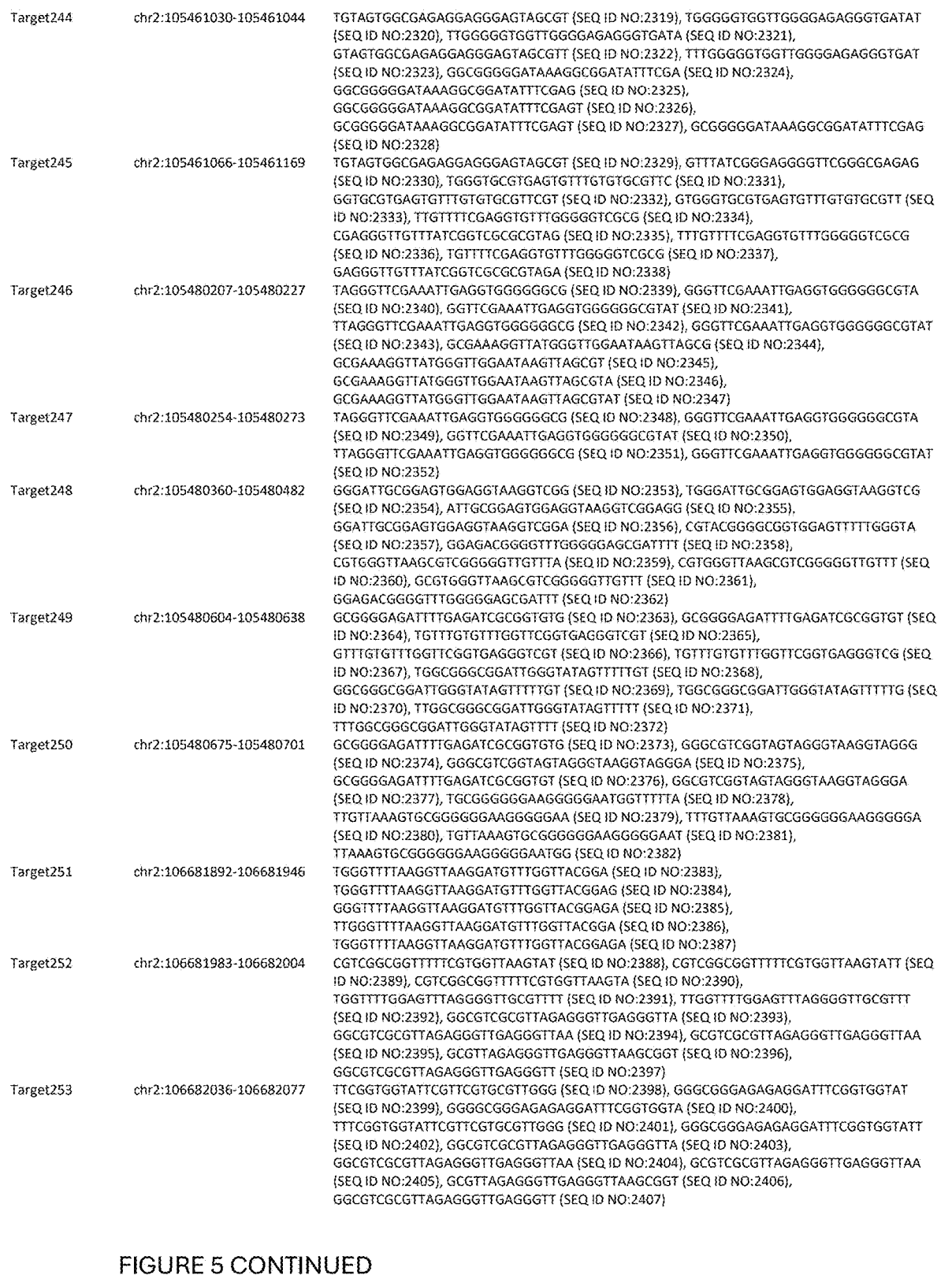

Target244 chr2:105461030-105461044 TGTAGTGGCGAGAGGAGGGAGTAGCGT (SEQ ID NO:2319), TGGGGGTGGTTGGGGAGAGGGTGATAT (SEQ ID NO:2320), TTGGGGGTGGTTGGGGAGAGGGTGATA (SEQ ID NO:2321), GTAGTGGCGAGAGGAGGGAGTAGCGTT (SEQ ID NO:2322), TTTGGGGGTGGTTGGGGAGAGGGTGAT (SEQ ID NO:2323), GGCGGGGGGATAAAGGCGGATATTTCGA (SEQ ID NO:2324), GGCGGGGGATAAAGGCGGATATTTCGAG (SEQ ID NO:2325), GGCGGGGGATAAAGGCGGATATTTCGAGT (SEQ ID NO:2326), GCGGGGGATAAAGGCGGATATTTCGAGT (SEQ ID NO:2327), GCGGGGGATAAAGGCGGATATTTCGAG (SEQ ID NO:2328)

Target245 chr2:105461066-105461169 TGTAGTGGCGAGAGGAGGGAGTAGCGT (SEQ ID NO:2329), GTTTATCGGGAGGGGTTCGGGCGAGAG (SEQ ID NO:2330), TGGGTGCGTGAGTGTTTGTGTGCGTTC (SEQ ID NO:2331), GGTGCGTGAGTGTTTGTGTGCGTTCGT (SEQ ID NO:2332), GTGGGTGCGTGAGTGTTTGTGTGCGTT (SEQ ID NO:2333), TTGTTTTCGAGGTGTTTGGGGGTCGCG (SEQ ID NO:2334), CGAGGGTTGTTTATCGGTCGCGCGTAG (SEQ ID NO:2335), TTTGTTTTCGAGGTGTTTGGGGGTCGCG (SEQ ID NO:2336), TGTTTTCGAGGTGTTTGGGGGTCGCG (SEQ ID NO:2337), GAGGGTTGTTTATCGGTCGCGCGTAGA (SEQ ID NO:2338)

Target246 chr2:105480207-105480227 TAGGGTTCGAAATTGAGGTGGGGGGGCG (SEQ ID NO:2339), GGGTTCGAAATTGAGGTGGGGGGGCGTA (SEQ ID NO:2340), GGTTCGAAATTGAGGTGGGGGGGCGTAT (SEQ ID NO:2341), TTAGGGTTCGAAATTGAGGTGGGGGGGCG (SEQ ID NO:2342), GGGTTCGAAATTGAGGTGGGGGGGCGTAT (SEQ ID NO:2343), GCGAAAGGTTATGGGTTGGAATAAGTTAGCG (SEQ ID NO:2344), GCGAAAGGTTATGGGTTGGAATAAGTTAGCGT (SEQ ID NO:2345), GCGAAAGGTTATGGGTTGGAATAAGTTAGCGTA (SEQ ID NO:2346), GCGAAAGGTTATGGGTTGGAATAAGTTAGCGTAT (SEQ ID NO:2347)

Target247 chr2:105480254-105480273 TAGGGTTCGAAATTGAGGTGGGGGGGCG (SEQ ID NO:2348), GGGTTCGAAATTGAGGTGGGGGGGCGTA (SEQ ID NO:2349), GGTTCGAAATTGAGGTGGGGGGGCGTAT (SEQ ID NO:2350), TTAGGGTTCGAAATTGAGGTGGGGGGGCG (SEQ ID NO:2351), GGGTTCGAAATTGAGGTGGGGGGGCGTAT (SEQ ID NO:2352)

Target248 chr2:105480360-105480482 GGGATTGCGGAGTGGAGGTAAGGTCGG (SEQ ID NO:2353), TGGGATTGCGGAGTGGAGGTAAGGTCG (SEQ ID NO:2354), ATTGCGGAGTGGAGGTAAGGTCGGAGG (SEQ ID NO:2355), GGATTGCGGAGTGGAGGTAAGGTCGGA (SEQ ID NO:2356), CGTACGGGGCGGTGGAGTTTTTGGGTA (SEQ ID NO:2357), GGAGACGGGGTTTGGGGGAGCGATTTT (SEQ ID NO:2358), CGTGGGTTAAGCGTCGGGGGTTGTTTA (SEQ ID NO:2359), CGTGGGTTAAGCGTCGGGGGTTGTTT (SEQ ID NO:2360), GCGTGGGTTAAGCGTCGGGGGTTGTTT (SEQ ID NO:2361), GGAGACGGGGTTTGGGGGAGCGATTT (SEQ ID NO:2362)

Target249 chr2:105480604-105480638 GCGGGGGAGATTTTGAGATCGCGGTGTG (SEQ ID NO:2363), GCGGGGGAGATTTTGAGATCGCGGTGT (SEQ ID NO:2364), TGTTTGTGTTTGGTTCGGTGAGGGTCGT (SEQ ID NO:2365), GTTTGTGTTTGGTTCGGTGAGGGTCGT (SEQ ID NO:2366), TGTTTGTGTTTGGTTCGGTGAGGGTCG (SEQ ID NO:2367), TGGCGGGCGGATTGGGTATAGTTTTTGT (SEQ ID NO:2368), GGCGGGCGGATTGGGTATAGTTTTTGT (SEQ ID NO:2369), TGGCGGGCGGATTGGGTATAGTTTTTG (SEQ ID NO:2370), TTGGCGGGCGGATTGGGTATAGTTTTT (SEQ ID NO:2371), TTTGGCGGGCGGATTGGGTATAGTTTT (SEQ ID NO:2372)

Target250 chr2:105480675-105480701 GCGGGGGAGATTTTGAGATCGCGGTGTG (SEQ ID NO:2373), GGGCGTCGGTAGTAGGGTAAGGTAGGG (SEQ ID NO:2374), GGGCGTCGGTAGTAGGGTAAGGTAGGGA (SEQ ID NO:2375), GCGGGGGAGATTTTGAGATCGCGGTGT (SEQ ID NO:2376), GGCGTCGGTAGTAGGGTAAGGTAGGGA (SEQ ID NO:2377), TGCGGGGGGGAAGGGGGAATGGTTTTTA (SEQ ID NO:2378), TTGTTAAAGTGCGGGGGGGAAGGGGGAA (SEQ ID NO:2379), TTTGTTAAAGTGCGGGGGGGAAGGGGGA (SEQ ID NO:2380), TGTTAAAGTGCGGGGGGGAAGGGGGAAT (SEQ ID NO:2381), TTAAAGTGCGGGGGGGAAGGGGGAATGG (SEQ ID NO:2382)

Target251 chr2:106681892-106681946 TGGGTTTTAAGGTTAAGGATGTTTGGTTACGGA (SEQ ID NO:2383), TGGGTTTTAAGGTTAAGGATGTTTGGTTACGGAG (SEQ ID NO:2384), GGGTTTTAAGGTTAAGGATGTTTGGTTACGGAGA (SEQ ID NO:2385), TTGGGTTTTAAGGTTAAGGATGTTTGGTTACGGA (SEQ ID NO:2386), TGGGTTTTAAGGTTAAGGATGTTTGGTTACGGAGA (SEQ ID NO:2387)

Target252 chr2:106681983-106682004 CGTCGGCGGTTTTTCGTGGTTAAGTAT (SEQ ID NO:2388), CGTCGGCGGTTTTTCGTGGTTAAGTATT (SEQ ID NO:2389), CGTCGGCGGTTTTTCGTGGTTAAGTA (SEQ ID NO:2390), TGGTTTTGGAGTTTAGGGGTTGCGTTTT (SEQ ID NO:2391), TTGGTTTTGGAGTTTAGGGGTTGCGTTT (SEQ ID NO:2392), GGCGTCGCGTTAGAGGGTTGAGGGTTA (SEQ ID NO:2393), GGCGTCGCGTTAGAGGGTTGAGGGTTAA (SEQ ID NO:2394), GCGTCGCGTTAGAGGGTTGAGGGTTAA (SEQ ID NO:2395), GCGTTAGAGGGTTGAGGGTTAAGCGGT (SEQ ID NO:2396), GGCGTCGCGTTAGAGGGTTGAGGGTT (SEQ ID NO:2397)

Target253 chr2:106682036-106682077 TTCGGTGGTATTCGTTCGTGCGTTGGG (SEQ ID NO:2398), GGGCGGGAGAGAGGATTTCGGTGGTAT (SEQ ID NO:2399), GGGGCGGGAGAGAGGATTTCGGTGGTA (SEQ ID NO:2400), TTTCGGTGGTATTCGTTCGTGCGTTGGG (SEQ ID NO:2401), GGGCGGGAGAGAGGATTTCGGTGGTATT (SEQ ID NO:2402), GGCGTCGCGTTAGAGGGTTGAGGGTTA (SEQ ID NO:2403), GGCGTCGCGTTAGAGGGTTGAGGGTTAA (SEQ ID NO:2404), GCGTCGCGTTAGAGGGTTGAGGGTTAA (SEQ ID NO:2405), GCGTTAGAGGGTTGAGGGTTAAGCGGT (SEQ ID NO:2406), GGCGTCGCGTTAGAGGGTTGAGGGTT (SEQ ID NO:2407)

FIGURE 5 CONTINUED

Target254    chr2:106682084-106682218    TTGGCGCGGCGTTTATTCGTTGGGTTT (SEQ ID NO:2408), TTTGGCGCGGCCGTTTATTCGTTGGGTT (SEQ ID NO:2409), TTTTTGGCGCGGCGTTTATTCGTTGGGT (SEQ ID NO:2410), TTCGGTGGTATTCGTTCGTGCGTTGGG (SEQ ID NO:2411), TTTTTGGCGCGGCGTTTATTCGTTGGG (SEQ ID NO:2412), GGTTAGGATAGTAGGTCGCGCGGGGGA (SEQ ID NO:2413), AGGGTTAGGATAGTAGGTCGCGCGGGG (SEQ ID NO:2414), GGTTAGGATAGTAGGTCGCGCGGGGG (SEQ ID NO:2416), GGGTTAGGATAGTAGGTCGCGCGGGG (SEQ ID NO:2416), TAGGGTTAGGATAGTAGGTCGCGCGGG (SEQ ID NO:2417)

Target255    chr2:106682237-106682271    TCGCGCGGTTTGTTGTTTTGGTTTTGA (SEQ ID NO:2418), GCGGTCGCGCGTTTGTTCGTTCGTATTTT (SEQ ID NO:2419), GCGCGGTTTGTTGTTTTGGTTTTGATCGGG (SEQ ID NO:2420), CGCGCGGTTTGTTGTTTTGGTTTTGATCGG (SEQ ID NO:2421), TTCGCGCGGTTTGTTGTTTTGGTTTTG (SEQ ID NO:2422), AGTTCGGTTAGGGTTAGGATAGTAGGTCGT (SEQ ID NO:2423), GCGTTAGTTCGGTTAGGGTTAGGATAGTAGGT (SEQ ID NO:2424), GCGTTAGTTCGGTTAGGGTTAGGATAGTAGGTCG (SEQ ID NO:2425), GCGTTAGTTCGGTTAGGGTTAGGATAGTAGGTCGT (SEQ ID NO:2426), GCGTTAGTTCGGTTAGGGTTAGGATAGTAGGTC (SEQ ID NO:2427)

Target256    chr2:106690422-106690449    GCGTTAGAAGCGGTAGTTGTGGGATCGG (SEQ ID NO:2428), GCGTTAGAAGCGGTAGTTGTGGGATCGGA (SEQ ID NO:2429), GCGTTAGAAGCGGTAGTTGTGGGATCG (SEQ ID NO:2430), CGTTAGAAGCGGTAGTTGTGGGATCGG (SEQ ID NO:2431), CGTTAGAAGCGGTAGTTGTGGGATCGGA (SEQ ID NO:2432), TTTTGTGGAAGTTAGGTTTGTAGTCGGAGGT (SEQ ID NO:2433), TTTTTGTGGAAGTTAGGTTTGTAGTCGGAGGT (SEQ ID NO:2434), TTTTTTGTGGAAGTTAGGTTTGTAGTCGGAGGT (SEQ ID NO:2435), TTTTGTGGAAGTTAGGTTTGTAGTCGGAGGTAA (SEQ ID NO:2436), TTTTTGTGGAAGTTAGGTTTGTAGTCGGAGGTA (SEQ ID NO:2437)

Target257    chr2:106690493-106690515    GCGTTAGAAGCGGTAGTTGTGGGATCGG (SEQ ID NO:2438), GCGTTAGAAGCGGTAGTTGTGGGATCGGA (SEQ ID NO:2439), TGGGTTTTGACGAAGCGGTAGGTGTTGT (SEQ ID NO:2440), GGGTTTTGACGAAGCGGTAGGTGTTGT (SEQ ID NO:2441), TGGGTTTTGACGAAGCGGTAGGTGTTG (SEQ ID NO:2442), TTTTGTGGAAGTTAGGTTTGTAGTCGGAGGT (SEQ ID NO:2443), TTTTTGTGGAAGTTAGGTTTGTAGTCGGAGGT (SEQ ID NO:2444), TTTTTTGTGGAAGTTAGGTTTGTAGTCGGAGGT (SEQ ID NO:2445), TTTTGTGGAAGTTAGGTTTGTAGTCGGAGGTAA (SEQ ID NO:2446), TTTTTGTGGAAGTTAGGTTTGTAGTCGGAGGTA (SEQ ID NO:2447)

Target258    chr2:111876312-111876756    GGGGGCGGCGAGGTTGTAAGGTTGTAT (SEQ ID NO:2448), GGCGCGGGAGAAGGTTGTAAGGGTTTT (SEQ ID NO:2449), CGGCGCGGGAGAAGGTTGTAAGGGTTT (SEQ ID NO:2450), GGGGGCGGCGAGGTTGTAAGGTTGTATA (SEQ ID NO:2451), GGGTTTTTGGTTTTCGACGCGGTTTGGG (SEQ ID NO:2452), TCGGTTAGAGGTGGCGGGTTTATGCGT (SEQ ID NO:2453), AGGAAGTCGGTTAGAGGTGGCGGGTTT (SEQ ID NO:2454), AAGGAAGTCGGTTAGAGGTGGCGGGTT (SEQ ID NO:2455), AAAGGAAGTCGGTTAGAGGTGGCGGGT (SEQ ID NO:2456), AGTCGGGGGAAGTAACGGGTTAAGCGT (SEQ ID NO:2457)

Target259    chr2:111876775-111877077    GCGTTGAGATTTTGGTATGGGGTTGCG (SEQ ID NO:2458), TGCGTTGAGATTTTGGTATGGGGTTGCG (SEQ ID NO:2459), TGCGTTGAGATTTTGGTATGGGGTTGC (SEQ ID NO:2460), GCGTTGAGATTTTGGTATGGGGTTGCG (SEQ ID NO:2461), TGCGTTGAGATTTTGGTATGGGGTTGC (SEQ ID NO:2462), CGTAGTCGGTAGGGAGAAGGAAGGGGT (SEQ ID NO:2463), TGAGCGAGGTGAAGGAGGTTTTGGGTT (SEQ ID NO:2464), TTGAGCGAGGTGAAGGAGGTTTTGGGT (SEQ ID NO:2465), GCGAGGTGAAGGAGGTTTTGGGTTTCGG (SEQ ID NO:2466), CGTAGTCGGTAGGGAGAAGGAAGGGGTT (SEQ ID NO:2467)

Target260    chr2:111877108-111877178    GCGTTGAGATTTTGGTATGGGGTTGCG (SEQ ID NO:2468), TGCGTTGAGATTTTGGTATGGGGTTGCG (SEQ ID NO:2469), TGCGTTGAGATTTTGGTATGGGGTTGCGT (SEQ ID NO:2470), GCGTTGAGATTTTGGTATGGGGTTGCG (SEQ ID NO:2471), TGCGTTGAGATTTTGGTATGGGGTTGC (SEQ ID NO:2472), GGTGTGGGAGGTGGATCGGGAAATGGA (SEQ ID NO:2473), TAATTGTAGCGGGGGTGTGGGAGGTGG (SEQ ID NO:2474), GGGTGTGGGAGGTGGATCGGGAAATGG (SEQ ID NO:2475), GGGGTGTGGGAGGTGGATCGGGAAATG (SEQ ID NO:2476), ATTGTAGCGGGGGTGTGGGAGGTGGAT (SEQ ID NO:2477)

Target261    chr2:113931398-113931767    GGGGAGTAGGAGGGGTGTGTGTTGTGG (SEQ ID NO:2478), CGGGGAGTAGGAGGGGTGTGTGTTGTG (SEQ ID NO:2479), TGTGGTAGGGGTTGGGGTAGGTGGGTA (SEQ ID NO:2480), GGGTATGGGGAAAGGGGTTGTAGGCGT (SEQ ID NO:2481), GTGGGTAGGGGAGAGGCGAGGGTTTTG (SEQ ID NO:2482), GAGGAGGGGTAGGTTGAGGGAGGAGGG (SEQ ID NO:2483), GGTTGAGGGAGGAGGGGGACGGGATAT (SEQ ID NO:2484), TGAGGAGGGGTAGGTTGAGGGAGGAGG (SEQ ID NO:2485), AGGAGGGGTAGGTTGAGGGAGGAGGGG (SEQ ID NO:2486), AGGTTGAGGGAGGAGGGGGACGGGATA (SEQ ID NO:2487)

Target262    chr2:114034275-114034368    AGCGGTAGAGAGTAAGGGTTTAGTTCGGT (SEQ ID NO:2488), TGGGTAGCGGTAGAGAGTAAGGGTTTAGT (SEQ ID NO:2489), GCGGTAGAGAGTAAGGGTTTAGTTCGGTT (SEQ ID NO:2490), AGCGGTAGAGAGTAAGGGTTTAGTTCGGTT (SEQ ID NO:2491), GGGTAGCGGTAGAGAGTAAGGGTTTAGTTCGG (SEQ ID NO:2492), CGGCGGTGGTAGGAGGAGTGAGTGTTT (SEQ ID NO:2493), TTTCGGCGGTGGTAGGAGGAGTGAGTG

FIGURE 5 CONTINUED

|  |  | (SEQ ID NO:2494), TCGGCGGTGGTAGGAGGAGTGAGTGTT (SEQ ID NO:2495), TTCGGCGGTGGTAGGAGGAGTGAGTGT (SEQ ID NO:2496), TTTTCGGCGGTGGTAGGAGGAGTGAGT (SEQ ID NO:2497) |
| Target263 | chr2:114034478-114034535 | CGTCGGAAGGGTTAGGGGAAGGTTAGG (SEQ ID NO:2498), CGTCGGAAGGGTTAGGGGAAGGTTAGGA (SEQ ID NO:2499), TCGTCGGAAGGGTTAGGGGAAGGTTAGG (SEQ ID NO:2500), TCGTCGGAAGGGTTAGGGGAAGGTTAGGA (SEQ ID NO:2501), CGGAAGGGTTAGGGGAAGGTTAGGAGG (SEQ ID NO:2502) |
| Target264 | chr2:131721486-131721513 | GCGGTTATAGAGTTCGAGCGGGGGGTC (SEQ ID NO:2503), GCGGTTATAGAGTTCGAGCGGGGGGT (SEQ ID NO:2504), CGGTTATAGAGTTCGAGCGGGGGGTC (SEQ ID NO:2505), GCGGTTATAGAGTTCGAGCGGGGGG (SEQ ID NO:2506), CGGTTATAGAGTTCGAGCGGGGGGT (SEQ ID NO:2507), TATAGGTTCGGGGAAGGTTGGGTCGGG (SEQ ID NO:2508), ATAGGTTCGGGGAAGGTTGGGTCGGG (SEQ ID NO:2509), ATAGGTTCGGGGAAGGTTGGGTCGGG (SEQ ID NO:2510), TATAGGTTCGGGGAAGGTTGGGTCGGGG (SEQ ID NO:2511), TTATAGGTTCGGGGAAGGTTGGGTCGGG (SEQ ID NO:2512) |
| Target265 | chr2:131721523-131721558 | GCGGTTATAGAGTTCGAGCGGGGGGTC (SEQ ID NO:2513), GCGGTTATAGAGTTCGAGCGGGGGGT (SEQ ID NO:2514), CGGTTATAGAGTTCGAGCGGGGGGTC (SEQ ID NO:2515), GCGGTTATAGAGTTCGAGCGGGGGG (SEQ ID NO:2516), CGGTTATAGAGTTCGAGCGGGGGGT (SEQ ID NO:2517), TATAGGTTCGGGGAAGGTTGGGTCGGG (SEQ ID NO:2518), ATAGGTTCGGGGAAGGTTGGGTCGGGG (SEQ ID NO:2519), ATAGGTTCGGGGAAGGTTGGGTCGGG (SEQ ID NO:2520), TATAGGTTCGGGGAAGGTTGGGTCGGGG (SEQ ID NO:2521), TTATAGGTTCGGGGAAGGTTGGGTCGGG (SEQ ID NO:2522) |
| Target266 | chr2:131721562-131721672 | GCGTGCGGGCGTAGTAATGTTTTAGCG (SEQ ID NO:2523), GCGTGCGGGCGTAGTAATGTTTTAGCGA (SEQ ID NO:2524), GCGTGCGGGCGTAGTAATGTTTTAGCGAG (SEQ ID NO:2525), CGTGCGGGCGTAGTAATGTTTTAGCGA (SEQ ID NO:2526), TCGAGTTTGTGGTTGGAGTTCGGGTTC (SEQ ID NO:2527), TATAGGTTCGGGGAAGGTTGGGTCGGG (SEQ ID NO:2528), ATAGGTTCGGGGAAGGTTGGGTCGGGG (SEQ ID NO:2529), GGAGTTCGGGGATAGTTCGGCGTTGTT (SEQ ID NO:2530), ATAGGTTCGGGGAAGGTTGGGTCGGG (SEQ ID NO:2531), TCGGGGATAGTTCGGCGTTGTTGTTGT (SEQ ID NO:2532) |
| Target267 | chr2:131721692-131721867 | TTCGGATAGTAGCGGCGTGGTGTGTGG (SEQ ID NO:2533), TCGATTCGGATAGTAGCGGCGTGGTGT (SEQ ID NO:2534), CGATTCGGATAGTAGCGGCGTGGTGTG (SEQ ID NO:2535), TCGATTCGGATAGTAGCGGCGTGGTGTG (SEQ ID NO:2536), GCGTGCGGGCGTAGTAATGTTTTAGCG (SEQ ID NO:2537), GAGGGGGGCGGGGGGGTTTTAAGAGTAT (SEQ ID NO:2538), AGGAGAAGGAAAGGTAGGAGGGGGGCG (SEQ ID NO:2539), GAGGAGAAGGAAAGGTAGGAGGGGGGC (SEQ ID NO:2540), TAGGAGGGGGGCGGGGGGGTTTTAAGAG (SEQ ID NO:2541), GGAGGGGGGCGGGGGGTTTTAAGAGTA (SEQ ID NO:2542) |
| Target268 | chr2:131792027-131792037 | AGGTTGTAGGTTGTGTCGAGTGGAGGT (SEQ ID NO:2543), AGGTTGTGTCGAGTGGAGGTAGAGGAA (SEQ ID NO:2544), AAGGTTGTAGGTTGTGTCGAGTGGAGGT (SEQ ID NO:2545), AAGGTTGTAGGTTGTGTCGAGTGGAGG (SEQ ID NO:2546), GGTTGTGTCGAGTGGAGGTAGAGGAAGT (SEQ ID NO:2547), GCGTAGGAATGTAGGGATGGCGGAGGT (SEQ ID NO:2548), GCGTAGGAATGTAGGGATGGCGGAGGTA (SEQ ID NO:2549), AGGAATGTAGGGATGGCGGAGGTAGGA (SEQ ID NO:2550), GCGTAGGAATGTAGGGATGGCGCGAGG (SEQ ID NO:2551), GCGTAGGAATGTAGGGATGGCGGAGGTAG (SEQ ID NO:2552) |
| Target269 | chr2:131792397-131792426 | AGGGTTAGGATTGTTGTGTCGGCGTGG (SEQ ID NO:2553), GGGTTAGGATTGTTGTGTCGGCGTGGA (SEQ ID NO:2554), AGGGTTAGGATTGTTGTGTCGGCGTGGA (SEQ ID NO:2555), GGGTTAGGATTGTTGTGTCGGCGTGGAG (SEQ ID NO:2556), GGGTTAGGATTGTTGTGTCGGCGTGGAGA (SEQ ID NO:2557), AGAGGTTTAGAGGGATCGCGGCGGTTC (SEQ ID NO:2558), GAGAGGTTTAGAGGGATCGCGGCGGTT (SEQ ID NO:2559), TTGGAGAGGTTTAGAGGGATCGCGGCG (SEQ ID NO:2560), GTAATTAAGTCGGTTGTGCGGGCGGGG (SEQ ID NO:2561), GGTAATTAAGTCGGTTGTGCGGGCGGG (SEQ ID NO:2562) |
| Target270 | chr2:131792452-131792468 | AGGGTTAGGATTGTTGTGTCGGCGTGG (SEQ ID NO:2563), GGGTTAGGATTGTTGTGTCGGCGTGGA (SEQ ID NO:2564), AGGGTTAGGATTGTTGTGTCGGCGTGGA (SEQ ID NO:2565), GGGTTAGGATTGTTGTGTCGGCGTGGAG (SEQ ID NO:2566), GGGTTAGGATTGTTGTGTCGGCGTGGAGA (SEQ ID NO:2567), GTAATTAAGTCGGTTGTGCGGGCGGGG (SEQ ID NO:2568), GGTAATTAAGTCGGTTGTGCGGGCGGG (SEQ ID NO:2569), TGGTAATTAAGTCGGTTGTGCGGGCGG (SEQ ID NO:2570), TAATTAAGTCGGTTGTGCGGGCGGGGG (SEQ ID NO:2571), TTGGTAATTAAGTCGGTTGTGCGGGCGG (SEQ ID NO:2572) |
| Target271 | chr2:131792471-131792650 | TTTTCGGGCGTTGCGGGTTATCGGTTC (SEQ ID NO:2573), TGTTAGGGTTTGGGGTTTGGGAGGCGT (SEQ ID NO:2574), TGCGGGTTATCGGTTCGGTTTTGTGCG (SEQ ID NO:2575), GGCGTTGCGGGTTATCGGTTCGGTTTT (SEQ ID NO:2576), TTTTTCGGGCGTTGCGGGTTATCGGTT (SEQ ID NO:2577), GTCGGGGTTGCGGGGTTTTCGTTATGG (SEQ ID NO:2578), TTGCGGGGTTTTCGTTATGGCGTTCGG (SEQ ID NO:2579), GCGGGGTTTTCGTTATGGCGTTCGGTT (SEQ ID NO:2580), CGTCGGGGTTGCGGGGTTTTCGTTATG (SEQ ID NO:2581), GGGTTGCGGGGTTTTCGTTATGGCGTT (SEQ ID NO:2582) |
| Target272 | chr2:135464416-135464530 | TGGGGATGGGAGGAGGTGAGGTTAGT (SEQ ID NO:2583), ATGGGGATGGGAGGAGGTGAGGTTAGT (SEQ ID NO:2584), ATGGGGATGGGAGGAGGTGAGGTTAGTT (SEQ ID NO:2585), TGGGGATGGGAGGAGGTGAGGTTAGT (SEQ ID NO:2586), TGGGGATGGGAGGAGGTGAGGTTAGTTA |

FIGURE 5 CONTINUED

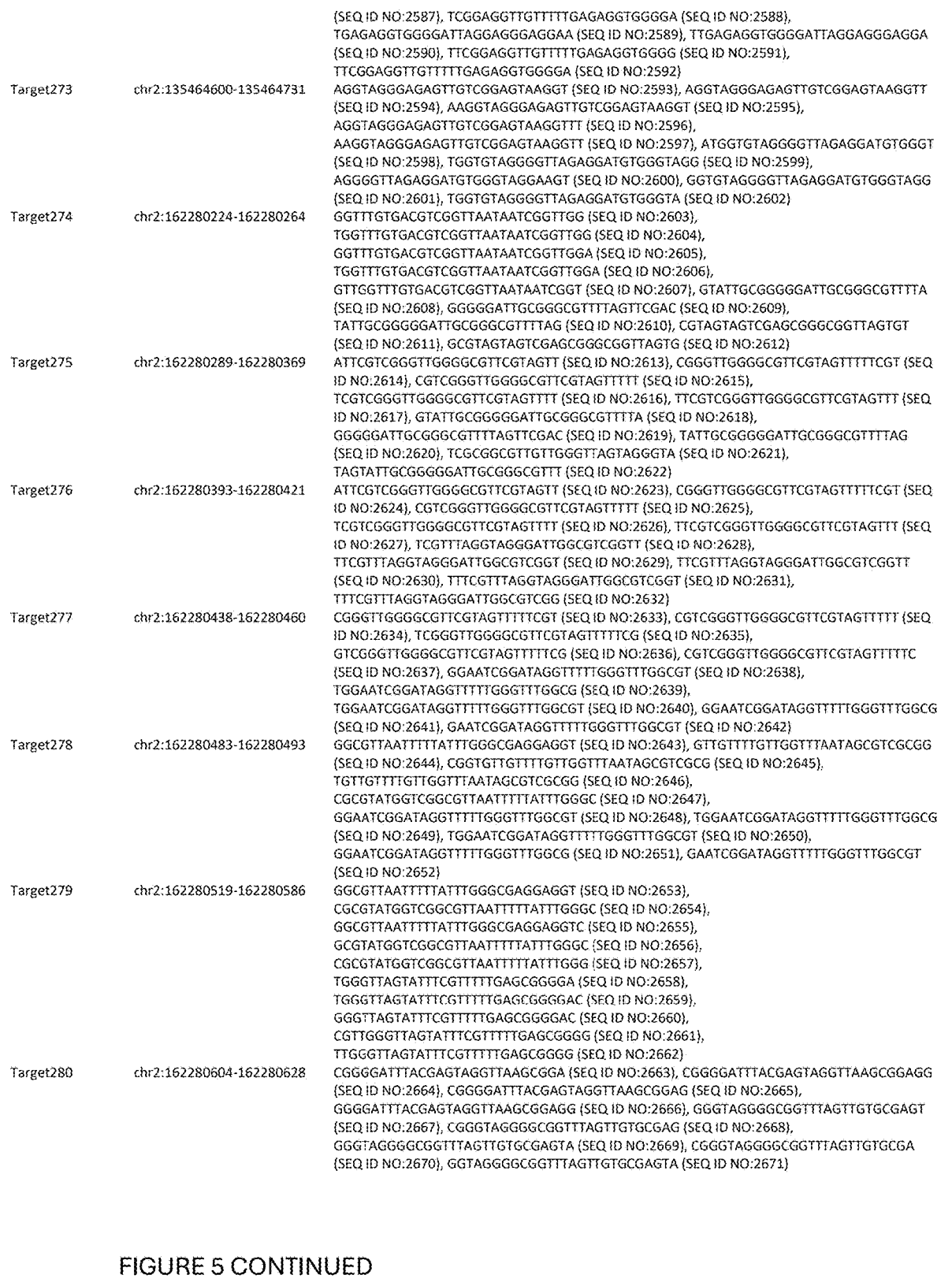

|  |  | {SEQ ID NO:2587}, TCGGAGGTTGTTTTTGAGAGGTGGGGA (SEQ ID NO:2588}, TGAGAGGTGGGGATTAGGAGGGAGGAA {SEQ ID NO:2589}, TTGAGAGGTGGGGATTAGGAGGGAGGA {SEQ ID NO:2590}, TTCGGAGGTTGTTTTTGAGAGGTGGGG (SEQ ID NO:2591}, TTCGGAGGTTGTTTTTGAGAGGTGGGGA {SEQ ID NO:2592} |
|---|---|---|
| Target273 | chr2:135464600-135464731 | AGGTAGGGAGAGTTGTCGGAGTAAGGT {SEQ ID NO:2593}, AGGTAGGGAGAGTTGTCGGAGTAAGGTT {SEQ ID NO:2594}, AAGGTAGGGAGAGTTGTCGGAGTAAGGT {SEQ ID NO:2595}, AGGTAGGGAGAGTTGTCGGAGTAAGGTTT {SEQ ID NO:2596}, AAGGTAGGGAGAGTTGTCGGAGTAAGGTT {SEQ ID NO:2597}, ATGGTGTAGGGGTTAGAGGATGTGGGT {SEQ ID NO:2598}, TGGTGTAGGGGTTAGAGGATGTGGGTAGG {SEQ ID NO:2599}, AGGGGTTAGAGGATGTGGGTAGGAAGT {SEQ ID NO:2600}, GGTGTAGGGGTTAGAGGATGTGGGTAGG {SEQ ID NO:2601}, TGGTGTAGGGGTTAGAGGATGTGGGTA {SEQ ID NO:2602} |
| Target274 | chr2:162280224-162280264 | GGTTTGTGACGTCGGTTAATAATCGGTTGG (SEQ ID NO:2603}, TGGTTTGTGACGTCGGTTAATAATCGGTTGG {SEQ ID NO:2604}, GGTTTGTGACGTCGGTTAATAATCGGTTGGA {SEQ ID NO:2605}, TGGTTTGTGACGTCGGTTAATAATCGGTTGGA {SEQ ID NO:2606}, GTTGGTTTGTGACGTCGGTTAATAATCGGT {SEQ ID NO:2607}, GTATTGCGGGGGATTGCGGGCGTTTTA {SEQ ID NO:2608}, GGGGGATTGCGGGCGTTTTAGTTCGAC {SEQ ID NO:2609}, TATTGCGGGGGATTGCGGGCGTTTTAG (SEQ ID NO:2610}, CGTAGTAGTCGAGCGGGCGGTTAGTGT {SEQ ID NO:2611}, GCGTAGTAGTCGAGCGGGCGGTTAGTG (SEQ ID NO:2612} |
| Target275 | chr2:162280289-162280369 | ATTCGTCGGGTTGGGGCGTTCGTAGTT {SEQ ID NO:2613}, CGGGTTGGGGCGTTCGTAGTTTTTCGT {SEQ ID NO:2614}, CGTCGGGTTGGGGCGTTCGTAGTTTTT {SEQ ID NO:2615}, TCGTCGGGTTGGGGCGTTCGTAGTTTT {SEQ ID NO:2616}, TTCGTCGGGTTGGGGCGTTCGTAGTTT {SEQ ID NO:2617}, GTATTGCGGGGGATTGCGGGCGTTTTA {SEQ ID NO:2618}, GGGGGATTGCGGGCGTTTTAGTTCGAC {SEQ ID NO:2619}, TATTGCGGGGGATTGCGGGCGTTTTAG {SEQ ID NO:2620}, TCGCGGCGTTGTTGGGTTAGTAGGGTA {SEQ ID NO:2621}, TAGTATTGCGGGGGATTGCGGGCGTTT {SEQ ID NO:2622} |
| Target276 | chr2:162280393-162280421 | ATTCGTCGGGTTGGGGCGTTCGTAGTT {SEQ ID NO:2623}, CGGGTTGGGGCGTTCGTAGTTTTTCGT {SEQ ID NO:2624}, CGTCGGGTTGGGGCGTTCGTAGTTTTT {SEQ ID NO:2625}, TCGTCGGGTTGGGGCGTTCGTAGTTTT {SEQ ID NO:2626}, TTCGTCGGGTTGGGGCGTTCGTAGTTT {SEQ ID NO:2627}, TCGTTTAGGTAGGGATTGGCGTCGGTT {SEQ ID NO:2628}, TTCGTTTAGGTAGGGATTGGCGTCGGT {SEQ ID NO:2629}, TTCGTTTAGGTAGGGATTGGCGTCGGTT {SEQ ID NO:2630}, TTTCGTTTAGGTAGGGATTGGCGTCGGT {SEQ ID NO:2631}, TTTCGTTTAGGTAGGGATTGGCGTCGG {SEQ ID NO:2632} |
| Target277 | chr2:162280438-162280460 | CGGGTTGGGGCGTTCGTAGTTTTTCGT {SEQ ID NO:2633}, CGTCGGGTTGGGGCGTTCGTAGTTTTT {SEQ ID NO:2634}, TCGGGTTGGGGCGTTCGTAGTTTTTCG {SEQ ID NO:2635}, GTCGGGTTGGGGCGTTCGTAGTTTTTCG {SEQ ID NO:2636}, CGTCGGGTTGGGGCGTTCGTAGTTTTTC {SEQ ID NO:2637}, GGAATCGGATAGGTTTTTGGGTTTGGCGT {SEQ ID NO:2638}, TGGAATCGGATAGGTTTTTGGGTTTGGCG {SEQ ID NO:2639}, TGGAATCGGATAGGTTTTTGGGTTTGGCGT {SEQ ID NO:2640}, GGAATCGGATAGGTTTTTGGGTTTGGCG {SEQ ID NO:2641}, GAATCGGATAGGTTTTTGGGTTTGGCGT {SEQ ID NO:2642} |
| Target278 | chr2:162280483-162280493 | GGCGTTAATTTTTATTTGGGCGAGGAGGT {SEQ ID NO:2643}, GTTGTTTTGTTGGTTTAATAGCGTCGCGG {SEQ ID NO:2644}, CGGTGTTGTTTTTGTTGGTTTAATAGCGTCGCGG {SEQ ID NO:2645}, TGTTGTTTTGTTGGTTTAATAGCGTCGCGG {SEQ ID NO:2646}, CGCGTATGGTCGGCGTTAATTTTTATTTGGGC {SEQ ID NO:2647}, GGAATCGGATAGGTTTTTGGGTTTGGCGT {SEQ ID NO:2648}, TGGAATCGGATAGGTTTTTGGGTTTGGCG {SEQ ID NO:2649}, TGGAATCGGATAGGTTTTTGGGTTTGGCGT {SEQ ID NO:2650}, GGAATCGGATAGGTTTTTGGGTTTGGCG {SEQ ID NO:2651}, GAATCGGATAGGTTTTTGGGTTTGGCGT {SEQ ID NO:2652} |
| Target279 | chr2:162280519-162280586 | GGCGTTAATTTTTATTTGGGCGAGGAGGT {SEQ ID NO:2653}, CGCGTATGGTCGGCGTTAATTTTTATTTGGGC {SEQ ID NO:2654}, GGCGTTAATTTTTATTTGGGCGAGGAGGTC {SEQ ID NO:2655}, GCGTATGGTCGGCGTTAATTTTTATTTGGGC {SEQ ID NO:2656}, CGCGTATGGTCGGCGTTAATTTTTATTTGGG {SEQ ID NO:2657}, TGGGTTAGTATTTCGTTTTTGAGCGGGGA {SEQ ID NO:2658}, TGGGTTAGTATTTCGTTTTTGAGCGGGGAC {SEQ ID NO:2659}, GGGTTAGTATTTCGTTTTTGAGCGGGGAC {SEQ ID NO:2660}, CGTTGGGTTAGTATTTCGTTTTTGAGCGGGG {SEQ ID NO:2661}, TTGGGTTAGTATTTCGTTTTTGAGCGGGG {SEQ ID NO:2662} |
| Target280 | chr2:162280604-162280628 | CGGGGATTTACGAGTAGGTTAAGCGGA {SEQ ID NO:2663}, CGGGGATTTACGAGTAGGTTAAGCGGAGG {SEQ ID NO:2664}, CGGGGATTTACGAGTAGGTTAAGCGGAG {SEQ ID NO:2665}, GGGGATTTACGAGTAGGTTAAGCGGAGG {SEQ ID NO:2666}, GGGTAGGGGCGGTTTAGTTGTGCGAGT {SEQ ID NO:2667}, CGGGTAGGGGCGGTTTAGTTGTGCGAG {SEQ ID NO:2668}, GGGTAGGGGCGGTTTAGTTGTGCGAGTA {SEQ ID NO:2669}, CGGGTAGGGGCGGTTTAGTTGTGCGA {SEQ ID NO:2670}, GGTAGGGGCGGTTTAGTTGTGCGAGTA {SEQ ID NO:2671} |

FIGURE 5 CONTINUED

| Target281 | chr2:162280761-162280772 | AGCGAGGTGTTGGTTTAGCGGGATTGC (SEQ ID NO:2672), GAGCGAGGTGTTGGTTTAGCGGGATTGC (SEQ ID NO:2673), AGAGCGAGGTGTTGGTTTAGCGGGATT (SEQ ID NO:2674), AAGAGCGAGGTGTTGGTTTAGCGGGAT (SEQ ID NO:2675), GAGCGAGGTGTTGGTTTAGCGGGATTG (SEQ ID NO:2676), AGGCGGAGTTGGGGAAGAGTTGTGAGG (SEQ ID NO:2677), GGAGGCGGAGTTGGGGAAGAGTTGTGA (SEQ ID NO:2678), TAAGGAGGAGTGTGGGGAGGCGGAGTT (SEQ ID NO:2679), CGGAGTTGGGGAAGAGTTGTGAGGGGT (SEQ ID NO:2680), AGAGTTGTGAGGGGTTGGTTGGGGGTT (SEQ ID NO:2681) |
| Target282 | chr2:166650143-166650508 | TATAGGGATTGGCGGGGGGTATCGTGGG (SEQ ID NO:2682), GGGTCGTTTTATAGGGATTGGCGGGGGT (SEQ ID NO:2683), GGGTCGTTTTATAGGGATTGGCGGGGG (SEQ ID NO:2684), GGGGTCGTTTTATAGGGATTGGCGGGG (SEQ ID NO:2685), AGGGGTCGTTTTATAGGGATTGGCGGGG (SEQ ID NO:2686), ATTTTGAGAGGGAGGGTTCGGCGGGAG (SEQ ID NO:2687), GATTTTGAGAGGGAGGGTTCGGCGGGA (SEQ ID NO:2688), TGGGGATTTTGAGAGGGAGGGTTCGGC (SEQ ID NO:2689), GGGAGGGTCGTAGCGTGGGGATTTTGA (SEQ ID NO:2690), TTGGGTTGCGTTAGAGTAGGCGGGAGG (SEQ ID NO:2691) |
| Target283 | chr2:166650529-166651284 | TGGGTTAGGCGTTAGGTGTAGGTGGCG (SEQ ID NO:2692), TTCGGGTTAAGTTTGGTTGTCGCGCGG (SEQ ID NO:2693), TCGGGTTTATTTGGCGGGTGGGTAGGGT (SEQ ID NO:2694), CGGGTTAAGTTTGGTTGTCGCGCGGTT (SEQ ID NO:2695), GGGTTAGGCGTTAGGTGTAGGTGGCGG (SEQ ID NO:2696), CGAGGAGGAAGGGAGGAATCGTGTGGG (SEQ ID NO:2697), TTGGAGCGTTTAGGTAGGGTTGGGGCG (SEQ ID NO:2698), GAGGAGGAAGGGAGGAATCGTGTGGGG (SEQ ID NO:2699), GAGGAAGGGAGGAATCGTGTGGGGGAA (SEQ ID NO:2700), CGGCGGCGGAGGAGGAGTTTTATTGAG (SEQ ID NO:2701) |
| Target284 | chr2:171679526-171679830 | TTGGAGAGGCGGGGGAAGATTAACGGG (SEQ ID NO:2702), TTTTCGGGTAGAGGTTGGAGAGGCGGG (SEQ ID NO:2703), GGTAGAGGTTGGAGAGGCGGGGGAAGA (SEQ ID NO:2704), GTAGAGGTTGGAGAGGCGGGGGAAGAT (SEQ ID NO:2705), CGTTAGTTTTTGCGCGCGGGAGATAGC (SEQ ID NO:2706), CGGCGCGGTTAAGTAGGGAAGGGAGTA (SEQ ID NO:2707), TTTTAGAAATGTAGGGAGGGCGCGGCG (SEQ ID NO:2708), CGGCGCGGTTAAGTAGGGAAGGGAGT (SEQ ID NO:2709), CGGCGCGGTTAAGTAGGGAAGGGAGTAG (SEQ ID NO:2710), GTTTTAGAAATGTAGGGAGGGCGCGGCG (SEQ ID NO:2711) |
| Target285 | chr2:171679840-171679912 | CGTTCGTTCGTTTTAGTTTCGGAGCGTG (SEQ ID NO:2712), CGTTCGTTCGTTTTAGTTTCGGAGCGT (SEQ ID NO:2713), TTCGTTCGTTTTAGTTTCGGAGCGTCG (SEQ ID NO:2714), CGAGGGCGGTGGTAGTTTGTAGTTAGA (SEQ ID NO:2715), GTTCGTTCGTTTTAGTTTCGGAGCGTCG (SEQ ID NO:2716), CGGCGCGGTTAAGTAGGGAAGGGAGTA (SEQ ID NO:2717), TTTTAGAAATGTAGGGAGGGCGCGGCG (SEQ ID NO:2718), GGCGGTAGGGTTGGGTTTTCGGTGGAA (SEQ ID NO:2719), TTCGGCGGTAGGGTTGGGTTTTCGGTG (SEQ ID NO:2720), GTTCGGCGGTAGGGTTGGGTTTTCGGT (SEQ ID NO:2721) |
| Target286 | chr2:171830684-171830708 | TGTGTATAAGTTCGGGGCGTCGGGGTG (SEQ ID NO:2722), TTGTGTATAAGTTCGGGGCGTCGGGGT (SEQ ID NO:2723), GGGCGGTTGGGTTTGGGTTTAGGTGTT (SEQ ID NO:2724), GTGTATAAGTTCGGGGCGTCGGGGTGG (SEQ ID NO:2725), GTTGTGTATAAGTTCGGGGCGTCGGGG (SEQ ID NO:2726) |
| Target287 | chr2:172965364-172965371 | GTGATGGTGGTGGTGGTGATGCGGTTG (SEQ ID NO:2727), TGCGGGGTTTGAGTGGGGTGTAGTAGC (SEQ ID NO:2728), GGTTTGAGTGGGGTGTAGTAGCGGCGT (SEQ ID NO:2729), CGGGGTTTGAGTGGGGTGTAGTAGCGG (SEQ ID NO:2730), CGTCGTCGTGATGGTGGTGGTGGTGAT (SEQ ID NO:2731), CGGCGTCGGTAGTTCGGGTTTTAGTTCG (SEQ ID NO:2732), CGGCGTCGGTAGTTCGGGTTTTAGTTCGA (SEQ ID NO:2733), GGCGTCGGTAGTTCGGGTTTTAGTTCG (SEQ ID NO:2734), CGGCGTCGGTAGTTCGGGTTTTAGTTC (SEQ ID NO:2735), GGCGTCGGTAGTTCGGGTTTTAGTTCGA (SEQ ID NO:2736) |
| Target288 | chr2:172965397-172965521 | GTGATGGTGGTGGTGGTGATGCGGTTG (SEQ ID NO:2737), TGCGGGGTTTGAGTGGGGTGTAGTAGC (SEQ ID NO:2738), GGTTTGAGTGGGGTGTAGTAGCGGCGT (SEQ ID NO:2739), CGGGGTTTGAGTGGGGTGTAGTAGCGG (SEQ ID NO:2740), CGTCGTGGTTTGTAGGTGTGAGGCGGA (SEQ ID NO:2741), CGGCGTCGGTAGTTCGGGTTTTAGTTCG (SEQ ID NO:2742), TGGGATTTTGGTGTGTCGTAGCGGATGG (SEQ ID NO:2743), GGGATTTTGGTGTGTCGTAGCGGATGG (SEQ ID NO:2744), CGGCGTCGGTAGTTCGGGTTTTAGTTCGA (SEQ ID NO:2745), GGCGTCGGTAGTTCGGGTTTTAGTTCG (SEQ ID NO:2746) |
| Target289 | chr2:172965544-172965563 | TTTTAGGAGGTCGGCGTTGAGATTGGC (SEQ ID NO:2747), GTTTTAGGAGGTCGGCGTTGAGATTGGC (SEQ ID NO:2748), AGTTTTAGGAGGTCGGCGTTGAGATTGGC (SEQ ID NO:2749), TTTAGGAGGTCGGCGTTGAGATTGGC (SEQ ID NO:2750), GTTTTAGGAGGTCGGCGTTGAGATTGG (SEQ ID NO:2751), TGGTGAGATTTTTTCGGAGTAGTATTTTGGGGT (SEQ ID NO:2752), GTGGTGAGATTTTTTCGGAGTAGTATTTTGGGGT (SEQ ID NO:2753), AGTGGTGAGATTTTTTCGGAGTAGTATTTTGGGG (SEQ ID NO:2754), AGTGGTGAGATTTTTTCGGAGTAGTATTTTGGGGT (SEQ ID NO:2755), AGATTTTTTCGGAGTAGTATTTTGGGGTTAGCGT (SEQ ID NO:2756) |
| Target290 | chr2:175201775-175201998 | TTCGGGTTGCGGTAAGGTGTACGGGAA (SEQ ID NO:2757), TTTCGGGTTGCGGTAAGGTGTACGGGA (SEQ ID NO:2758), ATTTCGGGTTGCGGTAAGGTGTACGGG (SEQ ID NO:2759), TTTCGGGTTGCGGTAAGGTGTACGGGAA (SEQ ID NO:2760), ATTTCGGGTTGCGGTAAGGTGTACGGGA (SEQ ID NO:2761), GGGGCGTTTTTAGGTTGTTGGCGTTCG (SEQ ID NO:2762), CGGGGCGTTTTTAGGTTGTTGGCGTTC (SEQ ID NO:2763), GGGCGTTTTTAGGTTGTTGGCGTTCGTG |

FIGURE 5 CONTINUED

{SEQ ID NO:2764}, GGGTCGTTCGTTCGTGTGTTAGCGTAGG {SEQ ID NO:2765},
CGGGGCGTTTTTAGGTTGTTGGCGTTCG {SEQ ID NO:2766}

| Target291 | chr2:175202051-175202065 | GTTCGGACGAGTTGTAGCGGTATTTGC {SEQ ID NO:2767}, AGCGTTTCGTTTGTTCGGTGTGTAATAAGC {SEQ ID NO:2768}, GGGGCGTTTTTAGGTTGTTGGCGTTCG {SEQ ID NO:2769}, CGGGGCGTTTTTAGGTTGTTGGCGTTC {SEQ ID NO:2770}, GGGCGTTTTTAGGTTGTTGGCGTTCGT {SEQ ID NO:2771}, GGGGCGTTTTTAGGTTGTTGGCGTTCGT {SEQ ID NO:2772}, TGTAGGATGAGGTCGGGGGATTCGGAA {SEQ ID NO:2773} |
| Target292 | chr2:175202067-175202376 | GGAGGCGGGAGGGTAGGGGTTTTAGTG {SEQ ID NO:2774}, GGCGGGAGGGTAGGGGTTTTAGTGACG {SEQ ID NO:2775}, TGATTTCGGCGTTAGTGTCGTTCGGGC {SEQ ID NO:2776}, GCGGCGGGGGTAAAAAGGGTAGCGATA {SEQ ID NO:2777}, TATAACGGGGGCGGCGGGGGTAAAAAG {SEQ ID NO:2778}, TTTATTCGGGCGCGGAAGGTAGAGGGG {SEQ ID NO:2779}, GCGTTTAGTTCGGGTTTTGGGGGCGTT {SEQ ID NO:2780}, GGGCGCGGAAGGTAGAGGGGAGTTTTT {SEQ ID NO:2781}, GCGCGGAAGGTAGAGGGGAGTTTTTCG {SEQ ID NO:2782}, GGGGCGTTTTTAGGTTGTTGGCGTTCG {SEQ ID NO:2783} |
| Target293 | chr2:175202388-175202400 | GGAGGCGGGAGGGTAGGGGTTTTAGTG {SEQ ID NO:2784}, GGCGGGAGGGTAGGGGTTTTAGTGACG {SEQ ID NO:2785}, GCGGGAGGGTAGGGGTTTTAGTGACGT {SEQ ID NO:2786}, GACGTTTTTAGGGTTCGGGTTGGGCGC {SEQ ID NO:2787}, TGACGTTTTTAGGGTTCGGGTTGGGCG {SEQ ID NO:2788}, TTTATTCGGGCGCGGAAGGTAGAGGGG {SEQ ID NO:2789}, GGGCGCGGAAGGTAGAGGGGAGTTTTT {SEQ ID NO:2790}, GCGCGGAAGGTAGAGGGGAGTTTTTCG {SEQ ID NO:2791}, TTATTCGGGCGCGGAAGGTAGAGGGGA {SEQ ID NO:2792}, GGCGCGGAAGGTAGAGGGGAGTTTTTC {SEQ ID NO:2793} |
| Target294 | chr2:175202430-175202523 | GGAGGCGGGAGGGTAGGGGTTTTAGTG {SEQ ID NO:2794}, GGCGGGAGGGTAGGGGTTTTAGTGACG {SEQ ID NO:2795}, GCGGGAGGGTAGGGGTTTTAGTGACGT {SEQ ID NO:2796}, GGGTTTTCGGGTTGCGGTTCGTTCGTT {SEQ ID NO:2797}, GACGTTTTTAGGGTTCGGGTTGGGCGC {SEQ ID NO:2798}, TTTATTCGGGCGCGGAAGGTAGAGGGG {SEQ ID NO:2799}, GGGCGCGGAAGGTAGAGGGGAGTTTTT {SEQ ID NO:2800}, AGTTTGGGCGAGTGGTATGTGTGTGCG {SEQ ID NO:2801}, GCGCGGAAGGTAGAGGGGAGTTTTTCG {SEQ ID NO:2802}, TTATTCGGGCGCGGAAGGTAGAGGGGA {SEQ ID NO:2803} |
| Target295 | chr2:176945119-176945216 | GTAGGGTGTAGAGTCGTCGTTGGGGGGG {SEQ ID NO:2804}, TAGGGTGTAGAGTCGTCGTTGGGGGGC {SEQ ID NO:2805}, AGTAGGGTGTAGAGTCGTCGTTGGGGG {SEQ ID NO:2806}, AGTAGGGTGTAGAGTCGTCGTTGGGGGG {SEQ ID NO:2807}, GAGTAGGGTGTAGAGTCGTCGTTGGGGG {SEQ ID NO:2808}, TCGGTCGGAGTTGTTGTGTAGTTTTCGT {SEQ ID NO:2809}, CGGTCGGAGTTGTTGTGTAGTTTTCGTT {SEQ ID NO:2810}, TCGGTCGGAGTTGTTGTGTAGTTTTCGTT {SEQ ID NO:2811}, TTCGGTCGGAGTTGTTGTGTAGTTTTCGT {SEQ ID NO:2812}, TTTCGGTCGGAGTTGTTGTGTAGTTTTCG {SEQ ID NO:2813} |
| Target296 | chr2:176945218-176945225 | GTAGGGTGTAGAGTCGTCGTTGGGGGGG {SEQ ID NO:2814}, TAGGGTGTAGAGTCGTCGTTGGGGGGC {SEQ ID NO:2815}, AGTAGGGTGTAGAGTCGTCGTTGGGGG {SEQ ID NO:2816}, AGTAGGGTGTAGAGTCGTCGTTGGGGGG {SEQ ID NO:2817}, GAGTAGGGTGTAGAGTCGTCGTTGGGGG {SEQ ID NO:2818}, TCGGTCGGAGTTGTTGTGTAGTTTTCGT {SEQ ID NO:2819}, CGGTCGGAGTTGTTGTGTAGTTTTCGTT {SEQ ID NO:2820}, TCGGTCGGAGTTGTTGTGTAGTTTTCGTT {SEQ ID NO:2821}, TTCGGTCGGAGTTGTTGTGTAGTTTTCGT {SEQ ID NO:2822}, TTTCGGTCGGAGTTGTTGTGTAGTTTTCG {SEQ ID NO:2823} |
| Target297 | chr2:176945270-176945337 | GCGCGGAAGGTGTTTAGTGGTCGGATG {SEQ ID NO:2824}, AGAGGGCGCGGAAGGTGTTTAGTGGTC {SEQ ID NO:2825}, GAGAGGGCGCGGAAGGTGTTTAGTGGT {SEQ ID NO:2826}, CGCGGAAGGTGTTTAGTGGTCGGATGG {SEQ ID NO:2827}, TTCGGTCGAGAGTAGGGGTGCGAGAGG {SEQ ID NO:2828}, CGGTTGTAGTTTTAGGCGCGGCGGTC {SEQ ID NO:2829}, CGGTTGTAGTTTTAGGCGCGGCGGT {SEQ ID NO:2830}, GCGGTTGTAGTTTTAGGCGCGGCGGTC {SEQ ID NO:2831}, GCGGTTGTAGTTTTAGGCGCGGCGG {SEQ ID NO:2832}, GCGGTTGTAGTTTTAGGCGCGGCGGT {SEQ ID NO:2833} |
| Target298 | chr2:176945339-176945352 | GCGCGGAAGGTGTTTAGTGGTCGGATG {SEQ ID NO:2834}, AGAGGGCGCGGAAGGTGTTTAGTGGTC {SEQ ID NO:2835}, GAGAGGGCGCGGAAGGTGTTTAGTGGT {SEQ ID NO:2836}, CGCGGAAGGTGTTTAGTGGTCGGATGG {SEQ ID NO:2837}, TTCGGTCGAGAGTAGGGGTGCGAGAGG {SEQ ID NO:2838}, CGGTTGTAGTTTTAGGCGCGGCGGTC {SEQ ID NO:2839}, CGGTTGTAGTTTTAGGCGCGGCGGT {SEQ ID NO:2840}, GCGGTTGTAGTTTTAGGCGCGGCGGTC {SEQ ID NO:2841}, GCGGTTGTAGTTTTAGGCGCGGCGG {SEQ ID NO:2842}, GCGGTTGTAGTTTTAGGCGCGGCGGT {SEQ ID NO:2843} |
| Target299 | chr2:176945372-176945459 | AAGGGGTAGGGTAGGTTTTCGGTGGCG {SEQ ID NO:2844}, GCGCGGAAGGTGTTTAGTGGTCGGATG {SEQ ID NO:2845}, AGAGGGCGCGGAAGGTGTTTAGTGGTC {SEQ ID NO:2846}, GAGAGGGCGCGGAAGGTGTTTAGTGGT {SEQ ID NO:2847}, CGGTCGTCGCGTTTGAGGTTGTAGTCG {SEQ ID NO:2848}, TCGTAGGTGTGGTTTTAGAATCGGCGT {SEQ ID NO:2849}, GCGGTAGCGTTTGGTTATGTTTTGGTCG {SEQ ID NO:2850}, GCGGTAGCGTTTGGTTATGTTTTGGTCGT {SEQ ID NO:2851}, TTCGTAGGTGTGGTTTTAGAATCGGCGT {SEQ ID NO:2852}, CGGTAGCGTTTGGTTATGTTTTGGTCGT {SEQ ID NO:2853} |

FIGURE 5 CONTINUED

| | | |
|---|---|---|
| Target300 | chr2:176945462-176945469 | AAGGGGTAGGGTAGGTTTTCGGTGGCG (SEQ ID NO:2854), CGGTCGTCGCGTTTGAGGTTGTAGTCG (SEQ ID NO:2855), GGGTAGGGTAGGTTTTCGGTGGCGGTC (SEQ ID NO:2856), GGTAGGGTAGGTTTTCGGTGGCGGTCG (SEQ ID NO:2857), GTGCGAGTGGAAGGGGTAGGGTAGGTT (SEQ ID NO:2858), TCGTAGGTGTGGTTTTAGAATCGGCGT (SEQ ID NO:2859), GCGGTAGCGTTTGGTTATGTTTTGGTCG (SEQ ID NO:2860), GCGGTAGCGTTTGGTTATGTTTTGGTCGT (SEQ ID NO:2861), TTCGTAGGTGTGGTTTTAGAATCGGCGT (SEQ ID NO:2862), CGGTAGCGTTTGGTTATGTTTTGGTCGT (SEQ ID NO:2863) |
| Target301 | chr2:176945532-176945551 | AAGGGGTAGGGTAGGTTTTCGGTGGCG (SEQ ID NO:2864), GGGGTCGGTTGGGTGCGGTTAGGATAT (SEQ ID NO:2865), GGGTAGGGTAGGTTTTCGGTGGCGGTC (SEQ ID NO:2866), TGTAGAAGTTGGGGTCGGTTGGGTGCG (SEQ ID NO:2867), GGTAGGGTAGGTTTTCGGTGGCGGTCG (SEQ ID NO:2868), TGGGATAGGAGTTGGGAATACGGGGCG (SEQ ID NO:2869), TTGGGATAGGAGTTGGGAATACGGGGCG (SEQ ID NO:2870), AGGTTCGGAAGGGGTAGAGGTTTTGGG (SEQ ID NO:2871), GGTTCGGAAGGGGTAGAGGTTTTGGGA (SEQ ID NO:2872), TTGGGATAGGAGTTGGGAATACGGGGC (SEQ ID NO:2873) |
| Target302 | chr2:176945604-176945648 | GGGGTCGGTTGGGTGCGGTTAGGATAT (SEQ ID NO:2874), TGTAGAAGTTGGGGTCGGTTGGGTGCG (SEQ ID NO:2875), GTGTAGAAGTTGGGGTCGGTTGGGTGC (SEQ ID NO:2876), GAAGTTGGGGTCGGTTGGGTGCGGTTA (SEQ ID NO:2877), AAGTTGGGGTCGGTTGGGTGCGGTTAG (SEQ ID NO:2878), GGGTATTCGGGGTTGGGTTTGGTCGGA (SEQ ID NO:2879), AGGGTATTCGGGGTTGGGTTTGGTCGG (SEQ ID NO:2880), GGTATTCGGGGTTGGGTTTGGTCGGAG (SEQ ID NO:2881), GGTATTCGGGGTTGGGTTTGGTCGGAGA (SEQ ID NO:2882), TAGGGTATTCGGGGTTGGGTTTGGTCGG (SEQ ID NO:2883) |
| Target303 | chr2:176947000-176947053 | GTGGTTTCGGGTAGGTTGAGTGTCGCG (SEQ ID NO:2884), GGTGGTTTCGGGTAGGTTGAGTGTCGC (SEQ ID NO:2885), TGAGTGTCGCGGTTAGTTCGTATCGGC (SEQ ID NO:2886), TGGTGGTTTCGGGTAGGTTGAGTGTCGC (SEQ ID NO:2887), CGGGTAGGTTGAGTGTCGCGGTTAGTT (SEQ ID NO:2888), GGGTGGTTTCGGTTTTGGCGCGGATTA (SEQ ID NO:2889), CGGCGTCGGGTTAGGTTTCGGAAGTT (SEQ ID NO:2890), GGGTGGTTTCGGTTTTGGCGCGGATTAA (SEQ ID NO:2891), GGTGGTTTCGGTTTTGGCGCGGATTAA (SEQ ID NO:2892), CGGCGTCGGGTTAGGTTTCGGAAGTTT (SEQ ID NO:2893) |
| Target304 | chr2:176947061-176947080 | GCGGTTAGTTCGTATCGGCGGGGTC (SEQ ID NO:2894), GCGTTAGAGTCGGAGTTATTTAGCGTCGCG (SEQ ID NO:2895), GCGGTTAGTTCGTATCGGCGGGGT (SEQ ID NO:2896), GCGTTAGAGTCGGAGTTATTTAGCGTCGC (SEQ ID NO:2897), CGTTAGAGTCGGAGTTATTTAGCGTCGCG (SEQ ID NO:2898), CGGCGTCGGGTTAGGTTTCGGAAGTT (SEQ ID NO:2899), CGGCGTCGGGTTAGGTTTCGGAAGTTT (SEQ ID NO:2900), CGGCGTCGGGTTAGGTTTCGGAAGT (SEQ ID NO:2901), CGGCGTCGGGTTAGGTTTCGGAAGTTTG (SEQ ID NO:2902), GGCGTCGGGTTAGGTTTCGGAAGTTT (SEQ ID NO:2903) |
| Target305 | chr2:176947118-176947173 | AGAGTCGGAGTTATTTAGCGTCGCGTT (SEQ ID NO:2904), GCGTTAGAGTCGGAGTTATTTAGCGTCGCG (SEQ ID NO:2905), GCGTTAGAGTCGGAGTTATTTAGCGTCGCGT (SEQ ID NO:2906), AGAGTCGGAGTTATTTAGCGTCGCGTTT (SEQ ID NO:2907), GCGTTAGAGTCGGAGTTATTTAGCGTCGC (SEQ ID NO:2908), TGTTAGGGTACGTAGAGAGCGGTTCGG (SEQ ID NO:2909), TTGTTAGGGTACGTAGAGAGCGGTTCGG (SEQ ID NO:2910), TTGTTAGGGTACGTAGAGAGCGGTTCG (SEQ ID NO:2911), TGCGTTGTTGGTCGTTTGTTTGTTAGGGT (SEQ ID NO:2912), GCGTTGTTGGTCGTTTGTTTGTTAGGGT (SEQ ID NO:2913) |
| Target306 | chr2:176947242-176947252 | AGTGGTTGTAGGATTAATAGTTCGGCGTTGG (SEQ ID NO:2914), GGTAGTCGAGTCGTTTTTTGCGTATTTTGGT (SEQ ID NO:2915), GAGTGGTTGTAGGATTAATAGTTCGGCGTTGG (SEQ ID NO:2916), TGAGTGGTTGTAGGATTAATAGTTCGGCGTT (SEQ ID NO:2917), TGAGTGGTTGTAGGATTAATAGTTCGGCGTTGG (SEQ ID NO:2918) |
| Target307 | chr2:176956535-176956546 | CGGGCGGGAGTGGGTGGTGATTGTAAA (SEQ ID NO:2919), ATTTGGTGTGAGAAACGGGCGGGAGTG (SEQ ID NO:2920), TTTGGTGTGAGAAACGGGCGGGAGTGG (SEQ ID NO:2921), GGGCGGGAGTGGGTGGTGATTGTAAAA (SEQ ID NO:2922), AATTTGGTGTGAGAAACGGGCGGGAGT (SEQ ID NO:2923), CGGCGTCGGGGGAGAAAGTTATTTAGT (SEQ ID NO:2924), CGGCGTCGGGGGAGAAAGTTATTTAGTT (SEQ ID NO:2925), TCGATTTGGGTTTTTTAGTTTTCGCGGGT (SEQ ID NO:2926), TCGATTTGGGTTTTTTAGTTTTCGCGGGTT (SEQ ID NO:2927), TTCGATTTGGGTTTTTTAGTTTTCGCGGGT (SEQ ID NO:2928) |
| Target308 | chr2:176956573-176956707 | CGCGGGAGTTGAGAGGTTTAGGTCGGA (SEQ ID NO:2929), TCGCGGGAGTTGAGAGGTTTAGGTCGG (SEQ ID NO:2930), CGGGCGGGAGTGGGTGGTGATTGTAAA (SEQ ID NO:2931), ATTTGGTGTGAGAAACGGGCGGGAGTG (SEQ ID NO:2932), TTTGGTGTGAGAAACGGGCGGGAGTGG (SEQ ID NO:2933), TGAAGCGTTTTTGGGGTTGGCGGTAGA (SEQ ID NO:2934), AAGCGTTTTTGGGGTTGGCGGTAGAGA (SEQ ID NO:2935), AGCGTTTTTGGGGTTGGCGGTAGAGAT (SEQ ID NO:2936), TGAAGCGTTTTTGGGGTTGGCGGTAGAG (SEQ ID NO:2937), GAAGCGTTTTTGGGGTTGGCGGTAGAG (SEQ ID NO:2938) |
| Target309 | chr2:176964663-176964673 | AGAGCGGGTTATGTGGGTTCGTTTTTG (SEQ ID NO:2939), GAGCGGGTTATGTGGGTTCGTTTTTGA (SEQ ID NO:2940), AGAGCGGGTTATGTGGGTTCGTTTTTGA (SEQ ID NO:2941), GAGCGGGTTATGTGGGTTCGTTTTTGAA (SEQ ID NO:2942), AGAGCGGGTTATGTGGGTTCGTTTTTGAA (SEQ ID NO:2943), GTTGTTGGGGGGTTGTAGGTCGAGAGGT (SEQ ID NO:2944), TGTTGGGGGGTTGTAGGTCGAGAGGTTC (SEQ ID NO:2945), TTGTTGGGGGGTTGTAGGTCGAGAGGTT |

FIGURE 5 CONTINUED

{SEQ ID NO:2946}, GTTGTTGGGGGTTGTAGGTCGAGAGGTT {SEQ ID NO:2947},
GAGAAGTCGTCGAAGGTAGTGGCGTTC {SEQ ID NO:2948}

Target310    chr2:176964709-176964740    GCGCGTTGTTTGGGTCGTTACGTTCG {SEQ ID NO:2949}, GGCGCGTTGTTTGGGTCGTTACGTTC {SEQ ID NO:2950}, CGCGTTGTTTGGGTCGTTACGTTCGT {SEQ ID NO:2951}, GCGCGTTGTTTGGGTCGTTACGTTCGT {SEQ ID NO:2952}, GGCGCGTTGTTTGGGTCGTTACGTTCG {SEQ ID NO:2953}, TTTTGGTTTAGCGGTCGTTTCGGGCGT {SEQ ID NO:2954}, TTTGGTTTAGCGGTCGTTTCGGGCGTA {SEQ ID NO:2955}, TTGGTTTAGCGGTCGTTTCGGGCGTAT {SEQ ID NO:2956}, GAAGGTAGTGGCGTTCGTAGGTTGCGT {SEQ ID NO:2957}, TTTTTGGTTTAGCGGTCGTTTCGGGCG {SEQ ID NO:2958}

Target311    chr2:176964769-176964806    GCGCGTTGTTTGGGTCGTTACGTTCG {SEQ ID NO:2959}, GGCGCGTTGTTTGGGTCGTTACGTTC {SEQ ID NO:2960}, CGCGTTGTTTGGGTCGTTACGTTCGT {SEQ ID NO:2961}, GCGCGTTGTTTGGGTCGTTACGTTCGT {SEQ ID NO:2962}, GGCGCGTTGTTTGGGTCGTTACGTTCG {SEQ ID NO:2963}, TTTTGGTTTAGCGGTCGTTTCGGGCGT {SEQ ID NO:2964}, TTTGGTTTAGCGGTCGTTTCGGGCGTA {SEQ ID NO:2965}, TTGGTTTAGCGGTCGTTTCGGGCGTAT {SEQ ID NO:2966}, TTTTTGGTTTAGCGGTCGTTTCGGGCG {SEQ ID NO:2967}, TTTTTGGTTTAGCGGTCGTTTCGGGCGT {SEQ ID NO:2968}

Target312    chr2:176964811-176964887    GGTCGTTGGGTTAGAGGAGCGCGGTC {SEQ ID NO:2969}, GGTCGTTGGGTTAGAGGAGCGCGGT {SEQ ID NO:2970}, GTCGTTGGGTTAGAGGAGCGCGGTC {SEQ ID NO:2971}, GCGTAGTTTGCGGGCGTTATTGTTTTCG {SEQ ID NO:2972}, GCGTAGTTTGCGGGCGTTATTGTTTTCG {SEQ ID NO:2973}, TTTTGGTTTAGCGGTCGTTTCGGGCGT {SEQ ID NO:2974}, TTTGGTTTAGCGGTCGTTTCGGGCGTA {SEQ ID NO:2975}, TTGGTTTAGCGGTCGTTTCGGGCGTAT {SEQ ID NO:2976}, TTTTTGGTTTAGCGGTCGTTTCGGGCG {SEQ ID NO:2977}, TTTTTGGTTTAGCGGTCGTTTCGGGCGT {SEQ ID NO:2978}

Target313    chr2:176964946-176964970    GGTCGTTGGGTTAGAGGAGCGCGGTC {SEQ ID NO:2979}, GGTCGTTGGGTTAGAGGAGCGCGGT {SEQ ID NO:2980}, GTCGTTGGGTTAGAGGAGCGCGGTC {SEQ ID NO:2981}, GGTCGTTGGGTTAGAGGAGCGCGG {SEQ ID NO:2982}, GTCGTTGGGTTAGAGGAGCGCGGT {SEQ ID NO:2983}, TTTTGGAGTAGGGTCGTGGAGTTCGGC {SEQ ID NO:2984}, TTTTTGGAGTAGGGTCGTGGAGTTCGGC {SEQ ID NO:2985}, GGGGCGTAGGGAGTTTTTTGGAGTAGGGT {SEQ ID NO:2986}, GGGGCGTAGGGAGTTTTTTGGAGTAGGG {SEQ ID NO:2987}, AGGGGCGTAGGGAGTTTTTTGGAGTAGGG {SEQ ID NO:2988}

Target314    chr2:176965003-176965036    GGGGGTTTTTTGCGTTTTTGGTTTTAAGGACG {SEQ ID NO:2989}, AGGGGGTTTTTTGCGTTTTTGGTTTTAAGGACG {SEQ ID NO:2990}, GGGGGTTTTTTGCGTTTTTGGTTTTAAGGACGA {SEQ ID NO:2991}, AGGGGGTTTTTTGCGTTTTTGGTTTTAAGGA {SEQ ID NO:2992}, GGGGTTTTTTGCGTTTTTGGTTTTAAGGACG {SEQ ID NO:2993}, TCGGTTCGGGGAGTATGGGTATCGTTT {SEQ ID NO:2994}, ATCGGTTCGGGGAGTATGGGTATCGTT {SEQ ID NO:2995}, AATCGGTTCGGGGAGTATGGGTATCGT {SEQ ID NO:2996}, TCGTCGGGTAGTGAAGGTCGTAGGTAA {SEQ ID NO:2997}, AGTTGAGCGGGTTTTTGGTGTCGTTTT {SEQ ID NO:2998}

Target315    chr2:176969353-176969393    TGGTTGCGTTTCGAAGGTTTGGTGCGT {SEQ ID NO:2999}, GCGGTTGGTTGCGTTTCGAAGGTTTGG {SEQ ID NO:3000}, GGTTGCGTTTCGAAGGTTTGGTGCGTT {SEQ ID NO:3001}, TTGGTTGCGTTTCGAAGGTTTGGTGCG {SEQ ID NO:3002}, TGGTTGCGTTTCGAAGGTTTGGTGCGTT {SEQ ID NO:3003}

Target316    chr2:176969516-176969530    GGGGGGGTAAGGGTTCGCGTTAAGGAGT {SEQ ID NO:3004}, AAGCGTTTTGGGTTGTGGAGTGGGTCG {SEQ ID NO:3005}, CGGGGGGGTAAGGGTTCGCGTTAAGGAG {SEQ ID NO:3006}, AGCGGGTTGGGATTGGAATGAAAGCGT {SEQ ID NO:3007}, CGGGGGGGTAAGGGGTTCGCGTTAAGGA {SEQ ID NO:3008}, ATAGGGGAAGGGGGCGGTCGGTTTTTT {SEQ ID NO:3009}, TTGTAGTGGCGCGTCGGTGTATAGGGG {SEQ ID NO:3010}, GTATAGGGGAAGGGGGCGGTCGGTTTT {SEQ ID NO:3011}, GTAGTGGCGCGTCGGTGTATAGGGGAA {SEQ ID NO:3012}, TAGTGGCGCGTCGGTGTATAGGGGAAG {SEQ ID NO:3013}

Target317    chr2:176969563-176969569    GGGGGGGTAAGGGTTCGCGTTAAGGAGT {SEQ ID NO:3014}, AAGCGTTTTGGGTTGTGGAGTGGGTCG {SEQ ID NO:3015}, CGGGGGGGTAAGGGTTCGCGTTAAGGAG {SEQ ID NO:3016}, AGCGGGTTGGGATTGGAATGAAAGCGT {SEQ ID NO:3017}, CGGGGGGGTAAGGGGTTCGCGTTAAGGA {SEQ ID NO:3018}, GCGATTTGGCGGGGGAGGGTGAGTTAT {SEQ ID NO:3019}, CGATTTGGCGGGGGAGGGTGAGTTATT {SEQ ID NO:3020}, GCGATTTGGCGGGGGAGGGTGAGTTA {SEQ ID NO:3021}, GCGATTTGGCGGGGGAGGGTGAGTTATT {SEQ ID NO:3022}, TTTGGCGGGGGAGGGTGAGTTATTTGT {SEQ ID NO:3023}

Target318    chr2:176969603-176969616    GGGGGGGTAAGGGTTCGCGTTAAGGAGT {SEQ ID NO:3024}, CGGGGGGGTAAGGGTTCGCGTTAAGGAG {SEQ ID NO:3025}, CGGGGGGGTAAGGGTTCGCGTTAAGGA {SEQ ID NO:3026}, GGGGGGGTAAGGGTTCGCGTTAAGGAGTC {SEQ ID NO:3027}, CGTTTTGGGTTGTGGAGTGGGTCGGG {SEQ ID NO:3028}, GGGTGGGGTGTAGGTAGTTCGGCGTTT {SEQ ID NO:3029}, GTACGGGGTGGGGTGTAGGTAGTTCGG {SEQ ID NO:3030}, GGTACGGGGTGGGGTGTAGGTAGTTCG {SEQ ID NO:3031}, TACGGGGTGGGGTGTAGGTAGTTCGGC {SEQ ID NO:3032}, GGGTGGGGTGTAGGTAGTTCGGCGTT {SEQ ID NO:3033}

FIGURE 5 CONTINUED

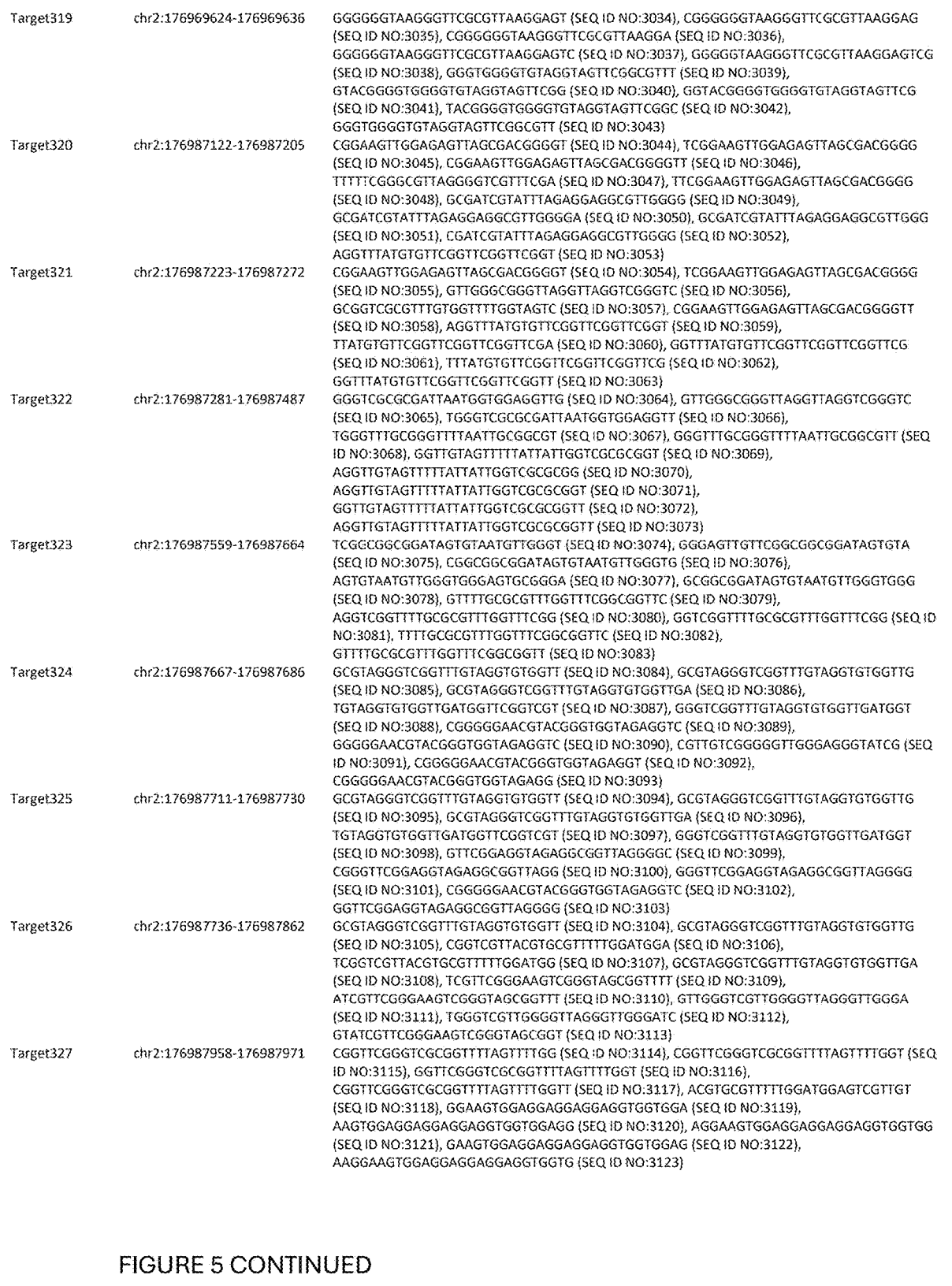

| | | |
|---|---|---|
| Target319 | chr2:176969624-176969636 | GGGGGGTAAGGGTTCGCGTTAAGGAGT (SEQ ID NO:3034), CGGGGGGTAAGGGTTCGCGTTAAGGAG (SEQ ID NO:3035), CGGGGGGTAAGGGTTCGCGTTAAGGA (SEQ ID NO:3036), GGGGGGTAAGGGTTCGCGTTAAGGAGTC (SEQ ID NO:3037), GGGGGTAAGGGTTCGCGTTAAGGAGTCG (SEQ ID NO:3038), GGGTGGGGTGTAGGGTAGTTCGGCGTTT (SEQ ID NO:3039), GTACGGGGTGGGGTGTAGGGTAGTTCGG (SEQ ID NO:3040), GGTACGGGGTGGGGTGTAGGGTAGTTCG (SEQ ID NO:3041), TACGGGGTGGGGTGTAGGGTAGTTCGGC (SEQ ID NO:3042), GGGTGGGGTGTAGGGTAGTTCGGCGTT (SEQ ID NO:3043) |
| Target320 | chr2:176987122-176987205 | CGGAAGTTGGAGAGTTAGCGACGGGGT (SEQ ID NO:3044), TCGGAAGTTGGAGAGTTAGCGACGGGG (SEQ ID NO:3045), CGGAAGTTGGAGAGTTAGCGACGGGGTT (SEQ ID NO:3046), TTTTTCGGGCGTTAGGGGTCGTTTCGA (SEQ ID NO:3047), TTCGGAAGTTGGAGAGTTAGCGACGGGG (SEQ ID NO:3048), GCGATCGTATTTAGAGGAGGCGTTGGGG (SEQ ID NO:3049), GCGATCGTATTTAGAGGAGGCGTTGGGGA (SEQ ID NO:3050), GCGATCGTATTTAGAGGAGGCGTTGGG (SEQ ID NO:3051), CGATCGTATTTAGAGGAGGCGTTGGGG (SEQ ID NO:3052), AGGTTTATGTGTTCGGTTCGGTTCGGT (SEQ ID NO:3053) |
| Target321 | chr2:176987223-176987272 | CGGAAGTTGGAGAGTTAGCGACGGGGT (SEQ ID NO:3054), TCGGAAGTTGGAGAGTTAGCGACGGGG (SEQ ID NO:3055), GTTGGGCGGGTTAGGTTAGGTCGGGTC (SEQ ID NO:3056), GCGGTCGCGTTTGTGGTTTTGGTAGTC (SEQ ID NO:3057), CGGAAGTTGGAGAGTTAGCGACGGGGTT (SEQ ID NO:3058), AGGTTTATGTGTTCGGTTCGGTTCGGT (SEQ ID NO:3059), TTATGTGTTCGGTTCGGTTCGGTTCGA (SEQ ID NO:3060), GGTTTATGTGTTCGGTTCGGTTCGGTTCG (SEQ ID NO:3061), TTTATGTGTTCGGTTCGGTTCGGTTCG (SEQ ID NO:3062), GGTTTATGTGTTCGGTTCGGTTCGGTT (SEQ ID NO:3063) |
| Target322 | chr2:176987281-176987487 | GGGTCGCGCGATTAATGGTGGAGGTTG (SEQ ID NO:3064), GTTGGGCGGGTTAGGTTAGGTCGGGTC (SEQ ID NO:3065), TGGGTCGCGCGATTAATGGTGGAGGTT (SEQ ID NO:3066), TGGGTTTGCGGGTTTTAATTGCGGCGT (SEQ ID NO:3067), GGGTTTGCGGGTTTTAATTGCGGCGTT (SEQ ID NO:3068), GGTTGTAGTTTTTATTATTGGTCGCGCGGT (SEQ ID NO:3069), AGGTTGTAGTTTTTATTATTGGTCGCGCGG (SEQ ID NO:3070), AGGTTGTAGTTTTTATTATTGGTCGCGCGGT (SEQ ID NO:3071), GGTTGTAGTTTTTATTATTGGTCGCGCGGTT (SEQ ID NO:3072), AGGTTGTAGTTTTTATTATTGGTCGCGCGGTT (SEQ ID NO:3073) |
| Target323 | chr2:176987559-176987664 | TCGGCGGCGGATAGTGTAATGTTGGGT (SEQ ID NO:3074), GGGAGTTGTTCGGCGGCGGATAGTGTA (SEQ ID NO:3075), CGGCGGCGGATAGTGTAATGTTGGGTG (SEQ ID NO:3076), AGTGTAATGTTGGGTGGGAGTGCGGGA (SEQ ID NO:3077), GCGGCGGATAGTGTAATGTTGGGTGGG (SEQ ID NO:3078), GTTTTGCGCGTTTGGTTTCGGCGGTTC (SEQ ID NO:3079), AGGTCGGTTTTGCGCGTTTGGTTTCGG (SEQ ID NO:3080), GGTCGGTTTTGCGCGTTTGGTTTCGG (SEQ ID NO:3081), TTTTGCGCGTTTGGTTTCGGCGGTTC (SEQ ID NO:3082), GTTTTGCGCGTTTGGTTTCGGCGGTT (SEQ ID NO:3083) |
| Target324 | chr2:176987667-176987686 | GCGTAGGGTCGGTTTGTAGGTGTGGTT (SEQ ID NO:3084), GCGTAGGGTCGGTTTGTAGGTGTGGTTG (SEQ ID NO:3085), GCGTAGGGTCGGTTTGTAGGTGTGGTTGA (SEQ ID NO:3086), TGTAGGTGTGGTTGATGGTTCGGTCGT (SEQ ID NO:3087), GGGTCGGTTTGTAGGTGTGGTTGATGGT (SEQ ID NO:3088), CGGGGGAACGTACGGGTGGTAGAGGTC (SEQ ID NO:3089), GGGGGGAACGTACGGGTGGTAGAGGTC (SEQ ID NO:3090), CGTTGTCGGGGGTTGGGAGGGTATCG (SEQ ID NO:3091), CGGGGGGAACGTACGGGTGGTAGAGGT (SEQ ID NO:3092), CGGGGGAACGTACGGGTGGTAGAGG (SEQ ID NO:3093) |
| Target325 | chr2:176987711-176987730 | GCGTAGGGTCGGTTTGTAGGTGTGGTT (SEQ ID NO:3094), GCGTAGGGTCGGTTTGTAGGTGTGGTTG (SEQ ID NO:3095), GCGTAGGGTCGGTTTGTAGGTGTGGTTGA (SEQ ID NO:3096), TGTAGGTGTGGTTGATGGTTCGGTCGT (SEQ ID NO:3097), GGGTCGGTTTGTAGGTGTGGTTGATGGT (SEQ ID NO:3098), GTTCGGAGGTAGAGGCGGTTAGGGGC (SEQ ID NO:3099), CGGGTTCGGAGGTAGAGGCGGTTAGG (SEQ ID NO:3100), GGGTTCGGAGGTAGAGGCGGTTAGGGG (SEQ ID NO:3101), CGGGGGAACGTACGGGTGGTAGAGGTC (SEQ ID NO:3102), GGTTCGGAGGTAGAGGCGGTTAGGGG (SEQ ID NO:3103) |
| Target326 | chr2:176987736-176987862 | GCGTAGGGTCGGTTTGTAGGTGTGGTT (SEQ ID NO:3104), GCGTAGGGTCGGTTTGTAGGTGTGGTTG (SEQ ID NO:3105), CGGTCGTTACGTGCGTTTTTGGATGG (SEQ ID NO:3106), TCGGTCGTTACGTGCGTTTTTGGATGG (SEQ ID NO:3107), GCGTAGGGTCGGTTTGTAGGTGTGGTTGA (SEQ ID NO:3108), TCGTTCGGGAAGTCGGGTAGCGGTTTT (SEQ ID NO:3109), ATCGTTCGGGAAGTCGGGTAGCGGTTT (SEQ ID NO:3110), GTTGGGTCGTTGGGGTTAGGGTTGGGA (SEQ ID NO:3111), TGGGTCGTTGGGGTTAGGGTTGGGATC (SEQ ID NO:3112), GTATCGTTCGGGAAGTCGGGTAGCGGT (SEQ ID NO:3113) |
| Target327 | chr2:176987958-176987971 | CGGTTCGGGTCGCGGTTTTAGTTTTGG (SEQ ID NO:3114), CGGTTCGGGTCGCGGTTTTAGTTTTGGT (SEQ ID NO:3115), GGTTCGGGTCGCGGTTTTAGTTTTGGT (SEQ ID NO:3116), CGGTTCGGGTCGCGGTTTTAGTTTTGGTT (SEQ ID NO:3117), ACGTGCGTTTTTGGATGGAGTCGTTGT (SEQ ID NO:3118), GGAAGTGGAGGAGGAGGAGGTGGTGGA (SEQ ID NO:3119), AAGTGGAGGAGGAGGAGGTGGTGGAGG (SEQ ID NO:3120), AGGAAGTGGAGGAGGAGGAGGTGGTGG (SEQ ID NO:3121), GAAGTGGAGGAGGAGGAGGTGGTGGAG (SEQ ID NO:3122), AAGGAAGTGGAGGAGGAGGAGGTGGTG (SEQ ID NO:3123) |

FIGURE 5 CONTINUED

| | | |
|---|---|---|
| Target328 | chr2:176988078-176988129 | GGTTCGGGAGTTTTAGGGGAGTAGCGGT (SEQ ID NO:3124), TGGTTCGGGAGTTTTAGGGGAGTAGCGG (SEQ ID NO:3125), GGTTCGGGAGTTTTAGGGGAGTAGCGG (SEQ ID NO:3126), GTGGTTCGGGAGTTTTAGGGGAGTAGCGG (SEQ ID NO:3127), GTTCGGGAGTTTTAGGGGAGTAGCGGT (SEQ ID NO:3128), TCGGGTGGTCGTTGTAAGTTGAGGGTT (SEQ ID NO:3129), GGGATCGGGTGGTCGTTGTAAGTTGAGGG (SEQ ID NO:3130), ATCGGGTGGTCGTTGTAAGTTGAGGGT (SEQ ID NO:3131), TGGGATCGGGTGGTCGTTGTAAGTTGA (SEQ ID NO:3132), GGATCGGGTGGTCGTTGTAAGTTGAGGG (SEQ ID NO:3133) |
| Target329 | chr2:176988152-176988159 | GGTTCGGGAGTTTTAGGGGAGTAGCGGT (SEQ ID NO:3134), TGGTTCGGGAGTTTTAGGGGAGTAGCGG (SEQ ID NO:3135), GGTTCGGGAGTTTTAGGGGAGTAGCGG (SEQ ID NO:3136), GTGGTTCGGGAGTTTTAGGGGAGTAGCGG (SEQ ID NO:3137), GTTCGGGAGTTTTAGGGGAGTAGCGG (SEQ ID NO:3138), TCGGGTGGTCGTTGTAAGTTGAGGGTT (SEQ ID NO:3139), GGGATCGGGTGGTCGTTGTAAGTTGAGGG (SEQ ID NO:3140), ATCGGGTGGTCGTTGTAAGTTGAGGGT (SEQ ID NO:3141), TGGGATCGGGTGGTCGTTGTAAGTTGA (SEQ ID NO:3142), GGATCGGGTGGTCGTTGTAAGTTGAGGG (SEQ ID NO:3143) |
| Target330 | chr2:176988168-176988204 | GGGGGAATCGGGTTTGGGGTAGGGATC (SEQ ID NO:3144), GAATCGGGTTTGGGGTAGGGATCGGGG (SEQ ID NO:3145), GGAATCGGGTTTGGGGTAGGGATCGGG (SEQ ID NO:3146), GGGAATCGGGTTTGGGGTAGGGATCGG (SEQ ID NO:3147), GGGGAATCGGGTTTGGGGTAGGGATCG (SEQ ID NO:3148), TCGGGTGGTCGTTGTAAGTTGAGGGTT (SEQ ID NO:3149), GGGATCGGGTGGTCGTTGTAAGTTGAGGG (SEQ ID NO:3150), ATCGGGTGGTCGTTGTAAGTTGAGGGT (SEQ ID NO:3151), TGGGATCGGGTGGTCGTTGTAAGTTGA (SEQ ID NO:3152), GGATCGGGTGGTCGTTGTAAGTTGAGGG (SEQ ID NO:3153) |
| Target331 | chr2:176988234-176988258 | GGGGGAATCGGGTTTGGGGTAGGGATC (SEQ ID NO:3154), GAATCGGGTTTGGGGTAGGGATCGGGG (SEQ ID NO:3155), GGAATCGGGTTTGGGGTAGGGATCGGG (SEQ ID NO:3156), GGGAATCGGGTTTGGGGTAGGGATCGG (SEQ ID NO:3157), GGGGAATCGGGTTTGGGGTAGGGATCG (SEQ ID NO:3158), ATTTATTTGGGTTAAGTTGTTGTTGTTGCGGTTG (SEQ ID NO:3159), TGTATTTATTTGGGTTAAGTTGTTGTTGTTGCGGT (SEQ ID NO:3160), TGTATTTATTTGGGTTAAGTTGTTGTTGTTGCGGTT (SEQ ID NO:3161), TTGTATTTATTTGGGTTAAGTTGTTGTTGTTGCGGT (SEQ ID NO:3162), GTATTTATTTGGGTTAAGTTGTTGTTGTTGCGGTTG (SEQ ID NO:3163) |
| Target332 | chr2:176994682-176994729 | GGTGGCGGCGGGTAGAGGGTGTTTTTT (SEQ ID NO:3164), GTGGCGGCGGGTAGAGGGTGTTTTTT (SEQ ID NO:3165), GTAAGAGGTGGCGGCGGGTAGAGGGTG (SEQ ID NO:3166), AGGTGGCGGCGGGTAGAGGGTGTTTTT (SEQ ID NO:3167), GGTGGCGGCGGGTAGAGGGTGTTTTT (SEQ ID NO:3168), CGGGGTTTCGTTTAGTTTTCGCGCGTC (SEQ ID NO:3169), CGGGTCGCGGGGTTTCGTTTAGTTTTCG (SEQ ID NO:3170), GGGTCGCGGGGTTTCGTTTAGTTTTCG (SEQ ID NO:3171), CGGGTCGCGGGGTTTCGTTTAGTTTTC (SEQ ID NO:3172), CGGGGTTTCGTTTAGTTTTCGCGCGT (SEQ ID NO:3173) |
| Target333 | chr2:176994747-176994872 | GTGGAGGTAGCGGGGTAGGTCGTTTGG (SEQ ID NO:3174), GATTATATTGCGGTCGAGTCGGGGCGC (SEQ ID NO:3175), AGTGGAGGTAGCGGGGTAGGTCGTTTG (SEQ ID NO:3176), ATTATATTGCGGTCGAGTCGGGGCGCG (SEQ ID NO:3177), GAGGTAGCGGGGTAGGTCGTTTGGGG (SEQ ID NO:3178), CGGGGTTTCGTTTAGTTTTCGCGCGTC (SEQ ID NO:3179), CGGGTCGCGGGGTTTCGTTTAGTTTTCG (SEQ ID NO:3180), GGGTCGCGGGGTTTCGTTTAGTTTTCG (SEQ ID NO:3181), CGGGTCGCGGGGTTTCGTTTAGTTTTC (SEQ ID NO:3182), CGTTTTTGAGGTTAGGTAGTCGCGGGC (SEQ ID NO:3183) |
| Target334 | chr2:176994931-176994997 | CGGGTATGAGCGTTTAGTAGTTGAGCGT (SEQ ID NO:3184), TCGGGTATGAGCGTTTAGTAGTTGAGCGT (SEQ ID NO:3185), TCGGGTATGAGCGTTTAGTAGTTGAGCG (SEQ ID NO:3186), GTCGGGTATGAGCGTTTAGTAGTTGAGCG (SEQ ID NO:3187), GTCGGGTATGAGCGTTTAGTAGTTGAGCGT (SEQ ID NO:3188), GGTTTGTGGGGCGGTTGTTTTCGTCGT (SEQ ID NO:3189), TTCGGTCGTATTGTCGCGGGGGTTTGT (SEQ ID NO:3190), ATTCGGTCGTATTGTCGCGGGGGTTTG (SEQ ID NO:3191), GGGGTTTGTGGGGCGGTTGTTTTCGTC (SEQ ID NO:3192), GGGTTTGTGGGGCGGTTGTTTTCGTCG (SEQ ID NO:3193) |
| Target335 | chr2:176995021-176995056 | CGGTTTCGGCGGCGAGAGTAGTC (SEQ ID NO:3194), CGGTTTCGGCGGCGAGAGTAGT (SEQ ID NO:3195), GTAGTCGTTTTATAGGTTTTCGCGGTAGTGC (SEQ ID NO:3196), AGTAGTCGTTTTATAGGTTTTCGCGGTAGTGC (SEQ ID NO:3197), GAGTAGTCGTTTTATAGGTTTTCGCGGTAGTGC (SEQ ID NO:3198), GCGGGCGGCGTTAAGTAGTTAGAGAGC (SEQ ID NO:3199), CGGGCGGCGTTAAGTAGTTAGAGAGCG (SEQ ID NO:3200), CGGGCGGCGTTAAGTAGTTAGAGAGCGA (SEQ ID NO:3201), GCGGGCGGCGTTAAGTAGTTAGAGAGCG (SEQ ID NO:3202), GGGCGGCGTTAAGTAGTTAGAGAGCGA (SEQ ID NO:3203) |
| Target336 | chr2:176995079-176995332 | AGGTTCGTTTTTTGGTTGTTTAGCGTCGT (SEQ ID NO:3204), GAGGTTCGTTTTTTGGTTGTTTAGCGTCGT (SEQ ID NO:3205), CGGTTTCGGCGGCGAGAGTAGTC (SEQ ID NO:3206), AGGTTCGTTTTTTGGTTGTTTAGCGTCGTT (SEQ ID NO:3207), GGTTCGTTTTTTGGTTGTTTAGCGTCGTTC (SEQ ID NO:3208), TCGGGTTGTTTTCGTCGGGGTGGAAGT (SEQ ID NO:3209), TATTTAGTTTCGGAGGGCGGCGGGGAC (SEQ ID NO:3210), GTATTTAGTTTCGGAGGGCGGCGGGGA (SEQ ID NO:3211), GTCGGGTTGTTTTCGTCGGGGTGGAAG (SEQ ID NO:3212), CGGTTTGGTAGGTAGCGGTCGGGGTTGT (SEQ ID NO:3213) |

FIGURE 5 CONTINUED

| Target337 | chr2:177016978-177017125 | GTTCGGTTGTGGGCGTAAAAGGGGGTG (SEQ ID NO:3214), GGGGCGTGTGGAGTTTTTATGGGCGTC (SEQ ID NO:3215), GTGGGGGCGTGTGGAGTTTTTATGGGC (SEQ ID NO:3216), ATGTGGTTGGTTGTTCGGTTGTGGGCG (SEQ ID NO:3217), GGCGTGTGGAGTTTTTATGGGCGTCGT (SEQ ID NO:3218) |
|---|---|---|
| Target338 | chr2:177017223-177017375 | GGCGGGAGGGAGGAAGTAAGCGAGTTT (SEQ ID NO:3219), TGTTTGAGGAGGTGGGTGGGAGTGAGC (SEQ ID NO:3220), GGTGTGTTTGAGGAGGTGGGTGGGAGT (SEQ ID NO:3221), TGTGGGTGTGTTTGAGGAGGTGGGTGG (SEQ ID NO:3222), GGGTGTGTTTGAGGAGGTGGGTGGGAG (SEQ ID NO:3223), TTGTTGTCGGGTGTAGGTCGTTCGGGA (SEQ ID NO:3224), TGTTGTCGGGTGTAGGTCGTTCGGGAT (SEQ ID NO:3225), TTTGTTGTCGGGTGTAGGTCGTTCGGG (SEQ ID NO:3226), TGTTGTCGGGTGTAGGTCGTTCGGGATC (SEQ ID NO:3227), GTTGTCGGGTGTAGGTCGTTCGGGATC (SEQ ID NO:3228) |
| Target339 | chr2:177017446-177017464 | GGGTGTGAGCGATTTTAATTCGACGGT (SEQ ID NO:3229), AGGGTGTGAGCGATTTTAATTCGACGGT (SEQ ID NO:3230), TAGGGTGTGAGCGATTTTAATTCGACGGT (SEQ ID NO:3231), ATAGGGTGTGAGCGATTTTAATTCGACGGT (SEQ ID NO:3232), TATAGGGTGTGAGCGATTTTAATTCGACGGT (SEQ ID NO:3233) |
| Target340 | chr2:177017483-177017516 | TGTGTTTGTCGGAGCGTTAGATTAAGATTTGGT (SEQ ID NO:3234), GTGTTTGTCGGAGCGTTAGATTAAGATTTGGTT (SEQ ID NO:3235), TTGTGTTTGTCGGAGCGTTAGATTAAGATTTGG (SEQ ID NO:3236), TGTGTTTGTCGGAGCGTTAGATTAAGATTTGGTT (SEQ ID NO:3237), TTGTGTTTGTCGGAGCGTTAGATTAAGATTTGGT (SEQ ID NO:3238), TGTTGGTTGGGGGCGATTGAGGAGGAG (SEQ ID NO:3239), GTTGGTTGGGGGCGATTGAGGAGGAGT (SEQ ID NO:3240), ATGTTGGTTGGGGGCGATTGAGGAGGA (SEQ ID NO:3241), TGGTTGGGGGCGATTGAGGAGGAGTAA (SEQ ID NO:3242), TTGGTTGGGGGCGATTGAGGAGGAGTA (SEQ ID NO:3243) |
| Target341 | chr2:177024222-177024286 | CGTTTTTGGAGTGGGGATGCGGTGGAT (SEQ ID NO:3244), CGTTTTTGGAGTGGGGATGCGGTGGATT (SEQ ID NO:3245), CGTTTTTGGAGTGGGGATGCGGTGGA (SEQ ID NO:3246), GTTTTTGGAGTGGGGATGCGGTGGATT (SEQ ID NO:3247), CGTTTTTGGAGTGGGGATGCGGTGGATTT (SEQ ID NO:3248), GGTTGGTGGGAATGATTTTGTAATGTGGAA (SEQ ID NO:3249), AGTAGCGGATTTTTTGGTTTGTAATGAGCGT (SEQ ID NO:3250), GGTTGGTGGGAATGATTTTGTAATGTGGGAAA (SEQ ID NO:3251), AGTAGCGGATTTTTTGGTTTGTAATGAGCGTT (SEQ ID NO:3252), GCGTTAGTAGCGGATTTTTTGGTTTGTAATGAGCG (SEQ ID NO:3253) |
| Target342 | chr2:177024294-177024328 | AGTGTGGTTTCGGTTGGGGGAGGGTTT (SEQ ID NO:3254), GTGGTTTCGGTTGGGGGAGGGTTTTGG (SEQ ID NO:3255), GAGTGTGGTTTCGGTTGGGGGAGGGTT (SEQ ID NO:3256), GTGTGGTTTCGGTTGGGGGAGGGTTTT (SEQ ID NO:3257), TGTGGTTTCGGTTGGGGGAGGGTTTTG (SEQ ID NO:3258), TGGTTGGTGGGAATGATTTTGTAATGTGGG (SEQ ID NO:3259), TGGTTGGTGGGAATGATTTTGTAATGTGGGA (SEQ ID NO:3260), GTGGTTGGTGGGAATGATTTTGTAATGTGGG (SEQ ID NO:3261), AGTGGTTGGTGGGAATGATTTTGTAATGTGGG (SEQ ID NO:3262), GTGGTTGGTGGGAATGATTTTGTAATGTGGGA (SEQ ID NO:3263) |
| Target343 | chr2:177024350-177024656 | AGTGTGGTTTCGGTTGGGGGAGGGTTT (SEQ ID NO:3264), GGTTTGGCGGTTGTTGGGTTTGTGGGA (SEQ ID NO:3265), GTGGTTTCGGTTGGGGGAGGGTTTTGG (SEQ ID NO:3266), GCGGTTGTTGGGTTTGTGGGATTTGCG (SEQ ID NO:3267), GAGTGTGGTTTCGGTTGGGGGAGGGTT (SEQ ID NO:3268), AGGAAGGCGAGGAGGATTGCGTAATGA (SEQ ID NO:3269), GGAAGGCGAGGAGGATTGCGTAATGAGT (SEQ ID NO:3270), GGAAGGCGAGGAGGATTGCGTAATGAG (SEQ ID NO:3271), CGAGGTTTGGAGTCGTTTAGGCGTTGA (SEQ ID NO:3272), AGGAAGGCGAGGAGGATTGCGTAATGAGT (SEQ ID NO:3273) |
| Target344 | chr2:177029880-177029993 | AGGGTGTAAGAGCGGGAAAAGTGCGGA (SEQ ID NO:3274), AGAGCGGGAAAAGTGCGGAGTAGGGAA (SEQ ID NO:3275), AAGAGCGGGAAAAGTGCGGAGTAGGGA (SEQ ID NO:3276), GGGTGTAAGAGCGGGAAAAGTGCGGAG (SEQ ID NO:3277), GGTGTAAGAGCGGGAAAAGTGCGGAGT (SEQ ID NO:3278), GCGTTTATAGCGATTAGGGGACGGGGT (SEQ ID NO:3279), GCGTTTATAGCGATTAGGGGACGGGGTT (SEQ ID NO:3280), CGGCGGTAGTAAACGTTTCGGTAAGGA (SEQ ID NO:3281), CGTTTATAGCGATTAGGGGACGGGGTT (SEQ ID NO:3282), GCGTTTATAGCGATTAGGGGACGGGG (SEQ ID NO:3283) |
| Target345 | chr2:177030040-177030172 | ATTAGGGTTCGGTTGTTTTGGAGGCGT (SEQ ID NO:3284), TAGGGTTCGGTTGTTTTGGAGGCGTAG (SEQ ID NO:3285), TTAGGGTTCGGTTGTTTTGGAGGCGTA (SEQ ID NO:3286), AGGGTTCGGTTGTTTTGGAGGCGTAG (SEQ ID NO:3287), TTAGGGTTCGGTTGTTTTGGAGGCGTAG (SEQ ID NO:3288), TGTCGGAAGGAAGGTATTTTTTGAGCGGT (SEQ ID NO:3289), TGTCGGAAGGAAGGTATTTTTTGAGCGGTT (SEQ ID NO:3290), TTGTCGGAAGGAAGGTATTTTTTGAGCGGT (SEQ ID NO:3291), GTCGGAAGGAAGGTATTTTTTGAGCGGTT (SEQ ID NO:3292), TTGTCGGAAGGAAGGTATTTTTTGAGCGG (SEQ ID NO:3293) |
| Target346 | chr2:177030178-177030289 | ATTAGGGTTCGGTTGTTTTGGAGGCGT (SEQ ID NO:3294), TAGGGTTCGGTTGTTTTGGAGGCGTAG (SEQ ID NO:3295), TTAGGGTTCGGTTGTTTTGGAGGCGTA (SEQ ID NO:3296), GGTTTTGTATTTCGGGTTTGCGGTTGGGT (SEQ ID NO:3297), TGGTTTTGTATTTCGGGTTTGCGGTTGGG (SEQ ID NO:3298), GGGTTAAACGGTTTTTTGTCGGAAGGAAGG (SEQ ID NO:3299), |

FIGURE 5 CONTINUED

GGGTTAAACGGTTTTTTGTCGGAAGGAAGGT (SEQ ID NO:3300),
AGGGTTAAACGGTTTTTTGTCGGAAGGAAGG (SEQ ID NO:3301),
AGGGGTTAAACGGTTTTTTGTCGGAAGGAAGGT (SEQ ID NO:3302),
GGTTAAACGGTTTTTTGTCGGAAGGAAGGT (SEQ ID NO:3303)

Target347   chr2:198650923-198650988   TATTTGGCGGGTGGGGAGAAGCGGATT (SEQ ID NO:3304), TTATTTGGCGGGTGGGGAGAAGCGGAT (SEQ ID NO:3305), GATTGCGTCGTTTCGGGTGGTAGGTGG (SEQ ID NO:3306), GGATTGCGTCGTTTCGGGTGGTAGGTG (SEQ ID NO:3307), GCGGCGAGGGTGGTTGTGGTAGTTGTA (SEQ ID NO:3308), CGTTCGTTTCGTTGTGTCGTGCGTTTT (SEQ ID NO:3309), CGTTCGTTTCGTTGTGTCGTGCGTTTTG (SEQ ID NO:3310), CGTTCGTTTCGTTGTGTCGTGCGTTTTGT (SEQ ID NO:3311), TCGTTTCGTTGTGTCGTGCGTTTGTT (SEQ ID NO:3312), TTCGTTTCGTTGTGTCGTGCGTTTTGT (SEQ ID NO:3313)

Target348   chr2:198651002-198651144   GTGGTTTTGGGATTTCGAGTCGGGGCG (SEQ ID NO:3314), TATTTGGCGGGTGGGGAGAAGCGGATT (SEQ ID NO:3315), TTATTTGGCGGGTGGGGAGAAGCGGAT (SEQ ID NO:3316), GGGCGTTTTAGGGGGTAGAGCGTACGGT (SEQ ID NO:3317), TCGGGGCGTTTTAGGGGGTAGAGCGTAC (SEQ ID NO:3318), TGGAGGAGAGGGGAAGGCGTGTATGGA (SEQ ID NO:3319), GTGGAGGAGAGGGGAAGGCGTGTATGG (SEQ ID NO:3320), GGAGGAGAGGGGAAGGCGTGTATGGAG (SEQ ID NO:3321), AGTGGAGGAGAGGGGAAGGCGTGTATG (SEQ ID NO:3322), AGTCGTTTGAGAGAAGGCGAGAGGGGT (SEQ ID NO:3323)

Target349   chr2:200335558-200335593   TGTCGGAGTTTTCGTATCGTGCGTTTT (SEQ ID NO:3324), TTGTCGGAGTTTTCGTATCGTGCGTTTT (SEQ ID NO:3325), TTTGTCGGAGTTTTCGTATCGTGCGTTT (SEQ ID NO:3326), TTTTGTCGGAGTTTTCGTATCGTGCGTT (SEQ ID NO:3327), TTTTTGTCGGAGTTTTCGTATCGTGCGT (SEQ ID NO:3328), CGGGGTCGTTAGTTTTTTTGAAGGGCGT (SEQ ID NO:3329), TTTTGGGGTGAAAGATTCGGGTGCGAA (SEQ ID NO:3330), TTTTTGGGGTGAAAGATTCGGGTGCGA (SEQ ID NO:3331), TTTTTTGGGGTGAAAGATTCGGGTGCG (SEQ ID NO:3332), TTTTTTGGGGTGAAAGATTCGGGTGCGAA (SEQ ID NO:3333)

Target350   chr2:200335807-200335821   CGGCGAGTGTAAAGTAGTTGCGTTTCG (SEQ ID NO:3334), TCGGCGAGTGTAAAGTAGTTGCGTTTCG (SEQ ID NO:3335), ATCGGCGAGTGTAAAGTAGTTGCGTTTCG (SEQ ID NO:3336), AGAATCGGCGAGTGTAAAGTAGTTGCGT (SEQ ID NO:3337), ATCGGCGAGTGTAAAGTAGTTGCGTTTC (SEQ ID NO:3338), TGTTCGGTATTTGCGCGTGTTTTGGGT (SEQ ID NO:3339), TCGGTATTTGCGCGTGTTTTGGGTAGT (SEQ ID NO:3340), TTGTTCGGTATTTGCGCGTGTTTTGGGT (SEQ ID NO:3341), TTGTTCGGTATTTGCGCGTGTTTTGGG (SEQ ID NO:3342), TGTTCGGTATTTGCGCGTGTTTTGGGTA (SEQ ID NO:3343)

Target351   chr2:209271397-209271466   ATATTGCGAATCGGGGGTGGCGGTAGT (SEQ ID NO:3344), ATTGCGAATCGGGGGTGGCGGTAGTAG (SEQ ID NO:3345), GAAATATTGCGAATCGGGGGTGGCGGT (SEQ ID NO:3346), TATTGCGAATCGGGGGTGGCGGTAGTA (SEQ ID NO:3347), AGAAATATTGCGAATCGGGGGTGGCGG (SEQ ID NO:3348), CGGCGCGAGGTTGGTTTTGTTTTTCGG (SEQ ID NO:3349), GCGGCGCGAGGTTGGTTTTGTTTTTCG (SEQ ID NO:3350), GGCGCGAGGTTGGTTTTGTTTTTCGGA (SEQ ID NO:3351), CGGCGCGAGGTTGGTTTTGTTTTTCGGA (SEQ ID NO:3352), GGCGCGAGGTTGGTTTTGTTTTTCGGAG (SEQ ID NO:3353)

Target352   chr2:209271483-209271606   GGGATTTAGTGATTTCGAGGAGGAGCGCG (SEQ ID NO:3354), CGGGATTTAGTGATTTCGAGGAGGAGCGC (SEQ ID NO:3355), GCGGGATTTAGTGATTTCGAGGAGGAGCG (SEQ ID NO:3356), TGCGGGATTTAGTGATTTCGAGGAGGAGCG (SEQ ID NO:3357), GGGATTTAGTGATTTCGAGGAGGAGCGCGA (SEQ ID NO:3358), GGGTTATCGGTCGAGGGTGTTTGGGGT (SEQ ID NO:3359), CGAGGGTGTTTGGGGTTTTGTCGTCGG (SEQ ID NO:3360), CGGTCGAGGGTGTTTGGGGTTTTGTCG (SEQ ID NO:3361), TCGGGTTATCGGTCGAGGGTGTTTGGG (SEQ ID NO:3362), CGGCGCGAGGTTGGTTTTGTTTTTCGG (SEQ ID NO:3363)

Target353   chr2:209271626-209271639   CGGCGATAAGATTTTAAGTATTTTCGGTCGGTGG (SEQ ID NO:3364), TCGGCGATAAGATTTTAAGTATTTTCGGTCGGT (SEQ ID NO:3365), CGGCGATAAGATTTTAAGTATTTTCGGTCGGTGGT (SEQ ID NO:3366), CGGCGATAAGATTTTAAGTATTTTCGGTCGGTG (SEQ ID NO:3367), TCGGCGATAAGATTTTAAGTATTTTCGGTCGGTGG (SEQ ID NO:3368), CGCGTAGTTGGGGTGGTCGGGGTTC (SEQ ID NO:3369), CGCGTAGTTGGGGTGGTCGGGGTT (SEQ ID NO:3370), CGCGTAGTTGGGGTGGTCGGGGT (SEQ ID NO:3371), GCGTAGTTGGGGTGGTCGGGGTTC (SEQ ID NO:3372), GACGCGTAGTTGGGGTGGTCGG (SEQ ID NO:3373)

Target354   chr2:220313171-220313218   TCGTTTAGGTTGGTGCGCGTCGGTTTT (SEQ ID NO:3374), TGGAGTAGTTTAAGTCGGAGCGCGGCG (SEQ ID NO:3375), ATCGTTTAGGTTGGTGCGCGTCGGTTT (SEQ ID NO:3376), GGAGTAGTTTAAGTCGGAGCGCGGCG (SEQ ID NO:3377), CGTTTAGGTTGGTGCGCGTCGGTTTTC (SEQ ID NO:3378), GAGGTTTCGGGGGTGTTTTACGGTGCG (SEQ ID NO:3379), AGGTTTCGGGGGTGTTTTACGGTGCG (SEQ ID NO:3380), GGTCGTTTTTTGTTGGAATAGGCGGCGT (SEQ ID NO:3381), GGTCGTTTTTTGTTGGAATAGGCGGCG (SEQ ID NO:3382), AGGTCGTTTTTTGTTGGAATAGGCGGCG (SEQ ID NO:3383)

Target355   chr2:220313238-220313493   GTTTTACGTCGCGGGAGGAGTTGGTGC (SEQ ID NO:3384), AGTTTAAGTCGGAGCGCGGCGTATCGT (SEQ ID NO:3385), CGGCGTATCGTGGGGTATTTTCGGGGT (SEQ ID NO:3386), TGGAGTAGTTTAAGTCGGAGCGCGGCG (SEQ ID NO:3387), GGAGTAGTTTAAGTCGGAGCGCGGCGT (SEQ ID NO:3388), CGATGTTTTGGGGGTGGAGGGTCGAGA (SEQ ID NO:3389),

FIGURE 5 CONTINUED

|  |  | CGAGGTTTGAGGTCGGGTTGCGTTGAC (SEQ ID NO:3390), TGTTCGTCGGTTCGCGGTTTTTGGGTT (SEQ ID NO:3391), CGGGTTTTCGAGGGGATGGGGTACGTT (SEQ ID NO:3392), TACGGTTCGCGATGTTTTGGGGGTGGA (SEQ ID NO:3393) |
|---|---|---|
| Target356 | chr2:220313516-220313601 | GGGGGACGAGTTTGGGAGGTTTAGGGAGT (SEQ ID NO:3394), GGGGGACGAGTTTGGGAGGTTTAGGGAG (SEQ ID NO:3395), GCGGGAGGAGTTGGTGCGTTCGTAC (SEQ ID NO:3396), GGGGACGAGTTTGGGAGGTTTAGGGAGT (SEQ ID NO:3397), GGGGGACGAGTTTGGGAGGTTTAGGGAGTC (SEQ ID NO:3398), TGTTCGTCGGTTCGCGGTTTTTGGGTT (SEQ ID NO:3399), TTGTTCGTCGGTTCGCGGTTTTTGGGT (SEQ ID NO:3400), GTTCGTCGGTTCGCGGTTTTTGGGTTT (SEQ ID NO:3401), TTTGTTCGTCGGTTCGCGGTTTTTGGG (SEQ ID NO:3402), TGTTCGTCGGTTCGCGGTTTTTGGGTTT (SEQ ID NO:3403) |
| Target357 | chr2:220313607-220313723 | GCGGGTAGGATAGAGTCGGGGGAAGGT (SEQ ID NO:3404), AGTTTGGGAGGTTTAGGGAGTCGCGGGT (SEQ ID NO:3405), GGCGGGTAGGATAGAGTCGGGGGGAAGG (SEQ ID NO:3406), CGGCGGGTAGGATAGAGTCGGGGGAAG (SEQ ID NO:3407), GTTTGGGAGGTTTAGGGAGTCGCGGGTC (SEQ ID NO:3408), TCGTTTTGGTTTTTGGGGGATCGGCGG (SEQ ID NO:3409), GTACGGTTTGCGTCGGGGGTTTCGTT (SEQ ID NO:3410), TTCGGCGTGGTTTAGGGTAGGAAGCGT (SEQ ID NO:3411), TACGGTTTGCGTCGGGGGTTTCGTTT (SEQ ID NO:3412), CGGTTTGCGTCGGGGGTTTCGTTTTC (SEQ ID NO:3413) |
| Target358 | chr2:220313761-220313815 | GGTCGTGCGTTTTTTGTTTTGGGTTACG (SEQ ID NO:3414), AGGTCGTGCGTTTTTTGTTTTGGGTTACG (SEQ ID NO:3415), GGCGTCGGGATTAATTTTCGTTGATTCGG (SEQ ID NO:3416), AGGCGTCGGGATTAATTTTCGTTGATTCGG (SEQ ID NO:3417), GGCGTCGGGATTAATTTTCGTTGATTCGGA (SEQ ID NO:3418), ACGGTTTGCGTCGGGGGTTTTCGTTTT (SEQ ID NO:3419), GTACGGTTTGCGTCGGGGGTTTTCGTT (SEQ ID NO:3420), TTCGGCGTGGTTTAGGGTAGGAAGCGT (SEQ ID NO:3421), TACGGTTTGCGTCGGGGGTTTTCGTTT (SEQ ID NO:3422), CGGTTTGCGTCGGGGGTTTTCGTTTTC (SEQ ID NO:3423) |
| Target359 | chr2:220313830-220313892 | ACGTCGGGTTTGGAGGGCGTTGTTGTA (SEQ ID NO:3424), CGTCGGGTTTGGAGGGCGTTGTTGTAT (SEQ ID NO:3425), TTTTGGGTTACGTCGGGTTTGGAGGGC (SEQ ID NO:3426), GGGCGGGGTTTGAGGTAGAGAAGAGGT (SEQ ID NO:3427), AGGGCGGGGTTTGAGGTAGAGAAGAGG (SEQ ID NO:3428), CGAGTTTAGGGGGAGGTGGGTCGGGTTC (SEQ ID NO:3429), ATCGAGTTTAGGGGGAGGTGGGTCGGGT (SEQ ID NO:3430), TCGAGTTTAGGGGGAGGTGGGTCGGGTT (SEQ ID NO:3431), GCGGGTTTTTCGGCGGTTTTAGGGTTT (SEQ ID NO:3432), TCGGCGATTTTTGTTTTGGTTGCGGGT (SEQ ID NO:3433) |
| Target360 | chr2:223163071-223164036 | TTGGAATTCGGGAAAGGGGAGGACGGG (SEQ ID NO:3434), GAATTCGGGAAAGGGGAGGACGGGGAG (SEQ ID NO:3435), TTACGGCGAGTCGGGGAGTTTGGTGAG (SEQ ID NO:3436), GAGTTACGGCGAGTCGGGGAGTTTGGT (SEQ ID NO:3437), AGTTTGGTGAGGTTGGAGCGCGGTTTG (SEQ ID NO:3438), AGGGAGGGTTTTAGCGCGTCGTTTGGA (SEQ ID NO:3439), AAGGGAGGGTTTTAGCGCGTCGTTTGG (SEQ ID NO:3440), GGGAGGGTTTTAGCGCGTCGTTTGGAT (SEQ ID NO:3441), GGTAAGGGAGGGTTTTAGCGCGTCGTT (SEQ ID NO:3442), AGGGAGGGTTTTAGCGCGTCGTTTGGAT (SEQ ID NO:3443) |
| Target361 | chr2:225266080-225266368 | GCGAATGTTGGAGAGAGTTTAGGACGC (SEQ ID NO:3444), TGGCGAATGTTGGAGAGAGTTTAGGACG (SEQ ID NO:3445), TTGGGTGGGGTAGTATTGTTATGGCGAA (SEQ ID NO:3446), TTTGGGTGGGGTAGTATTGTTATGGCGA (SEQ ID NO:3447), ATGGCGAATGTTGGAGAGAGTTTAGGACG (SEQ ID NO:3448), TGGGGGGTGAGGTAGGTGTATTGTGGT (SEQ ID NO:3449), TGGGGGGTGAGGTAGGTGTATTGTGGTT (SEQ ID NO:3450), TTGGGGGGTGAGGTAGGTGTATTGTGGT (SEQ ID NO:3451), GGGGGGGTGAGGTAGGTGTATTGTGGTT (SEQ ID NO:3452), TTGGGGGGTGAGGTAGGTGTATTGTGG (SEQ ID NO:3453) |
| Target362 | chr2:230933210-230933223 | TTTTCGGGGGTTTTTGGGGGTGTAGCGG (SEQ ID NO:3454), CGGGGGTTTTTGGGGGTGTAGCGGTTA (SEQ ID NO:3455), TTTCGGGGGTTTTTGGGGGTGTAGCGG (SEQ ID NO:3456), GGGGGTTTTTGGGGGTGTAGCGGTTAT (SEQ ID NO:3457), TTTTTCGGGGGTTTTTGGGGGTGTAGCG (SEQ ID NO:3458), GGGTTTCGGGCGGTGAGTATTCGAGGT (SEQ ID NO:3459), GGTTTCGGGCGGTGAGTATTCGAGGTC (SEQ ID NO:3460), GGGTTTCGGGCGGTGAGTATTCGAGGTC (SEQ ID NO:3461), GGGTTTCGGGCGGTGAGTATTCGAGG (SEQ ID NO:3462), CGGGTTTGGGGAATGGAGCGACGTC (SEQ ID NO:3463) |
| Target363 | chr2:230933225-230933272 | TTTTCGGGGGTTTTTGGGGGTGTAGCG (SEQ ID NO:3464), CGGGGGTTTTTGGGGGTGTAGCGGTTA (SEQ ID NO:3465), TTTCGGGGGTTTTTGGGGGTGTAGCGG (SEQ ID NO:3466), GGGGGTTTTTGGGGGTGTAGCGGTTAT (SEQ ID NO:3467), TTTTTCGGGGGTTTTTGGGGGTGTAGCG (SEQ ID NO:3468), GGGTTTCGGGCGGTGAGTATTCGAGGT (SEQ ID NO:3469), GGTTTCGGGCGGTGAGTATTCGAGGTC (SEQ ID NO:3470), GGGTTTCGGGCGGTGAGTATTCGAGGTC (SEQ ID NO:3471), GGGTTTCGGGCGGTGAGTATTCGAGG (SEQ ID NO:3472), GGTTTCGGGCGGTGAGTATTCGAGGT (SEQ ID NO:3473) |
| Target364 | chr2:230933275-230933303 | TTTTCGGGGGTTTTTGGGGGTGTAGCG (SEQ ID NO:3474), CGGGGGTTTTTGGGGGTGTAGCGGTTA (SEQ ID NO:3475), TTTCGGGGGTTTTTGGGGGTGTAGCGG (SEQ ID NO:3476), GGGGGTTTTTGGGGGTGTAGCGGTTAT (SEQ ID NO:3477), TTTTTCGGGGGTTTTTGGGGGTGTAGCG (SEQ ID NO:3478), GCGGAGAGTTGAGTCGTAGGTATTCGCG (SEQ ID NO:3479), GCGGAGAGTTGAGTCGTAGGTATTCGCGT (SEQ ID NO:3480), GCGGAGAGTTGAGTCGTAGGTATTCGC (SEQ ID NO:3481), TCGGGCGTGGAGTCGAGTGAGGTC (SEQ ID NO:3482), CGGAGAGTTGAGTCGTAGGTATTCGCGT (SEQ ID NO:3483) |

FIGURE 5 CONTINUED

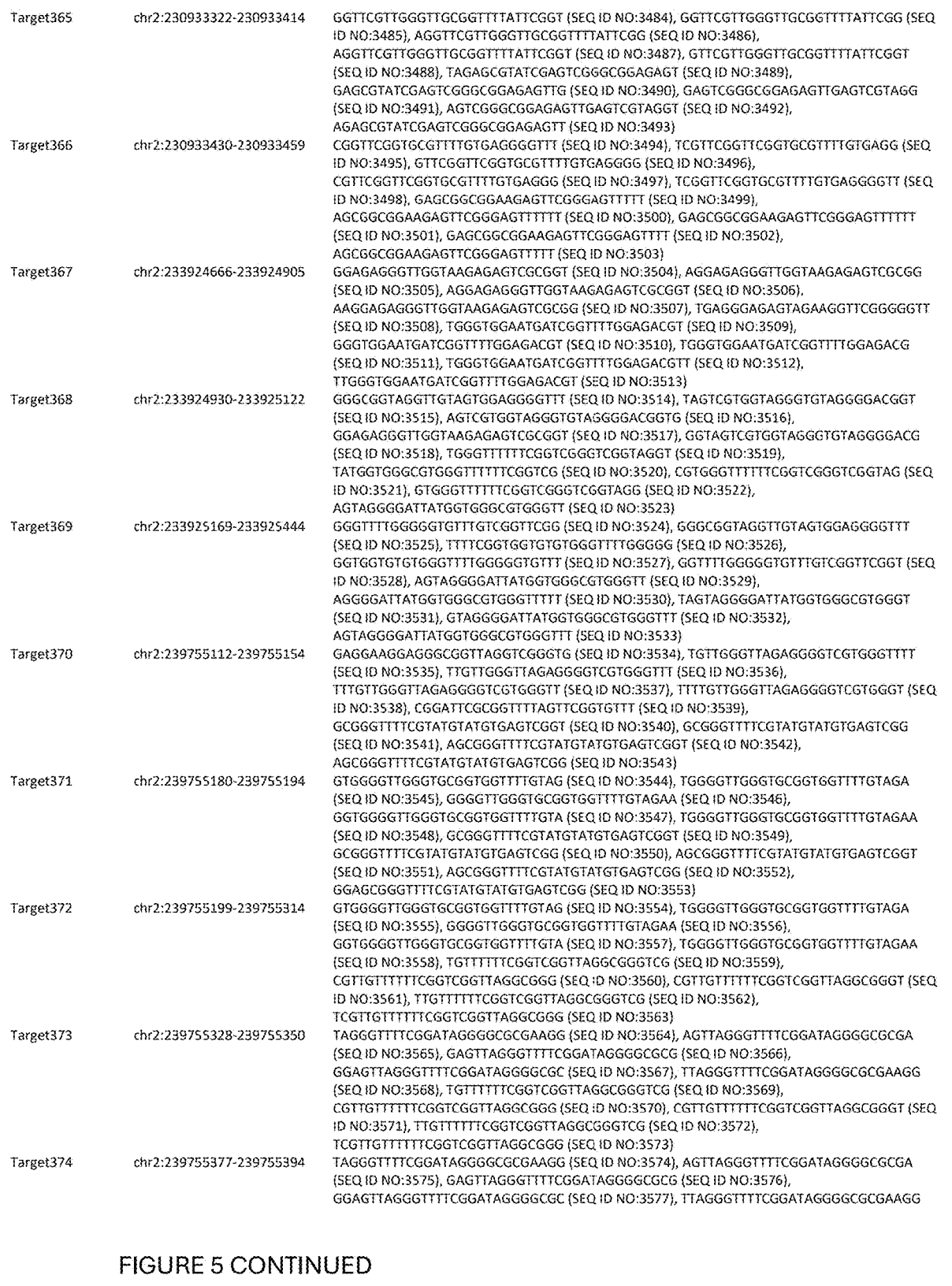

| Target365 | chr2:230933322-230933414 | GGTTCGTTGGGTTGCGGTTTTATTCGGT (SEQ ID NO:3484), GGTTCGTTGGGTTGCGGTTTTATTCGG (SEQ ID NO:3485), AGGTTCGTTGGGTTGCGGTTTTATTCGG (SEQ ID NO:3486), AGGTTCGTTGGGTTGCGGTTTTATTCGGT (SEQ ID NO:3487), GTTCGTTGGGTTGCGGTTTTATTCGGT (SEQ ID NO:3488), TAGAGCGTATCGAGTCGGGCGGAGAGT (SEQ ID NO:3489), GAGCGTATCGAGTCGGGCGGAGAGTTG (SEQ ID NO:3490), GAGTCGGGCGGAGAGTTGAGTCGTAGG (SEQ ID NO:3491), AGTCGGGCGGAGAGTTGAGTCGTAGGT (SEQ ID NO:3492), AGAGCGTATCGAGTCGGGCGGAGAGTT (SEQ ID NO:3493) |
|---|---|---|
| Target366 | chr2:230933430-230933459 | CGGTTCGGTGCGTTTTGTGAGGGGTTT (SEQ ID NO:3494), TCGTTCGGTTCGGTGCGTTTTGTGAGG (SEQ ID NO:3495), GTTCGGTTCGGTGCGTTTTGTGAGGGG (SEQ ID NO:3496), CGTTCGGTTCGGTGCGTTTTGTGAGGG (SEQ ID NO:3497), TCGGTTCGGTGCGTTTTGTGAGGGGTT (SEQ ID NO:3498), GAGCGGCGGAAGAGTTCGGGAGTTTTT (SEQ ID NO:3499), AGCGGCGGAAGAGTTCGGGAGTTTTTT (SEQ ID NO:3500), GAGCGGCGGAAGAGTTCGGGAGTTTTTT (SEQ ID NO:3501), GAGCGGCGGAAGAGTTCGGGAGTTTT (SEQ ID NO:3502), AGCGGCGGAAGAGTTCGGGAGTTTTT (SEQ ID NO:3503) |
| Target367 | chr2:233924666-233924905 | GGAGAGGGTTGGTAAGAGAGTCGCGGT (SEQ ID NO:3504), AGGAGAGGGTTGGTAAGAGAGTCGCGG (SEQ ID NO:3505), AGGAGAGGGTTGGTAAGAGAGTCGCGGT (SEQ ID NO:3506), AAGGAGAGGGTTGGTAAGAGAGTCGCG (SEQ ID NO:3507), TGAGGGAGAGTAGAAGGTTCGGGGGTT (SEQ ID NO:3508), TGGGTGGAATGATCGGTTTTGGAGACGT (SEQ ID NO:3509), GGGTGGAATGATCGGTTTTGGAGACGT (SEQ ID NO:3510), TGGGTGGAATGATCGGTTTTGGAGACG (SEQ ID NO:3511), TGGGTGGAATGATCGGTTTTGGAGACGTT (SEQ ID NO:3512), TTGGGTGGAATGATCGGTTTTGGAGACGT (SEQ ID NO:3513) |
| Target368 | chr2:233924930-233925122 | GGGCGGTAGGTTGTAGTGGAGGGGTTT (SEQ ID NO:3514), TAGTCGTGGTAGGGTGTAGGGGACGGT (SEQ ID NO:3515), AGTCGTGGTAGGGTGTAGGGGACGGTG (SEQ ID NO:3516), GGAGAGGGTTGGTAAGAGAGTCGCGGT (SEQ ID NO:3517), GGTAGTCGTGGTAGGGTGTAGGGGACG (SEQ ID NO:3518), TGGGTTTTTTCGGTCGGGTCGGTAGGT (SEQ ID NO:3519), TATGGTGGGCGTGGGTTTTTTCGGTCG (SEQ ID NO:3520), CGTGGGTTTTTTCGGTCGGGTCGGTAG (SEQ ID NO:3521), GTGGGTTTTTTCGGTCGGGTCGGTAGG (SEQ ID NO:3522), AGTAGGGGATTATGGTGGGCGTGGGTT (SEQ ID NO:3523) |
| Target369 | chr2:233925169-233925444 | GGGTTTTGGGGGTGTTTGTCGGTTCGG (SEQ ID NO:3524), GGGCGGTAGGTTGTAGTGGAGGGGTTT (SEQ ID NO:3525), TTTTCGGTGGTGTGTGGGTTTTGGGGG (SEQ ID NO:3526), GGTGGTGTGTGGGTTTTGGGGGTGTTT (SEQ ID NO:3527), GGTTTTGGGGGTGTTTGTCGGTTCGGT (SEQ ID NO:3528), AGTAGGGGATTATGGTGGGCGTGGGTT (SEQ ID NO:3529), AGGGGATTATGGTGGGCGTGGGTTTTT (SEQ ID NO:3530), TAGTAGGGGATTATGGTGGGCGTGGGT (SEQ ID NO:3531), GTAGGGGATTATGGTGGGCGTGGGTTT (SEQ ID NO:3532), AGTAGGGGATTATGGTGGGCGTGGGTTT (SEQ ID NO:3533) |
| Target370 | chr2:239755112-239755154 | GAGGAAGGAGGGCGGTTAGGTCGGGTG (SEQ ID NO:3534), TGTTGGGTTAGAGGGGTCGTGGGTTTT (SEQ ID NO:3535), TTGTTGGGTTAGAGGGGTCGTGGGTTTT (SEQ ID NO:3536), TTTGTTGGGTTAGAGGGGTCGTGGGTT (SEQ ID NO:3537), TTTTGTTGGGTTAGAGGGGTCGTGGGT (SEQ ID NO:3538), CGGATTCGCGGTTTTAGTTCGGTGTTT (SEQ ID NO:3539), GCGGGTTTTCGTATGTATGTGAGTCGGT (SEQ ID NO:3540), GCGGGTTTTCGTATGTATGTGAGTCGG (SEQ ID NO:3541), AGCGGGTTTTCGTATGTATGTGAGTCGGT (SEQ ID NO:3542), AGCGGGTTTTCGTATGTATGTGAGTCGG (SEQ ID NO:3543) |
| Target371 | chr2:239755180-239755194 | GTGGGGTTGGGTGCGGTGGTTTTGTAG (SEQ ID NO:3544), TGGGGTTGGGTGCGGTGGTTTTGTAGA (SEQ ID NO:3545), GGGGTTGGGTGCGGTGGTTTTGTAGAA (SEQ ID NO:3546), GGTGGGGTTGGGTGCGGTGGTTTTGTA (SEQ ID NO:3547), TGGGGTTGGGTGCGGTGGTTTTGTAGAA (SEQ ID NO:3548), GCGGGTTTTCGTATGTATGTGAGTCGGT (SEQ ID NO:3549), GCGGGTTTTCGTATGTATGTGAGTCGG (SEQ ID NO:3550), AGCGGGTTTTCGTATGTATGTGAGTCGGT (SEQ ID NO:3551), AGCGGGTTTTCGTATGTATGTGAGTCGG (SEQ ID NO:3552), GGAGCGGGTTTTCGTATGTATGTGAGTCGG (SEQ ID NO:3553) |
| Target372 | chr2:239755199-239755314 | GTGGGGTTGGGTGCGGTGGTTTTGTAG (SEQ ID NO:3554), TGGGGTTGGGTGCGGTGGTTTTGTAGA (SEQ ID NO:3555), GGGGTTGGGTGCGGTGGTTTTGTAGAA (SEQ ID NO:3556), GGTGGGGTTGGGTGCGGTGGTTTTGTA (SEQ ID NO:3557), TGGGGTTGGGTGCGGTGGTTTTGTAGAA (SEQ ID NO:3558), TGTTTTTTCGGTCGGTTAGGCGGGTCG (SEQ ID NO:3559), CGTTGTTTTTTCGGTCGGTTAGGCGGG (SEQ ID NO:3560), CGTTGTTTTTTCGGTCGGTTAGGCGGGT (SEQ ID NO:3561), TTGTTTTTTCGGTCGGTTAGGCGGGTCG (SEQ ID NO:3562), TCGTTGTTTTTTCGGTCGGTTAGGCGGG (SEQ ID NO:3563) |
| Target373 | chr2:239755328-239755350 | TAGGGTTTTCGGATAGGGGCGCGAAGG (SEQ ID NO:3564), AGTTAGGGTTTTCGGATAGGGGCGCGA (SEQ ID NO:3565), GAGTTAGGGTTTTCGGATAGGGGCGCG (SEQ ID NO:3566), GGAGTTAGGGTTTTCGGATAGGGGCGC (SEQ ID NO:3567), TTAGGGTTTTCGGATAGGGGCGCGAAGG (SEQ ID NO:3568), TGTTTTTTCGGTCGGTTAGGCGGGTCG (SEQ ID NO:3569), CGTTGTTTTTTCGGTCGGTTAGGCGGG (SEQ ID NO:3570), CGTTGTTTTTTCGGTCGGTTAGGCGGGT (SEQ ID NO:3571), TTGTTTTTTCGGTCGGTTAGGCGGGTCG (SEQ ID NO:3572), TCGTTGTTTTTTCGGTCGGTTAGGCGGG (SEQ ID NO:3573) |
| Target374 | chr2:239755377-239755394 | TAGGGTTTTCGGATAGGGGCGCGAAGG (SEQ ID NO:3574), AGTTAGGGTTTTCGGATAGGGGCGCGA (SEQ ID NO:3575), GAGTTAGGGTTTTCGGATAGGGGCGCG (SEQ ID NO:3576), GGAGTTAGGGTTTTCGGATAGGGGCGC (SEQ ID NO:3577), TTAGGGTTTTCGGATAGGGGCGCGAAGG |

FIGURE 5 CONTINUED

|  |  | (SEQ ID NO:3578), TGTTTTTTCGGTCGGTTAGGCGGGTCG (SEQ ID NO:3579), CGTTGTTTTTTCGGTCGGTTAGGCGGG (SEQ ID NO:3580), CGTTGTTTTTTCGGTCGGTTAGGCGGGT (SEQ ID NO:3581), TTGTTTTTTCGGTCGGTTAGGCGGGTCG (SEQ ID NO:3582), TCGTTGTTTTTTCGGTCGGTTAGGCGGG (SEQ ID NO:3583) |
| Target375 | chr2:239755407-239755456 | TAGGGGTTTTCGGATAGGGGCGCGAAGG (SEQ ID NO:3584), CGGTTCGTTTGGTCGGTCGGAGGAGTA (SEQ ID NO:3585), AGTTAGGGTTTTCGGATAGGGGCGCGA (SEQ ID NO:3586), GAGTTAGGGTTTTCGGATAGGGGCGCGA (SEQ ID NO:3587), GTTCGTTTGGTCGGTCGGAGGAGTAGC (SEQ ID NO:3588), GTTTTTTCGGTCGGTTAGGCGGGTCGT (SEQ ID NO:3589), TGTTTTTTCGGTCGGTTAGGCGGGTCG (SEQ ID NO:3590), CGTTGTTTTTTCGGTCGGTTAGGCGGG (SEQ ID NO:3591), CGTTGTTTTTTCGGTCGGTTAGGCGGGT (SEQ ID NO:3592), TTGTTTTTTCGGTCGGTTAGGCGGGTCG (SEQ ID NO:3593) |
| Target376 | chr2:239755491-239755506 | CGGTTCGTTTGGTCGGTCGGAGGAGTA (SEQ ID NO:3594), GTTCGTTTGGTCGGTCGGAGGAGTAGC (SEQ ID NO:3595), CGGTTCGTTTGGTCGGTCGGAGGAGTAG (SEQ ID NO:3596), CGGTTCGTTTGGTCGGTCGGAGGAGT (SEQ ID NO:3597), GGTTCGTTTGGTCGGTCGGAGGAGTAGC (SEQ ID NO:3598), AGTCGGGTTGTTAGGTAAGTCGCGTGA (SEQ ID NO:3599), TGAGTCGGGTTGTTAGGTAAGTCGCGT (SEQ ID NO:3600), GGTTCGGGTTTGAGTCGGGTTGTTAGGT (SEQ ID NO:3601), GGTTCGGGTTTGAGTCGGGTTGTTAGG (SEQ ID NO:3602), AGGTTCGGGTTTGAGTCGGGTTGTTAGG (SEQ ID NO:3603) |
| Target377 | chr2:241393792-241393817 | AGGAGGTTGTTGGACGTGTCGGAGGAT (SEQ ID NO:3604), GGAGGTTGTTGGACGTGTCGGAGGATGT (SEQ ID NO:3605), GGAGGTTGTTGGACGTGTCGGAGGATG (SEQ ID NO:3606), AGGAGGTTGTTGGACGTGTCGGAGGATG (SEQ ID NO:3607), TAGGAGGTTGTTGGACGTGTCGGAGGA (SEQ ID NO:3608), TTTTCGGATTTTAATTAGTTTCGGTGGTTGTGGT (SEQ ID NO:3609), GTTTTCGGATTTTAATTAGTTTCGGTGGTTGTGGT (SEQ ID NO:3610), TGTTTTCGGATTTTAATTAGTTTCGGTGGTTGTGG (SEQ ID NO:3611), TGTTTTCGGATTTTAATTAGTTTCGGTGGTTGTGGT (SEQ ID NO:3612), TTGTTTTCGGATTTTAATTAGTTTCGGTGGTTGTGG (SEQ ID NO:3613) |
| Target378 | chr2:241393833-241393881 | AGGAGGTTGTTGGACGTGTCGGAGGAT (SEQ ID NO:3614), GGAGGTTGTTGGACGTGTCGGAGGATGT (SEQ ID NO:3615), GGAGGTTGTTGGACGTGTCGGAGGATG (SEQ ID NO:3616), TGGGTTAGGGGTTGGGGTAGGTTTCGA (SEQ ID NO:3617), AGGAGGTTGTTGGACGTGTCGGAGGATG (SEQ ID NO:3618) |
| Target379 | chr2:242824433-242824450 | GCGTGGGTGGTTTTTGGTTGGGGAAGT (SEQ ID NO:3619), AGCGTGGGTGGTTTTTGGTTGGGGAAG (SEQ ID NO:3620), AGGTTGTGGCGTGTTTGGTGGTGTTGT (SEQ ID NO:3621), TGTAGCGTGGGTGGTTTTTGGTTGGGG (SEQ ID NO:3622), GTAGCGTGGGTGGTTTTTGGTTGGGGA (SEQ ID NO:3623), CGTTACGTGTTTGGAGAGGCGGTGTTA (SEQ ID NO:3624), CGTTACGTGTTTGGAGAGGCGGTGTT (SEQ ID NO:3625), CGTTACGTGTTTGGAGAGGCGGTGTTAT (SEQ ID NO:3626), CGTTACGTGTTTGGAGAGGCGGTGT (SEQ ID NO:3627), CGTTACGTGTTTGGAGAGGCGGTGTTATT (SEQ ID NO:3628) |
| Target380 | chr2:242824532-242824595 | TGGTGAGAGGTGGTTGGGAGGAAGTTT (SEQ ID NO:3629), TTGGTGAGAGGTGGTTGGGAGGAAGTT (SEQ ID NO:3630), TTTGGTGAGAGGTGGTTGGGAGGAAGT (SEQ ID NO:3631), TTGGTGAGAGGTGGTTGGGAGGAAGTTT (SEQ ID NO:3632), TTTGGTGAGAGGTGGTTGGGAGGAAGTT (SEQ ID NO:3633), CGTTTGCGGGGGGTAGAGGGAGAGAAGG (SEQ ID NO:3634), TTGCGGGGGGTAGAGGGAGAGAAGGAGA (SEQ ID NO:3635), TGCGGGGGGTAGAGGGAGAGAAGGAGAT (SEQ ID NO:3636), TTTGCGGGGGGTAGAGGGAGAGAAGGAG (SEQ ID NO:3637), TTTGCGGGGGGTAGAGGGAGAGAAGGAGA (SEQ ID NO:3638) |
| Target381 | chr3:9177892-9177965 | CGCGGCGGTTGATTTCGGTTCGGTATT (SEQ ID NO:3639), GGAGAAGGGCGGTAATGGGGAGTTCGT (SEQ ID NO:3640), AGGAGAAGGGCGGTAATGGGGAGTTCG (SEQ ID NO:3641), AGAAGGGCGGTAATGGGGAGTTCGTGT (SEQ ID NO:3642), CGCGGCGGTTGATTTCGGTTCGGTAT (SEQ ID NO:3643) |
| Target382 | chr3:9177983-9178004 | CGCGGCGGTTGATTTCGGTTCGGTATT (SEQ ID NO:3644), CGCGGCGGTTGATTTCGGTTCGGTAT (SEQ ID NO:3645), CGCGGCGGTTGATTTCGGTTCGGTATTT (SEQ ID NO:3646), GCGGCGGTTGATTTCGGTTCGGTATTT (SEQ ID NO:3647), GCGCGGCGGTTGATTTCGGTTCGGTAT (SEQ ID NO:3648) |
| Target383 | chr3:9178006-9178062 | TGGAGGTAGTAGATGTCGGGTCGGGGT (SEQ ID NO:3649), TAGATGTCGGGTCGGGGTTAGTCGTCG (SEQ ID NO:3650), CGGGGTTGGAGGTAGTAGATGTCGGGT (SEQ ID NO:3651), GCGTCGGGGTTGGAGGTAGTAGATGTCG (SEQ ID NO:3652), TGGAGGTAGTAGATGTCGGGTCGGGGTT (SEQ ID NO:3653), CGCGGCGGTTGATTTCGGTTCGGTATT (SEQ ID NO:3654), CGCGGCGGTTGATTTCGGTTCGGTAT (SEQ ID NO:3655), CGCGGCGGTTGATTTCGGTTCGGTATTT (SEQ ID NO:3656), GCGGCGGTTGATTTCGGTTCGGTATTT (SEQ ID NO:3657), GCGCGGCGGTTGATTTCGGTTCGGTAT (SEQ ID NO:3658) |
| Target384 | chr3:9178096-9178250 | AGTAGTCGGGGTGGTTGAAAGCGGGTT (SEQ ID NO:3659), TGGAGGTAGTAGATGTCGGGTCGGGGT (SEQ ID NO:3660), AGTCGGGGTGGTTGAAAGCGGGTTTTT (SEQ ID NO:3661), TAGTAGTCGGGGTGGTTGAAAGCGGGT (SEQ ID NO:3662), GTAGTCGGGGTGGTTGAAAGCGGGTTT (SEQ ID NO:3663), AGTTATTTCGGTTGTTGTACGTGGCGC (SEQ ID NO:3664), AGGGTGTTAGGGAGTTTGTTCGCGTTTG (SEQ ID NO:3665), TGGTCGAATATAGGAAGGGGAGAGGGAG (SEQ ID NO:3666), TAGTTATTTCGGTTGTTGTACGTGGCGC (SEQ ID NO:3667), TGGTCGAATATAGGAAGGGGAGAGGGAGA (SEQ ID NO:3668) |

FIGURE 5 CONTINUED

Target385    chr3:52828402-52828911    GTGAGCGAGGGGTTTTGTTGTGGAGGT (SEQ ID NO:3669), AGTGAGCGAGGGGTTTTGTTGTGGAGGT (SEQ ID NO:3670), AGTGAGCGAGGGGTTTTGTTGTGGAGG (SEQ ID NO:3671), GGGTAGTGAGCGAGGGGTTTTGTTGTGG (SEQ ID NO:3672), AGGGTAGTGAGCGAGGGGTTTTGTTGT (SEQ ID NO:3673), GCGTGGATGATGGAGATGGGGTGTGGA (SEQ ID NO:3674), GGTGGGAGGAGTGGAGGTAGGAAGGGT (SEQ ID NO:3675), TTGGCGTGGATGATGGAGATGGGGTGT (SEQ ID NO:3676), GTGATTTGTAGCGGGGGTGGGAGGAGT (SEQ ID NO:3677), TGATTTGTAGCGGGGGTGGGAGGAGTG (SEQ ID NO:3678)

Target386    chr3:62356123-62356237    GGAAGAGGCGGGCGTTTTAGGGGTAGT (SEQ ID NO:3679), GTAGAATGGTGGGGAGGAAGAGGCGGG (SEQ ID NO:3680), AGGAAGAGGCGGGCGTTTTAGGGGTAG (SEQ ID NO:3681), GAGGAAGAGGCGGGCGTTTTAGGGGTA (SEQ ID NO:3682), GTGGGGAGGAAGAGGCGGGCGTTTTAG (SEQ ID NO:3683), GAGCGCGGCGGGAGGGAAGTTGTATTA (SEQ ID NO:3684), AGCGCGGCGGGAGGGAAGTTGTATTAG (SEQ ID NO:3685), GCGCGGCGGGAGGGAAGTTGTATTAGT (SEQ ID NO:3686), AGCGCGGCGGGAGGGAAGTTGTATTA (SEQ ID NO:3687), CGCGGCGGGAGGGAAGTTGTATTAGTT (SEQ ID NO:3688)

Target387    chr3:62356280-62356286    CGTAAGCGTTAAGTCGGGTGTTTTTTCGA (SEQ ID NO:3689), TGCGTTTTTGTTTTGTTCGTTATAGAGGTTGGT (SEQ ID NO:3690), GCGTTTTTGTTTTGTTCGTTATAGAGGTTGGTG (SEQ ID NO:3691), GCGTTTTTGTTTTGTTCGTTATAGAGGTTGGTGT (SEQ ID NO:3692), TGCGTTTTTGTTTTGTTCGTTATAGAGGTTGGTG (SEQ ID NO:3693), GGGTTACGTAAAAGTTTTTCGGTTCGCGG (SEQ ID NO:3694), TGGGTTACGTAAAAGTTTTTCGGTTCGCGG (SEQ ID NO:3695), GGGTTACGTAAAAGTTTTTCGGTTCGCGGA (SEQ ID NO:3696), TGGGTTACGTAAAAGTTTTTCGGTTCGCGGA (SEQ ID NO:3697), TGGGTTACGTAAAAGTTTTTCGGTTCGCG (SEQ ID NO:3698)

Target388    chr3:62356310-62356329    GCGGGTCGGGAAATTTTTGCGTAGTTT (SEQ ID NO:3699), GCGGGTCGGGAAATTTTTGCGTAGTT (SEQ ID NO:3700), GCGGGTCGGGAAATTTTTGCGTAGTTTA (SEQ ID NO:3701), GCGGGTCGGGAAATTTTTGCGTAGTTTAG (SEQ ID NO:3702), GCGGGTCGGGAAATTTTTGCGTAGTTTAGA (SEQ ID NO:3703), TTGGTAGTTGGGGGGCGAGAAAGAAGT (SEQ ID NO:3704), AGTTGGTAGTTGGGGGGCGAGAAAGAA (SEQ ID NO:3705), GTTGGTAGTTGGGGGGCGAGAAAGAAGT (SEQ ID NO:3706), GTTGGTAGTTGGGGGGCGAGAAAGAAG (SEQ ID NO:3707), AGTTGGTAGTTGGGGGGCGAGAAAGAAGT (SEQ ID NO:3708)

Target389    chr3:62356353-62356372    GCGGGTCGGGAAATTTTTGCGTAGTTT (SEQ ID NO:3709), GCGGGTCGGGAAATTTTTGCGTAGTT (SEQ ID NO:3710), GCGGGTCGGGAAATTTTTGCGTAGTTTA (SEQ ID NO:3711), GCGGGTCGGGAAATTTTTGCGTAGTTTAG (SEQ ID NO:3712), GCGGGTCGGGAAATTTTTGCGTAGTTTAGA (SEQ ID NO:3713), TTGGTAGTTGGGGGGCGAGAAAGAAGT (SEQ ID NO:3714), AGTTGGTAGTTGGGGGGCGAGAAAGAA (SEQ ID NO:3715), GTTGGTAGTTGGGGGGCGAGAAAGAAGT (SEQ ID NO:3716), GTTGGTAGTTGGGGGGCGAGAAAGAAG (SEQ ID NO:3717), AGTTGGTAGTTGGGGGGCGAGAAAGAAGT (SEQ ID NO:3718)

Target390    chr3:62362918-62362940    TTTTCGGCGGCGGTAGGGAAATAGACG (SEQ ID NO:3719), GGTTGGGTTTTAAATTTTCGGCGGCGGT (SEQ ID NO:3720), ATTTTCGGCGGCGGTAGGGAAATAGACG (SEQ ID NO:3721), GGTTGGGTTTTAAATTTTCGGCGGCGG (SEQ ID NO:3722), TTTCGGCGGCGGTAGGGAAATAGACG (SEQ ID NO:3723), GCGTTTTGTTTTTCGGCGTGGGAAGGA (SEQ ID NO:3724), GCGTGGGAAGGATATAGGTCGTCGAGGG (SEQ ID NO:3725), GGCGTGGGAAGGATATAGGTCGTCGAGG (SEQ ID NO:3726), CGTGGGAAGGATATAGGTCGTCGAGGGG (SEQ ID NO:3727), GCGTGGGAAGGATATAGGTCGTCGAGG (SEQ ID NO:3728)

Target391    chr3:62363001-62363017    TTTCGGCGGCGGTAGGGAAATAGACG (SEQ ID NO:3729), TCGGCGGCGGTAGGGAAATAGACGATT (SEQ ID NO:3730), TTCGGCGGCGGTAGGGAAATAGACGAT (SEQ ID NO:3731), TTTTCGGCGGCGGTAGGGAAATAGACG (SEQ ID NO:3732), TTTTCGGCGGCGGTAGGGAAATAGACGA (SEQ ID NO:3733), GTGGTGTGCGGGTTGTTTGGTTAGGGC (SEQ ID NO:3734), AGTGGTGTGCGGGTTGTTTGGTTAGGG (SEQ ID NO:3735), TGGTGTGCGGGTTGTTTGGTTAGGGC (SEQ ID NO:3736), TGGTGTGCGGGTTGTTTGGTTAGGGCG (SEQ ID NO:3737), GGTGTGCGGGTTGTTTGGTTAGGGCG (SEQ ID NO:3738)

Target392    chr3:62363063-62363069    TCGTTGTTTTGCGGGGTTTGATCGGGG (SEQ ID NO:3739), GTTTGATCGGGGCGGCGATTTTTGGGA (SEQ ID NO:3740), TGATCGGGGCGGCGATTTTTGGGATTC (SEQ ID NO:3741), TTGATCGGGGCGGCGATTTTTGGGATT (SEQ ID NO:3742), TTTGATCGGGGCGGCGATTTTTGGGAT (SEQ ID NO:3743), GTGGTGTGCGGGTTGTTTGGTTAGGGC (SEQ ID NO:3744), AGTGGTGTGCGGGTTGTTTGGTTAGGG (SEQ ID NO:3745), TGGTGTGCGGGTTGTTTGGTTAGGGC (SEQ ID NO:3746), TGGTGTGCGGGTTGTTTGGTTAGGGCG (SEQ ID NO:3747), GGTGTGCGGGTTGTTTGGTTAGGGC (SEQ ID NO:3748)

Target393    chr3:62363076-62363082    TCGTTGTTTTGCGGGGTTTGATCGGGG (SEQ ID NO:3749), GTTTGATCGGGGCGGCGATTTTTGGGA (SEQ ID NO:3750), TGATCGGGGCGGCGATTTTTGGGATTC (SEQ ID NO:3751), TTGATCGGGGCGGCGATTTTTGGGATT (SEQ ID NO:3752), TTTGATCGGGGCGGCGATTTTTGGGAT (SEQ ID NO:3753), GTGGTGTGCGGGTTGTTTGGTTAGGGC (SEQ ID NO:3754), AGTGGTGTGCGGGTTGTTTGGTTAGGG (SEQ ID NO:3755), TGGTGTGCGGGTTGTTTGGTTAGGGC (SEQ ID NO:3756), TGGTGTGCGGGTTGTTTGGTTAGGGCG (SEQ ID NO:3757), GGTGTGCGGGTTGTTTGGTTAGGGCG (SEQ ID NO:3758)

FIGURE 5 CONTINUED

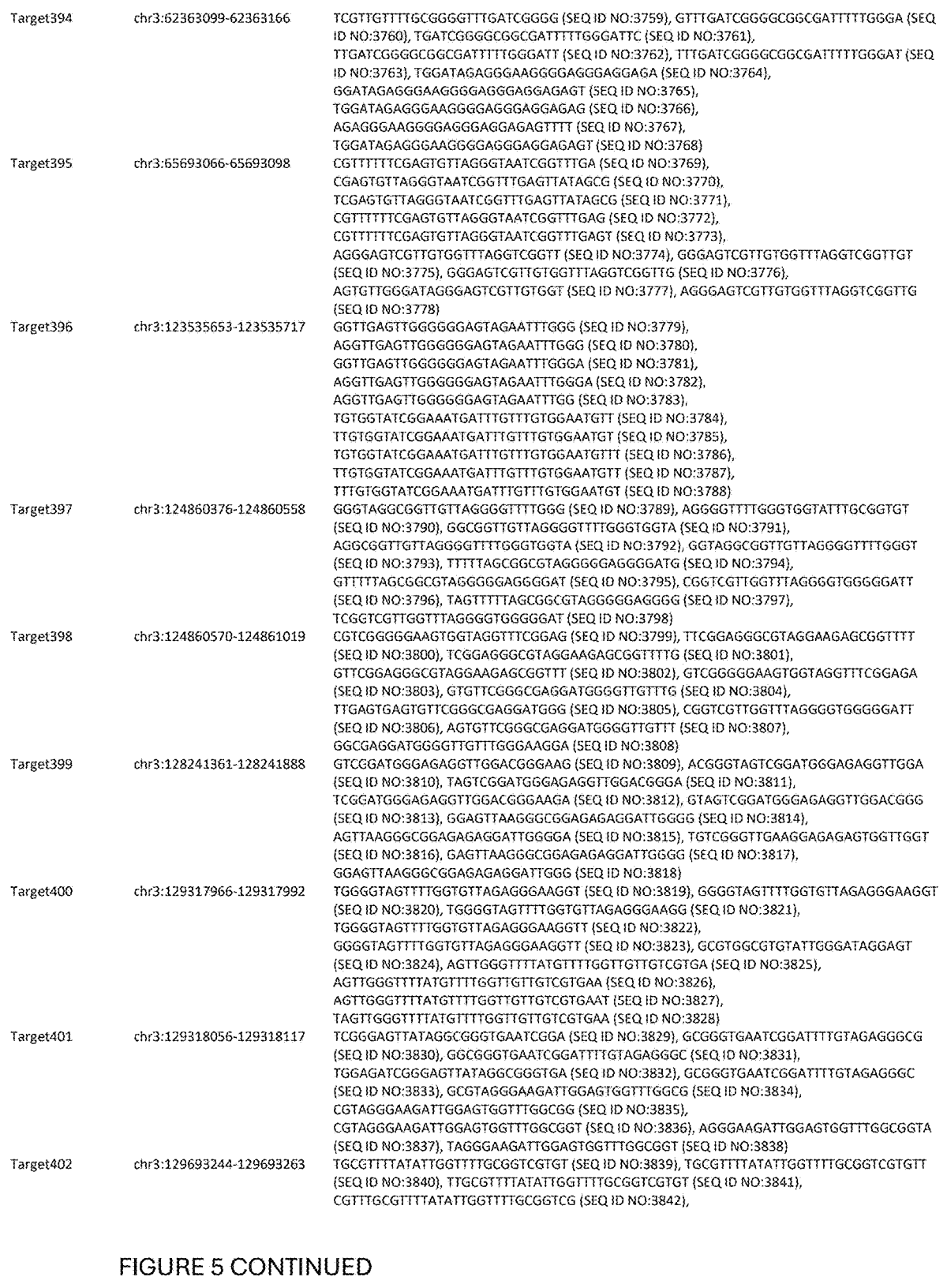

| | | |
|---|---|---|
| Target394 | chr3:62363099-62363166 | TCGTTGTTTTGCGGGGTTTGATCGGGG (SEQ ID NO:3759), GTTTGATCGGGGCGGCGATTTTTGGGA (SEQ ID NO:3760), TGATCGGGGCGGCGATTTTTGGGATTC (SEQ ID NO:3761), TTGATCGGGGCGGCGATTTTTGGGATT (SEQ ID NO:3762), TTTGATCGGGGCGGCGATTTTTGGGAT (SEQ ID NO:3763), TGGATAGAGGGAAGGGGAGGGAGGAGA (SEQ ID NO:3764), GGATAGAGGGAAGGGGAGGGAGGAGAGT (SEQ ID NO:3765), TGGATAGAGGGAAGGGGAGGGAGGAGAG (SEQ ID NO:3766), AGAGGGAAGGGGAGGGAGGAGAGTTTT (SEQ ID NO:3767), TGGATAGAGGGAAGGGGAGGGAGGAGAGT (SEQ ID NO:3768) |
| Target395 | chr3:65693066-65693098 | CGTTTTTTCGAGTGTTAGGGTAATCGGTTTGA (SEQ ID NO:3769), CGAGTGTTAGGGTAATCGGTTTGAGTTATAGCG (SEQ ID NO:3770), TCGAGTGTTAGGGTAATCGGTTTGAGTTATAGCG (SEQ ID NO:3771), CGTTTTTTCGAGTGTTAGGGTAATCGGTTTGAG (SEQ ID NO:3772), CGTTTTTTCGAGTGTTAGGGTAATCGGTTTGAGT (SEQ ID NO:3773), AGGGAGTCGTTGTGGTTAGGTCGGTT (SEQ ID NO:3774), GGGAGTCGTTGTGGTTAGGTCGGTTGT (SEQ ID NO:3775), GGGAGTCGTTGTGGTTAGGTCGGTTG (SEQ ID NO:3776), AGTGTTGGGATAGGGAGTCGTTGTGGT (SEQ ID NO:3777), AGGGAGTCGTTGTGGTTAGGTCGGTTG (SEQ ID NO:3778) |
| Target396 | chr3:123535653-123535717 | GGTTGAGTTGGGGGGAGTAGAATTTGGG (SEQ ID NO:3779), AGGTTGAGTTGGGGGGAGTAGAATTTGGG (SEQ ID NO:3780), GGTTGAGTTGGGGGGAGTAGAATTTGGGA (SEQ ID NO:3781), AGGTTGAGTTGGGGGGAGTAGAATTTGGGA (SEQ ID NO:3782), AGGTTGAGTTGGGGGGAGTAGAATTTGG (SEQ ID NO:3783), TGTGGTATCGGAAATGATTTGTTTGTGGAATGTT (SEQ ID NO:3784), TTGTGGTATCGGAAATGATTTGTTTGTGGAATGT (SEQ ID NO:3785), TGTGGTATCGGAAATGATTTGTTTGTGGAATGTTT (SEQ ID NO:3786), TTGTGGTATCGGAAATGATTTGTTTGTGGAATGTT (SEQ ID NO:3787), TTTGTGGTATCGGAAATGATTTGTTTGTGGAATGT (SEQ ID NO:3788) |
| Target397 | chr3:124860376-124860558 | GGGTAGGCGGTTGTTAGGGGTTTTGGG (SEQ ID NO:3789), AGGGGTTTTGGGTGGTATTTGCGGTGT (SEQ ID NO:3790), GGCGGTTGTTAGGGGTTTTGGGTGGTA (SEQ ID NO:3791), AGGCGGTTGTTAGGGGTTTTGGGTGGTA (SEQ ID NO:3792), GGTAGGCGGTTGTTAGGGGTTTTGGGT (SEQ ID NO:3793), TTTTTAGCGGCGTAGGGGGAGGGGATG (SEQ ID NO:3794), GTTTTTAGCGGCGTAGGGGGAGGGGAT (SEQ ID NO:3795), CGGTCGTTGGTTTAGGGGTGGGGGATT (SEQ ID NO:3796), TAGTTTTTAGCGGCGTAGGGGGAGGGG (SEQ ID NO:3797), TCGGTCGTTGGTTTAGGGGTGGGGGAT (SEQ ID NO:3798) |
| Target398 | chr3:124860570-124861019 | CGTCGGGGGAAGTGGTAGGTTTCGGAG (SEQ ID NO:3799), TTCGGAGGGGCGTAGGAAGAGCGGTTTT (SEQ ID NO:3800), TCGGAGGGGCGTAGGAAGAGCGGTTTTG (SEQ ID NO:3801), GTTCGGAGGGGCGTAGGAAGAGCGGTTT (SEQ ID NO:3802), GTCGGGGGAAGTGGTAGGTTTCGGAGA (SEQ ID NO:3803), GTGTTCGGGCGAGGATGGGGTTGTTG (SEQ ID NO:3804), TTGAGTGAGTGTTCGGGCGAGGATGGG (SEQ ID NO:3805), CGGTCGTTGGTTTAGGGGTGGGGGATT (SEQ ID NO:3806), AGTGTTCGGGCGAGGATGGGGTTGTTT (SEQ ID NO:3807), GGCGAGGATGGGGTTGTTTGGGAAGGA (SEQ ID NO:3808) |
| Target399 | chr3:128241361-128241888 | GTCGGATGGGAGAGGTTGGACGGGAAG (SEQ ID NO:3809), ACGGGTAGTCGGATGGGAGAGGTTGGA (SEQ ID NO:3810), TAGTCGGATGGGAGAGGTTGGACGGGA (SEQ ID NO:3811), TCGGATGGGAGAGGTTGGACGGGAAGA (SEQ ID NO:3812), GTAGTCGGATGGGAGAGGTTGGACGGG (SEQ ID NO:3813), GGAGTTAAGGGCGGAGAGAGGATTGGGG (SEQ ID NO:3814), AGTTAAGGGCGGAGAGAGGATTGGGGA (SEQ ID NO:3815), TGTCGGGTTGAAGGAGAGAGTGGTTGGT (SEQ ID NO:3816), GAGTTAAGGGCGGAGAGAGGATTGGGG (SEQ ID NO:3817), GGAGTTAAGGGCGGAGAGAGGATTGGG (SEQ ID NO:3818) |
| Target400 | chr3:129317966-129317992 | TGGGGTAGTTTTGGTGTTAGAGGGAAGGT (SEQ ID NO:3819), GGGGTAGTTTTGGTGTTAGAGGGAAGGT (SEQ ID NO:3820), TGGGGTAGTTTTGGTGTTAGAGGGAAGG (SEQ ID NO:3821), TGGGGTAGTTTTGGTGTTAGAGGGAAGGTT (SEQ ID NO:3822), GGGGTAGTTTTGGTGTTAGAGGGAAGGTT (SEQ ID NO:3823), GCGTGGCGTGTATTGGGATAGGAGT (SEQ ID NO:3824), AGTTGGGTTTTATGTTTTGGTTGTTGTCGTGA (SEQ ID NO:3825), AGTTGGGTTTTATGTTTTGGTTGTTGTCGTGAA (SEQ ID NO:3826), AGTTGGGTTTTATGTTTTGGTTGTTGTCGTGAAT (SEQ ID NO:3827), TAGTTGGGTTTTATGTTTTGGTTGTTGTCGTGAA (SEQ ID NO:3828) |
| Target401 | chr3:129318056-129318117 | TCGGGAGTTATAGGCGGGTGAATCGGA (SEQ ID NO:3829), GCGGGTGAATCGGATTTTGTAGAGGGCG (SEQ ID NO:3830), GGCGGGTGAATCGGATTTTGTAGAGGGC (SEQ ID NO:3831), TGGAGATCGGGAGTTATAGGCGGGTGA (SEQ ID NO:3832), GCGGGTGAATCGGATTTTGTAGAGGGC (SEQ ID NO:3833), GCGTAGGGAAGATTGGAGTGGTTTGGCG (SEQ ID NO:3834), CGTAGGGAAGATTGGAGTGGTTTGGCGG (SEQ ID NO:3835), CGTAGGGAAGATTGGAGTGGTTTGGCGGT (SEQ ID NO:3836), AGGGAAGATTGGAGTGGTTTGGCGGTA (SEQ ID NO:3837), TAGGGAAGATTGGAGTGGTTTGGCGGT (SEQ ID NO:3838) |
| Target402 | chr3:129693244-129693263 | TGCGTTTTATATTGGTTTTGCGGTCGTGT (SEQ ID NO:3839), TGCGTTTTATATTGGTTTTGCGGTCGTGTT (SEQ ID NO:3840), TTGCGTTTTATATTGGTTTTGCGGTCGTGT (SEQ ID NO:3841), CGTTTGCGTTTTATATTGGTTTTGCGGTCG (SEQ ID NO:3842), |

FIGURE 5 CONTINUED

CGTTTGCGTTTATATTGGTTTTGCGGTCGT (SEQ ID NO:3843), CGGAGGTATTGGTCGTAGGATGGGGCG
(SEQ ID NO:3844), CGCGGAGGTATTGGTCGTAGGATGGGG (SEQ ID NO:3845),
GGTATTGGTCGTAGGATGGGGCGTCGG (SEQ ID NO:3846), GCGGAGGTATTGGTCGTAGGATGGGGC
(SEQ ID NO:3847), AGGTATTGGTCGTAGGATGGGGCGTCG (SEQ ID NO:3848)

| | | |
|---|---|---|
| Target403 | chr3:129693303-129693314 | TTCGTGCGTTTGTGTTTAATCGTGCGT (SEQ ID NO:3849), TTTCGTGCGTTTGTGTTTAATCGTGCGT (SEQ ID NO:3850), TTTCGTGCGTTTGTGTTTAATCGTGCG (SEQ ID NO:3851), TCGTGCGTTTGTGTTTAATCGTGCGT (SEQ ID NO:3852), TTTTCGTGCGTTTGTGTTTAATCGTGCGT (SEQ ID NO:3853), CGGAGGTATTGGTCGTAGGATGGGGCG (SEQ ID NO:3854), CGCGGAGGTATTGGTCGTAGGATGGGG (SEQ ID NO:3855), GGTATTGGTCGTAGGATGGGGCGTCGG (SEQ ID NO:3856), GCGGAGGTATTGGTCGTAGGATGGGGC (SEQ ID NO:3857), AGGTATTGGTCGTAGGATGGGGCGTCG (SEQ ID NO:3858) |
| Target404 | chr3:129693344-129693386 | TCGTGCGTTTGTGTTTAATCGTGCGTT (SEQ ID NO:3859), TTCGTGCGTTTGTGTTTAATCGTGCGT (SEQ ID NO:3860), CGTGCGTTTGTGTTTAATCGTGCGTT (SEQ ID NO:3861), TCGTGCGTTTGTGTTTAATCGTGCGTTT (SEQ ID NO:3862), TTCGTGCGTTTGTGTTTAATCGTGCGTT (SEQ ID NO:3863), CGGAGGTATTGGTCGTAGGATGGGGCG (SEQ ID NO:3864), CGCGGAGGTATTGGTCGTAGGATGGGG (SEQ ID NO:3865), GGTATTGGTCGTAGGATGGGGCGTCGG (SEQ ID NO:3866), GCGGAGGTATTGGTCGTAGGATGGGGC (SEQ ID NO:3867), AGGTATTGGTCGTAGGATGGGGCGTCG (SEQ ID NO:3868) |
| Target405 | chr3:129693390-129693413 | CGTCGGCGTTTTATTTTGCGGTTAGTGT (SEQ ID NO:3869), CGTCGGCGTTTTATTTTGCGGTTAGTGTT (SEQ ID NO:3870), CGTCGGCGTTTTATTTTGCGGTTAGTGTTT (SEQ ID NO:3871), CGGCGTTTTATTTTGCGGTTAGTGTTTCG (SEQ ID NO:3872), CGTCGGCGTTTTATTTTGCGGTTAGTGTTTT (SEQ ID NO:3873), TTAGGCGGCGGTTCGAGTGAGGTTAGC (SEQ ID NO:3874), TTCGAGTGAGGTTAGCGGGGAGGGGTC (SEQ ID NO:3875), GTTAGGCGGCGGTTCGAGTGAGGTTAG (SEQ ID NO:3876), GTTCGAGTGAGGTTAGCGGGGAGGGG (SEQ ID NO:3877), GGTTCGAGTGAGGTTAGCGGGGAGGG (SEQ ID NO:3878) |
| Target406 | chr3:129693449-129693458 | TAGATTTTCGGAGGAGTAGGCGGGCGG (SEQ ID NO:3879), AGATTTTCGGAGGAGTAGGCGGGCGG (SEQ ID NO:3880), TTAGATTTTCGGAGGAGTAGGCGGGCGG (SEQ ID NO:3881), AGATTTTCGGAGGAGTAGGCGGGCGGG (SEQ ID NO:3882), TTAGATTTTCGGAGGAGTAGGCGGGCG (SEQ ID NO:3883), TTAGGCGGCGGTTCGAGTGAGGTTAGC (SEQ ID NO:3884), TTCGAGTGAGGTTAGCGGGGAGGGGTC (SEQ ID NO:3885), GTTAGGCGGCGGTTCGAGTGAGGTTAG (SEQ ID NO:3886), GTTCGAGTGAGGTTAGCGGGGAGGGG (SEQ ID NO:3887), GGTTCGAGTGAGGTTAGCGGGGAGGG (SEQ ID NO:3888) |
| Target407 | chr3:129693540-129693629 | TTGAAGAGGGTTCGGTAGGCGTTCGGG (SEQ ID NO:3889), TAGATTTTCGGAGGAGTAGGCGGGCGG (SEQ ID NO:3890), CGGTAGGCGTTCGGGGTTTTTAGCGTT (SEQ ID NO:3891), TTCGGTAGGCGTTCGGGGTTTTTAGCG (SEQ ID NO:3892), TGAAGAGGGTTCGGTAGGCGTTCGGG (SEQ ID NO:3893), GGAAGGAGAGGGGTTGGGGCGGTTATT (SEQ ID NO:3894), AGGAGAGGGGTTGGGGCGGTTATTTGT (SEQ ID NO:3895), GGTGAGGGCGGGTCGAGAGGGTTTTTT (SEQ ID NO:3896), GGAAGGAGAGGGGTTGGGGCGGTTATTT (SEQ ID NO:3897), GGAGAGGGGTTGGGGCGGTTATTTGTT (SEQ ID NO:3898) |
| Target408 | chr3:129693672-129693706 | TTGAAGAGGGTTCGGTAGGCGTTCGGG (SEQ ID NO:3899), AGGGTTCGGTAGGCGTTCGGGGTTTTT (SEQ ID NO:3900), CGGTAGGCGTTCGGGGTTTTTAGCGTT (SEQ ID NO:3901), GAGGGTTCGGTAGGCGTTCGGGGTTTT (SEQ ID NO:3902), TTCGGTAGGCGTTCGGGGTTTTTAGCG (SEQ ID NO:3903), GGGGAGGGATTCGGGGGTGCGAGTATAG (SEQ ID NO:3904), GGTGAGGGCGGGTCGAGAGGGTTTTTT (SEQ ID NO:3905), CGGGGAGGGATTCGGGGGTGCGAGTATA (SEQ ID NO:3906), AGGTGAGGGCGGGTCGAGAGGGTTTTT (SEQ ID NO:3907), AAGGTGAGGGCGGGTCGAGAGGGTTTT (SEQ ID NO:3908) |
| Target409 | chr3:133578115-133578515 | TTGGGTTGGGGGTGGGTGTTAGGGTTT (SEQ ID NO:3909), TTTGGGTTGGGGGTGGGTGTTAGGGTT (SEQ ID NO:3910), TTTTGGGTTGGGGGTGGGTGTTAGGGT (SEQ ID NO:3911), TGGGTTGGGGGTGGGTGTTAGGGTTA (SEQ ID NO:3912), TTTGGGTTGGGGGTGGGTGTTAGGGTTT (SEQ ID NO:3913), AGGTGGTTTAGGGGGTTGTTAGTTTTGGT (SEQ ID NO:3914), GGTGGTTTAGGGGGTTGTTAGTTTTGGTAGT (SEQ ID NO:3915), AGGTGGTTTAGGGGGTTGTTAGTTTTGGTAG (SEQ ID NO:3916), AGGTGGTTTAGGGGGTTGTTAGTTTTGGTAGT (SEQ ID NO:3917), TTAGGTGGTTTAGGGGGTTGTTAGTTTTGGT (SEQ ID NO:3918) |
| Target410 | chr3:137483751-137484225 | ATGGTATGGTTTCGGGGTTAGCGGCGT (SEQ ID NO:3919), TGGTATGGTTTCGGGGTTAGCGGCGTA (SEQ ID NO:3920), GGCGGTTGGTTTGTTCGTGGGGGTTTT (SEQ ID NO:3921), TTAAGGCGGTTGGTTTGTTCGTGGGGG (SEQ ID NO:3922), TAAGGCGGTTGGTTTGTTCGTGGGGGT (SEQ ID NO:3923), GTAGTTAGGGTTGGTGGGGGACGGGTG (SEQ ID NO:3924), GAGGTCGGCGGTAAGAAGGTTCGGGTT (SEQ ID NO:3925), ACGGGGGGTTGTAGGGTGGAGGTAGAT (SEQ ID NO:3926), AGGTCGGCGGTAAGAAGGTTCGGGTTT (SEQ ID NO:3927), GCGGGGTTTAGTAGGGAGTAGGGCGTC (SEQ ID NO:3928) |
| Target411 | chr3:138171444-138171844 | TGGGAGGAGGTTTAGTTCGTAGTAGGAATGA (SEQ ID NO:3929), TTGGGAGGAGGTTTAGTTCGTAGTAGGAATGA (SEQ ID NO:3930), TGGGAGGAGGTTTAGTTCGTAGTAGGAATGAT (SEQ ID NO:3931), TGTTTTTGGGAGGAGGTTTAGTTCGTAGTAGG (SEQ ID NO:3932), TGTTTTTGGGAGGAGGTTTAGTTCGTAGTAGGA (SEQ ID NO:3933), |

FIGURE 5 CONTINUED

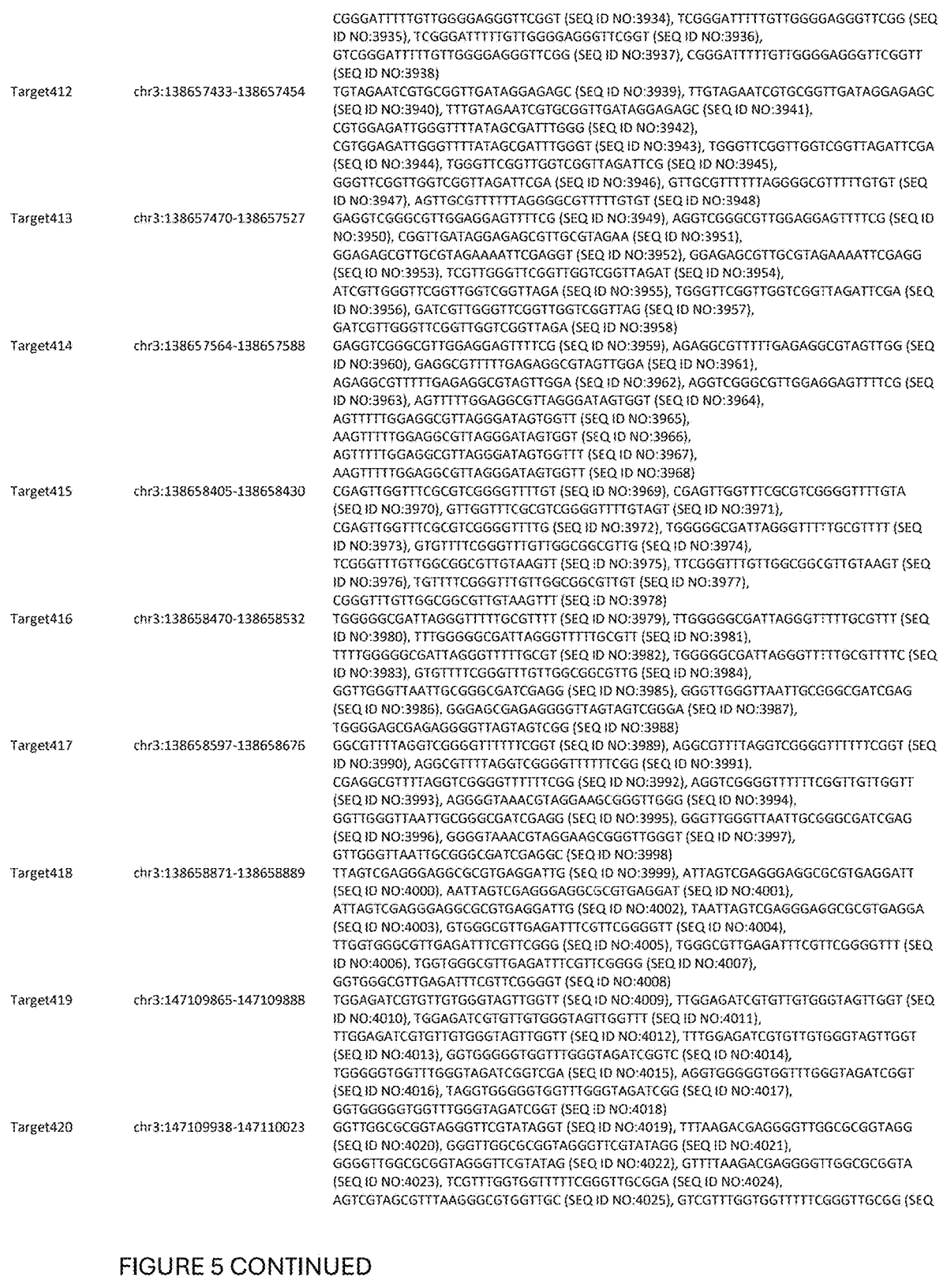

|  |  | CGGGATTTTTGTTGGGGAGGGGTTCGGT (SEQ ID NO:3934), TCGGGATTTTTGTTGGGGAGGGTTCGG (SEQ ID NO:3935), TCGGGATTTTTGTTGGGGAGGGTTCGGT (SEQ ID NO:3936), GTCGGGATTTTTGTTGGGGAGGGTTCGG (SEQ ID NO:3937), CGGGATTTTTGTTGGGGAGGGTTCGGTT (SEQ ID NO:3938) |
| Target412 | chr3:138657433-138657454 | TGTAGAATCGTGCGGTTGATAGGAGAGC (SEQ ID NO:3939), TTGTAGAATCGTGCGGTTGATAGGAGAGC (SEQ ID NO:3940), TTTGTAGAATCGTGCGGTTGATAGGAGAGC (SEQ ID NO:3941), CGTGGAGATTGGGTTTTATAGCGATTTGGG (SEQ ID NO:3942), CGTGGAGATTGGGTTTTATAGCGATTTGGGT (SEQ ID NO:3943), TGGGTTCGGTTGGTCGGTTAGATTCGA (SEQ ID NO:3944), TGGGTTCGGTTGGTCGGTTAGATTCG (SEQ ID NO:3945), GGGTTCGGTTGGTCGGTTAGATTCGA (SEQ ID NO:3946), GTTGCGTTTTTTAGGGGCGTTTTTGTGT (SEQ ID NO:3947), AGTTGCGTTTTTTAGGGGCGTTTTTGTGT (SEQ ID NO:3948) |
| Target413 | chr3:138657470-138657527 | GAGGTCGGGCGTTGGAGGGAGTTTTCG (SEQ ID NO:3949), AGGTCGGGCGTTGGAGGGAGTTTTCG (SEQ ID NO:3950), CGGTTGATAGGAGAGCGTTGCGTAGAA (SEQ ID NO:3951), GGAGAGCGTTGCGTAGAAAAATTCGAGGT (SEQ ID NO:3952), GGAGAGCGTTGCGTAGAAAAATTCGAGG (SEQ ID NO:3953), TCGTTGGGTTCGGTTGGTCGGTTAGAT (SEQ ID NO:3954), ATCGTTGGGTTCGGTTGGTCGGTTAGA (SEQ ID NO:3955), TGGGTTCGGTTGGTCGGTTAGATTCGA (SEQ ID NO:3956), GATCGTTGGGTTCGGTTGGTCGGTTAG (SEQ ID NO:3957), GATCGTTGGGTTCGGTTGGTCGGTTAGA (SEQ ID NO:3958) |
| Target414 | chr3:138657564-138657588 | GAGGTCGGGCGTTGGAGGGAGTTTTCG (SEQ ID NO:3959), AGAGGCGTTTTTGAGAGGCGTAGTTGG (SEQ ID NO:3960), GAGGCGTTTTTGAGAGGCGTAGTTGGA (SEQ ID NO:3961), AGAGGCGTTTTTGAGAGGCGTAGTTGGA (SEQ ID NO:3962), AGGTCGGGCGTTGGAGGGAGTTTTCG (SEQ ID NO:3963), AGTTTTTGGAGGCGTTAGGGATAGTGGT (SEQ ID NO:3964), AGTTTTTGGAGGCGTTAGGGATAGTGGTT (SEQ ID NO:3965), AAGTTTTTGGAGGCGTTAGGGATAGTGGT (SEQ ID NO:3966), AGTTTTTGGAGGCGTTAGGGATAGTGGTTT (SEQ ID NO:3967), AAGTTTTTGGAGGCGTTAGGGATAGTGGTT (SEQ ID NO:3968) |
| Target415 | chr3:138658405-138658430 | CGAGTTGGTTTCGCGTCGGGGTTTTGT (SEQ ID NO:3969), CGAGTTGGTTTCGCGTCGGGGTTTTGTA (SEQ ID NO:3970), GTTGGTTTCGCGTCGGGGTTTTGTAGT (SEQ ID NO:3971), CGAGTTGGTTTCGCGTCGGGGTTTTG (SEQ ID NO:3972), TGGGGGGCGATTAGGGGTTTTTGCGTTTT (SEQ ID NO:3973), GTGTTTTCGGGTTTGTTGGCGGCGTTG (SEQ ID NO:3974), TCGGGTTTGTTGGCGGCGTTGTAAGTT (SEQ ID NO:3975), TTCGGGTTTGTTGGCGGCGTTGTAAGT (SEQ ID NO:3976), TGTTTTCGGGTTTGTTGGCGGCGTTGT (SEQ ID NO:3977), CGGGTTTGTTGGCGGCGTTGTAAGTTT (SEQ ID NO:3978) |
| Target416 | chr3:138658470-138658532 | TGGGGGGCGATTAGGGGTTTTTGCGTTTT (SEQ ID NO:3979), TTGGGGGGCGATTAGGGGTTTTTGCGTTT (SEQ ID NO:3980), TTTGGGGGGCGATTAGGGGTTTTTGCGTT (SEQ ID NO:3981), TTTTGGGGGGCGATTAGGGGTTTTTGCGT (SEQ ID NO:3982), TGGGGGGCGATTAGGGGTTTTTGCGTTTTC (SEQ ID NO:3983), GTGTTTTCGGGTTTGTTGGCGGCGTTG (SEQ ID NO:3984), GGTTGGGTTAATTGCGGGCGATCGAGG (SEQ ID NO:3985), GGGTTGGGTTAATTGCGGGCGATCGAG (SEQ ID NO:3986), GGGAGCGAGAGGGGGTTAGTAGTCGGGA (SEQ ID NO:3987), TGGGAGCGAGAGGGGGTTAGTAGTCGG (SEQ ID NO:3988) |
| Target417 | chr3:138658597-138658676 | GGCGTTTTAGGTCGGGGTTTTTTCGGT (SEQ ID NO:3989), AGGCGTTTTAGGTCGGGGTTTTTTCGGT (SEQ ID NO:3990), AGGCGTTTTAGGTCGGGGTTTTTTCGG (SEQ ID NO:3991), CGAGGCGTTTTAGGTCGGGGTTTTTTCGG (SEQ ID NO:3992), AGGTCGGGGTTTTTTCGGTTGTTGGTT (SEQ ID NO:3993), AGGGGTAAACGTAGGAAGCGGGTTGGG (SEQ ID NO:3994), GGTTGGGTTAATTGCGGGCGATCGAGG (SEQ ID NO:3995), GGGTTGGGTTAATTGCGGGCGATCGAG (SEQ ID NO:3996), GGGGTAAACGTAGGAAGCGGGTTGGGT (SEQ ID NO:3997), GTTGGGTTAATTGCGGGCGATCGAGGC (SEQ ID NO:3998) |
| Target418 | chr3:138658871-138658889 | TTAGTCGAGGGAGGCGCGTGAGGATTG (SEQ ID NO:3999), ATTAGTCGAGGGAGGCGCGTGAGGATT (SEQ ID NO:4000), AATTAGTCGAGGGAGGCGCGTGAGGAT (SEQ ID NO:4001), ATTAGTCGAGGGAGGCGCGTGAGGATTG (SEQ ID NO:4002), TAATTAGTCGAGGGAGGCGCGTGAGGA (SEQ ID NO:4003), GTGGGCGTTGAGATTTCGTTCGGGGTT (SEQ ID NO:4004), TTGGTGGGCGTTGAGATTTCGTTCGGG (SEQ ID NO:4005), TGGGCGTTGAGATTTCGTTCGGGGTTT (SEQ ID NO:4006), TGGTGGGCGTTGAGATTTCGTTCGGGG (SEQ ID NO:4007), GGTGGGCGTTGAGATTTCGTTCGGGGT (SEQ ID NO:4008) |
| Target419 | chr3:147109865-147109888 | TGGAGATCGTGTTGTGGGTAGTTGGTT (SEQ ID NO:4009), TTGGAGATCGTGTTGTGGGTAGTTGGT (SEQ ID NO:4010), TGGAGATCGTGTTGTGGGTAGTTGGTTT (SEQ ID NO:4011), TTGGAGATCGTGTTGTGGGTAGTTGGTT (SEQ ID NO:4012), TTTGGAGATCGTGTTGTGGGTAGTTGGT (SEQ ID NO:4013), GGTGGGGGTGGTTTGGGTAGATCGGTC (SEQ ID NO:4014), TGGGGGTGGTTTGGGTAGATCGGTCGA (SEQ ID NO:4015), AGGTGGGGGTGGTTTGGGTAGATCGGT (SEQ ID NO:4016), TAGGTGGGGGTGGTTTGGGTAGATCGG (SEQ ID NO:4017), GGTGGGGGTGGTTTGGGTAGATCGGT (SEQ ID NO:4018) |
| Target420 | chr3:147109938-147110023 | GGTTGGCGCGGTAGGGGTTCGTATAGGT (SEQ ID NO:4019), TTTAAGACGAGGGGTTGGCGCGGTAGG (SEQ ID NO:4020), GGGTTGGCGCGGTAGGGGTTCGTATAGG (SEQ ID NO:4021), GGGGTTGGCGCGGTAGGGGTTCGTATAG (SEQ ID NO:4022), GTTTTAAGACGAGGGGTTGGCGCGGTA (SEQ ID NO:4023), TCGTTTGGTGGTTTTTCGGGTTGCGGA (SEQ ID NO:4024), AGTCGTAGCGTTTAAGGGCGTGGTTGC (SEQ ID NO:4025), GTCGTTTGGTGGTTTTTCGGGTTGCGG (SEQ |

FIGURE 5 CONTINUED

ID NO:4026), CGTTTGGTGGTTTTTCGGGTTGCGGAG (SEQ ID NO:4027), TCGTTTGGTGGTTTTTCGGGTTGCGGAG (SEQ ID NO:4028)

| Target421 | chr3:147110063-147110086 | GGTTGGCGCGGTAGGGTTCGTATAGGT (SEQ ID NO:4029), GGGTTGGCGCGGTAGGGTTCGTATAGG (SEQ ID NO:4030), GGGGTTGGCGCGGTAGGGTTCGTATAG (SEQ ID NO:4031), AGGGGTTGGCGCGGTAGGGTTCGTATA (SEQ ID NO:4032), GGTTGGCGCGGTAGGGTTCGTATAGGTT (SEQ ID NO:4033), TGTTAGTCGTTTGGTGGTTTTTCGGGTTGT (SEQ ID NO:4034), GTTAGTCGTTTGGTGGTTTTTCGGGTTGT (SEQ ID NO:4035), TGTTAGTCGTTTGGTGGTTTTTCGGGTTG (SEQ ID NO:4036), ATGTTAGTCGTTTGGTGGTTTTTCGGGTTG (SEQ ID NO:4037), ATGTTAGTCGTTTGGTGGTTTTTCGGGTTGT (SEQ ID NO:4038) |
|---|---|---|
| Target422 | chr3:147110125-147110230 | TTGGTATAGGTCGGGGAGGGGGTTGGGA (SEQ ID NO:4039), CGGTTGGTATAGGTCGGGGAGGGGGTTG (SEQ ID NO:4040), TGGTATAGGTCGGGGAGGGGGTTGGGAT (SEQ ID NO:4041), TATAGGTCGGGGAGGGGTTGGGATCGG (SEQ ID NO:4042), GGGTTGGGATCGGTGGTTGCGATGTTT (SEQ ID NO:4043), GGAATTTAGGTTTTCGGGTTTTCGGGGT (SEQ ID NO:4044), AGGAATTTAGGTTTTCGGGTTTTCGGGGT (SEQ ID NO:4045), GGAATTTAGGTTTTCGGGTTTTCGGGGTT (SEQ ID NO:4046), AGGAATTTAGGTTTTCGGGTTTTCGGGGTT (SEQ ID NO:4047), CGGTAGGAATTTAGGTTTTCGGGTTTTCGGGG (SEQ ID NO:4048) |
| Target423 | chr3:147110251-147110296 | TGTTTTGTAGAGTCGAGGGAAGGCGCG (SEQ ID NO:4049), TGTTTTGTAGAGTCGAGGGAAGGCGCGA (SEQ ID NO:4050), GTTTTGTAGAGTCGAGGGAAGGCGCGA (SEQ ID NO:4051), ATGTTTTGTAGAGTCGAGGGAAGGCGCG (SEQ ID NO:4052), ATGTTTTGTAGAGTCGAGGGAAGGCGCGA (SEQ ID NO:4053), GCGTTGGGAGGTAGTTATTTGTTTAAAGCGT (SEQ ID NO:4054), AGCGTTGGGAGGTAGTTATTTGTTTAAAGCG (SEQ ID NO:4055), GTCGGTTTTTTAATTTAGAGCGTTGGGAGGT (SEQ ID NO:4056), AGCGTTGGGAGGTAGTTATTTGTTTAAAGCGT (SEQ ID NO:4057), AGTCGGTTTTTTAATTTAGAGCGTTGGGAGGT (SEQ ID NO:4058) |
| Target424 | chr3:147110349-147110461 | AGTGTTGCGGAAATGGGGGAAGAAGGT (SEQ ID NO:4059), CGGAAATGGGGGAAGAAGGTTTTTGGGCG (SEQ ID NO:4060), GTGTTGCGGAAATGGGGGAAGAAGGTT (SEQ ID NO:4061), TGGGGGAAGAAGGTTTTTGGGCGTTTT (SEQ ID NO:4062), GCGGAAATGGGGGAAGAAGGTTTTTGGGC (SEQ ID NO:4063), TTCGGGTTTAGGAGTCGTTGATTGCGT (SEQ ID NO:4064), GGGTTCGGGAATTGGGGTTTTGTTTGT (SEQ ID NO:4065), AGGGTTCGGGAATTGGGGTTTTGTTTGT (SEQ ID NO:4066), AGGGTTCGGGAATTGGGGTTTTGTTTG (SEQ ID NO:4067), CGGAGATTCGGGTTTAGGAGTCGTTGA (SEQ ID NO:4068) |
| Target425 | chr3:157812170-157812185 | AGAGGAGGTAAGGGCGTCGCGAGTTTT (SEQ ID NO:4069), AAGAGGAGGTAAGGGCGTCGCGAGTTT (SEQ ID NO:4070), GTAAGAGGAGGTAAGGGCGTCGCGAGT (SEQ ID NO:4071), TAAGAGGAGGTAAGGGCGTCGCGAGTT (SEQ ID NO:4072), AGGAGGTAAGGGCGTCGCGAGTTTTTC (SEQ ID NO:4073), AGGTTCGCGGAGGTAGTTAGGTTCGGC (SEQ ID NO:4074), CGGAGAGGTTCGCGGAGGTAGTTAGGT (SEQ ID NO:4075), GAGGTTCGCGGAGGTAGTTAGGTTCGGC (SEQ ID NO:4076), GAGGTTCGCGGAGGTAGTTAGGTTCGG (SEQ ID NO:4077), AGAGGTTCGCGGAGGTAGTTAGGTTCGG (SEQ ID NO:4078) |
| Target426 | chr3:157812206-157812227 | AGAGGAGGTAAGGGCGTCGCGAGTTTT (SEQ ID NO:4079), AAGAGGAGGTAAGGGCGTCGCGAGTTT (SEQ ID NO:4080), GTAAGAGGAGGTAAGGGCGTCGCGAGT (SEQ ID NO:4081), TAAGAGGAGGTAAGGGCGTCGCGAGTT (SEQ ID NO:4082), AGGAGGTAAGGGCGTCGCGAGTTTTTC (SEQ ID NO:4083), AGTTAGGTGGGTTCGGCGCGGAGATTC (SEQ ID NO:4084), CGGAGAGGTTCGCGGAGGTAGTTAGGT (SEQ ID NO:4085), AGTTAGGTGGGTTCGGCGCGGAGATT (SEQ ID NO:4086), GTTAGGTGGGTTCGGCGCGGAGATTCG (SEQ ID NO:4087), GAGTTAGGTGGGTTCGGCGCGGAGAT (SEQ ID NO:4088) |
| Target427 | chr3:157812296-157812438 | TCGTCGGATTTGGTTGTTTTCGCGGGT (SEQ ID NO:4089), TTCGTCGGATTTGGTTGTTTTCGCGGGT (SEQ ID NO:4090), TTCGTCGGATTTGGTTGTTTTCGCGGG (SEQ ID NO:4091), TTTCGTCGGATTTGGTTGTTTTCGCGGG (SEQ ID NO:4092), CGTCGGATTTGGTTGTTTTCGCGGGT (SEQ ID NO:4093), TGCGATAGGAGTTAGGTGGGTTCGGCG (SEQ ID NO:4094), AGTTCGAGGTTAAAGGAGGCGGTGCGT (SEQ ID NO:4095), AGTTAGGTGGGTTCGGCGCGGAGATTC (SEQ ID NO:4096), GAGTTAGGTGGGTTCGGCGCGGAGATT (SEQ ID NO:4097), GATAGGAGTTAGGTGGGTTCGGCGCGG (SEQ ID NO:4098) |
| Target428 | chr3:157812457-157812476 | TGGAGATTTTGGAGTAGGGGAGATGGTGGT (SEQ ID NO:4099), GGAGATTTTGGAGTAGGGGAGATGGTGGT (SEQ ID NO:4100), TGGAGATTTTGGAGTAGGGGAGATGGTGG (SEQ ID NO:4101), GGAGATTTTGGAGTAGGGGAGATGGTGG (SEQ ID NO:4102), GGAGATTTTGGAGTAGGGGAGATGGTGGTT (SEQ ID NO:4103) |
| Target429 | chr3:157812608-157812618 | CGTGTTGGGATTTGGGTTAGGATTAGGGT (SEQ ID NO:4104), TCGTGTTGGGATTTGGGTTAGGATTAGGGT (SEQ ID NO:4105), TCGTGTTGGGATTTGGGTTAGGATTAGGG (SEQ ID NO:4106), CGTGTTGGGATTTGGGTTAGGATTAGGGTT (SEQ ID NO:4107), TTCGTGTTGGGATTTGGGTTAGGATTAGGG (SEQ ID NO:4108), TCGTCGTGGTTTTGTGGTTTTTAGCGA (SEQ ID NO:4109), CGTCGTGGTTTTGTGGTTTTTAGCGAGT (SEQ ID NO:4110), TCGTCGTGGTTTTGTGGTTTTTAGCGAGT (SEQ ID NO:4111), TCGTCGTGGTTTTGTGGTTTTTAGCGAG (SEQ ID NO:4112), TTCGTCGTGGTTTTGTGGTTTTTAGCGA (SEQ ID NO:4113) |

FIGURE 5 CONTINUED

| Target430 | chr3:157812620-157812652 | CGTGTTGGGATTTGGGTTAGGATTAGGGT (SEQ ID NO:4114),<br>TCGTGTTGGGATTTGGGTTAGGATTAGGGT (SEQ ID NO:4115),<br>TCGTGTTGGGATTTGGGTTAGGATTAGGG (SEQ ID NO:4116),<br>CGTGTTGGGATTTGGGTTAGGATTAGGGTT (SEQ ID NO:4117),<br>TTCGTGTTGGGATTTGGGTTAGGATTAGGG (SEQ ID NO:4118), TCGTCGTGGTTTTGTGGTTTTTAGCGA<br>(SEQ ID NO:4119), CGTCGTGGTTTTGTGGTTTTTAGCGAGT (SEQ ID NO:4120),<br>TCGTCGTGGTTTTGTGGTTTTTAGCGAGT (SEQ ID NO:4121), TCGTCGTGGTTTTGTGGTTTTTAGCGAG<br>(SEQ ID NO:4122), TTCGTCGTGGTTTTGTGGTTTTTAGCGA (SEQ ID NO:4123) |
| Target431 | chr3:170137078-170137103 | TCGGGTAAGGATTCGAGTTTGGCGGCG (SEQ ID NO:4124), CGGGTAAGGATTCGAGTTTGGCGGCG (SEQ<br>ID NO:4125), TCGGGTAAGGATTCGAGTTTGGCGGC (SEQ ID NO:4126),<br>AGTTGGGTTTTAAGGGGTTGTGGGTCG (SEQ ID NO:4127), GTTGGGTTTTAAGGGGTTGTGGGTCGA<br>(SEQ ID NO:4128), TGGGAGTCGTCGTTAAGTTCGGGTTTT (SEQ ID NO:4129),<br>TTGGGAGTCGTCGTTAAGTTCGGGTTT (SEQ ID NO:4130), TTTGGGAGTCGTCGTTAAGTTCGGGTT (SEQ<br>ID NO:4131), ATTTGGGAGTCGTCGTTAAGTTCGGGT (SEQ ID NO:4132),<br>GGATTTGGGAGTCGTCGTTAAGTTCGGGT (SEQ ID NO:4133) |
| Target432 | chr3:170137305-170137869 | TTTCGCGTCGTTGGGTTGGATAGGGAC (SEQ ID NO:4134), GTTTCGCGTCGTTGGGTTGGATAGGGA (SEQ<br>ID NO:4135), TTTATTGGGGAGATACGGAGCGCGTCG (SEQ ID NO:4136),<br>GTTTCGCGTCGTTGGGTTGGATAGGGAC (SEQ ID NO:4137), CGTTGGGTTGGATAGGGACGAGCGGG<br>(SEQ ID NO:4138), ATTTCGGGAAGCGGACGGTGGAAGGAT (SEQ ID NO:4139),<br>CGGGGGGTAGCGGAGATGGTTTTGGGTA (SEQ ID NO:4140), TATTTCGGGAAGCGGACGGTGGAAGGA<br>(SEQ ID NO:4141), CGGAGATGGTTTTGGGTACGTGCGGGA (SEQ ID NO:4142),<br>TTTCGGGAAGCGGACGGTGGAAGGATG (SEQ ID NO:4143) |
| Target433 | chr3:171175787-171176317 | TCGTTGCGTAGGGGGGTAGTCGGTTTT (SEQ ID NO:4144), TTCGTTGCGTAGGGGGGTAGTCGGTTTT (SEQ<br>ID NO:4145), TTTCGTTGCGTAGGGGGGTAGTCGGTTT (SEQ ID NO:4146),<br>ATTTCGTTGCGTAGGGGGGTAGTCGGTT (SEQ ID NO:4147), CGTTGCGTAGGGGGGTAGTCGGTTTTTG (SEQ<br>ID NO:4148), CGTAGCGGGGTGGGGTTGGTAATAGGG (SEQ ID NO:4149),<br>GGGGTGGGGTTGGTAATAGGGTGGGTG (SEQ ID NO:4150), ATGGATGGTTTCGATTGGGGGGTGGGGT<br>(SEQ ID NO:4151), CGGGAAGTGGTAAAGGGGGAAGGGGTT (SEQ ID NO:4152),<br>GGGTGGGGTTGGTAATAGGGTGGGTGT (SEQ ID NO:4153) |
| Target434 | chr3:181444205-181444223 | AGGATGAGGGTGGTGGTGGTTTTTGGG (SEQ ID NO:4154), GGATGAGGGTGGTGGTGGTTTTTGGGA<br>(SEQ ID NO:4155), AGGATGAGGGTGGTGGTGGTTTTTGGGA (SEQ ID NO:4156),<br>TGAGGGTGGTGGTGGTTTTTGGGAGAA (SEQ ID NO:4157), GGATGAGGGTGGTGGTGGTTTTTGGGAG<br>(SEQ ID NO:4158) |
| Target435 | chr3:181444455-181444464 | GTTTTGAAAGGTAGGGTTCGCGGCGGT (SEQ ID NO:4159), AGTTTTGAAAGGTAGGGTTCGCGGCGG<br>(SEQ ID NO:4160), AGTTTTGAAAGGTAGGGTTCGCGGCGGT (SEQ ID NO:4161),<br>TTTTGAAAGGTAGGGTTCGCGGCGGT (SEQ ID NO:4162), TAGTTTTGAAAGGTAGGGTTCGCGGCGG<br>(SEQ ID NO:4163) |
| Target436 | chr3:188012659-188012871 | CGTTTAGGAGGTGTCGTTCGAGTTTTGGT (SEQ ID NO:4164), CGTTTAGGAGGTGTCGTTCGAGTTTTGG<br>(SEQ ID NO:4165), AGGAGGTGTCGTTCGAGTTTTGGTTAGT (SEQ ID NO:4166),<br>TCGTTTAGGAGGTGTCGTTCGAGTTTTGG (SEQ ID NO:4167), TCGTTTAGGAGGTGTCGTTCGAGTTTTGGT<br>(SEQ ID NO:4168), AGGTGGGATAATGATTTTGATGGAGGATGGG (SEQ ID NO:4169),<br>GGTGGGATAATGATTTTGATGGAGGATGGGA (SEQ ID NO:4170),<br>AGGTGGGATAATGATTTTGATGGAGGATGGGA (SEQ ID NO:4171),<br>AAGGTGGGATAATGATTTTGATGGAGGATGGG (SEQ ID NO:4172),<br>GGTGGGATAATGATTTTGATGGAGGATGGGAA (SEQ ID NO:4173) |
| Target437 | chr3:188012918-188012956 | GGTGGACGTGTGTAGAGGTTGAAGGAG (SEQ ID NO:4174), GGTGGACGTGTGTAGAGGTTGAAGGAGA<br>(SEQ ID NO:4175), GGTGGACGTGTGTAGAGGTTGAAGGAGAG (SEQ ID NO:4176),<br>GGTGGACGTGTGTAGAGGTTGAAGGAGAGT (SEQ ID NO:4177),<br>TGGACGTGTGTAGAGGTTGAAGGAGAGT (SEQ ID NO:4178) |
| Target438 | chr3:192125830-192125856 | CGGGGGTTTCGAGGTGTTTTGAGGAGG (SEQ ID NO:4179), GGGGGTTTCGAGGTGTTTTGAGGAGGG<br>(SEQ ID NO:4180), ACGGGGGTTTCGAGGTGTTTTGAGGAGG (SEQ ID NO:4181),<br>GGGGGTTTCGAGGTGTTTTGAGGAGGGA (SEQ ID NO:4182), ACGGGGGTTTCGAGGTGTTTTGAGGAG<br>(SEQ ID NO:4183), AAGACGGGCGTTTTTTGTGCGAGAGGT (SEQ ID NO:4184),<br>AGACGGGCGTTTTTTGTGCGAGAGGTA (SEQ ID NO:4185), GACGGGCGTTTTTTGTGCGAGAGGTAC<br>(SEQ ID NO:4186), AGACGGGCGTTTTTTGTGCGAGAGGTAC (SEQ ID NO:4187),<br>AGACGGGCGTTTTTTGTGCGAGAGGT (SEQ ID NO:4188) |
| Target439 | chr3:192125889-192126115 | GTTTTTCGGTTTGCGTTTCGTCGGGGC (SEQ ID NO:4189), GCGTTCGTTTTTGTTGGGGTTGGAGCG (SEQ<br>ID NO:4190), GCGAGGGTAGGATTTGGGCGGTTAGGG (SEQ ID NO:4191),<br>GGCGAGGGTAGGATTTGGGCGGTTAGG (SEQ ID NO:4192), GGGCGAGGGTAGGATTTGGGCGGTTAG<br>(SEQ ID NO:4193), TCGGAGGGCGTAGTAGAGGTTGGGGTT (SEQ ID NO:4194),<br>CGGAGGGCGTAGTAGAGGTTGGGGTTT (SEQ ID NO:4195), AGTCGGAGGGCGTAGTAGAGGTTGGGG<br>(SEQ ID NO:4196), GTCGGAGGGCGTAGTAGAGGTTGGGGT (SEQ ID NO:4197),<br>AAGTCGGAGGGCGTAGTAGAGGTTGGG (SEQ ID NO:4198) |
| Target440 | chr3:192126116-192126199 | GTTTTTCGGTTTGCGTTTCGTCGGGGC (SEQ ID NO:4199), GTTAGGGAAAGGGTAGTCGCGGGGAGG<br>(SEQ ID NO:4200), GGTTAGGGAAAGGGTAGTCGCGGGGAG (SEQ ID NO:4201),<br>GGAAAGGGTAGTCGCGGGGAGGTAGTG (SEQ ID NO:4202), TTAGGGAAAGGGTAGTCGCGGGGAGGT |

FIGURE 5 CONTINUED

|  |  | (SEQ ID NO:4203), TCGTTTTGGGGTGTAAGTTTGGGGTGT (SEQ ID NO:4204), AGAGGGTTTGGGATCGTTTCGTTTCGT (SEQ ID NO:4205), GAGGGTTTGGGATCGTTTCGTTTCGTT (SEQ ID NO:4206), TTCGGTCGTTAGAGGTTGGGGAAGTTT (SEQ ID NO:4207), TTTCGGTCGTTAGAGGTTGGGGAAGTT (SEQ ID NO:4208) |
|---|---|---|
| Target441 | chr3:192126244-192126266 | TTTTAATTTTTGGCGGTCGGGGGGCGG (SEQ ID NO:4209), TTTTTAATTTTTGGCGGTCGGGGGGCG (SEQ ID NO:4210), TTTAATTTTTGGCGGTCGGGGGGCGG (SEQ ID NO:4211), TTTTTAATTTTTGGCGGTCGGGGGGCGG (SEQ ID NO:4212), TTTAATTTTTGGCGGTCGGGGGGCGGG (SEQ ID NO:4213), TCGTTTTGGGGTGTAAGTTTGGGGTGT (SEQ ID NO:4214), AGAGGGTTTGGGATCGTTTCGTTTCGT (SEQ ID NO:4215), CGATCGTTTTGGGGTGTAAGTTTGGGGT (SEQ ID NO:4216), CGATCGTTTTGGGGTGTAAGTTTGGGG (SEQ ID NO:4217), TCGATCGTTTTGGGGTGTAAGTTTGGGGT (SEQ ID NO:4218) |
| Target442 | chr3:192126283-192126367 | TTTTAATTTTTGGCGGTCGGGGGGCGG (SEQ ID NO:4219), TCGGCGTTTAAGGGGGTAGTGGGGAGTT (SEQ ID NO:4220), ATCGGCGTTTAAGGGGGTAGTGGGGAGT (SEQ ID NO:4221), TTTTTAATTTTTGGCGGTCGGGGGGCG (SEQ ID NO:4222), TTTAATTTTTGGCGGTCGGGGGGCGG (SEQ ID NO:4223), TCGTTTTGGGGTGTAAGTTTGGGGTGT (SEQ ID NO:4224), CGATCGTTTTGGGGTGTAAGTTTGGGGT (SEQ ID NO:4225), CGATCGTTTTGGGGTGTAAGTTTGGGG (SEQ ID NO:4226), TCGATCGTTTTGGGGTGTAAGTTTGGGGT (SEQ ID NO:4227), TCGATCGTTTTGGGGTGTAAGTTTGGGG (SEQ ID NO:4228) |
| Target443 | chr3:193894534-193894595 | CGTGGAGTTGTTGTTAGAGGTGCGGGA (SEQ ID NO:4229), TCGTGGAGTTGTTGTTAGAGGTGCGGG (SEQ ID NO:4230), TCGTGGAGTTGTTGTTAGAGGTGCGGGA (SEQ ID NO:4231), GTCGGTGTTTGTAGGCGGTTGTTGAGT (SEQ ID NO:4232), CGTGGAGTTGTTGTTAGAGGTGCGGGAT (SEQ ID NO:4233), CGGGGGTTCGGTCGTTTAGTTGGGTTG (SEQ ID NO:4234), GGGGGTTCGGTCGTTTAGTTGGGTTGG (SEQ ID NO:4235), GGGGTTCGGTCGTTTAGTTGGGTTGGT (SEQ ID NO:4236), GGGGGTTCGGTCGTTTAGTTGGGTTGGT (SEQ ID NO:4237), GGGGTTCGGTCGTTTAGTTGGGTTGGTT (SEQ ID NO:4238) |
| Target444 | chr3:193894619-193894705 | CGTGGAGTTGTTGTTAGAGGTGCGGGA (SEQ ID NO:4239), TCGTGGAGTTGTTGTTAGAGGTGCGGG (SEQ ID NO:4240), TCGTGGAGTTGTTGTTAGAGGTGCGGGA (SEQ ID NO:4241), TGGGCGGTCGGATTTTCGTTTGAGTTGT (SEQ ID NO:4242), GGGCGGTCGGATTTTCGTTTGAGTTGT (SEQ ID NO:4243), AGGGTTGGAAGAGTGTAAATAGGATTGCGT (SEQ ID NO:4244), AGGATTGCGTGAGGTTTCGTGTTTATGTTT (SEQ ID NO:4245), AGGGTTGGAAGAGTGTAAATAGGATTGCGTG (SEQ ID NO:4246), GGGTTGGAAGAGTGTAAATAGGATTGCGTGA (SEQ ID NO:4247), AGTGTAAATAGGATTGCGTGAGGTTTCGTGT (SEQ ID NO:4248) |
| Target445 | chr3:196367455-196367942 | GGAGGAGGTCGGATCGGGGGTTTTAGG (SEQ ID NO:4249), GATTGGAGGAGGTCGGATCGGGGGTTT (SEQ ID NO:4250), TCGGATAGGGTTGGTCGGGGTTGTTGT (SEQ ID NO:4251), ATTGGAGGAGGTCGGATCGGGGGTTTT (SEQ ID NO:4252), CGGATAGGGTTGGTCGGGGTTGTTGTG (SEQ ID NO:4253), CGAGGGTTACGGAAGAGCGTTCGAGTT (SEQ ID NO:4254), CGAGGGTTACGGAAGAGCGTTCGAGTTT (SEQ ID NO:4255), CGAGGGTTACGGAAGAGCGTTCGAGT (SEQ ID NO:4256), GAGGGTTACGGAAGAGCGTTCGAGTTT (SEQ ID NO:4257), CGAGGGTTACGGAAGAGCGTTCGAGTTTT (SEQ ID NO:4258) |
| Target446 | chr3:196387459-196387506 | GTCGTCGAGGGAGTGGTGGTTTAGTTT (SEQ ID NO:4259), GTCGTCGAGGGAGATGGTGGTTTAGTTT (SEQ ID NO:4260), GTCGTCGAGGGAGATGGTGGTTTAGT (SEQ ID NO:4261), TCGTCGAGGGAGATGGTGGTTTAGTTTT (SEQ ID NO:4262), GTCGTCGAGGGAGATGGTGGTTTAGTTTT (SEQ ID NO:4263), TGGTGGAGGTTTAGGTGGGAGAGGGAA (SEQ ID NO:4264), TTGGTGGAGGTTTAGGTGGGAGAGGGA (SEQ ID NO:4265), GGTGGAGGTTTAGGTGGGAGAGGGAAGG (SEQ ID NO:4266), TGGAGGTTTAGGTGGGAGAGGGAAGGT (SEQ ID NO:4267), GTGGAGGTTTAGGTGGGAGAGGGAAGGT (SEQ ID NO:4268) |
| Target447 | chr3:196387611-196387699 | TTAGTTCGGTGAGCGTTTCGGGGGGGTT (SEQ ID NO:4269), TTTAGTTCGGTGAGCGTTTCGGGGGGT (SEQ ID NO:4270), GTGAGCGTTTCGGGGGGTTCGTGTTTT (SEQ ID NO:4271), TAGTTCGGTGAGCGTTTCGGGGGGGTC (SEQ ID NO:4272), TGAGCGTTTCGGGGGGGTTCGTGTTTTC (SEQ ID NO:4273) |
| Target448 | chr3:196387727-196387781 | TGGTTTCGGGGTTGGTTAGTTGTTTGGGT (SEQ ID NO:4274), GGTTTCGGGGTTGGTTAGTTGTTTGGGT (SEQ ID NO:4275), TGGTTTCGGGGTTGGTTAGTTGTTTGGG (SEQ ID NO:4276), TGTCGGAGTTGTATTTGGTTTCGGGGT (SEQ ID NO:4277), GGTTTCGGGGTTGGTTAGTTGTTTGGG (SEQ ID NO:4278), TTGGCGAAGAGGTTAGGGGGGACGTTT (SEQ ID NO:4279), ATTGGCGAAGAGGTTAGGGGGGACGTT (SEQ ID NO:4280), TGGCGAAGAGGTTAGGGGGGACGTTTA (SEQ ID NO:4281), AGGGGGGACGTTTAGGGAGTTGGTTGGA (SEQ ID NO:4282), TATTGGCGAAGAGGTTAGGGGGGACGT (SEQ ID NO:4283) |
| Target449 | chr3:197639602-197639700 | GCGTTACGTGGTTTTGTAGTGTTGGTGA (SEQ ID NO:4284), GCGTTACGTGGTTTTGTAGTGTTGGTGAA (SEQ ID NO:4285), TGCGGGGAAGACGTATTGGTATTTGATTGT (SEQ ID NO:4286), GCGTTACGTGGTTTTGTAGTGTTGGTGAAT (SEQ ID NO:4287), AGTTTTGCGGGGAAGACGTATTGGTATTTG (SEQ ID NO:4288) |
| Target450 | chr3:197639785-197639810 | GTGGCGCGGTATTGTGTGTGGATTGC (SEQ ID NO:4289), AGAGTAGTAGTTCGGTCGGTAGTTGAGGT (SEQ ID NO:4290), GAGAGTAGTAGTTCGGTCGGTAGTTGAGGT (SEQ ID NO:4291), TGAGAGTAGTAGTTCGGTCGGTAGTTGAGG (SEQ ID NO:4292), TGAGAGTAGTAGTTCGGTCGGTAGTTGAGGT (SEQ ID NO:4293), |

FIGURE 5 CONTINUED

|  |  |  |
|---|---|---|
|  |  | TGGAGCGTCGTTTTTGTTTTTTAGTGGGT (SEQ ID NO:4294), TTGGAGCGTCGTTTTTGTTTTTTAGTGGGT (SEQ ID NO:4295), TTTGGAGCGTCGTTTTTGTTTTTTAGTGGGT (SEQ ID NO:4296), TTGGAGCGTCGTTTTTGTTTTTTAGTGGGTA (SEQ ID NO:4297), TTTTGGAGCGTCGTTTTTGTTTTTTAGTGGGT (SEQ ID NO:4298) |
| Target451 | chr3:197639879-197639946 | GCGGTATTGTGTGGATTGCGTGTGTTT (SEQ ID NO:4299), GCGGTATTGTGTGGATTGCGTGTGTTTT (SEQ ID NO:4300), GCGGTATTGTGTGGATTGCGTGTGTT (SEQ ID NO:4301), AGGGGGGATTTCGGAGTGTTAGGAAGAGT (SEQ ID NO:4302), TGTGGGGTTTAAAAAGGGGGATTTCGGA (SEQ ID NO:4303), TGGGTCGTGGAATTTGTGTGTGGGAGG (SEQ ID NO:4304), TGGGTCGTGGAATTTGTGTGTGGGAGGA (SEQ ID NO:4305), GGGTCGTGGAATTTGTGTGTGGGAGGA (SEQ ID NO:4306), TTGGGTCGTGGAATTTGTGTGTGGGAGG (SEQ ID NO:4307), TTGGGTCGTGGAATTTGTGTGTGGGAGGA (SEQ ID NO:4308) |
| Target452 | chr4:2813724-2813793 | AGGTGGTTTTGCGGGGAGGTAGTAGGG (SEQ ID NO:4309), GGTGGTTTTGCGGGGAGGTAGTAGGGA (SEQ ID NO:4310), GGTGGTTTTGCGGGGAGGTAGTAGGGAG (SEQ ID NO:4311), GAGGTGGTTTTGCGGGGAGGTAGTAGGG (SEQ ID NO:4312), TGGTTTTGCGGGGAGGTAGTAGGGAGT (SEQ ID NO:4313), GAGGTTTTGAAAGTTGTTTGGGGGTTAGGGT (SEQ ID NO:4314), TGAGGTTTTGAAAGTTGTTTGGGGGTTAGGG (SEQ ID NO:4315), TGAGGTTTTGAAAGTTGTTTGGGGGTTAGGGT (SEQ ID NO:4316), GGTTTTGAAAGTTGTTTGGGGGTTAGGGTTGT (SEQ ID NO:4317), AGGTTTTGAAAGTTGTTTGGGGGTTTAGGGTTG (SEQ ID NO:4318) |
| Target453 | chr4:2813941-2814002 | GGGAATAGGAAGTTTCGGGTGGGGAGG (SEQ ID NO:4319), AGGGAATAGGAAGTTTCGGGTGGGGAGG (SEQ ID NO:4320), GGGAATAGGAAGTTTCGGGTGGGGAGGA (SEQ ID NO:4321), AGGGAATAGGAAGTTTCGGGTGGGGAGGA (SEQ ID NO:4322), CGGATGGTGGATGAGGGGTAGTTTTGGGT (SEQ ID NO:4323), TGTGAGGTTTGACGCGTTTGGTTGTTT (SEQ ID NO:4324), TGTTTTTGAGGTTTGTGGTCGTCGGTGT (SEQ ID NO:4325), ATGTGAGGTTTGACGCGTTTGGTTGTT (SEQ ID NO:4326), GTTTTTGAGGTTTGTGGTCGTCGGTGT (SEQ ID NO:4327), TGTTTTTGAGGTTTGTGGTCGTCGGTG (SEQ ID NO:4328) |
| Target454 | chr4:2814004-2814242 | AGTTTCGGGTGGGGAGGAAGTATCGGC (SEQ ID NO:4329), GGGTGGGGAGGAAGTATCGGCGGTTAT (SEQ ID NO:4330), GTTTCGGGTGGGGAGGAAGTATCGGCG (SEQ ID NO:4331), TTTCGGGTGGGGAGGAAGTATCGGCG (SEQ ID NO:4332), AAGTTTCGGGTGGGGAGGAAGTATCGGC (SEQ ID NO:4333), CGGGGTCGGTGTTTTGGGGTTTAGGGA (SEQ ID NO:4334), GGGTCGGTGTTTTGGGGTTTAGGGAGG (SEQ ID NO:4335), GGGGTCGGTGTTTTGGGGTTTAGGGAG (SEQ ID NO:4336), GGGTCGGTGTTTTGGGGTTTAGGGAGGT (SEQ ID NO:4337), GGGGTCGGTGTTTTGGGGTTTAGGGAGG (SEQ ID NO:4338) |
| Target455 | chr4:2814283-2814401 | ATTGGGGTTCGGGAGGCGGTATTGGTT (SEQ ID NO:4339), AGGATTGGGGTTCGGGAGGCGGTATTG (SEQ ID NO:4340), TTGGGGTTCGGGAGGCGGTATTGGTTT (SEQ ID NO:4341), TTTTTAGGATTGGGGTTCGGGAGGCGGT (SEQ ID NO:4342), GATTGGGGTTCGGGAGGCGGTATTGGT (SEQ ID NO:4343), TTTTTGTCGGTCGTATGTGATGGGGGG (SEQ ID NO:4344), TTTTTTGTCGGTCGTATGTGATGGGGGG (SEQ ID NO:4345), ACGGTTAGTTTCGAGGAAGGTTGTGGT (SEQ ID NO:4346), TTTTGTCGGTCGTATGTGATGGGGGGG (SEQ ID NO:4347), ACGGTTAGTTTCGAGGAAGGTTGTGTT (SEQ ID NO:4348) |
| Target456 | chr4:3311897-3312297 | GGGCGGGTAGGTTTATGTTGTTTTGGGT (SEQ ID NO:4349), GGGCGGGTAGGTTTATGTTGTTTTGGG (SEQ ID NO:4350), AGGGCGGGTAGGTTTATGTTGTTTTGGGT (SEQ ID NO:4351), AGGGCGGGTAGGTTTATGTTGTTTTGGG (SEQ ID NO:4352), CGTGTTTTGTTGTGTTTAGGGCGGGTAGGT (SEQ ID NO:4353), TGGGGTGTAGCGTGGATTGGAGATAGT (SEQ ID NO:4354), TTTTTGGGGTGTAGCGTGGATTGGAGA (SEQ ID NO:4355), TTTTGGGGTGTAGCGTGGATTGGAGAT (SEQ ID NO:4356), TGGGGTGTAGCGTGGATTGGAGATAGTT (SEQ ID NO:4357), TTGGGGTGTAGCGTGGATTGGAGATAGT (SEQ ID NO:4358) |
| Target457 | chr4:8582287-8582301 | GGTTGGGAGGTTCGGTTGGAGGTGTGA (SEQ ID NO:4359), GGCGTGGCGAGGGTTGTGTTGTTTAGG (SEQ ID NO:4360), AGGCGTGGCGAGGGTTGTGTTGTTTAG (SEQ ID NO:4361), GCGTGGCGAGGGTTGTGTTGTTTAGGA (SEQ ID NO:4362), TAGGGTTGGGAGGTTCGGTTGGAGGTG (SEQ ID NO:4363), GCGTGGTAGGATGGGATTTTGCGCGTT (SEQ ID NO:4364), CGTGGCGTGGTAGGATGGGATTTTGCG (SEQ ID NO:4365), TCGTGGCGTGGTAGGATGGGATTTTGC (SEQ ID NO:4366), GCGTGGTAGGATGGGATTTTGCGCGT (SEQ ID NO:4367), TTTTGAGGTTGAAGCGAGGCGTAGGGG (SEQ ID NO:4368) |
| Target458 | chr4:8859601-8859631 | GAGTTTCGGGTTTTAGTTTTAGGAGTCGCG (SEQ ID NO:4369), GGGGATTCGAGGTTTTTGAGGATTTTAAATTGTCG (SEQ ID NO:4370), GGGGATTCGAGGTTTTTGAGGATTTTAAATTGTCGT (SEQ ID NO:4371), AGGGGATTCGAGGTTTTTGAGGATTTTAAATTGTCG (SEQ ID NO:4372), GGGATTCGAGGTTTTTGAGGATTTTAAATTGTCGT (SEQ ID NO:4373), GCGGTTTTTGGAATTGGGGTTCGGGGT (SEQ ID NO:4374), ACGCGGTTTTTGGAATTGGGGTTCGGG (SEQ ID NO:4375), CGCGGTTTTTGGAATTGGGGTTCGGGG (SEQ ID NO:4376), GACGCGGTTTTTGGAATTGGGGTTCGG (SEQ ID NO:4377), AGACGCGGTTTTTGGAATTGGGGTTCGG (SEQ ID NO:4378) |
| Target459 | chr4:8859638-8859725 | GGAGGGGTGAAGTCGAGGGGTGGTTTT (SEQ ID NO:4379), GAGAGAGTAGGGTTTCGGGCGTTCGGG (SEQ ID NO:4380), TGAGAGAGTAGGGTTTCGGGCGTTCGG (SEQ ID NO:4381), AGGAGGGGTGAAGTCGAGGGGTGGTTT (SEQ ID NO:4382), GAGGAGGGGTGAAGTCGAGGGGTGGTT |

FIGURE 5 CONTINUED (SEQ ID NO:4383), GGTTTGGGGGCGGTCGGTTTGTTGTTT (SEQ ID NO:4384),
GTTTGGGGGCGGTCGGTTTGTTGTTTT (SEQ ID NO:4385), GGTTTGGGGGCGGTCGGTTTGTTGTT (SEQ
ID NO:4386), GGTTTGGGGGCGGTCGGTTTGTTGTTTT (SEQ ID NO:4387),
TTGGGGGCGGTCGGTTTGTTGTTTTTT (SEQ ID NO:4388)

Target460    chr4:8859834-8859850    GGGGGGAGGGGGTAGTAGGTCGATCGTT (SEQ ID NO:4389), GTGGGGGAGGGGGTAGTAGGTCGATCG
(SEQ ID NO:4390), CGTGGGGGAGGGGGTAGTAGGTCGATC (SEQ ID NO:4391),
TGGGGGAGGGGGTAGTAGGTCGATCG (SEQ ID NO:4392), GGGGGAGGGGGTAGTAGGTCGATCGT (SEQ
ID NO:4393), ATGGACGGGGGTTTCGATCGGTTTGGG (SEQ ID NO:4394),
AATGGACGGGGGTTTCGATCGGTTTGG (SEQ ID NO:4395), AAATGGACGGGGGTTTCGATCGGTTTGG
(SEQ ID NO:4396), AATGGACGGGGGTTTCGATCGGTTTGGG (SEQ ID NO:4397),
TGGACGGGGGTTTCGATCGGTTTGGG (SEQ ID NO:4398)

Target461    chr4:8859927-8859996    GGGGGAGGGGGTAGTAGGTCGATCGTT (SEQ ID NO:4399), GAGGTTCGGATGTGTTGACGTTGCGGT
(SEQ ID NO:4400), GTGGGGGAGGGGGTAGTAGGTCGATCG (SEQ ID NO:4401),
CGTGGGGGAGGGGGTAGTAGGTCGATC (SEQ ID NO:4402), AGGTTCGGATGTGTTGACGTTGCGGTT
(SEQ ID NO:4403)

Target462    chr4:8859998-8860005    GAGGTTCGGATGTGTTGACGTTGCGGT (SEQ ID NO:4404), AGGTTCGGATGTGTTGACGTTGCGGTT (SEQ
ID NO:4405), GAGGTTCGGATGTGTTGACGTTGCGGTT (SEQ ID NO:4406),
AGGTTCGGATGTGTTGACGTTGCGGT (SEQ ID NO:4407), GGTTCGGATGTGTTGACGTTGCGGTTA (SEQ
ID NO:4408)

Target463    chr4:8862980-8863016    GGGTTTTAGCGGGGTAGGTAGGGTTCGG (SEQ ID NO:4409), GGTTTTAGCGGGGTAGGTAGGGTTCGG
(SEQ ID NO:4410), GGGTTTTAGCGGGGTAGGTAGGGTTCG (SEQ ID NO:4411),
AGGGTTTTAGCGGGGTAGGTAGGGTTCG (SEQ ID NO:4412), GGTTTTAGCGGGGTAGGTAGGGTTCGGA
(SEQ ID NO:4413), GTCGTTCGGTCGGGTAGTGGGAAGTCG (SEQ ID NO:4414),
GTTCGGTCGGGTAGTGGGAAGTCGGTG (SEQ ID NO:4415), TTCGGTCGGGTAGTGGGAAGTCGGTGT
(SEQ ID NO:4416), TCGGTCGGGTAGTGGGAAGTCGGTGTC (SEQ ID NO:4417),
CGGTCGGGTAGTGGGAAGTCGGTGTC (SEQ ID NO:4418)

Target464    chr4:8863143-8863155    TTTGGGAGGGGCGGGTCGGGATTAGAG (SEQ ID NO:4419), GTTTGGGAGGGGCGGGTCGGGATTAGA
(SEQ ID NO:4420), GTTTGGGAGGGGCGGGTCGGGATTAG (SEQ ID NO:4421),
TTTGGGAGGGGCGGGTCGGGATTAGA (SEQ ID NO:4422), TTTGGGAGGGGCGGGTCGGGATTAG (SEQ
ID NO:4423), GCGCGCGTGTATTTGTTTTGGTTATCG (SEQ ID NO:4424),
GCGCGCGTGTATTTGTTTTGGTTATCGA (SEQ ID NO:4425), GCGCGCGTGTATTTGTTTTGGTTATCGAGG
(SEQ ID NO:4426), GCGCGCGTGTATTTGTTTTGGTTATCGAGGT (SEQ ID NO:4427),
GCGCGCGTGTATTTGTTTTGGTTATCGAG (SEQ ID NO:4428)

Target465    chr4:8863239-8863244    CGACGGGGGGAGTTTCGGTGATTAGGGT (SEQ ID NO:4429), TACGTTCGGGAAAGGGGGGTAGGGAAC
(SEQ ID NO:4430), ACGTTCGGGAAAGGGGGGTAGGGAAC (SEQ ID NO:4431),
TTACGTTCGGGAAAGGGGGGTAGGGAA (SEQ ID NO:4432), ATTACGTTCGGGAAAGGGGGGTAGGGA
(SEQ ID NO:4433), GCGTAGTTTCGGTCGTGTTTTCGGGGT (SEQ ID NO:4434),
GCGTAGTTTCGGTCGTGTTTTCGGGGTT (SEQ ID NO:4435), GTTTCGGTCGTGTTTTCGGGGTTTCGT (SEQ
ID NO:4436), AGTTTCGGTCGTGTTTTCGGGGTTTCGT (SEQ ID NO:4437),
AGTTTCGGTCGTGTTTTCGGGGTTTCG (SEQ ID NO:4438)

Target466    chr4:8863260-8863266    CGACGGGGGGAGTTTCGGTGATTAGGGT (SEQ ID NO:4439), TACGTTCGGGAAAGGGGGGTAGGGAAC
(SEQ ID NO:4440), ACGTTCGGGAAAGGGGGGTAGGGAAC (SEQ ID NO:4441),
TTACGTTCGGGAAAGGGGGGTAGGGAA (SEQ ID NO:4442), ATTACGTTCGGGAAAGGGGGGTAGGGA
(SEQ ID NO:4443), GCGTAGTTTCGGTCGTGTTTTCGGGGT (SEQ ID NO:4444),
GCGTAGTTTCGGTCGTGTTTTCGGGGTT (SEQ ID NO:4445), GTTTCGGTCGTGTTTTCGGGGTTTCGT (SEQ
ID NO:4446), AGTTTCGGTCGTGTTTTCGGGGTTTCGT (SEQ ID NO:4447),
AGTTTCGGTCGTGTTTTCGGGGTTTCG (SEQ ID NO:4448)

Target467    chr4:8863304-8863317    CGACGGGGGGAGTTTCGGTGATTAGGGT (SEQ ID NO:4449), ACGTTCGGGAAAGGGGGGTAGGGAAC
(SEQ ID NO:4450), GTTCGGGAAAGGGGGGTAGGGAACGA (SEQ ID NO:4451),
CGACGGGGGGAGTTTCGGTGATTAGGGTA (SEQ ID NO:4452), CGACGGGGGGAGTTTCGGTGATTAGGG
(SEQ ID NO:4453), GCGTAGTTTCGGTCGTGTTTTCGGGGT (SEQ ID NO:4454),
GCGTAGTTTCGGTCGTGTTTTCGGGGTT (SEQ ID NO:4455), AGTTTCGGTCGTGTTTTCGGGGTTTCG (SEQ
ID NO:4456), CGTAGTTTCGGTCGTGTTTTCGGGGTT (SEQ ID NO:4457),
GCGTAGTTTCGGTCGTGTTTTCGGGGTTT (SEQ ID NO:4458)

Target468    chr4:8863338-8863351    GTAGGCGGAGTTTCGGGGGTACGGTC (SEQ ID NO:4459), GTAGGCGGAGTTTCGGGGGTACGGTCG
(SEQ ID NO:4460), CGTAGGCGGAGTTTCGGGGGTACGGTC (SEQ ID NO:4461),
GTAGGCGGAGTTTCGGGGGTACGGT (SEQ ID NO:4462), TAGGCGGAGTTTCGGGGGTACGGTC (SEQ ID
NO:4463), CGACGGCGTTTTAGGTTAGAGTTGTGGG (SEQ ID NO:4464),
CGACGGCGTTTTAGGTTAGAGTTGTGGGT (SEQ ID NO:4465), ACGGCGTTTTAGGTTAGAGTTGTGGGT
(SEQ ID NO:4466), CGACGGCGTTTTAGGTTAGAGTTGTGG (SEQ ID NO:4467),
GACGGCGTTTTAGGTTAGAGTTGTGGGT (SEQ ID NO:4468)

Target469    chr4:8863569-8863591    TGGGTCGGGCGTTGTAGATTAAGTACGT (SEQ ID NO:4469), GGGTCGGGCGTTGTAGATTAAGTACGT
(SEQ ID NO:4470), TGGGTCGGGCGTTGTAGATTAAGTACG (SEQ ID NO:4471),
GTGGGTCGGGCGTTGTAGATTAAGTACGT (SEQ ID NO:4472), GTGGGTCGGGCGTTGTAGATTAAGTACG
(SEQ ID NO:4473), CGTTGTAGTGTTTGGGAGGTTGCGCGT (SEQ ID NO:4474),
TCGTTGTAGTGTTTGGGAGGTTGCGCG (SEQ ID NO:4475), CGGGTGCGTTGTTTTTGGTTTTCGGGT (SEQ

FIGURE 5 CONTINUED

ID NO:4476), TCGGGTGCGTTGTTTTTGGTTTTCGGGT (SEQ ID NO:4477), TCGGGTGCGTTGTTTTTGGTTTTCGGG (SEQ ID NO:4478)

| Target470 | chr4:8863629-8863637 | TTCGGGATTAAGAGGAGGTCGTTGCGC (SEQ ID NO:4479), ATTCGGGATTAAGAGGAGGTCGTTGCGC (SEQ ID NO:4480), TCGGGATTAAGAGGAGGTCGTTGCGC (SEQ ID NO:4481), ATTCGGGATTAAGAGGAGGTCGTTGCG (SEQ ID NO:4482), TGGGTCGGGCGTTGTAGATTAAGTACGT (SEQ ID NO:4483), CGTTGTAGTGTTTGGGAGGTTGCGCGT (SEQ ID NO:4484), TCGTTGTAGTGTTTGGGAGGTTGCGCG (SEQ ID NO:4485), TTCGTTGTAGTGTTTGGGAGGTTGCGCG (SEQ ID NO:4486), AGGGAGGACGGATAAGGGTTGAAGGGT (SEQ ID NO:4487), TGTAGTGTTTGGGAGGTTGCGCGTAGT (SEQ ID NO:4488) |
| Target471 | chr4:13543525-13543536 | CGGGAGTTGGAGTTGGGTTTTATTTTTAGGTG (SEQ ID NO:4489), CGGGAGTTGGAGTTGGGTTTTATTTTTAGGTGT (SEQ ID NO:4490), CGGGAGTTGGAGTTGGGTTTTATTTTTAGGTGTT (SEQ ID NO:4491), CGGGAGTTGGAGTTGGGTTTTATTTTTAGGTGTTT (SEQ ID NO:4492), GGGAGTTGGAGTTGGGTTTTATTTTTAGGTGTTT (SEQ ID NO:4493), CGGTTTCGGATCGGCGTTGATAGTTGT (SEQ ID NO:4494), TCGTTTGGGTTGAGGTAGCGAGTGATT (SEQ ID NO:4495), TTCGTTTGGGTTGAGGTAGCGAGTGAT (SEQ ID NO:4496), ATTCGTTTGGGTTGAGGTAGCGAGTGA (SEQ ID NO:4497), CGGTTTCGGATCGGCGTTGATAGTTGTA (SEQ ID NO:4498) |
| Target472 | chr4:13543563-13543934 | TTTTTGGCGGGGCGTTTCGTGTAGGTT (SEQ ID NO:4499), TTTTTTGGCGGGGCGTTTCGTGTAGGT (SEQ ID NO:4500), GCGGTAGTTGCGTAGGTGGAGAGCGTT (SEQ ID NO:4501), CGGAGTCGGAGCGCGGGAATTATTCGT (SEQ ID NO:4502), TTTTGGCGGGGCGTTTCGTGTAGGTTA (SEQ ID NO:4503), AAGGTGGTCGTAAAGGTGTTGGTGCGC (SEQ ID NO:4504), GGAGGAGGAGGAGTCGGCGGCGTTTAAGTT (SEQ ID NO:4505), GAGGAGGAGGAGTCGGCGGCGTTTAAG (SEQ ID NO:4506), GAGGAGGAGGAGTCGGCGGCGTTTAA (SEQ ID NO:4507), GAAGGTGGTCGTAAAGGTGTTGGTGCGC (SEQ ID NO:4508) |
| Target473 | chr4:13543948-13544043 | CGTTTTTTGCGTGGTTTGGGCGTCGTC (SEQ ID NO:4509), CGGGTTCGGATAGGTAGCGTTGGTGGT (SEQ ID NO:4510), CGGGTTCGGATAGGTAGCGTTGGTGGTT (SEQ ID NO:4511), CGTTTTTTGCGTGGTTTGGGCGTCGT (SEQ ID NO:4512), GCGTTTTTTGCGTGGTTTGGGCGTCGT (SEQ ID NO:4513), GGAGGAGGAGGAGTCGGCGGCGTTTAAGTT (SEQ ID NO:4514), GAGGAGGAGGAGTCGGCGGCGTTTAAG (SEQ ID NO:4515), GAGGAGGAGGAGTCGGCGGCGTTTAA (SEQ ID NO:4516), AGGAGGAGGAGTCGGCGGCGTTTAAG (SEQ ID NO:4517), AGGAGGAGGAGTCGGCGGCGTTTAAGT (SEQ ID NO:4518) |
| Target474 | chr4:24801646-24801871 | ATCGCGTCGGTTTGGTCGTTTCGTTCG (SEQ ID NO:4519), GGTATCGCGTCGGTTTGGTCGTTTCGT (SEQ ID NO:4520), AGGTATCGCGTCGGTTTGGTCGTTTCG (SEQ ID NO:4521), CGGTTCGCGACGGTAGTTTTTGGAGGT (SEQ ID NO:4522), TCGCGTCGGTTTGGTCGTTTCGTTCG (SEQ ID NO:4523), ACGTTGGTTTGGTTGTCGTCGCGGTTT (SEQ ID NO:4524), GGGTTTCGGGGGTTTTTGGTCGTCGTC (SEQ ID NO:4525), AGAGGGGGGTTTCGGGGGTTTTTGGTC (SEQ ID NO:4526), TAGAGGGGGGTTTCGGGGGTTTTTGGT (SEQ ID NO:4527), TACGTTGGTTTGGTTGTCGTCGCGGTT (SEQ ID NO:4528) |
| Target475 | chr4:24801881-24801888 | CGGGTTCGGGTTTTGGGAGCGTTAGG (SEQ ID NO:4529), GTCGTTTGAGCGCGGTTTTTATTCGGC (SEQ ID NO:4530), TGGTTTGTTGCGTGGTGGGCGTGTG (SEQ ID NO:4531), TGGTTTGTTGCGTGGTGGGCGTGT (SEQ ID NO:4532), GGTTTGTTGCGTGGTGGGCGTGTG (SEQ ID NO:4533), ATTTTTGGGTGGAGAGGGTTGCGGGGA (SEQ ID NO:4534), GGGTTTCGGGGGTTTTTGGTCGTCGTT (SEQ ID NO:4535), AGAGGGGGGTTTCGGGGGTTTTTGGTC (SEQ ID NO:4536), TAGAGGGGGGTTTCGGGGGTTTTTGGT (SEQ ID NO:4537), TTTTTGGGTGGAGAGGGTTGCGGGGAG (SEQ ID NO:4538) |
| Target476 | chr4:24801971-24802055 | GCGGTTTTTATTCGGCGGCGGTTAGGG (SEQ ID NO:4539), GGCGGCGGTTAGGGGATTTTCGAGGTTT (SEQ ID NO:4540), CGGTTTTTATTCGGCGGCGGTTAGGGA (SEQ ID NO:4541), ATTCGGCGGCGGTTAGGGGATTTTCGAG (SEQ ID NO:4542), TTCGGCGGCGGTTAGGGGATTTTCGAGG (SEQ ID NO:4543), GGGGAAGGAGGGTTTGGGTGGAAAGGT (SEQ ID NO:4544), TGGGGAAGGAGGGTTTGGGTGGAAAGG (SEQ ID NO:4545), ATTTTTGGGTGGAGAGGGTTGCGGGGA (SEQ ID NO:4546), ATTGAGTGGGGGGTTTCGAGGGTTGGG (SEQ ID NO:4547), GGGTGGAGAGGGTTGCGGGGAGATTTT (SEQ ID NO:4548) |
| Target477 | chr4:38672865-38673330 | TGTTTGGGGAGGTGGAAGAGTGGTGTGT (SEQ ID NO:4549), GTTTGGGGAGGTGGAAGAGTGGTGTGT (SEQ ID NO:4550), TGTTTGGGGAGGTGGAAGAGTGGTGTG (SEQ ID NO:4551), TTTGGGGAGGTGGAAGAGTGGTGTGT (SEQ ID NO:4552), TTGTTTGGGGAGGTGGAAGAGTGGTGT (SEQ ID NO:4553), TCGGAGAAGATAGAACGTGGGGATAGTTTGT (SEQ ID NO:4554), CGGAGAAGATAGAACGTGGGGATAGTTTGTT (SEQ ID NO:4555), TCGGAGAAGATAGAACGTGGGGATAGTTTGTT (SEQ ID NO:4556), CGGAGAAGATAGAACGTGGGGATAGTTTGTTT (SEQ ID NO:4557), TCGGAGAAGATAGAACGTGGGGATAGTTTGTTT (SEQ ID NO:4558) |
| Target478 | chr4:40858832-40859392 | CGTTTATTGGTTGTTGGGGGAGGCGCGT (SEQ ID NO:4559), GTTGGGGAGGCGCGTGGTTTCGTTTTA (SEQ ID NO:4560), AAGTCGGGCGGGGATGTCGTTTTAGGT (SEQ ID NO:4561), TCGGGCGGGGATGTCGTTTTAGGTGTT (SEQ ID NO:4562), CGGTGTCGTCGTTAAGTAGTCGCGCG (SEQ ID NO:4563), GACGGTTGGAAGGGTTGAAGAGGGGGT (SEQ ID NO:4564), |

FIGURE 5 CONTINUED

|  |  | TGGACGGTTGGAAGGGTTGAAGAGGGG (SEQ ID NO:4565), AGGAAGGGAGTATGTTGGGGTGGGGGA (SEQ ID NO:4566), AGGTGAGGAAGTTGGCGAAGGAACGGT (SEQ ID NO:4567), ACGGTTGGAAGGGTTGAAGAGGGGGTT (SEQ ID NO:4568) |
| Target479 | chr4:44449387-44449403 | GAGCGGGTTGGGTCGAGAAGGTAAGAT (SEQ ID NO:4569), AGCGGGTTGGGTCGAGAAGGTAAGATT (SEQ ID NO:4570), TTTTGGTATTTGGGAGCGGGTTGGGTC (SEQ ID NO:4571), ATTTTGGTATTTGGGAGCGGGTTGGGT (SEQ ID NO:4572), GAGCGGGTTGGGTCGAGAAGGTAAGATT (SEQ ID NO:4573), GGGGTGTTCGGGGTAGGCGTTGGTTAA (SEQ ID NO:4574), TTGAGTTTCGTTGGAGGTTTCGCGGGG (SEQ ID NO:4575), TTTCGTTGGAGGTTTCGCGGGGGTGTT (SEQ ID NO:4576), TGAGTTTCGTTGGAGGTTTCGCGGGGG (SEQ ID NO:4577), GAGTTTCGTTGGAGGTTTCGCGGGGGT (SEQ ID NO:4578) |
| Target480 | chr4:44449486-44449529 | GCGTTTGTTTCGGATATTTTCGCGGGGT (SEQ ID NO:4579), GCGTTTGTTTCGGATATTTTCGCGGGG (SEQ ID NO:4580), GGTTTTTAGCGGGGTTTAAATTGGCGGCG (SEQ ID NO:4581), TTTTTAGCGGGGTTTAAATTGGCGGCG (SEQ ID NO:4582), GGGTTTTTAGCGGGGTTTAAATTGGCGGC (SEQ ID NO:4583), TTGAGTTTCGTTGGAGGTTTCGCGGGG (SEQ ID NO:4584), TTCGTTGGAGGTTTCGCGGGGGTGTTT (SEQ ID NO:4585), TTTCGTTGGAGGTTTCGCGGGGGTGTT (SEQ ID NO:4586), TGAGTTTCGTTGGAGGTTTCGCGGGGG (SEQ ID NO:4587), GAGTTTCGTTGGAGGTTTCGCGGGGGT (SEQ ID NO:4588) |
| Target481 | chr4:44449579-44450217 | GTGTTGGGAAACGTCGGGGTTGCGAAT (SEQ ID NO:4589), GTTTAGTAGGGGGCGAGGGGTGTTGGG (SEQ ID NO:4590), GGTTTAGTAGGGGGCGAGGGGTGTTGG (SEQ ID NO:4591), ACGTCGGAATTTGGCGTCGGTTTGGTT (SEQ ID NO:4592), AGCGGGGTTTAAATTGGCGGCGGTTTA (SEQ ID NO:4593), CGAGTTGTTTAGGGATAGTCGGGCGCG (SEQ ID NO:4594), CGCGTTGGTTAAGGAGGTTTTCGGGGA (SEQ ID NO:4595), TCGCGTTGGTTAAGGAGGTTTTCGGGG (SEQ ID NO:4596), TCGCGTTGGTTAAGGAGGTTTTCGGGGA (SEQ ID NO:4597), CGAGTTGTTTAGGGATAGTCGGGCGCGT (SEQ ID NO:4598) |
| Target482 | chr4:57521419-57521450 | TGTAGCGTGAGTTTTGTAGTTCGGGGG (SEQ ID NO:4599), TGTAGCGTGAGTTTTGTAGTTCGGGGGA (SEQ ID NO:4600), TAGCGTGAGTTTTGTAGTTCGGGGGAC (SEQ ID NO:4601), GTAGCGTGAGTTTTGTAGTTCGGGGGA (SEQ ID NO:4602), GTGTAGCGTGAGTTTTGTAGTTCGGGGG (SEQ ID NO:4603), GGGCGTTGTTAGGATGGTAGGAGCGGT (SEQ ID NO:4604), TTAGGAGGTTGAGGTCGGGAGGGAGGG (SEQ ID NO:4605), AGGGCGTTGTTAGGATGGTAGGAGCGG (SEQ ID NO:4606), GTCGGGAGGGAGGGCGTTGTTAGGATG (SEQ ID NO:4607), GGGAGGGAGGGCGTTGTTAGGATGGTA (SEQ ID NO:4608) |
| Target483 | chr4:57521506-57521734 | TCGGGAAGGCGAGATAGGGATAGGCGA (SEQ ID NO:4609), GTCGGGAAGGCGAGATAGGGATAGGCG (SEQ ID NO:4610), CGGGAAGGCGAGATAGGGATAGGCGAG (SEQ ID NO:4611), ATTAGAGGGGATCGAGTCGGGAAGGCG (SEQ ID NO:4612), GGGGGACGTTGTAGTGTGATGTGGTGG (SEQ ID NO:4613), TTAGGAGGTTGAGGTCGGGAGGGAGGG (SEQ ID NO:4614), TGGCGAATTAGGAGGTTGAGGTCGGGA (SEQ ID NO:4615), GGCGGGAATGTTAGAGTTGGAAGGCGT (SEQ ID NO:4616), TAGGAGGTTGAGGTCGGGAGGGAGGG (SEQ ID NO:4617), ATTAGGAGGTTGAGGTCGGGAGGGAGGG (SEQ ID NO:4618) |
| Target484 | chr4:57521777-57521797 | TCGGGAAGGCGAGATAGGGATAGGCGA (SEQ ID NO:4619), GTCGGGAAGGCGAGATAGGGATAGGCG (SEQ ID NO:4620), AGCGTGTATTTCGGGTTGTCGGGGAGA (SEQ ID NO:4621), CGGGAAGGCGAGATAGGGATAGGCGAG (SEQ ID NO:4622), GCGTGTATTTCGGGTTGTCGGGGAGAG (SEQ ID NO:4623), TCGTTTTTTATGGGCGTTCGGTTTTTTCGT (SEQ ID NO:4624), TCGTTTTTTCGTTTTTATGGGCGTTCGGT (SEQ ID NO:4625), CGTTTTTATGGGCGTTCGGTTTTTTCGTT (SEQ ID NO:4626), CGTTTTTTCGTTTTTATGGGCGTTCGGTT (SEQ ID NO:4627), TCGTTTTTATGGGCGTTCGGTTTTTTCGTT (SEQ ID NO:4628) |
| Target485 | chr4:57521838-57522347 | TTTAGTTTAGGTAGGGGTCGGGGCGCG (SEQ ID NO:4629), TCGGGGAATTACGGTTGGATGGGGGTG (SEQ ID NO:4630), AGCGTGGTGGAATTCGGGTGTTTGTCG (SEQ ID NO:4631), GCGTGGTGGAATTCGGGTGTTTGTCGA (SEQ ID NO:4632), AGCGTGTATTTCGGGTTGTCGGGGAGA (SEQ ID NO:4633), GCGTGTAGTTATCGGGGATTTGCGCGG (SEQ ID NO:4634), GAGGTTCGGGTGGGGGGTAGTCGTAAG (SEQ ID NO:4635), GTTTTTGTAAGGGGTTTCGGGGGGCGC (SEQ ID NO:4636), AGTTTTTGTAAGGGGTTTCGGGGGGCG (SEQ ID NO:4637), GGAGGTTCGGGTGGGGGGTAGTCGTAA (SEQ ID NO:4638) |
| Target486 | chr4:74864044-74864329 | GGGTCGCGCGGTTGGATAGGAGGTTTA (SEQ ID NO:4639), GGGTCGCGCGGTTGGATAGGAGGTTTAT (SEQ ID NO:4640), GGTCGCGCGGTTGGATAGGAGGTTTAT (SEQ ID NO:4641), GGGTCGCGCGGTTGGATAGGAGGTTT (SEQ ID NO:4642), TTGGCGATGGGTTTTGGTTGCGTTAGT (SEQ ID NO:4643), TGTGCGCGTTGTTGGTGTTGTTGTTGT (SEQ ID NO:4644), TGCGCGTTGTTGGTGTTGTTGTTGTTGT (SEQ ID NO:4645), TGTGCGCGTTGTTGGTGTTGTTGTTGTT (SEQ ID NO:4646), TTGTGCGCGTTGTTGGTGTTGTTGTTGT (SEQ ID NO:4647), GCGCGTTGTTGGTGTTGTTGTTGTTGT (SEQ ID NO:4648) |
| Target487 | chr4:74864368-74864404 | CGGTCGCGGGTTTTTGAATTGGGTGGA (SEQ ID NO:4649), GGAGGAGCGGAGATTGGAGGAGCGAAG (SEQ ID NO:4650), GGGTCGCGCGGTTGGATAGGAGGTTTA (SEQ ID NO:4651), GAGGAGCGGAGATTGGAGGAGCGAAGA (SEQ ID NO:4652), TGGAGGAGCGGAGATTGGAGGAGCGAA (SEQ ID NO:4653), TGGGGAGAGATGAGTGTAGATAAAAGGAGTGT (SEQ ID NO:4654), TGAGTTTTTTGTTAGTGGGGGAGAGATGAGTGT (SEQ ID NO:4655), AGTGGGGAGAGATGAGTGTAGATAAAAGGAGT (SEQ ID NO:4656), |

FIGURE 5 CONTINUED

GTGGGGAGAGATGAGTGTAGATAAAAGGAGTGT (SEQ ID NO:4657),
AGTGGGGAGAGATGAGTGTAGATAAAAGGAGTG (SEQ ID NO:4658)

| | | |
|---|---|---|
| Target488 | chr4:74864587-74864615 | GTGGAAAGAAGAGGTTGGGGGAGGGGG (SEQ ID NO:4659), GTGGGGAGGGTGGTTAGGAGGAGTTGC (SEQ ID NO:4660), TGGTGGGGAGGGTGGTTAGGAGGAGTT (SEQ ID NO:4661), TTGGTGGGGAGGGTGGTTAGGAGGAGT (SEQ ID NO:4662), GGGAGGGTGGTTAGGAGGAGTTGCGTG (SEQ ID NO:4663), GAGGGTTGCGTGTTTTAGAAAAGTCGGT (SEQ ID NO:4664), AGAGGGTTGCGTGTTTTAGAAAAGTCGGT (SEQ ID NO:4665), AGAGGGTTGCGTGTTTTAGAAAAGTCGGTA (SEQ ID NO:4666), TAGAGGGTTGCGTGTTTTAGAAAAGTCGGT (SEQ ID NO:4667), TTAGAGGGTTGCGTGTTTTAGAAAAGTCGGT (SEQ ID NO:4668) |
| Target489 | chr4:84035837-84035923 | TCGAGTAGGAAATGTTTTGTGGTTTGGGAGA (SEQ ID NO:4669), CGAGTAGGAAATGTTTTGTGGTTTGGGAGAG (SEQ ID NO:4670), CGAGTAGGAAATGTTTTGTGGTTTGGGAGAGA (SEQ ID NO:4671), TCGAGTAGGAAATGTTTTGTGGTTTGGGAGAG (SEQ ID NO:4672), TTCGAGTAGGAAATGTTTTGTGGTTTGGGAGA (SEQ ID NO:4673) |
| Target490 | chr4:94755670-94755872 | AGCGTGGGGGTGGTTTGTCGTAATGTG (SEQ ID NO:4674), GCGTGGGGGTGGTTTGTCGTAATGTGA (SEQ ID NO:4675), AAGCGTGGGGGTGGTTTGTCGTAATGT (SEQ ID NO:4676), AGCGTGGGGGTGGTTTGTCGTAATGTGA (SEQ ID NO:4677), GGGAGAGGTAGGGGAGGAGAGAAGTCGG (SEQ ID NO:4678), TTGAGGAGGTCGGGGAGGGGGTGATGAT (SEQ ID NO:4679), AGGAGGAGGTCGAGGTTGAGGAGGTCG (SEQ ID NO:4680), TGAGGAGGTCGGGGAGGGGTGATGATG (SEQ ID NO:4681), GGTCGGGGAGGGGTGATGATGGTGTTA (SEQ ID NO:4682), GTTGAGGAGGTCGGGGAGGGGTGATGA (SEQ ID NO:4683) |
| Target491 | chr4:94755903-94755934 | AGGTAGTTTTTCGGGGAGTTGTGCGGT (SEQ ID NO:4684), GGTAGTTTTTCGGGGAGTTGTGCGGTT (SEQ ID NO:4685), AGGTAGTTTTTCGGGGAGTTGTGCGGTT (SEQ ID NO:4686), TAGGTAGTTTTTCGGGGAGTTGTGCGGT (SEQ ID NO:4687), TAGGTAGTTTTTCGGGGAGTTGTGCGG (SEQ ID NO:4688), GCGTAGTTGGGGGAGGAGAGGGGTTTC (SEQ ID NO:4689), TAGTTGGGGGAGGAGAGGGGTTTCGGT (SEQ ID NO:4690), CGGTTTTTCGTTGCGTAGTTGGGGGAGG (SEQ ID NO:4691), CGTAGTTGGGGGAGGAGAGGGGTTTCG (SEQ ID NO:4692), TTCGTTGCGTAGTTGGGGGAGGAGAGG (SEQ ID NO:4693) |
| Target492 | chr4:94755975-94755997 | GCGTAGTTGGGGGAGGAGAGGGGTTTC (SEQ ID NO:4694), TAGTTGGGGGAGGAGAGGGGTTTCGGT (SEQ ID NO:4695), TTGCGTGTTGGGTTGGTTGTTGGGAGG (SEQ ID NO:4696), GTTGGGAGGTGTAGTGGGTAGTGGCGG (SEQ ID NO:4697), CGGTTTTTCGTTGCGTAGTTGGGGGAGG (SEQ ID NO:4698) |
| Target493 | chr4:94756002-94756032 | GCGTAGTTGGGGGAGGAGAGGGGTTTC (SEQ ID NO:4699), TAGTTGGGGGAGGAGAGGGGTTTCGGT (SEQ ID NO:4700), TTGCGTGTTGGGTTGGTTGTTGGGAGG (SEQ ID NO:4701), GTTGGGAGGTGTAGTGGGTAGTGGCGG (SEQ ID NO:4702), CGGTTTTTCGTTGCGTAGTTGGGGGAGG (SEQ ID NO:4703) |
| Target494 | chr4:94756141-94756154 | TAAGGGGAGGGGAAGTTGGAGGCGGTA (SEQ ID NO:4704), GTTAAGGGGAGGGGAAGTTGGAGGCGG (SEQ ID NO:4705), TGTTAAGGGGAGGGGAAGTTGGAGGCG (SEQ ID NO:4706), TTAAGGGGAGGGGAAGTTGGAGGCGGT (SEQ ID NO:4707), AAGGGGAGGGGAAGTTGGAGGCGGTAG (SEQ ID NO:4708) |
| Target495 | chr4:101111813-101111928 | TCGGGTTATTGGGATCGTAATTTCGGGT (SEQ ID NO:4709), CGGGTTATTGGGATCGTAATTTCGGGTGT (SEQ ID NO:4710), TCGGGTTATTGGGATCGTAATTTCGGGTGT (SEQ ID NO:4711), TCGGGTTATTGGGATCGTAATTTCGGGTG (SEQ ID NO:4712), TTCGGGTTATTGGGATCGTAATTTCGGGT (SEQ ID NO:4713), GGACGTTCGGGGAGGGGTCGTATTGAA (SEQ ID NO:4714), CGGACGTTCGGGGAGGGGTCGTATTGA (SEQ ID NO:4715), GGACGTTCGGGGAGGGGTCGTATTGAAT (SEQ ID NO:4716), CGGGAGTAGTTTGAGTGTGAAAGCGCGG (SEQ ID NO:4717), GGACGTTCGGGGAGGGGTCGTATTGA (SEQ ID NO:4718) |
| Target496 | chr4:101111950-101111971 | TGTTTTCGGTAGCGGGAAGTTTTAAGCG (SEQ ID NO:4719), TCGGGTTATTGGGATCGTAATTTCGGGT (SEQ ID NO:4720), CGGGTTATTGGGATCGTAATTTCGGGTGT (SEQ ID NO:4721), TCGGGTTATTGGGATCGTAATTTCGGGTGT (SEQ ID NO:4722), TCGGGTTATTGGGATCGTAATTTCGGGTG (SEQ ID NO:4723) |
| Target497 | chr4:102712099-102712325 | ATTTGGACGTTACGAGGAGGGAGCGCG (SEQ ID NO:4724), TATTTGGACGTTACGAGGAGGGAGCGCG (SEQ ID NO:4725), CGTATTCGGAGGGGTTTGACGTCGAGGT (SEQ ID NO:4726), CGTATTCGGAGGGGTTTGACGTCGAGG (SEQ ID NO:4727), GTTCGGCGGGTAGTAGTGCGTAGGTTT (SEQ ID NO:4728), GGATTTTGATTCGGGTGTTGGGGAAAGT (SEQ ID NO:4729), AGGATTTTGATTCGGGTGTTGGGGAAAGT (SEQ ID NO:4730), TGGGTTGTTGGCGGTAGGATAAAAAGGA (SEQ ID NO:4731), GGATTTTGATTCGGGTGTTGGGGAAAGTT (SEQ ID NO:4732), TGGGTTGTTTGGCGGTAGGATAAAAAGGAG (SEQ ID NO:4733) |
| Target498 | chr4:102712452-102712469 | GGGAGTTTTGGTTAGCGGGTTATTTTTAGTGTT (SEQ ID NO:4734), GGGAGTTTTGGTTAGCGGGTTATTTTTAGTGTT (SEQ ID NO:4735), GGGAGTTTTGGTTAGCGGGTTATTTTTAGTGTTG (SEQ ID NO:4736), GGGAGTTTTGGTTAGCGGGTTATTTTTAGTGTTGT (SEQ ID NO:4737), GGAGTTTTGGTTAGCGGGTTATTTTTAGTGTTGT (SEQ ID NO:4738), |

FIGURE 5 CONTINUED

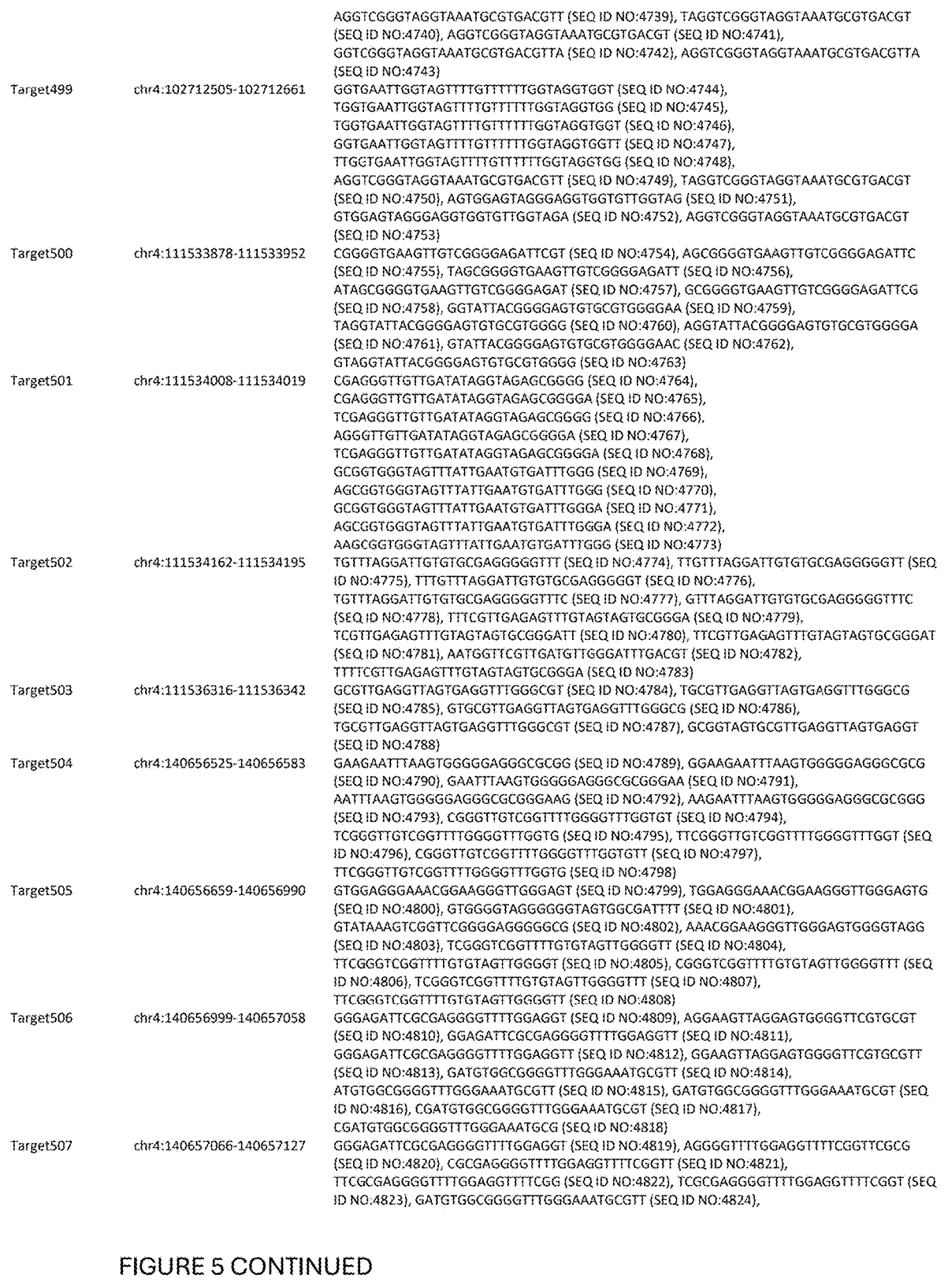

|  |  | AGGTCGGGTAGGTAAATGCGTGACGTT (SEQ ID NO:4739), TAGGTCGGGTAGGTAAATGCGTGACGT (SEQ ID NO:4740), AGGTCGGGTAGGTAAATGCGTGACGT (SEQ ID NO:4741), GGTCGGGTAGGTAAATGCGTGACGTTA (SEQ ID NO:4742), AGGTCGGGTAGGTAAATGCGTGACGTTA (SEQ ID NO:4743) |
|---|---|---|
| Target499 | chr4:102712505-102712661 | GGTGAATTGGTAGTTTTGTTTTTTGGTAGGTGGT (SEQ ID NO:4744), TGGTGAATTGGTAGTTTTGTTTTTTGGTAGGTGG (SEQ ID NO:4745), TGGTGAATTGGTAGTTTTGTTTTTTGGTAGGTGGT (SEQ ID NO:4746), GGTGAATTGGTAGTTTTGTTTTTTGGTAGGTGGTT (SEQ ID NO:4747), TTGGTGAATTGGTAGTTTTGTTTTTTGGTAGGTGG (SEQ ID NO:4748), AGGTCGGGTAGGTAAATGCGTGACGTT (SEQ ID NO:4749), TAGGTCGGGTAGGTAAATGCGTGACGT (SEQ ID NO:4750), AGTGGAGTAGGGAGGTGGTGTTGGTAG (SEQ ID NO:4751), GTGGAGTAGGGAGGTGGTGTTGGTAGA (SEQ ID NO:4752), AGGTCGGGTAGGTAAATGCGTGACGT (SEQ ID NO:4753) |
| Target500 | chr4:111533878-111533952 | CGGGGGTGAAGTTGTCGGGGAGATTCGT (SEQ ID NO:4754), AGCGGGGTGAAGTTGTCGGGGAGATTC (SEQ ID NO:4755), TAGCGGGGTGAAGTTGTCGGGGAGATT (SEQ ID NO:4756), ATAGCGGGGTGAAGTTGTCGGGGAGAT (SEQ ID NO:4757), GCGGGGTGAAGTTGTCGGGGAGATTCG (SEQ ID NO:4758), GGTATTACGGGGAGTGTGCGTGGGGAA (SEQ ID NO:4759), TAGGTATTACGGGGAGTGTGCGTGGGG (SEQ ID NO:4760), AGGTATTACGGGGAGTGTGCGTGGGGA (SEQ ID NO:4761), GTATTACGGGGAGTGTGCGTGGGGAAC (SEQ ID NO:4762), GTAGGTATTACGGGGAGTGTGCGTGGGG (SEQ ID NO:4763) |
| Target501 | chr4:111534008-111534019 | CGAGGGTTGTTGATATAGGTAGAGCGGGG (SEQ ID NO:4764), CGAGGGTTGTTGATATAGGTAGAGCGGGGA (SEQ ID NO:4765), TCGAGGGTTGTTGATATAGGTAGAGCGGGG (SEQ ID NO:4766), AGGGTTGTTGATATAGGTAGAGCGGGGA (SEQ ID NO:4767), TCGAGGGTTGTTGATATAGGTAGAGCGGGGA (SEQ ID NO:4768), GCGGTGGGTAGTTTATTGAATGTGATTTGGG (SEQ ID NO:4769), AGCGGTGGGTAGTTTATTGAATGTGATTTGGG (SEQ ID NO:4770), GCGGTGGGTAGTTTATTGAATGTGATTTGGGA (SEQ ID NO:4771), AGCGGTGGGTAGTTTATTGAATGTGATTTGGGA (SEQ ID NO:4772), AAGCGGTGGGTAGTTTATTGAATGTGATTTGGG (SEQ ID NO:4773) |
| Target502 | chr4:111534162-111534195 | TGTTTAGGATTGTGTGCGAGGGGGTTT (SEQ ID NO:4774), TTGTTTAGGATTGTGTGCGAGGGGGTT (SEQ ID NO:4775), TTTGTTTAGGATTGTGTGCGAGGGGGT (SEQ ID NO:4776), TGTTTAGGATTGTGTGCGAGGGGGTTTC (SEQ ID NO:4777), GTTTAGGATTGTGTGCGAGGGGGTTTC (SEQ ID NO:4778), TTTCGTTGAGAGTTTGTAGTAGTGCGGGA (SEQ ID NO:4779), TCGTTGAGAGTTTGTAGTAGTGCGGGATT (SEQ ID NO:4780), TTCGTTGAGAGTTTGTAGTAGTGCGGGAT (SEQ ID NO:4781), AATGGTTCGTTGATGTTGGGATTTGACGT (SEQ ID NO:4782), TTTTCGTTGAGAGTTTGTAGTAGTGCGGGA (SEQ ID NO:4783) |
| Target503 | chr4:111536316-111536342 | GCGTTGAGGTTAGTGAGGTTTGGGCGT (SEQ ID NO:4784), TGCGTTGAGGTTAGTGAGGTTTGGGCG (SEQ ID NO:4785), GTGCGTTGAGGTTAGTGAGGTTTGGGCG (SEQ ID NO:4786), TGCGTTGAGGTTAGTGAGGTTTGGGCGT (SEQ ID NO:4787), GCGGTAGTGCGTTGAGGTTAGTGAGGT (SEQ ID NO:4788) |
| Target504 | chr4:140656525-140656583 | GAAGAATTTAAGTGGGGGAGGGCGCGG (SEQ ID NO:4789), GGAAGAATTTAAGTGGGGGAGGGCGCG (SEQ ID NO:4790), GAATTTAAGTGGGGGAGGGCGCGGGAA (SEQ ID NO:4791), AATTTAAGTGGGGGAGGGCGCGGGAAG (SEQ ID NO:4792), AAGAATTTAAGTGGGGGAGGGCGCGGG (SEQ ID NO:4793), CGGGTTGTCGGTTTTGGGGTTTGGTGT (SEQ ID NO:4794), TCGGGTTGTCGGTTTTGGGGTTTGGTG (SEQ ID NO:4795), TTCGGGTTGTCGGTTTTGGGGTTTGGT (SEQ ID NO:4796), CGGGTTGTCGGTTTTGGGGTTTGGTGTT (SEQ ID NO:4797), TTCGGGTTGTCGGTTTTGGGGTTTGGTG (SEQ ID NO:4798) |
| Target505 | chr4:140656659-140656990 | GTGGAGGGAAACGGAAGGGTTGGGAGT (SEQ ID NO:4799), TGGAGGGAAACGGAAGGGTTGGGAGTG (SEQ ID NO:4800), GTGGGGTAGGGGGGGTAGTGGCGATTTT (SEQ ID NO:4801), GTATAAAGTCGGTTCGGGGAGGGGGGCG (SEQ ID NO:4802), AAACGGAAGGGTTGGGAGTGGGGTAGG (SEQ ID NO:4803), TCGGGTCGGTTTTGTGTAGTTGGGGT (SEQ ID NO:4804), TTCGGGTCGGTTTTGTGTAGTTGGGGT (SEQ ID NO:4805), CGGGTCGGTTTTGTGTAGTTGGGGTTT (SEQ ID NO:4806), TCGGGTCGGTTTTGTGTAGTTGGGGTTT (SEQ ID NO:4807), TTCGGGTCGGTTTTGTGTAGTTGGGGTT (SEQ ID NO:4808) |
| Target506 | chr4:140656999-140657058 | GGGAGATTCGCGAGGGGTTTTGGAGGT (SEQ ID NO:4809), AGGAAGTTAGGAGTGGGGTTCGTGCGT (SEQ ID NO:4810), GGAGATTCGCGAGGGGTTTTGGAGGTT (SEQ ID NO:4811), GGGAGATTCGCGAGGGGTTTTGGAGGT (SEQ ID NO:4812), GGAAGTTAGGAGTGGGGTTCGTGCGTT (SEQ ID NO:4813), GATGTGGCGGGGTTTGGGAAATGCGTT (SEQ ID NO:4814), ATGTGGCGGGGTTTGGGAAATGCGTT (SEQ ID NO:4815), GATGTGGCGGGGTTTGGGAAATGCGT (SEQ ID NO:4816), CGATGTGGCGGGGTTTGGGAAATGCGT (SEQ ID NO:4817), CGATGTGGCGGGGTTTGGGAAATGCG (SEQ ID NO:4818) |
| Target507 | chr4:140657066-140657127 | GGGAGATTCGCGAGGGGTTTTGGAGGT (SEQ ID NO:4819), AGGGGTTTTGGAGGTTTTCGGTTCGCG (SEQ ID NO:4820), CGCGAGGGGTTTTGGAGGTTTTCGGTT (SEQ ID NO:4821), TTCGCGAGGGGTTTTGGAGGTTTTCGG (SEQ ID NO:4822), TCGCGAGGGGTTTTGGAGGTTTTCGGT (SEQ ID NO:4823), GATGTGGCGGGGTTTGGGAAATGCGTT (SEQ ID NO:4824), |

FIGURE 5 CONTINUED

|  |  | ATGTGGCGGGGTTTGGGAAATGCGTT (SEQ ID NO:4825), GATGTGGCGGGGTTTGGGAAATGCGT (SEQ ID NO:4826), CGATGTGGCGGGGTTTGGGAAATGCGT (SEQ ID NO:4827), CGATGTGGCGGGGTTTGGGAAATGCG (SEQ ID NO:4828) |
|---|---|---|
| Target508 | chr4:147560029-147560039 | GGCGCGGGGAGAGGGGAGTATAATTCG (SEQ ID NO:4829), GCGTTTTTTGGTAAGGGAGGGCGGAGG (SEQ ID NO:4830), GGCGTTTTTTGGTAAGGGAGGGCGGAG (SEQ ID NO:4831), GCGCGGGGAGAGGGGAGTATAATTCGT (SEQ ID NO:4832), AGTCGGCGTTTTTTGGTAAGGGAGGGC (SEQ ID NO:4833), CGCGTTTTTTCGTCGTTTTTGTTGTTAGTTTGA (SEQ ID NO:4834), CGCGTTTTTTCGTCGTTTTTGTTGTTAGTTTGAA (SEQ ID NO:4835), CGCGTTTTTTCGTCGTTTTTGTTGTTAGTTTGAAC (SEQ ID NO:4836) |
| Target509 | chr4:147560073-147560116 | GGCGCGGGGAGAGGGGAGTATAATTCG (SEQ ID NO:4837), GCGCGGGGAGAGGGGAGTATAATTCGT (SEQ ID NO:4838), AGGCGCGGGGAGAGGGGAGTATAATTC (SEQ ID NO:4839), GCGCGGGGAGAGGGGAGTATAATTCGTC (SEQ ID NO:4840), GTAGGCGCGGGGAGAGGGGAGTATAAT (SEQ ID NO:4841), CGGGTTAGTCGGGGTTGGAGTTGGGAA (SEQ ID NO:4842), AGTCGGGGTTGGAGTTGGGAAGGGTTG (SEQ ID NO:4843), TGTCGGGTTAGTCGGGGTTGGAGTTGG (SEQ ID NO:4844), TCGGGGTTGGAGTTGGGAAGGGTTGTG (SEQ ID NO:4845), GTCGGGGTTGGAGTTGGGAAGGGTTGT (SEQ ID NO:4846) |
| Target510 | chr4:147560126-147560184 | GAGGAGCGGGGGTAGTTTCGGGTGTC (SEQ ID NO:4847), AGGAGCGGGGGTAGTTTCGGGTGTC (SEQ ID NO:4848), GAGGAGCGGGGGTAGTTTCGGGTGT (SEQ ID NO:4849), GCGGCGGCGGGTGAGTTTAATTTCG (SEQ ID NO:4850), GATTGATAGTAGAGGCGGCGAAGGAGC (SEQ ID NO:4851), CGGGTTAGTCGGGGTTGGAGTTGGGAA (SEQ ID NO:4852), AGTCGGGGTTGGAGTTGGGAAGGGTTG (SEQ ID NO:4853), TGTCGGGTTAGTCGGGGTTGGAGTTGG (SEQ ID NO:4854), TCGGGGTTGGAGTTGGGAAGGGTTGTG (SEQ ID NO:4855), GTCGGGGTTGGAGTTGGGAAGGGTTGT (SEQ ID NO:4856) |
| Target511 | chr4:147560209-147560239 | GCGGCGGCGGGTGAGTTTAATTTCGTA (SEQ ID NO:4857), GCGGCGGCGGGTGAGTTTAATTTCGTAT (SEQ ID NO:4858), GCGGCGGCGGGTGAGTTTAATTTCGT (SEQ ID NO:4859), CGGCGGCGGGTGAGTTTAATTTCGTAT (SEQ ID NO:4860), CGGTTGGTTCGGTATTTTTCGGAGGGT (SEQ ID NO:4861), GTTCGTCGGGGCGTTGGTTCGTAGA (SEQ ID NO:4862), TTCGTCGGGGCGTTGGTTCGTAGA (SEQ ID NO:4863), GTTCGTCGGGGCGTTGGTTCGTAG (SEQ ID NO:4864), TCGTCGGGGCGTTGGTTCGTAGA (SEQ ID NO:4865), GTTCGTCGGGGCGTTGGTTCGTA (SEQ ID NO:4866) |
| Target512 | chr4:147560266-147560287 | GCGGCGGCGGGTGAGTTTAATTTCGTA (SEQ ID NO:4867), GCGGCGGCGGGTGAGTTTAATTTCGTAT (SEQ ID NO:4868), GCGGCGGCGGGTGAGTTTAATTTCGT (SEQ ID NO:4869), CGGCGGCGGGTGAGTTTAATTTCGTAT (SEQ ID NO:4870), CGGTTGGTTCGGTATTTTTCGGAGGGT (SEQ ID NO:4871), TCGGCGAGGTGTTGTGTAGTGTCGAGT (SEQ ID NO:4872), AGTTCGGCGAGGTGTTGTGTAGTGTCG (SEQ ID NO:4873), GTTCGGCGAGGTGTTGTGTAGTGTCGA (SEQ ID NO:4874), GGAGTTCGGCGAGGTGTTGTGTAGTGT (SEQ ID NO:4875), TTCGGCGAGGTGTTGTGTAGTGTCGAGT (SEQ ID NO:4876) |
| Target513 | chr4:147560324-147560344 | GTTTCGGCGGGCGGGAAGATGATGATG (SEQ ID NO:4877), TTCGGCGGGCGGGAAGATGATGATGAT (SEQ ID NO:4878), TTTCGGCGGGCGGGAAGATGATGATGA (SEQ ID NO:4879), TCGGCGGGCGGGAAGATGATGATGATG (SEQ ID NO:4880), CGGCGGGCGGGAAGATGATGATGATGT (SEQ ID NO:4881), TCGAGTTGTTGGGGGAGTTGGTCGAGG (SEQ ID NO:4882), TCGGCGAGGTGTTGTGTAGTGTCGAGT (SEQ ID NO:4883), CGAGTTGTTGGGGGAGTTGGTCGAGGG (SEQ ID NO:4884), GAGTTGTTGGGGGAGTTGGTCGAGGGC (SEQ ID NO:4885), TGTTCGAGTTGTTGGGGGAGTTGGTCG (SEQ ID NO:4886) |
| Target514 | chr4:147560372-147560403 | GTTTCGGCGGGCGGGAAGATGATGATG (SEQ ID NO:4887), TTCGGCGGGCGGGAAGATGATGATGAT (SEQ ID NO:4888), TTTCGGCGGGCGGGAAGATGATGATGA (SEQ ID NO:4889), TCGGCGGGCGGGAAGATGATGATGATG (SEQ ID NO:4890), CGGCGGGCGGGAAGATGATGATGATGT (SEQ ID NO:4891), TCGAGTTGTTGGGGGAGTTGGTCGAGG (SEQ ID NO:4892), CGAGTTGTTGGGGGAGTTGGTCGAGGG (SEQ ID NO:4893), GAGTTGTTGGGGGAGTTGGTCGAGGGC (SEQ ID NO:4894), TGTTCGAGTTGTTGGGGGAGTTGGTCG (SEQ ID NO:4895), TGTTCGAGTTGTTGGGGGAGTTGGTCGA (SEQ ID NO:4896) |
| Target515 | chr4:147560414-147560442 | CGTCGGGTTTTTCGGTTTTTATCGCGT (SEQ ID NO:4897), TCGTCGGGTTTTTCGGTTTTTATCGCGT (SEQ ID NO:4898), TCGTCGGGTTTTTCGGTTTTTATCGCG (SEQ ID NO:4899), ACGGCGGTAGTTTGTACGTGGAGTTTA (SEQ ID NO:4900), CGTCGGGTTTTTCGGTTTTTATCGCGTT (SEQ ID NO:4901), GAGTTGTTGGGGGAGTTGGTCGAGGGT (SEQ ID NO:4902), TCGAGTTGTTGGGGGAGTTGGTCGAGG (SEQ ID NO:4903), CGAGTTGTTGGGGGAGTTGGTCGAGGG (SEQ ID NO:4904), TGTTCGAGTTGTTGGGGGAGTTGGTCG (SEQ ID NO:4905), TGTTCGAGTTGTTGGGGGAGTTGGTCGA (SEQ ID NO:4906) |
| Target516 | chr4:147560460-147560533 | CGTCGGGTTTTTCGGTTTTTATCGCGT (SEQ ID NO:4907), TCGTCGGGTTTTTCGGTTTTTATCGCGT (SEQ ID NO:4908), TCGTCGGGTTTTTCGGTTTTTATCGCG (SEQ ID NO:4909), GAGTAACGTTGGTGGTGGCGGCGG (SEQ ID NO:4910), ACGGCGGTAGTTTGTACGTGGAGTTTA (SEQ ID NO:4911), CGTATCGGTGGGGTTGGAAGATAGGT (SEQ ID NO:4912), CGGTGGGGTTGGAAGATAGGTTTTTCGT (SEQ ID NO:4913), CGGTGGGGTTGGAAGATAGGTTTTTCG (SEQ ID NO:4914), TCGGTGGGGTTGGAAGATAGGTTTTTCGT (SEQ ID NO:4915), TCGGTGGGGTTGGAAGATAGGTTTTTCG (SEQ ID NO:4916) |

FIGURE 5 CONTINUED

| | | |
|---|---|---|
| Target517 | chr4:154709576-154709641 | CGGTGGTTGGTAGGAGGTGGTCGTTGT (SEQ ID NO:4917), TCGGTGGTTGGTAGGAGGTGGTCGTTG (SEQ ID NO:4918), TTCGGTGGTTGGTAGGAGGTGGTCGTT (SEQ ID NO:4919), TTTCGGTGGTTGGTAGGAGGTGGTCGT (SEQ ID NO:4920), TTCGGTGGTTGGTAGGAGGTGGTCGTTG (SEQ ID NO:4921), TGCGTGTAGGTGAAGGATCGTTGCGTT (SEQ ID NO:4922), TTGCGTGTAGGTGAAGGATCGTTGCGT (SEQ ID NO:4923), TGCGTGTAGGTGAAGGATCGTTGCGTTT (SEQ ID NO:4924), TTGCGTGTAGGTGAAGGATCGTTGCGTT (SEQ ID NO:4925), TTTGCGTGTAGGTGAAGGATCGTTGCGT (SEQ ID NO:4926) |
| Target518 | chr4:154709675-154709698 | AGGTTATCGAGGTAGACGGGGGCGAAG (SEQ ID NO:4927), GGTTATCGAGGTAGACGGGGGCGAAGA (SEQ ID NO:4928), AGGTTATCGAGGTAGACGGGGGCGAAGA (SEQ ID NO:4929), GGTTATCGAGGTAGACGGGGGCGAAGAG (SEQ ID NO:4930), TAGGTTATCGAGGTAGACGGGGGCGAA (SEQ ID NO:4931), GAAGGAGGTGTTGGAGTAGGTCGGCGT (SEQ ID NO:4932), TGAAGGAGGTGTTGGAGTAGGTCGGCG (SEQ ID NO:4933), AGGTGTTGGAGTAGGTCGGCGTTTGGA (SEQ ID NO:4934), AGGAGGTGTTGGAGTAGGTCGGCGTTT (SEQ ID NO:4935), AAGGAGGTGTTGGAGTAGGTCGGCGTT (SEQ ID NO:4936) |
| Target519 | chr4:154709745-154709760 | AGGTTATCGAGGTAGACGGGGGCGAAG (SEQ ID NO:4937), GGTTATCGAGGTAGACGGGGGCGAAGA (SEQ ID NO:4938), AGGTTATCGAGGTAGACGGGGGCGAAGA (SEQ ID NO:4939), GGTTATCGAGGTAGACGGGGGCGAAGAG (SEQ ID NO:4940), TAGGTTATCGAGGTAGACGGGGGCGAA (SEQ ID NO:4942), GAAGGAGGTGTTGGAGTAGGTCGGCGT (SEQ ID NO:4942), TGAAGGAGGTGTTGGAGTAGGTCGGCG (SEQ ID NO:4943), AGGTGTTGGAGTAGGTCGGCGTTTGGA (SEQ ID NO:4944), AGGAGGTGTTGGAGTAGGTCGGCGTTT (SEQ ID NO:4945), AAGGAGGTGTTGGAGTAGGTCGGCGTT (SEQ ID NO:4946) |
| Target520 | chr4:154709812-154709968 | AGGTAGTAGTGCGAGGCGAGGAAGAGT (SEQ ID NO:4947), TGCGTTTGTAGGAGAAGTCGGGTTGGT (SEQ ID NO:4948), TGCGAGGCGAGGAAGAGTAGTAGTAGC (SEQ ID NO:4949), GCGAGGCGAGGAAGAGTAGTAGTAGCG (SEQ ID NO:4950), GGGTTGGTTAAAGAGGAAGAGTTCGCGCG (SEQ ID NO:4951), TCGTATTGTTGTTTGGGTTCGGCGCGC (SEQ ID NO:4952), TTCGTATTGTTGTTTGGGTTCGGCGCG (SEQ ID NO:4953), GTATTGTTGTTTGGGTTCGGCGCGCG (SEQ ID NO:4954), CGTATTGTTGTTTGGGTTCGGCGCGC (SEQ ID NO:4955), GTATTGTTGTTTGGGTTCGGCGCGCGG (SEQ ID NO:4956) |
| Target521 | chr4:155663750-155663883 | CGGTGGGGATATCGCGTGTTAAGTTTGGC (SEQ ID NO:4957), GGTGGGGATATCGCGTGTTAAGTTTGGC (SEQ ID NO:4958), CGGTGGGGATATCGCGTGTTAAGTTTGG (SEQ ID NO:4959), TCGGTGGGGATATCGCGTGTTAAGTTTGG (SEQ ID NO:4960), AGCGTCGATTGGGTAGTTTTGTGGAGT (SEQ ID NO:4961), TAGGGAGTTGTCGGGTGAGGGAGTCGT (SEQ ID NO:4962), GGGAGTTGTCGGGTGAGGGAGTCGTTG (SEQ ID NO:4963), GGAGTTGTCGGGTGAGGGAGTCGTTGA (SEQ ID NO:4964), TCGGGTGAGGGAGTCGTTGAAGCGTTG (SEQ ID NO:4965), TTGTCGGGTGAGGGAGTCGTTGAAGCG (SEQ ID NO:4966) |
| Target522 | chr4:155663971-155663991 | GGAGGTATTGGAGTCGGGTTGTAGGCGT (SEQ ID NO:4967), GGAGGTATTGGAGTCGGGTTGTAGGCG (SEQ ID NO:4968), AGGAGGTATTGGAGTCGGGTTGTAGGCG (SEQ ID NO:4969), GAGGTATTGGAGTCGGGTTGTAGGCGT (SEQ ID NO:4970), AGGAGGTATTGGAGTCGGGTTGTAGGCGT (SEQ ID NO:4971) |
| Target523 | chr4:155664153-155664191 | AGGGAGGCGGATAAAGTTTCGGTGGGT (SEQ ID NO:4972), TTTTTGGCGGGCGTTGGGATTTCGTCG (SEQ ID NO:4973), GGCGGGCGTTGGGATTTCGTCGTTTTT (SEQ ID NO:4974), GGGAGGCGGATAAAGTTTCGGTGGGTG (SEQ ID NO:4975), GCGGGCGTTGGGATTTCGTCGTTTTTT (SEQ ID NO:4976), TTTGCGCGTCGGTGATTTGAATTCGAG (SEQ ID NO:4977), CGAGTTTAGTTTTTGCGCGTCGGTGAT (SEQ ID NO:4978), TTTTGCGCGTCGGTGATTTGAATTCGA (SEQ ID NO:4979), TTTTGCGCGTCGGTGATTTGAATTCGAG (SEQ ID NO:4980), GAGGGTGTGTGTAGGGCGGGGG (SEQ ID NO:4981) |
| Target524 | chr4:155664237-155664243 | TTTTTGGCGGGCGTTGGGATTTCGTCG (SEQ ID NO:4982), GGCGGGCGTTGGGATTTCGTCGTTTTT (SEQ ID NO:4983), GCGGGCGTTGGGATTTCGTCGTTTTTT (SEQ ID NO:4984), TTTTTTGGCGGGCGTTGGGATTTCGTC (SEQ ID NO:4985), TGGCGGGCGTTGGGATTTCGTCGTTTT (SEQ ID NO:4986), GAGGGTGTGTGTAGGGCGGGGG (SEQ ID NO:4987), TCGGCGCGAGGGTGTGTGTGTAGG (SEQ ID NO:4988), CGAGGGTGTGTGTGTAGGGCGGGG (SEQ ID NO:4989), CGCGAGGGTGTGTGTGTAGGGCG (SEQ ID NO:4990), CGGCGCGAGGGTGTGTGTGTAGG (SEQ ID NO:4991) |
| Target525 | chr4:155664309-155664315 | AGGTTTCGGGTTTAAATTATCGGCGCG (SEQ ID NO:4992), GGTGTTTAGGAGCGTAGAGAGGTTTCGGG (SEQ ID NO:4993), GGTGTTTAGGAGCGTAGAGAGGTTTCGGGT (SEQ ID NO:4994), TGTTTAGGAGCGTAGAGAGGTTTCGGGT (SEQ ID NO:4995), GTTTAGGAGCGTAGAGAGGTTTCGGGT (SEQ ID NO:4996) |
| Target526 | chr4:158141377-158141450 | TTCGGTTGGGTTAGGTGAGGAGGATGA (SEQ ID NO:4997), TGTTTTCGGTTGGGTTAGGTGAGGAGG (SEQ ID NO:4998), AGTAGGGTTTGGTGAGAGGACGTTTCG (SEQ ID NO:4999), TTTCGGTTGGGTTAGGTGAGGAGGATGA (SEQ ID NO:5000), CGGTTGGGTTAGGTGAGGAGGATGATAGGG (SEQ ID NO:5001), TCGTGCGGTTGTTGTAGTTGTTGCGGA (SEQ ID NO:5002), CGTGCGGTTGTTGTAGTTGTTGCGGAG (SEQ ID NO:5003), CGTGCGGTTGTTGTAGTTGTTGCGGAGA (SEQ ID NO:5004), TCGTGCGGTTGTTGTAGTTGTTGCGGAG (SEQ ID NO:5005), TTCGTGCGGTTGTTGTAGTTGTTGCGG (SEQ ID NO:5006) |

FIGURE 5 CONTINUED

| | | |
|---|---|---|
| Target527 | chr4:158141492-158141575 | AGTAGGGTTTGGTGAGAGGACGTTTCG (SEQ ID NO:5007), TTCGGTGTTGAAAGGTCGAGGCGC (SEQ ID NO:5008), TAGTAGGGTTTGGTGAGAGGACGTTTCG (SEQ ID NO:5009), ATAGTAGGGTTTGGTGAGAGGACGTTTCG (SEQ ID NO:5010), TCGGTGTTGAAAGGTCGAGGCGC (SEQ ID NO:5011), GCGCGGCCGTTGAGAAAGTATAGTTCGGG (SEQ ID NO:5012), GAGATTTCGGGTTTTCGGGGTTGTCGC (SEQ ID NO:5013), CGCGGCGTTGAGAAAGTATAGTTCGGGG (SEQ ID NO:5014), GCGCGGCCGTTGAGAAAGTATAGTTCGG (SEQ ID NO:5015), TGCGCGGCCGTTGAGAAAGTATAGTTCGG (SEQ ID NO:5016) |
| Target528 | chr4:158141581-158141718 | GTTTACGGTGGTGCGGGGTGTCGG (SEQ ID NO:5017), GTTTACGGTGGTGCGGGGTGTCGGG (SEQ ID NO:5018), TTTACGGTGGTGCGGGGTGTCGGG (SEQ ID NO:5019), TTTACGGTGGTGCGGGGTGTCGG (SEQ ID NO:5020), GTTTACGGTGGTGCGGGGTGTCGGGC (SEQ ID NO:5021), TAGAGAGGGGTAGGTAGTTTCGGGCGC (SEQ ID NO:5022), AGAGAGGGGTAGGTAGTTTCGGGCGCG (SEQ ID NO:5023), GCGCGGCCGTTGAGAAAGTATAGTTCGGG (SEQ ID NO:5024), GAGAGGGGTAGGTAGTTTCGGGCGCG (SEQ ID NO:5025), TAGAGAGGGGTAGGTAGTTTCGGGCGCG (SEQ ID NO:5026) |
| Target529 | chr4:170101207-170101387 | TGTTGTTACGTAGATGGTTTGGTTTTGGTTGTT (SEQ ID NO:5027), TTGTTGTTACGTAGATGGTTTGGTTTTGGTTGT (SEQ ID NO:5028), TGTTGTTACGTAGATGGTTTGGTTTTGGTTGTTT (SEQ ID NO:5029), TTGTTGTTACGTAGATGGTTTGGTTTTGGTTGTT (SEQ ID NO:5030), TTTGTTGTTACGTAGATGGTTTGGTTTTGGTTGT (SEQ ID NO:5031) |
| Target530 | chr4:170101458-170101589 | CGGAGAGTTTGAGGATTCGTGTTTTAAGTTTCG (SEQ ID NO:5032), CGGAGAGTTTGAGGATTCGTGTTTTAAGTTTCGT (SEQ ID NO:5033), TCGGAGAGTTTGAGGATTCGTGTTTTAAGTTTCG (SEQ ID NO:5034), TCGGAGAGTTTGAGGATTCGTGTTTTAAGTTTCGT (SEQ ID NO:5035), CGGAGAGTTTGAGGATTCGTGTTTTAAGTTTCGTT (SEQ ID NO:5036) |
| Target531 | chr4:174429587-174429721 | GGTGGAGGTGGAGGTGAAATGTCGAGGT (SEQ ID NO:5037), GGTGGAGGTGGAGGTGAAATGTCGAGG (SEQ ID NO:5038), GGAGGTGGAGGTGGAGGTGAAATGTCG (SEQ ID NO:5039), AGGTGGAGGTGGAGGTGAAATGTCGAGG (SEQ ID NO:5040), AGGAGGTGGAGGTGGAGGTGAAATGTCG (SEQ ID NO:5041), GGGGCGGGGGGTTGTGGTTTGGTTTTAT (SEQ ID NO:5042), TGGGGCGGGGGTTGTGGTTTGGTTTTA (SEQ ID NO:5043), TTTATGTGTTGGCGGTGGTGGGGC (SEQ ID NO:5044), GGGGCGGGGGGTTGTGGTTTGGTTTTATT (SEQ ID NO:5045), GGGGCGGGGGGTTGTGGTTTGGTTTTA (SEQ ID NO:5046) |
| Target532 | chr4:174429886-174429939 | AGGTGAGGGTAGGGGTTTTTTTGAAAGGT (SEQ ID NO:5047), AGGTGAGGGTAGGGGTTTTTTTGAAAGGTATT (SEQ ID NO:5048), AGGTGAGGGTAGGGGTTTTTTTGAAAGGTATTAG (SEQ ID NO:5049), GGTGAGGGTAGGGGTTTTTTTGAAAGGTATTAGA (SEQ ID NO:5050), AGGTGAGGGTAGGGGTTTTTTTGAAAGGTATTAGA (SEQ ID NO:5051), GGATGCGGAGTGGTTTTTTTGGTGGTCGT (SEQ ID NO:5052), GGATGCGGAGTGGTTTTTTTGGTGGTCG (SEQ ID NO:5053), AGGATGCGGAGTGGTTTTTTTGGTGGTCG (SEQ ID NO:5054), GATGCGGAGTGGTTTTTTTGGTGGTCGT (SEQ ID NO:5055), AGGATGCGGAGTGGTTTTTTTGGTGGTC (SEQ ID NO:5056) |
| Target533 | chr4:190861696-190861763 | CGTAGGTTAGCGAGGGTAGTTTGAGTCGT (SEQ ID NO:5057), CGTAGGTTAGCGAGGGTAGTTTGAGTCG (SEQ ID NO:5058), GTTGGGTTGTCGGGTGCGTTGTGGAAT (SEQ ID NO:5059), GGTTGTCGGGTGCGTTGTGGAATCGTT (SEQ ID NO:5060), TTGGGTTGTCGGGTGCGTTGTGGAATC (SEQ ID NO:5061), GTTGGGTTGTCGGGTGCGTTGTGGAA (SEQ ID NO:5062), GGTTGTCGGGTGCGTTGTGGAATCGTTT (SEQ ID NO:5063) |
| Target534 | chr4:190861770-190861807 | CGTAGGTTAGCGAGGGTAGTTTGAGTCGT (SEQ ID NO:5064), CGTAGGTTAGCGAGGGTAGTTTGAGTCG (SEQ ID NO:5065), CGTCGTTAGTTCGTTGTTTTAGTAGGAGGCG (SEQ ID NO:5066), TCGTCGTTAGTTCGTTGTTTTAGTAGGAGGCG (SEQ ID NO:5067), TCGTCGTTAGTTCGTTGTTTTAGTAGGAGGC (SEQ ID NO:5068), GTTGGGTTGTCGGGTGCGTTGTGGAAT (SEQ ID NO:5069), GGTTGTCGGGTGCGTTGTGGAATCGTT (SEQ ID NO:5070), TTGGGTTGTCGGGTGCGTTGTGGAATC (SEQ ID NO:5071), GTTGGGTTGTCGGGTGCGTTGTGGAA (SEQ ID NO:5072), GGTTGTCGGGTGCGTTGTGGAATCGTTT (SEQ ID NO:5073) |
| Target535 | chr4:190861849-190861859 | CGTAGGTTAGCGAGGGTAGTTTGAGTCGT (SEQ ID NO:5074), CGTAGGTTAGCGAGGGTAGTTTGAGTCG (SEQ ID NO:5075), CGTAGGTTAGCGAGGGTAGTTTGAGTCGTT (SEQ ID NO:5076), AGGTTAGCGAGGGTAGTTTGAGTCGTTT (SEQ ID NO:5077), GTAGGTTAGCGAGGGTAGTTTGAGTCGTT (SEQ ID NO:5078), TTTCGGGTTTTTGTCGGGGAGTTACGG (SEQ ID NO:5079), TTCGGGTTTTTGTCGGGGAGTTACGG (SEQ ID NO:5080), GGTATTCGCGCGTAGTTGTTTTTTGGC (SEQ ID NO:5081), CGTAGAGGGTTAAAAGGTATTCGCGCGT (SEQ ID NO:5082), CGTAGAGGGTTAAAAGGTATTCGCGCG (SEQ ID NO:5083) |
| Target536 | chr4:190861931-190861981 | AGGGAGTAGTTGCGCGCGGATGTTTT (SEQ ID NO:5084), CGTTAGGGAGTAGTTGCGCGCGGATGT (SEQ ID NO:5085), GTTAGGGAGTAGTTGCGCGCGGATGTT (SEQ ID NO:5086), TAGGGAGTAGTTGCGCGCGGATGTTTT (SEQ ID NO:5087), TTAGGGAGTAGTTGCGCGCGGATGTTTT (SEQ ID NO:5088), CGGGGTAGTATAGGGGCGCGGAGAAAT (SEQ ID NO:5089), CGGGGTAGTATAGGGGCGCGGAGAAA (SEQ ID NO:5090), CGGGGTAGTATAGGGGCGCGGAGAAATA (SEQ ID NO:5091), TTTCGGGTTTTTGTCGGGGAGTTACGG (SEQ ID NO:5092), CGGGGTAGTATAGGGGCGCGGAGAA (SEQ ID NO:5093) |

FIGURE 5 CONTINUED

| Target537 | chr4:190862105-190862129 | GTTTGGGTGAAGACGGAGGCGGGTTTT (SEQ ID NO:5094), TTTGGGTGAAGACGGAGGCGGGTTTTA (SEQ ID NO:5095), GTTTGGGTGAAGACGGAGGCGGGTTT (SEQ ID NO:5096), TTGGGTGAAGACGGAGGCGGGTTTTAT (SEQ ID NO:5097), GTTTGGGTGAAGACGGAGGCGGGTTTTA (SEQ ID NO:5098), ATTTTTGCGCGGAGAGGTTGAGGTCGG (SEQ ID NO:5099), CGCGGAGAGGTTGAGGTCGGTTTTGGA (SEQ ID NO:5100), TTGCGCGGAGAGGTTGAGGTCGGTTTT (SEQ ID NO:5101), TTTGCGCGGAGAGGTTGAGGTCGGTTT (SEQ ID NO:5102), TTTTGCGCGGAGAGGTTGAGGTCGGTT (SEQ ID NO:5103) |
|---|---|---|
| Target538 | chr4:190940267-190940284 | TGGTAGGGAATGGAGGTTTCGGGCGTT (SEQ ID NO:5104), TTGGTAGGGAATGGAGGTTTCGGGCGT (SEQ ID NO:5105), TGGTAGGGAATGGAGGTTTCGGGCGTTT (SEQ ID NO:5106), TTGGTAGGGAATGGAGGTTTCGGGCGTT (SEQ ID NO:5107), TTTGGTAGGGAATGGAGGTTTCGGGCGT (SEQ ID NO:5108) |
| Target539 | chr4:190940313-190940328 | TGGTAGGGAATGGAGGTTTCGGGCGTT (SEQ ID NO:5109), TTGGTAGGGAATGGAGGTTTCGGGCGT (SEQ ID NO:5110), TGGTAGGGAATGGAGGTTTCGGGCGTTT (SEQ ID NO:5111), TTGGTAGGGAATGGAGGTTTCGGGCGTT (SEQ ID NO:5112), TTTGGTAGGGAATGGAGGTTTCGGGCGT (SEQ ID NO:5113), CGCGAGGTTGGGATTAGGTATTTTCGGA (SEQ ID NO:5114), TCGCGAGGTTGGGATTAGGTATTTTCGG (SEQ ID NO:5115), TCGCGAGGTTGGGATTAGGTATTTTCGGA (SEQ ID NO:5116), CGCGAGGTTGGGATTAGGTATTTTCGGAG (SEQ ID NO:5117), CGCGAGGTTGGGATTAGGTATTTTCGGAGT (SEQ ID NO:5118) |
| Target540 | chr4:190940381-190940432 | TAGAGGGGGAGAGTAGTTCGGTCGCGG (SEQ ID NO:5119), ATAGAGGGGGAGAGTAGTTCGGTCGCGG (SEQ ID NO:5120), ATAGAGGGGGAGAGTAGTTCGGTCGCG (SEQ ID NO:5121), TGGTGTTTGGGCGTATAGAGGGGGAGA (SEQ ID NO:5122), GCGATTGGTGTTTGGGCGTATAGAGGGG (SEQ ID NO:5123), GCGGTGGCGTTTGGTTGGTTTAAGAGT (SEQ ID NO:5124), GCGGTGGCGTTTGGTTGGTTTAAGAGTT (SEQ ID NO:5125), CGGTGGCGTTTGGTTGGTTTAAGAGTTCGG (SEQ ID NO:5126), GCGGTGGCGTTTGGTTGGTTTAAGAGTTC (SEQ ID NO:5127), CGGTGGCGTTTGGTTGGTTTAAGAGTTCG (SEQ ID NO:5128) |
| Target541 | chr5:1130914-1130995 | GTGGTGGGAGGGTGGTAGAAGCGGAAA (SEQ ID NO:5129), GTATAGACGTAGGTGGGCGGGTGGTGG (SEQ ID NO:5130), TGGTGGGAGGGTGGTAGAAGCGGAAAG (SEQ ID NO:5131), GGTGGGAGGGTGGTAGAAGCGGAAAGA (SEQ ID NO:5132), TGGGAGGGTGGTAGAAGCGGAAAGAGG (SEQ ID NO:5133), TGGTCGGAAGGAGATTGTATGGGTTGTGT (SEQ ID NO:5134), GGTCGGAAGGAGATTGTATGGGTTGTGT (SEQ ID NO:5135), TGGTCGGAAGGAGATTGTATGGGTTGTG (SEQ ID NO:5136), TTGGTCGGAAGGAGATTGTATGGGTTGT (SEQ ID NO:5137), TGGTCGGAAGGAGATTGTATGGGTTGTGTT (SEQ ID NO:5138) |
| Target542 | chr5:1131271-1131326 | GGGTGAGGTTTGGGGGAGGGTAGTAAGG (SEQ ID NO:5139), AGGGTGAGGTTTGGGGGAGGGTAGTAA (SEQ ID NO:5140), TTAGGGTGAGGTTTGGGGGAGGGTAGT (SEQ ID NO:5141), AGGGTGAGGTTTGGGGGAGGGTAGTAAGG (SEQ ID NO:5142), GGTGAGGTTTGGGGGAGGGTAGTAAGGT (SEQ ID NO:5143), TGGTAAGGAGTAGGACGGTCGGGAGGG (SEQ ID NO:5144), GGTAAGGAGTAGGACGGTCGGGAGGGA (SEQ ID NO:5145), TTGGTAAGGAGTAGGACGGTCGGGAGGG (SEQ ID NO:5146), TTGGTAAGGAGTAGGACGGTCGGGAGG (SEQ ID NO:5147), TGGTAAGGAGTAGGACGGTCGGGAGGGA (SEQ ID NO:5148) |
| Target543 | chr5:1131364-1131378 | GTTCGGATTTACGGGGATTTGTAGGGGTTTATG (SEQ ID NO:5149), TGGTAAGGAGTAGGACGGTCGGGAGGG (SEQ ID NO:5150), GGTAAGGAGTAGGACGGTCGGGAGGGA (SEQ ID NO:5151), TTGGTAAGGAGTAGGACGGTCGGGAGGG (SEQ ID NO:5152), GGTAAGGAGTAGGACGGTCGGGAGGGAT (SEQ ID NO:5153), TTGGTAAGGAGTAGGACGGTCGGGAGG (SEQ ID NO:5154) |
| Target544 | chr5:1876208-1876216 | AAAAGGTTGCGGCGGGAGTTTTCGGTTT (SEQ ID NO:5155), AAAAGGTTGCGGCGGGAGTTTTCGGTT (SEQ ID NO:5156), AAGGTTGCGGCGGGAGTTTTCGGTTTG (SEQ ID NO:5157), TAAAAGGTTGCGGCGGGAGTTTTCGGT (SEQ ID NO:5158), AAAAGGTTGCGGCGGGAGTTTTCGGTTT (SEQ ID NO:5159) |
| Target545 | chr5:1876286-1876433 | CGTTCGTTAGGTCGGGGGTTTTCGTCG (SEQ ID NO:5160), GTTCGTTAGGTCGGGGGTTTTCGTCGT (SEQ ID NO:5161), TCGTTCGTTAGGTCGGGGGTTTTCGTCG (SEQ ID NO:5162), TCGTTCGTTAGGTCGGGGGTTTTCGTC (SEQ ID NO:5163), CGTTCGTTAGGTCGGGGGTTTTCGTCGT (SEQ ID NO:5164), AAAGGTTGCGGCGGGAGTTTTCGGTTT (SEQ ID NO:5165), AAAAGGTTGCGGCGGGAGTTTTCGGTT (SEQ ID NO:5166), AAGGTTGCGGCGGGAGTTTTCGGTTTG (SEQ ID NO:5167), AGGGTTTGGATCGGGTTTTGAGGGGGA (SEQ ID NO:5168), TAAAAGGTTGCGGCGGGAGTTTTCGGT (SEQ ID NO:5169) |
| Target546 | chr5:1876557-1876571 | CGCGGGGGATTTTGGTGGTTTAGGGGT (SEQ ID NO:5170), ACGCGGGGGATTTTGGTGGTTTAGGGG (SEQ ID NO:5171), CGCGGGGGATTTTGGTGGTTTAGGGG (SEQ ID NO:5172), TACGCGGGGGATTTTGGTGGTTTAGGG (SEQ ID NO:5173), TACGCGGGGGATTTTGGTGGTTTAGGGG (SEQ ID NO:5174), GAGACGTAGGATTGTTTTGCGGGCGGG (SEQ ID NO:5175), GGAGACGTAGGATTGTTTTGCGGGCGG (SEQ ID NO:5176), GGGCGGGCGGTTTTGGAGGGATTTATT (SEQ ID NO:5177), CGGGCGGGCGGTTTTGGAGGGATTTAT (SEQ ID NO:5178), AGACGTAGGATTGTTTTGCGGGCGGGC (SEQ ID NO:5179) |
| Target547 | chr5:1876630-1876660 | GCGGGGGATTTTGGTGGTTTAGGGGTT (SEQ ID NO:5180), CGCGGGGGATTTTGGTGGTTTAGGGGT (SEQ ID NO:5181), ACGCGGGGGATTTTGGTGGTTTAGGGG (SEQ ID NO:5182), CGCGGGGGATTTTGGTGGTTTAGGGG (SEQ ID NO:5183), TACGCGGGGGATTTTGGTGGTTTAGGG (SEQ ID NO:5184), GAGACGTAGGATTGTTTTGCGGGCGGG (SEQ ID NO:5185), |

FIGURE 5 CONTINUED

|  |  |  |
|---|---|---|
|  |  | GGAGACGTAGGATTGTTTTGCGGGCGG (SEQ ID NO:5186), TTAAGGATTACGGGAGCGGTTCGGGGG (SEQ ID NO:5187), AGACGTAGGATTGTTTTGCGGGCGGGT (SEQ ID NO:5188), TTTAAGGATTACGGGAGCGGTTCGGGGG (SEQ ID NO:5189) |
| Target548 | chr5:1877909-1877921 | GGTTTAGGTTTAGGCGGTGGAGGTTTCGG (SEQ ID NO:5190), TTTAGGTTTAGGCGGTGGAGGTTTCGG (SEQ ID NO:5191), CGGTGGAGGTTTCGGCGTGGTAGC (SEQ ID NO:5192), GCGGTGGAGGTTTCGGCGTGGTAG (SEQ ID NO:5193), AGGTTTAGGTTTAGGCGGTGGAGGTTTCGG (SEQ ID NO:5194), CGGAGAGGGGGTTTTTGAATTTGGATTTTTGGG (SEQ ID NO:5195), CGGAGAGGGGGTTTTTGAATTTGGATTTTTGGGA (SEQ ID NO:5196), TCGGAGAGGGGGTTTTTGAATTTGGATTTTTGGG (SEQ ID NO:5197), CGGAGAGGGGGTTTTTGAATTTGGATTTTTGG (SEQ ID NO:5198), GGAGAGGGGGTTTTTGAATTTGGATTTTTGGG (SEQ ID NO:5199) |
| Target549 | chr5:1877967-1878069 | GCGTGGTAGCGTCGGGTTTGTTTATGT (SEQ ID NO:5200), GCGTGGTAGCGTCGGGTTTGTTTATGTT (SEQ ID NO:5201), GGTTTAGGTTTAGGCGGTGGAGGTTTCGG (SEQ ID NO:5202), TTTAGGTTTAGGCGGTGGAGGTTTCGG (SEQ ID NO:5203), GCGGTGGAGGTTTCGGCGTGGTAG (SEQ ID NO:5204), TTTTTTGCGTTTGAGGCGGGCGGGTTT (SEQ ID NO:5205), TTTTTGCGTTTGAGGCGGGCGGGTTTC (SEQ ID NO:5206), TTTTTGCGTTTGAGGCGGGCGGGTTT (SEQ ID NO:5207), TTTTTTGCGTTTGAGGCGGGCGGGTT (SEQ ID NO:5208), TTTTGCGTTTGAGGCGGGCGGGTTTC (SEQ ID NO:5209) |
| Target550 | chr5:1878079-1878210 | TTGTCGTCGGTTTTGGGTAGGGCGAGT (SEQ ID NO:5210), GGTTTGTCGTCGGTTTTGGGTAGGGCG (SEQ ID NO:5211), GCGTTTGTAGTTGGGGCGTTTTGGGGT (SEQ ID NO:5212), GGGTTTGTCGTCGGTTTTGGGTAGGGC (SEQ ID NO:5213), GGAAAGGCGCGGGGTTAGGGGTGTAGTT (SEQ ID NO:5214), TTCGGGTTTTTGGGACGTTCGTTGGGG (SEQ ID NO:5215), TCGGGTTTTTGGGACGTTCGTTGGGG (SEQ ID NO:5216), TTTCGGGTTTTTGGGACGTTCGTTGGGG (SEQ ID NO:5217), CGGGTTTTTGGGACGTTCGTTGGGGG (SEQ ID NO:5218), TCGGGTTTTTGGGACGTTCGTTGGGG (SEQ ID NO:5219) |
| Target551 | chr5:1878215-1878266 | TTGTCGTCGGTTTTGGGTAGGGCGAGT (SEQ ID NO:5220), GGTTTGTCGTCGGTTTTGGGTAGGGCG (SEQ ID NO:5221), GCGTTTGTAGTTGGGGCGTTTTGGGGT (SEQ ID NO:5222), GGGTTTGTCGTCGGTTTTGGGTAGGGC (SEQ ID NO:5223), GGAAAGGCGCGGGGTTAGGGGTGTAGTT (SEQ ID NO:5224), TTCGGGTTTTTGGGACGTTCGTTGGGG (SEQ ID NO:5225), TCGGGTTTTTGGGACGTTCGTTGGGG (SEQ ID NO:5226), TTTCGGGTTTTTGGGACGTTCGTTGGGG (SEQ ID NO:5227), CGGGTTTTTGGGACGTTCGTTGGGGG (SEQ ID NO:5228), CGGGTTTTTGGGACGTTCGTTGGGGGT (SEQ ID NO:5229) |
| Target552 | chr5:2134732-2135132 | TGGGGTATGGAAGTTTGACGGGAAGAGGG (SEQ ID NO:5230), GGGGTATGGAAGTTTGACGGGAAGAGGG (SEQ ID NO:5231), GGGGTATGGAAGTTTGACGGGAAGAGGGA (SEQ ID NO:5232), TGGGGTATGGAAGTTTGACGGGAAGAGGGA (SEQ ID NO:5233), TGGGGTATGGAAGTTTGACGGGAAGAGG (SEQ ID NO:5234), AGTGCGTGCGGTTTTTGGTATTGGGGT (SEQ ID NO:5235), GAGTGCGTGCGGTTTTTGGTATTGGGGT (SEQ ID NO:5236), GAGTGCGTGCGGTTTTTGGTATTGGGG (SEQ ID NO:5237), GGAGTGCGTGCGGTTTTTGGTATTGGG (SEQ ID NO:5238), GTGCGTGCGGTTTTTGGTATTGGGGTT (SEQ ID NO:5239) |
| Target553 | chr5:2149263-2149663 | TTTGTCGGGTGGTTTTTGCGTGGTTGA (SEQ ID NO:5240), GGGTAATGAAGTTGGAGGTAGGCGTGCG (SEQ ID NO:5241), CGGGTAATGAAGTTGGAGGTAGGCGTGC (SEQ ID NO:5242), TGTCGGGTGGTTTTTGCGTGGTTGATT (SEQ ID NO:5243), TTGTCGGGTGGTTTTTGCGTGGTTGAT (SEQ ID NO:5244), GTAGAGCGGTTCGATGAGGGGGTTGTGT (SEQ ID NO:5245), AGTAGAGCGGTTCGATGAGGGGGTTGTGT (SEQ ID NO:5246), AGTAGAGCGGTTCGATGAGGGGGTTGTG (SEQ ID NO:5247), AGAGCGGTTCGATGAGGGGGTTGTGTTA (SEQ ID NO:5248), TAGAGCGGTTCGATGAGGGGGTTGTGTT (SEQ ID NO:5249) |
| Target554 | chr5:3602148-3602161 | TAGATGGGTTAGTCGGGATGCGGTGCG (SEQ ID NO:5250), ATAGATGGGTTAGTCGGGATGCGGTGCG (SEQ ID NO:5251), AGATGGGTTAGTCGGGATGCGGTGCG (SEQ ID NO:5252), ATAGATGGGTTAGTCGGGATGCGGTGC (SEQ ID NO:5253), GATGGGTTAGTCGGGATGCGGTGCG (SEQ ID NO:5254) |
| Target555 | chr5:3602272-3602308 | ACGAGGGGTTGAGGTTGTGGTGGGAAG (SEQ ID NO:5255), GGGTTGAGGTTGTGGTGGGAAGCGAGA (SEQ ID NO:5256), GGTGGGAAGCGAGAAAGAGGAGGTGGT (SEQ ID NO:5257), TGGTGGGAAGCGAGAAAGAGGAGGTGG (SEQ ID NO:5258), TTTTGCGGTGTGAGGTGTGAACGAGGG (SEQ ID NO:5259), GGTGCGCGCGTTTGAGGGTAAAGGAC (SEQ ID NO:5260), GGTGCGCGCGTTTGAGGGTAAAGGA (SEQ ID NO:5261), CGGTGCGCGCGTTTGAGGGTAAAGGAC (SEQ ID NO:5262), CGGTGCGCGCGTTTGAGGGTAAAGGA (SEQ ID NO:5263), CGGTGCGCGCGTTTGAGGGTAAAGG (SEQ ID NO:5264) |
| Target556 | chr5:3602339-3602483 | TATTCGTAGCGGGGTTGGTTTCGGGCG (SEQ ID NO:5265), ATATTCGTAGCGGGGTTGGTTTCGGGC (SEQ ID NO:5266), GCGCGAGTGGGGAAAGGTTTAGGAGTT (SEQ ID NO:5267), ATATTCGTAGCGGGGTTGGTTTCGGGCG (SEQ ID NO:5268), AATATTCGTAGCGGGGTTGGTTTCGGGC (SEQ ID NO:5269), TTTTGAAGGTGTTTGTTGCGGCGCGTG (SEQ ID NO:5270), TTTTTGAAGGTGTTTGTTGCGGCGCGT (SEQ ID NO:5271), TTTGAAGGTGTTTGTTGCGGCGCGTGG (SEQ ID NO:5272), TTTTTGAAGGTGTTTGTTGCGGCGCGTG (SEQ ID NO:5273), TTTGAAGGTGTTTGTTGCGGCGCGTG (SEQ ID NO:5274) |

FIGURE 5 CONTINUED

| Target557 | chr5:3602487-3602497 | TATTCGTAGCGGGGTTGGTTTCGGGCG (SEQ ID NO:5275), ATATTCGTAGCGGGGTTGGTTTCGGGC (SEQ ID NO:5276), GCGCGAGTGGGGAAAGGTTTAGGAGTT (SEQ ID NO:5277), ATATTCGTAGCGGGGTTGGTTTCGGGCG (SEQ ID NO:5278), AATATTCGTAGCGGGGTTGGTTTCGGGC (SEQ ID NO:5279), TTTTTGAAGGTGTTTGTTGCGGCGCGTG (SEQ ID NO:5280), TTTTTGAAGGTGTTTGTTGCGGCGCGT (SEQ ID NO:5281), TTTGAAGGTGTTTGTTGCGGCGCGTGG (SEQ ID NO:5282), TTTTTGAAGGTGTTTGTTGCGGCGCGTG (SEQ ID NO:5283), TTTGAAGGTGTTTGTTGCGGCGCGTG (SEQ ID NO:5284) |
| Target558 | chr5:3602501-3602582 | TATTCGTAGCGGGGTTGGTTTCGGGCG (SEQ ID NO:5285), ATATTCGTAGCGGGGTTGGTTTCGGGC (SEQ ID NO:5286), GCGCGAGTGGGGAAAGGTTTAGGAGTT (SEQ ID NO:5287), ATATTCGTAGCGGGGTTGGTTTCGGGCG (SEQ ID NO:5288), AATATTCGTAGCGGGGTTGGTTTCGGGC (SEQ ID NO:5289), CGTTTTGAAGGTTTCGCGTCGGGTTC (SEQ ID NO:5290), GTTTTTTGAAGGTGTTTGTTGCGGCGT (SEQ ID NO:5291), AGTTTTTTGAAGGTGTTTGTTGCGGCGT (SEQ ID NO:5292), AGTTTTTTGAAGGTGTTTGTTGCGGCG (SEQ ID NO:5293), AAGTTTTTTGAAGGTGTTTGTTGCGGCGT (SEQ ID NO:5294) |
| Target559 | chr5:3602672-3602707 | TGTTAGCGAGGATGTGGGTTGTCGGGA (SEQ ID NO:5295), GCGAGGATGTGGGTTGTCGGGAAAAACG (SEQ ID NO:5296), TTGTTAGCGAGGATGTGGGTTGTCGGG (SEQ ID NO:5297), AGCGAGGATGTGGGTTGTCGGGAAAAA (SEQ ID NO:5298), CGAGGATGTGGGTTGTCGGGAAAAACGG (SEQ ID NO:5299), GTCGGGAAGGGCGGGTTATAGGTTGGG (SEQ ID NO:5300), GGAAGGGCGGGTTATAGGTTGGGGGTG (SEQ ID NO:5301), AGTCGGGAAGGGCGGGTTATAGGTTGG (SEQ ID NO:5302), GTTATAGGTTGGGGGTGCGAGCGGAGG (SEQ ID NO:5303), GGTTATAGGTTGGGGGTGCGAGCGGAG (SEQ ID NO:5304) |
| Target560 | chr5:5140383-5140428 | CGTCGTCGCGGTTGTTATTTCGTTTTTC (SEQ ID NO:5305), GTGCGAGCGGGTAGGGAGGATTCGATT (SEQ ID NO:5306), TGCGAGCGGGTAGGGAGGATTCGATTT (SEQ ID NO:5307), GTGCGAGCGGGTAGGGAGGATTCGAT (SEQ ID NO:5308), GTGCGAGCGGGTAGGGAGGATTCGATTT (SEQ ID NO:5309), TGCGAGCGGGTAGGGAGGATTCGATT (SEQ ID NO:5310) |
| Target561 | chr5:5140434-5140492 | CGGAGTCGTTGTGGGGAATTTTTTCGC (SEQ ID NO:5311), CGTCGTCGCGGTTGTTATTTCGTTTTTC (SEQ ID NO:5312), CGGAGTTTTAGTAATAATTTCGGCGCGGC (SEQ ID NO:5313), GTGCGAGCGGGTAGGGAGGATTCGATT (SEQ ID NO:5314), GGGGTTATCGGAGGGTTTTCGGTCGGT (SEQ ID NO:5315), AGGGGTTATCGGAGGGTTTTCGGTCGG (SEQ ID NO:5316), TCGAGGGGTTAGGGGTTATCGGAGGGT (SEQ ID NO:5317), TGCGAGCGGGTAGGGAGGATTCGATTT (SEQ ID NO:5318) |
| Target562 | chr5:5140520-5140539 | CGGAGTCGTTGTGGGGAATTTTTTCGC (SEQ ID NO:5319), ATTTTTTCGCGTTTTGTTTGGGTCGGG (SEQ ID NO:5320), GGGAATTTTTTCGCGTTTTGTTTGGGTCGGG (SEQ ID NO:5321), AATTTTTTCGCGTTTTGTTTGGGTCGGG (SEQ ID NO:5322), CGCGTTTTGTTTGGGTCGGGTTTTTT (SEQ ID NO:5323), GGGGTTATCGGAGGGTTTTCGGTCGGT (SEQ ID NO:5324), AGGGGTTATCGGAGGGTTTTCGGTCGG (SEQ ID NO:5325), TCGAGGGGTTAGGGGTTATCGGAGGGT (SEQ ID NO:5326), CGAGGGGTTAGGGGTTATCGGAGGGTT (SEQ ID NO:5327), GCGTTTCGAGGGGTTAGGGGTTATCGG (SEQ ID NO:5328) |
| Target563 | chr5:5140549-5140879 | CGTTGTCGGTCGGGGATTTTTCGGTGG (SEQ ID NO:5329), GGCGTTGTGGATGTTGTTGGCGTAGGT (SEQ ID NO:5330), GTTTGGCGGCGTTGTGGATGTTGTTGG (SEQ ID NO:5331), GGTTTGGCGGCGTTGTGGATGTTGTTG (SEQ ID NO:5332), CGGTAGCGTTTGGGAGTTCGAGCGTTT (SEQ ID NO:5333), GGAGAGGAGTCGCGCGGGGGATTCGTTTT (SEQ ID NO:5334), GCGTTGGTGGGAGCGTTCGGGATTTAT (SEQ ID NO:5335), GGAGAGGAGTCGCGCGGGGGATTCGTTT (SEQ ID NO:5336), AGGAGCGTTTCGAGGGGTTAGGGGTTA (SEQ ID NO:5337), TAGGAGCGTTTCGAGGGGTTAGGGGTT (SEQ ID NO:5338) |
| Target564 | chr5:10333225-10333253 | TTTCGCGTGTGATGGGGGTTGTTTGGG (SEQ ID NO:5339), AGGTGGGTGAGGAGTTTTTAGGCGCGT (SEQ ID NO:5340), GTGATGGGGGTTGTTTGGGTGGGGTTG (SEQ ID NO:5341), TGATGGGGGTTGTTTGGGTGGGGTTGT (SEQ ID NO:5342), TGTGATGGGGGTTGTTTGGGTGGGGTT (SEQ ID NO:5343), TGAGTGTTCGGGGTTTGGGTAGTGTTGT (SEQ ID NO:5344), GAGTGTTCGGGGTTTGGGTAGTGTTGT (SEQ ID NO:5345), TGAGTGTTCGGGGTTTGGGTAGTGTTG (SEQ ID NO:5346), TGGTTGGTATTTGGTCGTTTGTAGGCGGT (SEQ ID NO:5347), GGTTGGTATTTGGTCGTTTGTAGGCGGT (SEQ ID NO:5348) |
| Target565 | chr5:10333262-10333318 | TTTCGCGTGTGATGGGGGTTGTTTGGG (SEQ ID NO:5349), AGGTGGGTGAGGAGTTTTTAGGCGCGT (SEQ ID NO:5350), GTGATGGGGGTTGTTTGGGTGGGGTTG (SEQ ID NO:5351), TGATGGGGGTTGTTTGGGTGGGGTTGT (SEQ ID NO:5352), TGTGATGGGGGTTGTTTGGGTGGGGTT (SEQ ID NO:5353), ACGGTTGGGGTGTTTTGGCGTTAAGAGC (SEQ ID NO:5354), CGGTTGGGGTGTTTTGGCGTTAAGAGC (SEQ ID NO:5355), GGACGGTTGGGGTGTTTTGGCGTTAAG (SEQ ID NO:5356), GGACGGTTGGGGTGTTTTGGCGTTAAGA (SEQ ID NO:5357), ACGGTTGGGGTGTTTTGGCGTTAAGAG (SEQ ID NO:5358) |
| Target566 | chr5:10333439-10333565 | GATTTTAGATCGCGGGGGTGTGGGGC (SEQ ID NO:5359), ATTTTAGATCGCGGGGGTGTGGGGC (SEQ ID NO:5360), CGTCGGGGATTTGTTATTTGGGTTCGGT (SEQ ID NO:5361), CGTCGGGGATTTGTTATTTGGGTTCGG (SEQ ID NO:5362), TCGTCGGGGATTTGTTATTTGGGTTCGGT (SEQ ID NO:5363), GCGGTTTTGGGCGGCGTTTGTTTTTT (SEQ ID NO:5364), GCGGTTTTGGGCGGCGTTTGTTTTT (SEQ ID NO:5365), GGTTTAAGGTCGGTAGCGATTTTGGGG (SEQ ID NO:5366), GGTTTAAGGTCGGTAGCGATTTTGGGGA (SEQ ID NO:5367), GCGGTTTTGGGCGGCGTTTGTTTT (SEQ ID NO:5368) |

FIGURE 5 CONTINUED

| Target567 | chr5:10333591-10333637 | GTGGGGCGTCGGGGAAGGAGATAGAAG (SEQ ID NO:5369), TATTTGGGGTTGCGTTTTGGGTGGGCG (SEQ ID NO:5370), TAGGGTCGCGGGGGATATTTGGGGTTGC (SEQ ID NO:5371), TGTGGGGCGTCGGGGAAGGAGATAGAA (SEQ ID NO:5372), GGGGCGTCGGGGAAGGAGATAGAAGGA (SEQ ID NO:5373), GGTTTTCGGTTAGGGGGAGTTAGGGCGT (SEQ ID NO:5374), GGTTTTCGGTTAGGGGGAGTTAGGGCG (SEQ ID NO:5375), GTTTTCGGTTAGGGGGAGTTAGGGCGT (SEQ ID NO:5376), GGTTTTCGGTTAGGGGGAGTTAGGGCGTA (SEQ ID NO:5377), TTTTCGGTTAGGGGGAGTTAGGGCGTA (SEQ ID NO:5378) |
| Target568 | chr5:16180103-16180184 | GGGCGGGTTGGAAGTGGGGGATTTTTT (SEQ ID NO:5379), CGGGCGGGTTGGAAGTGGGGGATTTTT (SEQ ID NO:5380), GGGCGGGTTGGAAGTGGGGGATTTTT (SEQ ID NO:5381), GGGCGGGTTGGAAGTGGGGGATTTTTTA (SEQ ID NO:5382), CGGGCGGGTTGGAAGTGGGGGATTTT (SEQ ID NO:5383), AGCGTTGCGTCGTTTGGAGAGGGGTTA (SEQ ID NO:5384), TAGCGTTGCGTCGTTTGGAGAGGGGTT (SEQ ID NO:5385), GCGTTGCGTCGTTTGGAGAGGGGTTAT (SEQ ID NO:5386), GTAGCGTTGCGTCGTTTGGAGAGGGGT (SEQ ID NO:5387), TAGCGTTGCGTCGTTTGGAGAGGGGT (SEQ ID NO:5388) |
| Target569 | chr5:16180231-16180278 | GGGAAGTAGGGGGGTAGGGGAGAGGTCG (SEQ ID NO:5389), TATTGGATGGGTCGGTGGGATGTGGCG (SEQ ID NO:5390), TGGGAAGTAGGGGGGTAGGGGAGAGGTC (SEQ ID NO:5391), CGTGAGTTGGGAAGTAGGGGGGTAGGGG (SEQ ID NO:5392), TTGGGAAGTAGGGGGGTAGGGGAGAGGT (SEQ ID NO:5393), TGGAAGTGGCGTTATAGTTTCGGGTT (SEQ ID NO:5394), TGTTTAGTTAGTTCGGGCGCGTTTAGGG (SEQ ID NO:5395), GTTTAGTTAGTTCGGGCGCGTTTAGGG (SEQ ID NO:5396), TGGAAGTGGCGGTTATAGTTTCGGGTTT (SEQ ID NO:5397), TTGTTTAGTTAGTTCGGGCGCGTTTAGGG (SEQ ID NO:5398) |
| Target570 | chr5:16180290-16180342 | GGGAAGTAGGGGGGTAGGGGAGAGGTCG (SEQ ID NO:5399), TATTGGATGGGTCGGTGGGATGTGGCG (SEQ ID NO:5400), TGGGAAGTAGGGGGGTAGGGGAGAGGTC (SEQ ID NO:5401), CGTGAGTTGGGAAGTAGGGGGGTAGGGG (SEQ ID NO:5402), TTGGGAAGTAGGGGGGTAGGGGAGAGGT (SEQ ID NO:5403), GGAGCGAGGGTTTGGAAGTGGCGGTTA (SEQ ID NO:5404), GAGCGAGGGTTTGGAAGTGGCGGTTAT (SEQ ID NO:5405), GGAGCGAGGGTTTGGAAGTGGCGGTTAT (SEQ ID NO:5406), AGCGAGGGTTTGGAAGTGGCGGTTATA (SEQ ID NO:5407), GAGCGAGGGTTTGGAAGTGGCGGTTA (SEQ ID NO:5408) |
| Target571 | chr5:16180362-16180394 | TGGTTGAGTAGTGGAGCGGGAAAGGGCG (SEQ ID NO:5409), GGTTGAGTAGTGGAGCGGGAAAGGGCGC (SEQ ID NO:5410), GTTGAGTAGTGGAGCGGGAAAGGGCGC (SEQ ID NO:5411), TTGGTTGAGTAGTGGAGCGGGAAAGGGC (SEQ ID NO:5412), TTGAGTAGTGGAGCGGGAAAGGGCGC (SEQ ID NO:5413), GGAGCGAGGGTTTGGAAGTGGCGGTTA (SEQ ID NO:5414), GAGCGAGGGTTTGGAAGTGGCGGTTAT (SEQ ID NO:5415), GGAGCGAGGGTTTGGAAGTGGCGGTTAT (SEQ ID NO:5416), AGCGAGGGTTTGGAAGTGGCGGTTATA (SEQ ID NO:5417), CGAGGGCGGGATAGATAGGGAGAGGAT (SEQ ID NO:5418) |
| Target572 | chr5:37834738-37834807 | TTAGGTTGGTTTGGGGTACGTGCGGGG (SEQ ID NO:5419), ATTAGGTTGGTTTGGGGTACGTGCGGG (SEQ ID NO:5420), GTTTGGGGTACGTGCGGGGTTGGTTG (SEQ ID NO:5421), GTTGGTTTGGGGTACGTGCGGGGTTG (SEQ ID NO:5422), TAGGTTGGTTTGGGGTACGTGCGGGG (SEQ ID NO:5423), CGTCGGTAAGAGGTTTTTCGAGGCGTT (SEQ ID NO:5424), CGTCGGTAAGAGGTTTTTCGAGGCGTTC (SEQ ID NO:5425), TGGGATGTCGTGGTTGTTTGTTTGGTGT (SEQ ID NO:5426), GGGATGTCGTGGTTGTTTGTTTGGTGT (SEQ ID NO:5427), TGGGATGTCGTGGTTGTTTGTTTGGTG (SEQ ID NO:5428) |
| Target573 | chr5:37834826-37834845 | CGGCGGGCGTTTCGGGAGGTTTTTTAT (SEQ ID NO:5429), TCGGCGGGCGTTTCGGGAGGTTTTTTA (SEQ ID NO:5430), GCGTTTCGGGAGGTTTTTTATCGGCGG (SEQ ID NO:5431), GGCGTTTCGGGAGGTTTTTTATCGGCG (SEQ ID NO:5432), GCGGGCGTTTCGGGAGGTTTTTTATCG (SEQ ID NO:5433), TTTCGTTTGTTCGCGTAGGTGTCGTCG (SEQ ID NO:5434), TTTTCGTTTGTTCGCGTAGGTGTCGTCG (SEQ ID NO:5435), TTCGTTTGTTCGCGTAGGTGTCGTCG (SEQ ID NO:5436), TGGGATGTCGTGGTTGTTTGTTTGGTGT (SEQ ID NO:5437), TTTTCGTTTGTTCGCGTAGGTGTCGTC (SEQ ID NO:5438) |
| Target574 | chr5:37834848-37835000 | CGGCGGGCGTTTCGGGAGGTTTTTTAT (SEQ ID NO:5439), TCGGCGGGCGTTTCGGGAGGTTTTTTA (SEQ ID NO:5440), GGTAGGCGGGAGGTGGGGGAGAGAATC (SEQ ID NO:5441), GCGTTTCGGGAGGTTTTTTATCGGCGG (SEQ ID NO:5442), GGCGTTTCGGGAGGTTTTTTATCGGCG (SEQ ID NO:5443), GGAGAGGGGCGTAGGGATTCGTAGGGA (SEQ ID NO:5444), GAGGTTGGAGAGGGGCGTAGGGATTCG (SEQ ID NO:5445), CGAGGTTGGAGAGGGGCGTAGGGATTC (SEQ ID NO:5446), AGAGGGGCGTAGGGATTCGTAGGGAGT (SEQ ID NO:5447), TGGAGAGGGGCGTAGGGATTCGTAGGG (SEQ ID NO:5448) |
| Target575 | chr5:37835015-37835110 | GGTAGGCGGGAGGTGGGGGAGAGAATC (SEQ ID NO:5449), GTAGGCGGGAGGTGGGGGAGAGAATC (SEQ ID NO:5450), GGTAGGCGGGAGGTGGGGGAGAGAAT (SEQ ID NO:5451), GGGTAGGCGGGAGGTGGGGGAGAGAAT (SEQ ID NO:5452), GTAGGCGGGAGGTGGGGGAGAGAAT (SEQ ID NO:5453), AGTTGTTTTTGGGGCGCGTTGAGGAGG (SEQ ID NO:5454), CGAGTTGTTTTTGGGGCGCGTTGAGGA (SEQ ID NO:5455), GTGGTGGGGGGTGGGGGGTTAATTGGAG (SEQ ID NO:5456), TTTTTGGGGCGCGTTGAGGAGGGGAGAA (SEQ ID NO:5457), GCGTTGAGGAGGGGAGAAGCGAATTGGG (SEQ ID NO:5458) |
| Target576 | chr5:40680972-40680986 | CGCGAGTTTGGAGATTTTGGTGGTCGT (SEQ ID NO:5459), TCGCGAGTTTGGAGATTTTGGTGGTCGT (SEQ ID NO:5460), TCGCGAGTTTGGAGATTTTGGTGGTCG (SEQ ID NO:5461), ATCGCGAGTTTGGAGATTTTGGTGGTCG (SEQ ID NO:5462), ATCGCGAGTTTGGAGATTTTGGTGGTCGT |

FIGURE 5 CONTINUED

|  |  | {SEQ ID NO:5463}, GGTTGGCGGTGCGTAGTTTTGGAGTGT {SEQ ID NO:5464}, GTGGTTGGCGGTGCGTAGTTTTGGAGT {SEQ ID NO:5465}, TGGTTGGCGGTGCGTAGTTTTGGAGTG {SEQ ID NO:5466}, AGTGGTTGGCGGTGCGTAGTTTTGGAG {SEQ ID NO:5467}, GTGGTTGGCGGTGCGTAGTTTTGGAGTG {SEQ ID NO:5468} |
| Target577 | chr5:40681015-40681119 | AGATTTTGGTGGTCGTAGTTGGTAAGTGGT {SEQ ID NO:5469}, CGGGCGCGGGGTTTAATATTTTATAAGTGGT {SEQ ID NO:5470}, TCGGGCGCGGGGTTTAATATTTTATAAGTGGT {SEQ ID NO:5471}, GAGATTTTGGTGGTCGTAGTTGGTAAGTGGT {SEQ ID NO:5472}, AGATTTTGGTGGTCGTAGTTGGTAAGTGGTT {SEQ ID NO:5473}, GGTCGGGGTTTAAGGAGGCGGACGAAT {SEQ ID NO:5474}, GGTTGGCGGTGCGTAGTTTTGGAGTGT {SEQ ID NO:5475}, GTGGTTGGCGGTGCGTAGTTTTGGAGT {SEQ ID NO:5476}, TTAGTCGGTCGGGGTTTAAGGAGGCGG {SEQ ID NO:5477}, TGGTTGGCGGTGCGTAGTTTTGGAGTG {SEQ ID NO:5478} |
| Target578 | chr5:40681137-40681170 | CGATCGGTTGAATAGTTTAGTGATTATTTCGGCG {SEQ ID NO:5479}, TCGATCGGTTGAATAGTTTAGTGATTATTTCGGCG {SEQ ID NO:5480}, TTCGATCGGTTGAATAGTTTAGTGATTATTTCGGCG {SEQ ID NO:5481}, TGTTTTTTGCGCGATTTGTATAGTATTACGATGGT {SEQ ID NO:5482}, TGTTTTTTGCGCGATTTGTATAGTATTACGATGGTT {SEQ ID NO:5483}, TTGTTTTTTGCGCGATTTGTATAGTATTACGATGGT {SEQ ID NO:5484}, TGCGCGATTTGTATAGTATTACGATGGTTATTAGGT {SEQ ID NO:5485} |
| Target579 | chr5:40681212-40681372 | TTCGGGGTGGTGGGTAATTTGGTGGTT {SEQ ID NO:5486}, GGCGGTGATGTTTATTTTCGGGGTGGTGG {SEQ ID NO:5487}, TTTCGGGGTGGTGGGTAATTTGGTGGTT {SEQ ID NO:5488}, GCGGTGATGTTTATTTTCGGGGTGGTGG {SEQ ID NO:5489}, AGGGTTAATGGTTCGGGGGGTTAGTCGT {SEQ ID NO:5490}, AGCGGTTGGTTTTCGGGTTATTGGTTT {SEQ ID NO:5491}, GGCGTAGATGATGTTGAGGTCGGATAGGT {SEQ ID NO:5492}, TGGCGTAGATGATGTTGAGGTCGGATAGG {SEQ ID NO:5493}, TGGCGTAGATGATGTTGAGGTCGGATAGGT {SEQ ID NO:5494}, GGCGTAGATGATGTTGAGGTCGGATAGG {SEQ ID NO:5495} |
| Target580 | chr5:40681410-40681441 | AGGGTTAATGGTTCGGGGGGTTAGTCGT {SEQ ID NO:5496}, TAATGGTTCGGGGGGTTAGTCGTTGTGC {SEQ ID NO:5497}, GGGTTAATGGTTCGGGGGGTTAGTCGTT {SEQ ID NO:5498}, AGGGTTAATGGTTCGGGGGGTTAGTCGTT {SEQ ID NO:5499}, AAGGGTTAATGGTTCGGGGGGTTAGTCGT {SEQ ID NO:5500}, AGGTATGGTTGATGGTTAGGTAGCGTTCG {SEQ ID NO:5501}, GGTATGGTTGATGGTTAGGTAGCGTTCGA {SEQ ID NO:5502}, AGGTATGGTTGATGGTTAGGTAGCGTTCGA {SEQ ID NO:5503}, GGTATGGTTGATGGTTAGGTAGCGTTCGAT {SEQ ID NO:5504}, AGGTATGGTTGATGGTTAGGTAGCGTTCGAT {SEQ ID NO:5505} |
| Target581 | chr5:40681485-40682018 | TCGTTCGTGGTGAGTGATCGGGGTTGG {SEQ ID NO:5506}, TTGTGTGCGGCGCGTTGTTTCGTATGT {SEQ ID NO:5507}, GCGGTCGTTTCGGTTGTTTTTCGGGGT {SEQ ID NO:5508}, TGTGTGCGGCGCGTTGTTTCGTATGTA {SEQ ID NO:5509}, TGTTTGTGTGCGGCGCGTTGTTTCGTA {SEQ ID NO:5510}, CGGTCGCGTGGTGTTGTTCGGTGTTTA {SEQ ID NO:5511}, GGTAGCGGGGTGGTTTCGGGAGGTAAT {SEQ ID NO:5512}, TAGCGGGGTGGTTTCGGGAGGTAATCG {SEQ ID NO:5513}, GGGAAAGTAGGGAGCGGGGAATGGACG {SEQ ID NO:5514}, GGACGGTGGCGAGAATGAGGAAGGAGT {SEQ ID NO:5515} |
| Target582 | chr5:50685400-50685513 | CGGGCGGGTCGGTAAGCGAGTTTTTAG {SEQ ID NO:5516}, GGGCGGGTCGGTAAGCGAGTTTTTAGT {SEQ ID NO:5517}, TGTTTTGAGTATTTCGGGCGGGCGAGT {SEQ ID NO:5518}, GCGGGCGGGTCGGTAAGCGAGTTTTTA {SEQ ID NO:5519}, CGGGCGGGTCGGTAAGCGAGTTTTTAGT {SEQ ID NO:5520}, TGTTTGGCGGAGATGGGTTTCGTTGCG {SEQ ID NO:5521}, GTGGGGTCGTAGGGTTGGTTGTTTGGC {SEQ ID NO:5522}, CGTGAGCGTTGGGTTGGAGGTTCGTTT {SEQ ID NO:5523}, GATGGGTTTCGTTGCGGGGTAAGGAGC {SEQ ID NO:5524}, AGGGTTGGTTGTTTGGCGGAGATGGGT {SEQ ID NO:5525} |
| Target583 | chr5:50685534-50685625 | CGGGCGGGTCGGTAAGCGAGTTTTTAG {SEQ ID NO:5526}, GGGCGGGTCGGTAAGCGAGTTTTTAGT {SEQ ID NO:5527}, GCGGGCGGGTCGGTAAGCGAGTTTTTA {SEQ ID NO:5528}, CGGGCGGGTCGGTAAGCGAGTTTTTAGT {SEQ ID NO:5529}, CGGGCGGGTCGGTAAGCGAGTTTTTA {SEQ ID NO:5530}, GCGGGTTTGCGGCGTAGTAGGTTCGTA {SEQ ID NO:5531}, CGGGTTTGCGGCGTAGTAGGTTCGTAA {SEQ ID NO:5532}, CGGGTTTGCGGCGTAGTAGGTTCGTAAG {SEQ ID NO:5533}, GCGGGTTTGCGGCGTAGTAGGTTCGTAA {SEQ ID NO:5534}, CGGGTTTGCGGCGTAGTAGGTTCGTA {SEQ ID NO:5535} |
| Target584 | chr5:50685654-50685699 | ACGGGTTTTAGTTTTCGTGTGATTCGGGT {SEQ ID NO:5536}, CGGGTTTTAGTTTTCGTGTGATTCGGGT {SEQ ID NO:5537}, ACGGGTTTTAGTTTTCGTGTGATTCGGG {SEQ ID NO:5538}, GACGGGTTTTAGTTTTCGTGTGATTCGGG {SEQ ID NO:5539}, GACGGGTTTTAGTTTTCGTGTGATTCGGGT {SEQ ID NO:5540}, AGTTTTGTTATTGGGTTGTTGTTGTTGGAGTTGT {SEQ ID NO:5541}, AGTTTTGTTATTGGGTTGTTGTTGTTGGAGTTGTT {SEQ ID NO:5542}, TAGTTTTGTTATTGGGTTGTTGTTGTTGGAGTTGT {SEQ ID NO:5543}, TAGTTTTGTTATTGGGTTGTTGTTGTTGGAGTTGTT {SEQ ID NO:5544}, GTTTTGTTATTGGGTTGTTGTTGTTGGAGTTGTTTT {SEQ ID NO:5545} |

FIGURE 5 CONTINUED

| | | |
|---|---|---|
| Target585 | chr5:50685784-50685848 | TGTGAGTGGTTTTGGGGTCGGGTAGGG (SEQ ID NO:5546), GGGAATGCGAGGGGGAAGGAGACGTAG (SEQ ID NO:5547), GTAGGGAATGCGAGGGGGAAGGAGACG (SEQ ID NO:5548), TTTTGGGGTCGGGTAGGGAATGCGAGG (SEQ ID NO:5549), GGAATGCGAGGGGGAAGGAGACGTAGC (SEQ ID NO:5550), CGGCGTCGGGTAGTTTGTTTTTCGGGG (SEQ ID NO:5551), ATGGGTAGGGGGGTAAGGATGAGGGGT (SEQ ID NO:5552), GGCGTCGGGTAGTTTGTTTTTCGGGGT (SEQ ID NO:5553), TTCGGGGTATGGGTAGGGGGGTAAGGA (SEQ ID NO:5554), TCGGGGTATGGGTAGGGGGGTAAGGAT (SEQ ID NO:5555) |
| Target586 | chr5:72594949-72594960 | GGCGAGTAGTTTGGTGGTTTTGGCGGT (SEQ ID NO:5556), TCGGACGAGGCGAGTAGTTTGGTGGTT (SEQ ID NO:5557), TTCGGACGAGGCGAGTAGTTTGGTGGT (SEQ ID NO:5558), AGGCGAGTAGTTTGGTGGTTTTGGCGG (SEQ ID NO:5559), CGAGGCGAGTAGTTTGGTGGTTTTGGCG (SEQ ID NO:5560), GCGGAGTTTAGGGCGTACGGTTGTGTC (SEQ ID NO:5561), CGGAGTTTAGGGCGTACGGTTGTGTCG (SEQ ID NO:5562), TGTGTCGTTCGGGTTTGTTTTCGGAGC (SEQ ID NO:5563), GTTTAGCGGTGGTAGTCGGGAGTTCGT (SEQ ID NO:5564), GCGGAGTTTAGGGCGTACGGTTGTGT (SEQ ID NO:5565) |
| Target587 | chr5:72677125-72677162 | AGGTATAGAGGAGGTCGTTTTGTTTTTGCGA (SEQ ID NO:5566), AAGGTATAGAGGAGGTCGTTTTGTTTTTGCGA (SEQ ID NO:5567), AAAGGTATAGAGGAGGTCGTTTTGTTTTTGCG (SEQ ID NO:5568), AAAGGTATAGAGGAGGTCGTTTTGTTTTTGCGA (SEQ ID NO:5569), TAAAGGTATAGAGGAGGTCGTTTTGTTTTTGCGA (SEQ ID NO:5570), GTGGGGGCGGGAGGTGGTTTTGTTTTTT (SEQ ID NO:5571), GGGGGCGGGAGGTGGTTTGTTTTTTTG (SEQ ID NO:5572), TGGGGGCGGGAGGTGGTTTTGTTTTTTTG (SEQ ID NO:5573), GTGGGGGCGGGAGGTGGTTTTGTTTT (SEQ ID NO:5574), AACGTTTGAATTTCGGCGGTTGGAGGC (SEQ ID NO:5575) |
| Target588 | chr5:72677195-72677368 | CGTCGGGGTTTAGGCGTTTGTGAAAGA (SEQ ID NO:5576), CGTCGGGGGTTTAGGCGTTTGTGAAAGAT (SEQ ID NO:5577), GCGTTAGGTCGGTGTAGGAGGGCG (SEQ ID NO:5578), CGTCGGGGTTTAGGCGTTTGTGAAAG (SEQ ID NO:5579), CGTCGGGGTTTAGGCGTTTGTGAAAGATA (SEQ ID NO:5580), TGTCGGGTAGGGGTGGTAGGTCGAGTT (SEQ ID NO:5581), ATGTCGGGTAGGGGTGGTAGGTCGAGT (SEQ ID NO:5582), TGGCGTTGGAGAGAGCGTTCGTTGGAT (SEQ ID NO:5583), GGTTTGGCGTTGGAGAGAGCGTTCGTT (SEQ ID NO:5584), TTTGGCGTTGGAGAGAGCGTTCGTTGG (SEQ ID NO:5585) |
| Target589 | chr5:72677377-72677662 | AGGAGGGCGTTGGGGGTTCGGTTGTTA (SEQ ID NO:5586), TAGGAGGGCGTTGGGGGTTCGGTTTGTT (SEQ ID NO:5587), GTTAGGTCGGTGTAGGAGGGCGTTGGG (SEQ ID NO:5588), CGTTAGGTCGGTGTAGGAGGGCGTTGG (SEQ ID NO:5589), TGTAGGAGGGCGTTGGGGGTTCGGTTTG (SEQ ID NO:5590), CGCGGGTTTGATTTCGTCGGTTCGGAT (SEQ ID NO:5591), GCGGCGTGCGGTTTTTTCGTTCGAATG (SEQ ID NO:5592), GATTTCGTCGGTTCGGATGGATGGGCG (SEQ ID NO:5593), GTTTGTGGCGCGGGTTTGATTTCGTCG (SEQ ID NO:5594), TTCGAGACGGGTATGCGGGAGGAGGAA (SEQ ID NO:5595) |
| Target590 | chr5:72677710-72677737 | TGTTGGGTTCGGGTTTGGTTTAGAGCGT (SEQ ID NO:5596), GTTGGGTTCGGGTTTGGTTTAGAGCGT (SEQ ID NO:5597), TGTTGGGTTCGGGTTTGGTTTAGAGCG (SEQ ID NO:5598), CGTATTCGGGCGGGGAGGTCGTACG (SEQ ID NO:5599), AGGGTTGTTGGGTTCGGGTTTGGTTTA (SEQ ID NO:5600), TCGGGAGGTATTTGGTTGGTTCGGAGT (SEQ ID NO:5601), AGTCGGGAGGTATTTGGTTGGTTCGGA (SEQ ID NO:5602), CGGGTTCGGAGGAGAGGTTCGGGTG (SEQ ID NO:5603), GGGTTCGGAGGAGAGGTTCGGGTGC (SEQ ID NO:5604), GGTTCGGGGTTTCGTATTAGTCGGGAGG (SEQ ID NO:5605) |
| Target591 | chr5:72677755-72677812 | TGTTGGGTTCGGGTTTGGTTTAGAGCGT (SEQ ID NO:5606), GTTGGGTTCGGGTTTGGTTTAGAGCGT (SEQ ID NO:5607), TGTTGGGTTCGGGTTTGGTTTAGAGCG (SEQ ID NO:5608), CGTATTCGGGCGGGGAGGTCGTACG (SEQ ID NO:5609), AGGGTTGTTGGGTTCGGGTTTGGTTTA (SEQ ID NO:5610), TCGGGAGGTATTTGGTTGGTTCGGAGT (SEQ ID NO:5611), AGTCGGGAGGTATTTGGTTGGTTCGGA (SEQ ID NO:5612), GGTTCGGGGTTTCGTATTAGTCGGGAGG (SEQ ID NO:5613), GGTTCGGGGTTTCGTATTAGTCGGGAGGT (SEQ ID NO:5614), GTCGGGAGGTATTTGGTTGGTTCGGAGT (SEQ ID NO:5615) |
| Target592 | chr5:72715325-72715334 | GGGTAGTGGGGAGGGGGCGTTAAGAGT (SEQ ID NO:5616), ATATTTGGTCGGGTAGTGGGGAGGGGG (SEQ ID NO:5617), TATTTGGTCGGGTAGTGGGGAGGGGGC (SEQ ID NO:5618), GGGTAGTGGGGAGGGGGCGTTAAGAGTA (SEQ ID NO:5619), GGGTAGTGGGGAGGGGGCGTTAAGAG (SEQ ID NO:5620), TCGTGGTTAGTTGCGTTCGGTCGTTT (SEQ ID NO:5621), TTCGTGGTTAGTTGCGTTCGGTCGTTT (SEQ ID NO:5622), ATTCGTGGTTAGTTGCGTTCGGTCGTT (SEQ ID NO:5623), CGTGGTTAGTTGCGTTCGGTCGTTTTC (SEQ ID NO:5624), TCGTGGTTAGTTGCGTTCGGTCGTTTC (SEQ ID NO:5625) |
| Target593 | chr5:72715408-72715469 | TTGGTTTGTTTGGATTGTCGGGTCGGC (SEQ ID NO:5626), GCGGTTTGGTTTGTTTGGATTGTCGGGT (SEQ ID NO:5627), GCGGTTTGGTTTGTTTGGATTGTCGGG (SEQ ID NO:5628), AGCGGTTTGGTTTGTTTGGATTGTCGGG (SEQ ID NO:5629), AGCGGTTTGGTTTGTTTGGATTGTCGGGT (SEQ ID NO:5630), TTTCGGTGGTTTGGTTTTTTCGCGCGG (SEQ ID NO:5631), GTTTCGGTGGTTTGGTTTTTTCGCGCGG (SEQ ID NO:5632), CGTTTCGGTGGTTTGGTTTTTTCGCGCG (SEQ ID NO:5633), GTTTCGGTGGTTTGGTTTTTTCGCGCG (SEQ ID NO:5634), CGTTTCGGTGGTTTGGTTTTTTCGCGC (SEQ ID NO:5635) |

FIGURE 5 CONTINUED

| Target594 | chr5:72715485-72715515 | CGCGGAGGAGTTAGATTATCGGGGCGT (SEQ ID NO:5636), TCGCGCGGAGGAGTTAGATTATCGGGG (SEQ ID NO:5637), GTCGCGCGGAGGAGTTAGATTATCGGGG (SEQ ID NO:5638), GTCGCGCGGAGGAGTTAGATTATCGGG (SEQ ID NO:5639), CGCGGAGGAGTTAGATTATCGGGGCGTA (SEQ ID NO:5640) |
|---|---|---|
| Target595 | chr5:76249401-76249527 | AAGCGGGAGTTGGTTGGGGAGTAGTCG (SEQ ID NO:5641), GGTTGGGGAGTAGTCGTATCGTCGCGT (SEQ ID NO:5642), TGGTTGGGGAGTAGTCGTATCGTCGCG (SEQ ID NO:5643), GCGGGAGTTGGTTGGGGAGTAGTCGTA (SEQ ID NO:5644), TGAAGCGGGAGTTGGTTGGGGAGTAGT (SEQ ID NO:5645), TGGCGTTGAAGAGTAGGAAAGGATCGT (SEQ ID NO:5646), GGTTGGCGTTGAAGAGTAGGAAAGGATCG (SEQ ID NO:5647), GGTTGGCGTTGAAGAGTAGGAAAGGATCGT (SEQ ID NO:5648), TTGGCGTTGAAGAGTAGGAAAGGATCGT (SEQ ID NO:5649), AGGTTGGCGTTGAAGAGTAGGAAAGGATCG (SEQ ID NO:5650) |
| Target596 | chr5:76249541-76249811 | AGGTGGGATTTTGTGCGGGGGGGTAGAG (SEQ ID NO:5651), AGGTTGGAAGTCGGGGCGTTGGGTATT (SEQ ID NO:5652), TTTAGGTTGGAAGTCGGGGCGTTGGGT (SEQ ID NO:5653), AAGCGGGAGTTGGTTGGGGAGTAGTCG (SEQ ID NO:5654), AAGGTGGGATTTTGTGCGGGGGGTAGA (SEQ ID NO:5655), CGGTCGGCGGTGAAGGTGAATTGGTTT (SEQ ID NO:5656), TCGGTCGGCGGTGAAGGTGAATTGGTT (SEQ ID NO:5657), TTGCGTAGTGTAGTTGCGGTCGGTCGG (SEQ ID NO:5658), GTCGGTCGGCGGTGAAGGTGAATTGGT (SEQ ID NO:5659), GTCGGTCGGCGGTGAAGGTGAATTGG (SEQ ID NO:5660) |
| Target597 | chr5:77140543-77140645 | GCGTGGGGAGAATTGGAGCGGTTGTTC (SEQ ID NO:5661), TGGGGAGAATTGGAGCGGTTGTTCGGA (SEQ ID NO:5662), GGTTGTGGGGAGGTGGTGTGGGAGTAC (SEQ ID NO:5663), CGTGGGGAGAATTGGAGCGGTTGTTCG (SEQ ID NO:5664), GAGGTGGTGTGGGAGTACGGTCGTTGT (SEQ ID NO:5665), CGGGGGCGTTCGGGGTAGTCGTTTTAGT (SEQ ID NO:5666), AAAGTATTCGGGATTAGGGCGGGGGCG (SEQ ID NO:5667), GAGGGGGTTGGGGGGGTGAGTGGAAATA (SEQ ID NO:5668), GTATTCGGGATTAGGGCGGGGGCGTTC (SEQ ID NO:5669), AGGGGGGTTGGGGGGGTGAGTGGAAATAA (SEQ ID NO:5670) |
| Target598 | chr5:77140667-77140698 | GCGTGGGGAGAATTGGAGCGGTTGTTC (SEQ ID NO:5671), TGGGGAGAATTGGAGCGGTTGTTCGGA (SEQ ID NO:5672), GGTTGTGGGGAGGTGGTGTGGGAGTAC (SEQ ID NO:5673), CGTGGGGAGAATTGGAGCGGTTGTTCG (SEQ ID NO:5674), GAGGTGGTGTGGGAGTACGGTCGTTGT (SEQ ID NO:5675), GTTTCGGGGAGGGCGCGATGTGTTTTT (SEQ ID NO:5676), TTTCGGGGAGGGCGCGATGTGTTTTTT (SEQ ID NO:5677), GAGGGGGTTGGGGGGGTGAGTGGAAATA (SEQ ID NO:5678), GTTTGGAATTAGGACGGCGGGAGGGGG (SEQ ID NO:5679), GGTTTGGAATTAGGACGGCGGGAGGGG (SEQ ID NO:5680) |
| Target599 | chr5:77140757-77140827 | AGGTTGTCGGGGAGGGGGTATATCGCG (SEQ ID NO:5681), TAGGTTGTCGGGGAGGGGGTATATCGC (SEQ ID NO:5682), GGTTGTCGGGGAGGGGGTATATCGCG (SEQ ID NO:5683), TCGGTTTGGTTGTAGTCGCGTGGATGT (SEQ ID NO:5684), TAGGTTGTCGGGGAGGGGGTATATCGCG (SEQ ID NO:5685), GACGACGGGGTAGTGGAGGGATGTTCG (SEQ ID NO:5686), GAGGAGACGACGGGGTAGTGGAGGGAT (SEQ ID NO:5687), AGAGAGTGGAAGGAGGAGACGACGGGG (SEQ ID NO:5688), GTTTCGGGGAGGGCGCGATGTGTTTTT (SEQ ID NO:5689), TTTCGGGGAGGGCGCGATGTGTTTTT (SEQ ID NO:5690) |
| Target600 | chr5:77140834-77140914 | TCGTGGGGAGCGTTCGAGTAGGTAGGG (SEQ ID NO:5691), GTGGGGAGCGTTCGAGTAGGTAGGGTT (SEQ ID NO:5692), CGTGGGGAGCGTTCGAGTAGGTAGGGT (SEQ ID NO:5693), AGGTTGTCGGGGAGGGGGTATATCGCG (SEQ ID NO:5694), CGTGGGGAGCGTTCGAGTAGGTAGGG (SEQ ID NO:5695), GACGACGGGGTAGTGGAGGGATGTTCG (SEQ ID NO:5696), GAGGAGACGACGGGGTAGTGGAGGGAT (SEQ ID NO:5697), AGAGAGTGGAAGGAGGAGACGACGGGG (SEQ ID NO:5698), GGAAGGAGGAGACGACGGGGTAGTGGA (SEQ ID NO:5699), AAGGAGGAGACGACGGGGTAGTGGAGG (SEQ ID NO:5700) |
| Target601 | chr5:115912075-115912099 | GGGGCGGTGGGTAGGATTGCGTTTTTT (SEQ ID NO:5701), TATAGATTTGGGGTAGTGGGGGGCGCG (SEQ ID NO:5702), TAGTTTCGGGAGGGGGTTGGGGAGTGT (SEQ ID NO:5703), GTTAGTTTCGGGAGGGGGTTGGGGAGT (SEQ ID NO:5704), TTAGTTTCGGGAGGGGGTTGGGGAGTG (SEQ ID NO:5705), CGCGGGATTTTGAGGAGACGTTTTGGA (SEQ ID NO:5706), TCGCGGGATTTTGAGGAGACGTTTTGG (SEQ ID NO:5707), TCGCGGGATTTTGAGGAGACGTTTTGGA (SEQ ID NO:5708), CGCGGGATTTTGAGGAGACGTTTTGGAG (SEQ ID NO:5709), CGCGGGATTTTGAGGAGACGTTTTGGAGT (SEQ ID NO:5710) |
| Target602 | chr5:115912143-115912177 | GGGGCGGTGGGTAGGATTGCGTTTTTT (SEQ ID NO:5711), GCGGGGTTAGGAGAAGGATTTGGCGGT (SEQ ID NO:5712), TAGTTTCGGGAGGGGGTTGGGGAGTGT (SEQ ID NO:5713), GTTAGTTTCGGGAGGGGGTTGGGGAGT (SEQ ID NO:5714), TTAGTTTCGGGAGGGGGTTGGGGAGTG (SEQ ID NO:5715), AAGGGGTTGTAGTATCGCGTTTGGGGC (SEQ ID NO:5716), GAAGGGGTTGTAGTATCGCGTTTGGGC (SEQ ID NO:5717), CGAAGGGGTTGTAGTATCGCGTTTGGGG (SEQ ID NO:5718), TCGAAGGGGTTGTAGTATCGCGTTTGGGG (SEQ ID NO:5719), AGGGGTTGTAGTATCGCGTTTGGGGC (SEQ ID NO:5720) |
| Target603 | chr5:115912257-115912294 | GCGGGGTTAGGAGAAGGATTTGGCGGT (SEQ ID NO:5721), CGCGGGGTTAGGAGAAGGATTTGGCGG (SEQ ID NO:5722), TTCGCGGGGTTAGGAGAAGGATTTGGC (SEQ ID NO:5723), CGGGGTTAGGAGAAGGATTTGGCGGTT (SEQ ID NO:5724), CGCGGGGTTAGGAGAAGGATTTGGCG (SEQ ID NO:5725), CGGTTGGGTGGAGCGCGGGATAAAAAA (SEQ ID NO:5726), AGGGGTTGTAGTATCGCGTTTGGGGC (SEQ ID NO:5727), CGGTTGGGTGGAGCGCGGGATAAAAAAT |

FIGURE 5 CONTINUED

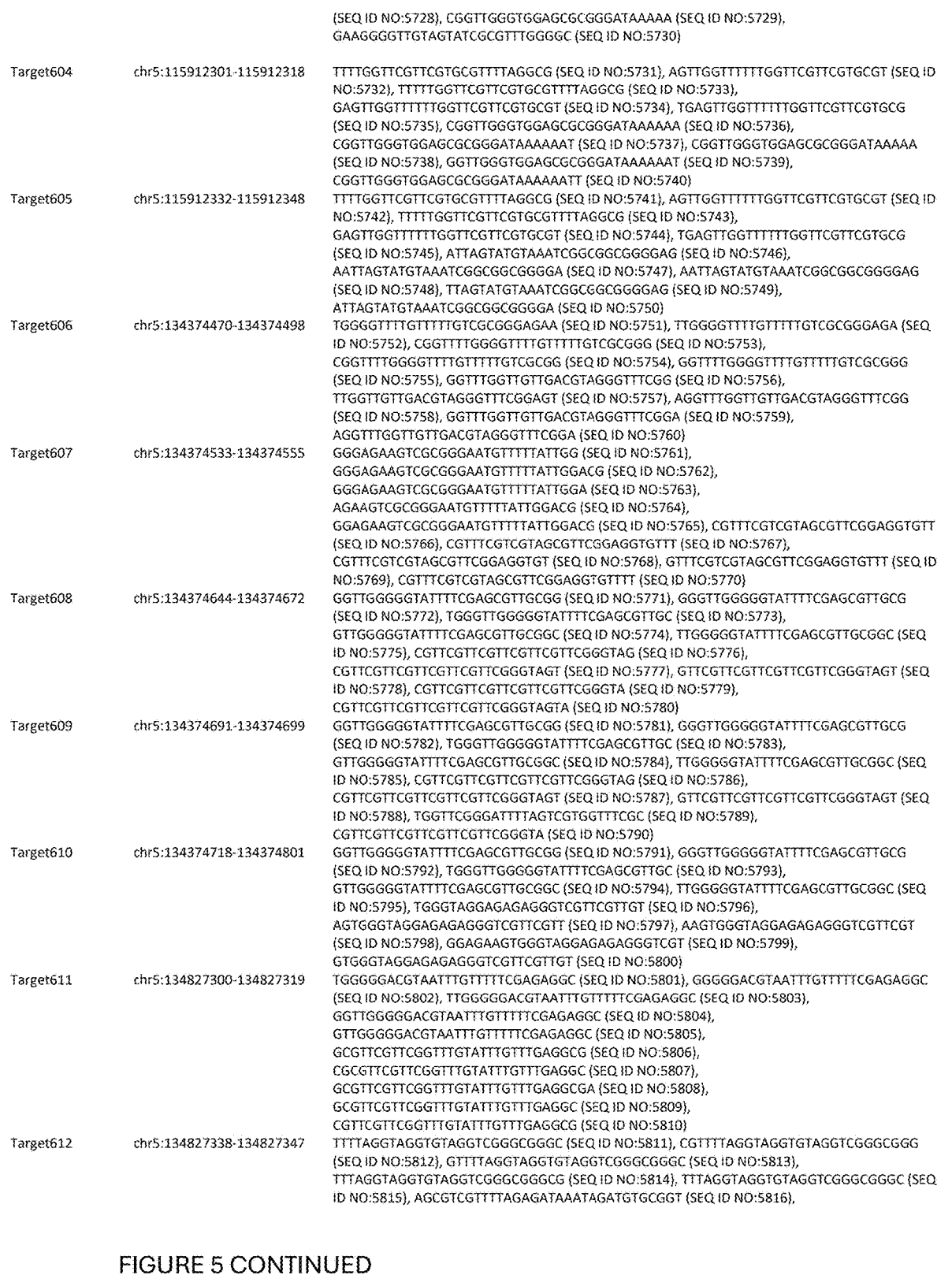

{SEQ ID NO:5728}, CGGTTGGGTGGAGCGCGGGATAAAAA {SEQ ID NO:5729},
GAAGGGGTTGTAGTATCGCGTTTGGGGC {SEQ ID NO:5730}

Target604    chr5:115912301-115912318    TTTTGGTTCGTTCGTGCGTTTAGGCG {SEQ ID NO:5731}, AGTTGGTTTTTTGGTTCGTTCGTGCGT {SEQ ID
NO:5732}, TTTTTGGTTCGTTCGTGCGTTTTAGGCG {SEQ ID NO:5733},
GAGTTGGTTTTTTGGTTCGTTCGTGCGT {SEQ ID NO:5734}, TGAGTTGGTTTTTTGGTTCGTTCGTGCG
{SEQ ID NO:5735}, CGGTTGGGTGGAGCGCGGGATAAAAAA {SEQ ID NO:5736},
CGGTTGGGTGGAGCGCGGGATAAAAAAT {SEQ ID NO:5737}, CGGTTGGGTGGAGCGCGGGATAAAAA
{SEQ ID NO:5738}, GGTTGGGTGGAGCGCGGGATAAAAAAT {SEQ ID NO:5739},
CGGTTGGGTGGAGCGCGGGATAAAAAATT {SEQ ID NO:5740}

Target605    chr5:115912332-115912348    TTTTGGTTCGTTCGTGCGTTTTAGGCG {SEQ ID NO:5741}, AGTTGGTTTTTTGGTTCGTTCGTGCGT {SEQ ID
NO:5742}, TTTTTGGTTCGTTCGTGCGTTTTAGGCG {SEQ ID NO:5743},
GAGTTGGTTTTTTGGTTCGTTCGTGCGT {SEQ ID NO:5744}, TGAGTTGGTTTTTTGGTTCGTTCGTGCG
{SEQ ID NO:5745}, ATTAGTATGTAAATCGGCGGCGGGGAG {SEQ ID NO:5746},
AATTAGTATGTAAATCGGCGGCGGGGA {SEQ ID NO:5747}, AATTAGTATGTAAATCGGCGGCGGGGAG
{SEQ ID NO:5748}, TTAGTATGTAAATCGGCGGCGGGGAG {SEQ ID NO:5749},
ATTAGTATGTAAATCGGCGGCGGGGA {SEQ ID NO:5750}

Target606    chr5:134374470-134374498    TGGGGTTTTGTTTTTGTCGCGGGAGAA {SEQ ID NO:5751}, TTGGGGTTTTGTTTTTGTCGCGGGAGA {SEQ
ID NO:5752}, CGGTTTTGGGGTTTTGTTTTTGTCGCGGG {SEQ ID NO:5753},
CGGTTTTGGGGTTTTGTTTTTGTCGCGG {SEQ ID NO:5754}, GGTTTTGGGGTTTTGTTTTTGTCGCGGG
{SEQ ID NO:5755}, GGTTTGGTTGTTGACGTAGGGTTTCGG {SEQ ID NO:5756},
TTGGTTGTTGACGTAGGGTTTCGGAGT {SEQ ID NO:5757}, AGGTTTGGTTGTTGACGTAGGGTTTCGG
{SEQ ID NO:5758}, GGTTTGGTTGTTGACGTAGGGTTTCGGA {SEQ ID NO:5759},
AGGTTTGGTTGTTGACGTAGGGTTTCGG {SEQ ID NO:5760}

Target607    chr5:134374533-134374555    GGGAGAAGTCGCGGGAATGTTTTTATTGG {SEQ ID NO:5761},
GGGAGAAGTCGCGGGAATGTTTTTATTGGACG {SEQ ID NO:5762},
GGGAGAAGTCGCGGGAATGTTTTTATTGGA {SEQ ID NO:5763},
AGAAGTCGCGGGAATGTTTTTATTGGACG {SEQ ID NO:5764},
GGAGAAGTCGCGGGAATGTTTTTATTGGACG {SEQ ID NO:5765}, CGTTTCGTCGTAGCGTTCGGAGGTGTT
{SEQ ID NO:5766}, CGTTTCGTCGTAGCGTTCGGAGGTGTTT {SEQ ID NO:5767},
CGTTTCGTCGTAGCGTTCGGAGGTGT {SEQ ID NO:5768}, GTTTCGTCGTAGCGTTCGGAGGTGTTT {SEQ ID
NO:5769}, CGTTTCGTCGTAGCGTTCGGAGGTGTTTT {SEQ ID NO:5770}

Target608    chr5:134374644-134374672    GGTTGGGGGTATTTTCGAGCGTTGCGG {SEQ ID NO:5771}, GGGTTGGGGGTATTTTCGAGCGTTGCG
{SEQ ID NO:5772}, TGGGTTGGGGGTATTTTCGAGCGTTGC {SEQ ID NO:5773},
GTTGGGGGTATTTTCGAGCGTTGCGG {SEQ ID NO:5774}, TTGGGGGTATTTTCGAGCGTTGCGGC {SEQ
ID NO:5775}, CGTTCGTTCGTTCGTTCGTTCGGGTAG {SEQ ID NO:5776},
CGTTCGTTCGTTCGTTCGTTCGGGTAGT {SEQ ID NO:5777}, GTTCGTTCGTTCGTTCGTTCGGGTAGT {SEQ
ID NO:5778}, CGTTCGTTCGTTCGTTCGTTCGGGTA {SEQ ID NO:5779},
CGTTCGTTCGTTCGTTCGTTCGGGTAGTA {SEQ ID NO:5780}

Target609    chr5:134374691-134374699    GGTTGGGGGTATTTTCGAGCGTTGCGG {SEQ ID NO:5781}, GGGTTGGGGGTATTTTCGAGCGTTGCG
{SEQ ID NO:5782}, TGGGTTGGGGGTATTTTCGAGCGTTGC {SEQ ID NO:5783},
GTTGGGGGTATTTTCGAGCGTTGCGGC {SEQ ID NO:5784}, TTGGGGGTATTTTCGAGCGTTGCGGC {SEQ
ID NO:5785}, CGTTCGTTCGTTCGTTCGTTCGGGTAG {SEQ ID NO:5786},
CGTTCGTTCGTTCGTTCGTTCGGGTAGT {SEQ ID NO:5787}, GTTCGTTCGTTCGTTCGTTCGGGTAGT {SEQ
ID NO:5788}, TGGTTCGGGATTTTAGTCGTGGTTTCGC {SEQ ID NO:5789},
CGTTCGTTCGTTCGTTCGGGTA {SEQ ID NO:5790}

Target610    chr5:134374718-134374801    GGTTGGGGGTATTTTCGAGCGTTGCGG {SEQ ID NO:5791}, GGGTTGGGGGTATTTTCGAGCGTTGCG
{SEQ ID NO:5792}, TGGGTTGGGGGTATTTTCGAGCGTTGC {SEQ ID NO:5793},
GTTGGGGGTATTTTCGAGCGTTGCGGC {SEQ ID NO:5794}, TTGGGGGTATTTTCGAGCGTTGCGGC {SEQ
ID NO:5795}, TGGGTAGGAGAGAGGGTCGTTCGTTGT {SEQ ID NO:5796},
AGTGGGTAGGAGAGAGGGTCGTTCGTT {SEQ ID NO:5797}, AAGTGGGTAGGAGAGAGGGTCGTTCGT
{SEQ ID NO:5798}, GGAGAAGTGGGTAGGAGAGAGGGTCGT {SEQ ID NO:5799},
GTGGGTAGGAGAGAGGGTCGTTCGTTGT {SEQ ID NO:5800}

Target611    chr5:134827300-134827319    TGGGGGACGTAATTTGTTTTTCGAGAGGC {SEQ ID NO:5801}, GGGGGACGTAATTTGTTTTTCGAGAGGC
{SEQ ID NO:5802}, TTGGGGGACGTAATTTGTTTTTCGAGAGGC {SEQ ID NO:5803},
GGTTGGGGGACGTAATTTGTTTTTCGAGAGGC {SEQ ID NO:5804},
GTTGGGGGACGTAATTTGTTTTTCGAGAGGC {SEQ ID NO:5805},
GCGTTCGTTCGGTTTGTATTTGTTTGAGCG {SEQ ID NO:5806},
CGCGTTCGTTCGGTTTGTATTTGTTTGAGGC {SEQ ID NO:5807},
GCGTTCGTTCGGTTTGTATTTGTTTGAGGCGA {SEQ ID NO:5808},
GCGTTCGTTCGGTTTGTATTTGTTTGAGGC {SEQ ID NO:5809},
CGTTCGTTCGGTTTGTATTTGTTTGAGGCG {SEQ ID NO:5810}

Target612    chr5:134827338-134827347    TTTTAGGTAGGTGTAGGTCGGGCGGGC {SEQ ID NO:5811}, CGTTTTAGGTAGGTGTAGGTCGGGCGGG
{SEQ ID NO:5812}, GTTTTAGGTAGGTGTAGGTCGGGCGGGC {SEQ ID NO:5813},
TTTAGGTAGGTGTAGGTCGGGCGGGCG {SEQ ID NO:5814}, TTTAGGTAGGTGTAGGTCGGGCGGGC {SEQ
ID NO:5815}, AGCGTCGTTTTAGAGATAAATAGATGTGCGGT {SEQ ID NO:5816},

FIGURE 5 CONTINUED

|  |  |  |
|---|---|---|
|  |  | AGCGTCGTTTTAGAGATAAATAGATGTGCGGTT (SEQ ID NO:5817), |
|  |  | TAGCGTCGTTTTAGAGATAAATAGATGTGCGGT (SEQ ID NO:5818), |
|  |  | GCGTCGTTTTAGAGATAAATAGATGTGCGGTTT (SEQ ID NO:5819), |
|  |  | AGCGTCGTTTTAGAGATAAATAGATGTGCGGTTT (SEQ ID NO:5820) |
| Target613 | chr5:134827413-134827494 | GGGGCGGGGTAGGGGCGTTATTTTTTG (SEQ ID NO:5821), TTTTAGGTAGGTGTAGGTCGGGCGGGC (SEQ ID NO:5822), TGGGGCGGGGTAGGGGCGTTATTTTTT (SEQ ID NO:5823), GGGCGGGGTAGGGGCGTTATTTTTTGA (SEQ ID NO:5824), GTGGGGCGGGGTAGGGGCGTTATTTTT (SEQ ID NO:5825), TATTTAGACGGAGGAGGGGCGGGAGGT (SEQ ID NO:5826), AGGAGGGGCGGGAGGTTTTGTTTTCGA (SEQ ID NO:5827), GAGGAGGGGCGGGAGGTTTTGTTTTCG (SEQ ID NO:5828), GCGTTTTAGGATGGGGTGCGTAGTGGG (SEQ ID NO:5829), TGGGGTGCGTAGTGGGTAGTTAAGCGT (SEQ ID NO:5830) |
| Target614 | chr5:134870741-134870766 | AAGGAGAAAATAGGGTCGTCGGGGCGG (SEQ ID NO:5831), AAAATAGGGTCGTCGGGGCGGTAGGTG (SEQ ID NO:5832), GAAAATAGGGTCGTCGGGGCGGTAGGT (SEQ ID NO:5833), AGAAAATAGGGTCGTCGGGGCGGTAGG (SEQ ID NO:5834), GGAGAAAATAGGGTCGTCGGGGCGGTA (SEQ ID NO:5835), GCGACGCGGAGTTTTGGGGTTTAGGTG (SEQ ID NO:5836), AGCGACGCGGAGTTTTGGGGTTTAGGT (SEQ ID NO:5837), CGCGGAGTTTTGGGGTTTAGGTGTCGT (SEQ ID NO:5838), ACGCGGAGTTTTGGGGTTTAGGTGTCG (SEQ ID NO:5839), CGACGCGGAGTTTTGGGGTTTAGGTGT (SEQ ID NO:5840) |
| Target615 | chr5:134870796-134870808 | AAGGAGAAAATAGGGTCGTCGGGGCGG (SEQ ID NO:5841), AAAATAGGGTCGTCGGGGCGGTAGGTG (SEQ ID NO:5842), TCGGGGCGGTAGGTGAAGTTTTCGGAG (SEQ ID NO:5843), TTCGGAGGCGGTTGGGTTATTGGGGTT (SEQ ID NO:5844), TTTCGGAGGCGGTTGGGTTATTGGGGT (SEQ ID NO:5845), GCGACGCGGAGTTTTGGGGTTTAGGTG (SEQ ID NO:5846), AGCGACGCGGAGTTTTGGGGTTTAGGT (SEQ ID NO:5847), CGGATTAAGGGTTGTTCGGAGGCGGTG (SEQ ID NO:5848), CGCGGAGTTTTGGGGTTTAGGTGTCGT (SEQ ID NO:5849), ACGCGGAGTTTTGGGGTTTAGGTGTCG (SEQ ID NO:5850) |
| Target616 | chr5:134870832-134870936 | AAGGAGAAAATAGGGTCGTCGGGGCGG (SEQ ID NO:5851), AAAATAGGGTCGTCGGGGCGGTAGGTG (SEQ ID NO:5852), TTCGGAGGCGGTTGGGTTATTGGGGTT (SEQ ID NO:5853), TTTCGGAGGCGGTTGGGTTATTGGGGT (SEQ ID NO:5854), GAAAATAGGGTCGTCGGGGCGGTAGGT (SEQ ID NO:5855), CGGATTAAGGGTTGTTCGGAGGCGGTG (SEQ ID NO:5856), TTGGCGGATTAAGGGTTGTTCGGAGGC (SEQ ID NO:5857), TGGCGGATTAAGGGTTGTTCGGAGGCG (SEQ ID NO:5858), GCGGATTAAGGGTTGTTCGGAGGCGGT (SEQ ID NO:5859), GGTGTTCGGGAGCGTTTTTTGTCGTCG (SEQ ID NO:5860) |
| Target617 | chr5:134870972-134870983 | TTTGGGGGATCGGGTAGGTAGGGGACG (SEQ ID NO:5861), TGGGGGATCGGGTAGGTAGGGGACGTA (SEQ ID NO:5862), GGGGGATCGGGTAGGTAGGGGACGTA (SEQ ID NO:5863), TTGGGGGATCGGGTAGGTAGGGGACG (SEQ ID NO:5864), TTGGGGGATCGGGTAGGTAGGGGACGT (SEQ ID NO:5865), TCGTATGTATAATTTGAACGCGGTTTTGGACG (SEQ ID NO:5866), ATCGTATGTATAATTTGAACGCGGTTTTGGACG (SEQ ID NO:5867), AATCGTATGTATAATTTGAACGCGGTTTTGGACG (SEQ ID NO:5868), TAATCGTATGTATAATTTGAACGCGGTTTTGGACG (SEQ ID NO:5869), CGTAATCGTATGTATAATTTGAACGCGGTTTTGGA (SEQ ID NO:5870) |
| Target618 | chr5:134871011-134871140 | TTGGTGAGTTTGGTGTCGTCGGGGAAC (SEQ ID NO:5871), TTTGGTGAGTTTGGTGTCGTCGGGGAA (SEQ ID NO:5872), TTTTGGTGAGTTTGGTGTCGTCGGGGA (SEQ ID NO:5873), TTTGGTGAGTTTGGTGTCGTCGGGGAAC (SEQ ID NO:5874), TGGTGAGTTTGGTGTCGTCGGGGAAC (SEQ ID NO:5875), CGTCGGTTCGTAGGGGCGCGTTTAATA (SEQ ID NO:5876), TATAGGACGACGAGTAGGAGAGGCGGC (SEQ ID NO:5877), CGTCGGTTCGTAGGGGCGCGTTTAAT (SEQ ID NO:5878), GTATAGGACGACGAGTAGGAGAGGCGGC (SEQ ID NO:5879), GTTGTATTCGTTGCGTAGGAGTCGGCG (SEQ ID NO:5880) |
| Target619 | chr5:134880147-134880156 | GGGAGGCGGAGGTTGTAGTGAGTCGAG (SEQ ID NO:5881), TTCGGGAGGCGGAGGTTGTAGTGAGTC (SEQ ID NO:5882), CGTTTGAATTCGGGAGGCGGAGGTTGT (SEQ ID NO:5883), TCGTTTGAATTCGGGAGGCGGAGGTTG (SEQ ID NO:5884), ATTCGGGAGGCGGAGGTTGTAGTGAGT (SEQ ID NO:5885), GGGGAGGGGCGGGGGGTTAGAATGTTTT (SEQ ID NO:5886), GGGGAGGGGCGGGGGTTAGAATGTTTT (SEQ ID NO:5887), GGGGAGGGGCGGGGGTTAGAATGTTT (SEQ ID NO:5888), GGGGAGGGGCGGGGGGTTAGAATGTTTTT (SEQ ID NO:5889), CGGGGAGGGGCGGGGGTTAGAATGTTT (SEQ ID NO:5890) |
| Target620 | chr5:140800769-140800814 | TCGGTTTAGAGTTTGTTATGGCGAATCGGT (SEQ ID NO:5891), CGGTTTAGAGTTTGTTATGGCGAATCGGTT (SEQ ID NO:5892), CGCGGAATATCGGTTTAGAGTTTGTTATGGCG (SEQ ID NO:5893), TCGGTTTAGAGTTTGTTATGGCGAATCGGTT (SEQ ID NO:5894), ATCGGTTTAGAGTTTGTTATGGCGAATCGGT (SEQ ID NO:5895), CGCGTTGTAGTCGATTCGTTATGGTAGGT (SEQ ID NO:5896), TCGCGTTGTAGTCGATTCGTTATGGTAGG (SEQ ID NO:5897), TCGCGTTGTAGTCGATTCGTTATGGTAGGT (SEQ ID NO:5898), CGCGTTGTAGTCGATTCGTTATGGTAGGTT (SEQ ID NO:5899), TCGCGTTGTAGTCGATTCGTTATGGTAGGTT (SEQ ID NO:5900) |
| Target621 | chr5:140800815-140800829 | TCGGTTTAGAGTTTGTTATGGCGAATCGGT (SEQ ID NO:5901), CGGTTTAGAGTTTGTTATGGCGAATCGGTT (SEQ ID NO:5902), CGCGGAATATCGGTTTAGAGTTTGTTATGGCG (SEQ ID NO:5903), |

FIGURE 5 CONTINUED

TCGGTTTAGAGTTTGTTATGGCGAATCGGTT (SEQ ID NO:5904),
ATCGGTTTAGAGTTTGTTATGGCGAATCGGT (SEQ ID NO:5905),
CGGATTTGTTTGGTTCGGAATTTTCGTAGCG (SEQ ID NO:5906),
CGGATTTGTTTGGTTCGGAATTTTCGTAGCGT (SEQ ID NO:5907),
TCGGATTTGTTTGGTTCGGAATTTTCGTAGCG (SEQ ID NO:5908),
TCGGATTTGTTTGGTTCGGAATTTTCGTAGCGT (SEQ ID NO:5909),
GGATTTGTTTGGTTCGGAATTTTCGTAGCGT (SEQ ID NO:5910)

Target622    chr5:140800862-140800930    CGTTGCGGGGGTTTCGGGTTAGGTAGA (SEQ ID NO:5911), GACGTTGCGGGGGTTTCGGGTTAGGTA (SEQ ID NO:5912), ACGTTGCGGGGGTTTCGGGTTAGGTAG (SEQ ID NO:5913), TTTTTTGGGGACGTTGCGGGGGTTTCG (SEQ ID NO:5914), ACGTTGCGGGGGTTTCGGGTTAGGTA (SEQ ID NO:5915), CGCGTTTCGTTAGTTTTCGGGGTTTTAGT (SEQ ID NO:5916), CGCGTTTCGTTAGTTTTCGGGGTTTTAGTT (SEQ ID NO:5917), CGCGTTTCGTTAGTTTTCGGGGTTTTAGTTT (SEQ ID NO:5918), CGCGTTTCGTTAGTTTTCGGGGTTTTAGTTTT (SEQ ID NO:5919), CGCGTTTCGTTAGTTTTCGGGGTTTTAGTTTTA (SEQ ID NO:5920)

Target623    chr5:140800981-140800996    CGTTGCGGGGGTTTCGGGTTAGGTAGA (SEQ ID NO:5921), GACGTTGCGGGGGTTTCGGGTTAGGTA (SEQ ID NO:5922), ACGTTGCGGGGGTTTCGGGTTAGGTAG (SEQ ID NO:5923), GGGTTGGAGTTTCGGGAGTTGGCGAAG (SEQ ID NO:5924), TTTGGGGTTGGAGTTTCGGGAGTTGGC (SEQ ID NO:5925), ATTTTGTTTGTCGTGATTAAGTTGTCGTTTCGC (SEQ ID NO:5926), TCGGTTTATTTTGTTTGTCGTGATTAAGTTGTCGT (SEQ ID NO:5927), TCGGTTTATTTTGTTTGTCGTGATTAAGTTGTCGTT (SEQ ID NO:5928), TTCGGTTTATTTTGTTTGTCGTGATTAAGTTGTCGT (SEQ ID NO:5929), TTTATTTTGTTTGTCGTGATTAAGTTGTCGTTTCGC (SEQ ID NO:5930)

Target624    chr5:140801033-140801091    GGGTTGGAGTTTCGGGAGTTGGCGAAG (SEQ ID NO:5931), TTTGGGGTTGGAGTTTCGGGAGTTGGC (SEQ ID NO:5932), GGGGTTGGAGTTTCGGGAGTTGGCGAA (SEQ ID NO:5933), TTGGGGTTGGAGTTTCGGGAGTTGGCG (SEQ ID NO:5934), GGGGTTGGAGTTTCGGGAGTTGGCGA (SEQ ID NO:5935), TCGGTTTATTTTGTTTGTCGTGATTAAGTTGTCGT (SEQ ID NO:5936), TCGGTTTATTTTGTTTGTCGTGATTAAGTTGTCGTT (SEQ ID NO:5937), TTCGGTTTATTTTGTTTGTCGTGATTAAGTTGTCGT (SEQ ID NO:5938)

Target625    chr5:140892549-140892926    AGGTGGGTGTTGGAAGAAGGGCGGAAT (SEQ ID NO:5939), GGTGGGGATTTGAGTGCGGCGTGTTAG (SEQ ID NO:5940), ATCGGTTCGTTGTGGGGGTGGGGATTT (SEQ ID NO:5941), AGGTAGAAGAGGAGATTTCGGCGCGGG (SEQ ID NO:5942), GAGGTGGGTGTTGGAAGAAGGGCGGAA (SEQ ID NO:5943), GGGGGTGCGGGGGGTAAAGGAGAGTTTA (SEQ ID NO:5944), AAGTTTTTCGGGGCGTTTCGGGTAGGT (SEQ ID NO:5945), GGGGGTGCGGGGGGTAAAGGAGAGTTT (SEQ ID NO:5946), TGGGGGTGCGGGGGGTAAAGGAGAGTTT (SEQ ID NO:5947), GGGGGTGCGGGGGGTAAAGGAGAGTTTAT (SEQ ID NO:5948)

Target626    chr5:140892953-140893456    GAGTGGGAGGGAATGCGGGAGGTGATT (SEQ ID NO:5949), AGGTAGAAGAGGAGATTTCGGCGCGGG (SEQ ID NO:5950), AGCGTTTCGGAGGGGTTTTACGGGAGGA (SEQ ID NO:5951), AGTGGGAGGGAATGCGGGAGGTGATTT (SEQ ID NO:5952), GCGTTTCGGAGGGGTTTTACGGGAGGAG (SEQ ID NO:5953), CGGGGAAGTAGGGGAGAGTAGGCGAGTGA (SEQ ID NO:5954), GGGGGTGCGGGGGGTAAAGGAGAGTTTA (SEQ ID NO:5955), ATTTTTAGGTAGCGGGGGGTGGGGGTGC (SEQ ID NO:5956), AGGGAGGGGAGTTGAGTTTGCGATGGA (SEQ ID NO:5957), AAGGAGGGAGGGGAGTTGAGTTTGCGA (SEQ ID NO:5958)

Target627    chr5:149979264-149979770    GATGGAGGGCGAGAGGGGATTTGGGAG (SEQ ID NO:5959), TGTATTGTGAGTTTGGGGGTCGGCGGT (SEQ ID NO:5960), GGAGGGCGAGAGGGGATTTGGGAGTTG (SEQ ID NO:5961), GTATTGTGAGTTTGGGGGTCGGCGGTG (SEQ ID NO:5962), AGATGGAGGGCGAGAGGGGATTTGGGA (SEQ ID NO:5963), GGGTGACGTTAGTAGGGTTGGGAATGGGG (SEQ ID NO:5964), GGGGTGACGTTAGTAGGGTTGGGAATGGG (SEQ ID NO:5965), GGTGACGTTAGTAGGGTTGGGAATGGGGT (SEQ ID NO:5966), GGTGACGTTAGTAGGGTTGGGAATGGGG (SEQ ID NO:5967), GGGTGACGTTAGTAGGGTTGGGAATGGG (SEQ ID NO:5968)

Target628    chr5:153862183-153862194    GGTTTTTGGAAGTTTAGGTCGCGGCGT (SEQ ID NO:5969), AGGTTTTTGGAAGTTTAGGTCGCGGCGT (SEQ ID NO:5970), AGGTTTTTGGAAGTTTAGGTCGCGGCG (SEQ ID NO:5971), GGTTTTTGGAAGTTTAGGTCGCGGCGTT (SEQ ID NO:5972), TGGACGTTTTGTAGTGGTGGGGTTTCGT (SEQ ID NO:5973), GCGGGGATTGTTCGTGGCGTTAAGGTT (SEQ ID NO:5974), GTGCGGGGATTGTTCGTGGCGTTAAGG (SEQ ID NO:5975), GGTGCGGGGATTGTTCGTGGCGTTAAG (SEQ ID NO:5976), TAAGGTTACGGGATTGCGGCGGGAGAA (SEQ ID NO:5977), TTAAGGTTACGGGATTGCGGCGGGAGA (SEQ ID NO:5978)

Target629    chr5:153862230-153862252    GGTTTTTGGAAGTTTAGGTCGCGGCGT (SEQ ID NO:5979), AGGTTTTTGGAAGTTTAGGTCGCGGCGT (SEQ ID NO:5980), AGGTTTTTGGAAGTTTAGGTCGCGGCG (SEQ ID NO:5981), GGTTTTTGGAAGTTTAGGTCGCGGCGTT (SEQ ID NO:5982), AGGTTTTTGGAAGTTTAGGTCGCGGCGTT (SEQ ID NO:5983), AGATAAGGGGTTCGGTGCGGGGATTGT (SEQ ID NO:5984), TAAGGGGTTCGGTGCGGGGATTGTTCG (SEQ ID NO:5985), ATAAGGGGTTCGGTGCGGGGATTGTTC (SEQ ID NO:5986), GATAAGGGGTTCGGTGCGGGGATTGTT (SEQ ID NO:5987), AGATAAGGGGTTCGGTGCGGGGATTGTT (SEQ ID NO:5988)

FIGURE 5 CONTINUED

| | | |
|---|---|---|
| Target630 | chr5:153862357-153862422 | TTTCGTTGTTTTGGGGAATCGCGTCGC (SEQ ID NO:5989), TTTTCGTTGTTTTGGGGAATCGCGTCGC (SEQ ID NO:5990), TTCGTTGTTTTGGGGAATCGCGTCGC (SEQ ID NO:5991), TTTTCGTTGTTTTGGGGAATCGCGTCG (SEQ ID NO:5992), ATTTTCGTTGTTTTGGGGAATCGCGTCGC (SEQ ID NO:5993), GCGTTTAAGTTGCGGGGTAAATGGTTCG (SEQ ID NO:5994), GGGGTAAATGGTTCGCGGGTTGATTTATGGC (SEQ ID NO:5995), GGGTAAATGGTTCGCGGGTTGATTTATGGC (SEQ ID NO:5996), GGGGTAAATGGTTCGCGGGTTGATTT (SEQ ID NO:5997), GGGGTAAATGGTTCGCGGGTTGATTTATGG (SEQ ID NO:5998) |
| Target631 | chr5:168307062-168307160 | AGGGGAATCGGGGATAGGAGGAGGTGG (SEQ ID NO:5999), GGGGAATCGGGGATAGGAGGAGGTGGT (SEQ ID NO:6000), GGAGGTGGTAGAAGGAAAGGTCGGGGT (SEQ ID NO:6001), GGAAGGGGAATCGGGGATAGGAGGAGGT (SEQ ID NO:6002), TGGAAGGGGAATCGGGGATAGGAGGAGG (SEQ ID NO:6003) |
| Target632 | chr5:172672831-172672843 | GGGGTTTTTTCGTTCGGGGTTAGGCGT (SEQ ID NO:6004), TGGGGTTTTTTCGTTCGGGGTTAGGCG (SEQ ID NO:6005), TTGGGGTTTTTTCGTTCGGGGTTAGGCG (SEQ ID NO:6006), TGGGGTTTTTTCGTTCGGGGTTAGGCGT (SEQ ID NO:6007), GGGGTTTTTTCGTTCGGGGTTAGGCGTA (SEQ ID NO:6008), TTTCGGATTTTTAAAGGGGCGGCGGGG (SEQ ID NO:6009), CGGATTTTTAAAGGGGCGGCGGGGTTT (SEQ ID NO:6010), TCGGATTTTTAAAGGGGCGGCGGGGTT (SEQ ID NO:6011), TTCGGATTTTTAAAGGGGCGGCGGGGT (SEQ ID NO:6012), TTTTCGGATTTTTAAAGGGGCGGCGGGG (SEQ ID NO:6013) |
| Target633 | chr5:172672959-172672971 | AGGGTGCGGGGGGTTTAGAATTCGAGG (SEQ ID NO:6014), TAGGGGTTCGGGGAGGGTGGAGAGAAGG (SEQ ID NO:6015), GAAGGGGCGGGAGTTAGGATGAGGGTG (SEQ ID NO:6016), AGAAGGGGCGGGAGTTAGGATGAGGGT (SEQ ID NO:6017), GAGTTAGGATGAGGGTGCGGGGGGTTT (SEQ ID NO:6018) |
| Target634 | chr5:172673096-172673103 | AGAGGATAGAGGTTAGGACGGTGGCGA (SEQ ID NO:6019), GAGGATAGAGGTTAGGACGGTGGCGAA (SEQ ID NO:6020), AGAGGATAGAGGTTAGGACGGTGGCGAA (SEQ ID NO:6021), AGGATAGAGGTTAGGACGGTGGCGAAA (SEQ ID NO:6022), GAGGATAGAGGTTAGGACGGTGGCGAAA (SEQ ID NO:6023) |
| Target635 | chr5:177411494-177411511 | GGTCGGGTTGAGTCGGGTTGGTTTCGA (SEQ ID NO:6024), TCGGTCGGGTTGAGTCGGGTTGGTTTC (SEQ ID NO:6025), GTCGGTCGGGTTGAGTCGGGTTGGTTT (SEQ ID NO:6026), TCGGTCGGGTTGAGTCGGGTTGGTTT (SEQ ID NO:6027), CGGTCGGGTTGAGTCGGGTTGGTTTCG (SEQ ID NO:6028), AGTCGAGGGTAGGGTTTTGTTGTGCGT (SEQ ID NO:6029), GGAGTCGAGGGTAGGGTTTTGTTGTGCG (SEQ ID NO:6030), GGAGTCGAGGGTAGGGTTTTGTTGTGCGT (SEQ ID NO:6031), GAGTCGAGGGTAGGGTTTTGTTGTGCGT (SEQ ID NO:6032), GAGTCGAGGGTAGGGTTTTGTTGTGCG (SEQ ID NO:6033) |
| Target636 | chr5:177411600-177411615 | GGCGCGGAGATGGGTTAGAGTTCGGTT (SEQ ID NO:6034), GGTGAGGGGGTAAAGTCGGTTCGGAGT (SEQ ID NO:6035), AGGTGAGGGGGTAAAGTCGGTTCGGAG (SEQ ID NO:6036), GACGGCGCGGAGATGGGTTAGAGTTCG (SEQ ID NO:6037), CGACGGCGCGGAGATGGGTTAGAGTTC (SEQ ID NO:6038), GTCGAGGGTTTGTTGGAATTCGCGGGG (SEQ ID NO:6039), CGAGGGTTTGTTGGAATTCGCGGGGTT (SEQ ID NO:6040), CGTCGAGGGTTTGTTGGAATTCGCGGG (SEQ ID NO:6041), TCGAGGGTTTGTTGGAATTCGCGGGGT (SEQ ID NO:6042), CGAGGGTTTGTTGGAATTCGCGGGGTTT (SEQ ID NO:6043) |
| Target637 | chr5:177411654-177411797 | AAGTCGGTTCGGAGTTTTCGGGGGTGT (SEQ ID NO:6044), CGGTTCGGAGTTTTCGGGGGTGTAGGA (SEQ ID NO:6045), TCGGTTCGGAGTTTTCGGGGGTGTAGG (SEQ ID NO:6046), TAGAGGGTTTTCGTTCGTAGGGGCGCG (SEQ ID NO:6047), TTTTCGGGGGTGTAGGAGGGGTTTCGC (SEQ ID NO:6048), TGAGTGGTTCGGTCGGGCGTAGAGTTT (SEQ ID NO:6049), TTGAGTGGTTCGGTCGGGCGTAGAGTT (SEQ ID NO:6050), TTTGAGTGGTTCGGTCGGGCGTAGAGT (SEQ ID NO:6051), GGAGTTTTGAGTGGTTCGGTCGGGCGT (SEQ ID NO:6052), TTCGGTCGGGCGTAGAGTTTTAGGGGA (SEQ ID NO:6053) |
| Target638 | chr5:177411807-177411831 | TAGAGGGTTTTCGTTCGTAGGGGCGCG (SEQ ID NO:6054), AGGGTTTTCGTTCGTAGGGGCGCGTTC (SEQ ID NO:6055), GAGGGTTTTCGTTCGTAGGGGCGCGTT (SEQ ID NO:6056), TTAGAGGGTTTTCGTTCGTAGGGGCGC (SEQ ID NO:6057), GGGTTTTCGTTCGTAGGGGCGCGTTC (SEQ ID NO:6058), TGAGTGGTTCGGTCGGGCGTAGAGTTT (SEQ ID NO:6059), TTGAGTGGTTCGGTCGGGCGTAGAGTT (SEQ ID NO:6060), TTTGAGTGGTTCGGTCGGGCGTAGAGT (SEQ ID NO:6061), ATTTGGAGTTCGAAGTGGGTGTGCGGG (SEQ ID NO:6062), GGAGTTTTGAGTGGTTCGGTCGGGCGT (SEQ ID NO:6063) |
| Target639 | chr5:178003699-178003824 | GGGTCGTGGAGGGTTTCGGGTTGTTT (SEQ ID NO:6064), GGGGTCGTGGAGGGTTTCGGGTTGTTT (SEQ ID NO:6065), TCGTCGCGTCGGTTTTTCGGTTTTGTT (SEQ ID NO:6066), GGGTCGTGGAGGGTTTCGGGTTGTTTT (SEQ ID NO:6067), GGGGTCGTGGAGGGTTTCGGGTTGTT (SEQ ID NO:6068), CGTCGGGGGATTCGTTGGGGTTTTTCG (SEQ ID NO:6069), GCGGAGGTTTGGCGTTTCGGAGGATAG (SEQ ID NO:6070), GGCGGAGGTTTGGCGTTTCGGAGGATA (SEQ ID NO:6071), GTCGGGGGATTCGTTGGGGTTTTTCGT (SEQ ID NO:6072), GTCGTCGGGGGATTCGTTGGGGTTTTT (SEQ ID NO:6073) |
| Target640 | chr5:178003825-178004122 | CGGGAGGTCGTTTGGGTTCGGTTTTGG (SEQ ID NO:6074), GGGAGGTCGTTTGGGTTCGGTTTTGGA (SEQ ID NO:6075), CGGGAGGTCGTTTGGGTTCGGTTTTGGA (SEQ ID NO:6076), GGGAGGTCGTTTGGGTTCGGTTTTGGAT (SEQ ID NO:6077), GATCGTCGCGTCGGTTTTTCGGTTTTG (SEQ ID NO:6078), CGATAGGGAGGATTTCGGCGGGGAGTT (SEQ ID NO:6079), GGGTTTTGGGAGTTGGGTTGAGCGAGG (SEQ ID NO:6080), TGGGTTTTGGGAGTTGGGTTGAGCGAG |

FIGURE 5 CONTINUED (SEQ ID NO:6081), GGGGTTTCGGTTTATAGGGCGCGGAGG (SEQ ID NO:6082),
GCGGGGTTGATTCGGTAGAGCGGTTAG (SEQ ID NO:6083)

| Target641 | chr5:179894247-179894340 | AAGGTCGGGGCGGAGTGGGGTTGTTTAA (SEQ ID NO:6084), GAAGTTAGAAGGTCGGGGCGGAGTGGG (SEQ ID NO:6085), CGGGAAGTTTTGGGTAGGCGTTCGTGG (SEQ ID NO:6086), GGTCGGGGCGGAGTGGGTTGTTTAAGA (SEQ ID NO:6087), GAAGGTCGGGGCGGAGTGGGTTGTTTA (SEQ ID NO:6088), ACGGGCGTTTGTTTAGGGTTTTTCGGT (SEQ ID NO:6089), ACGGGCGTTTGTTTAGGGTTTTTCGGTT (SEQ ID NO:6090), CGGGCGTTTGTTTAGGGTTTTTCGGTT (SEQ ID NO:6091), CGGGCGTTTGTTTAGGGTTTTTCGGTG (SEQ ID NO:6092), CGGGCGTTTGTTTAGGGTTTTTCGGTGT (SEQ ID NO:6093) |
| Target642 | chr5:180486301-180486314 | CGGGGTTTAGATCGTTTCGGGCGGGTA (SEQ ID NO:6094), GGAGGTGTCGGAGGATGGTAAGAGCGT (SEQ ID NO:6095), TGGAGGTGTCGGAGGATGGTAAGAGCG (SEQ ID NO:6096), AGGTGTCGGAGGATGGTAAGAGCGTGT (SEQ ID NO:6097), CGGGGTTTAGATCGTTTCGGGCGGGTAT (SEQ ID NO:6098), GAGAATCGTTGCGGGTGGTTAGGCGTC (SEQ ID NO:6099), AGAATCGTTGCGGGTGGTTAGGCGTCG (SEQ ID NO:6100), GAATCGTTGCGGGTGGTTAGGCGTCG (SEQ ID NO:6101), GAATCGTTGCGGGTGGTTAGGCGTCGG (SEQ ID NO:6102), AGAATCGTTGCGGGTGGTTAGGCGTC (SEQ ID NO:6103) |
| Target643 | chr5:180486321-180486452 | GGAGGTGTCGGAGGATGGTAAGAGCGT (SEQ ID NO:6104), TGGAGGTGTCGGAGGATGGTAAGAGCG (SEQ ID NO:6105), AGGTGTCGGAGGATGGTAAGAGCGTGT (SEQ ID NO:6106), GGAGGTGTCGGAGGATGGTAAGAGCGTG (SEQ ID NO:6107), TGGAGGTGTCGGAGGATGGTAAGAGCGT (SEQ ID NO:6108), GTAGTCGGTCGTAGGGTTTAGGCGCGT (SEQ ID NO:6109), GTCGGTCGTAGGGTTTAGGCGCGTAGG (SEQ ID NO:6110), AGTCGGTCGTAGGGTTTAGGCGCGTAG (SEQ ID NO:6111), AGTAGTCGGTCGTAGGGTTTAGGCGCG (SEQ ID NO:6112), GAGAATCGTTGCGGGTGGTTAGGCGTC (SEQ ID NO:6113) |
| Target644 | chr5:180486463-180486489 | CGTTGAGTTTGGAGCGGTTTTTCGTCGG (SEQ ID NO:6114), GCGTTGAGTTTGGAGCGGTTTTTCGTC (SEQ ID NO:6115), GCGTTGAGTTTGGAGCGGTTTTTCGTCGG (SEQ ID NO:6116), GTTGAGTTTGGAGCGGTTTTTCGTCGG (SEQ ID NO:6117), TCGTTGGTTTTTGGGCGTTTGTTTGGT (SEQ ID NO:6118), CGGTCGTAGGGTTTAGGCGCGTAGGTT (SEQ ID NO:6119), GTAGTCGGTCGTAGGGTTTAGGCGCGT (SEQ ID NO:6120), GTCGGTCGTAGGGTTTAGGCGCGTAGG (SEQ ID NO:6121), AGTCGGTCGTAGGGTTTAGGCGCGTAG (SEQ ID NO:6122), AGTAGTCGGTCGTAGGGTTTAGGCGCG (SEQ ID NO:6123) |
| Target645 | chr5:180486501-180486539 | GCGGTCGGTTATTGGGTGTTGGGGTTG (SEQ ID NO:6124), TTTGCGGTCGGTTATTGGGTGTTGGGG (SEQ ID NO:6125), TGCGGTCGGTTATTGGGTGTTGGGGTT (SEQ ID NO:6126), TTGCGGTCGGTTATTGGGTGTTGGGGT (SEQ ID NO:6127), CGGTCGGTTATTGGGTGTTGGGGTTGT (SEQ ID NO:6128), CGTTTAGGCGTCGCGGGGGTAC (SEQ ID NO:6129), GCGGTGCGGGGTTAGGACGAAG (SEQ ID NO:6130), GCGGTGCGGGGTTAGGACGAA (SEQ ID NO:6131), CGTTTAGGCGTCGCGGGGGTA (SEQ ID NO:6132), CGTTTAGGCGTCGCGGGGGT (SEQ ID NO:6133) |
| Target646 | chr5:180486547-180486594 | GCGGTCGGTTATTGGGTGTTGGGGTTG (SEQ ID NO:6134), TTTGCGGTCGGTTATTGGGTGTTGGGG (SEQ ID NO:6135), TGCGGTCGGTTATTGGGTGTTGGGGTT (SEQ ID NO:6136), TTGCGGTCGGTTATTGGGTGTTGGGGT (SEQ ID NO:6137), CGGTCGGTTATTGGGTGTTGGGGTTGT (SEQ ID NO:6138), TGGAAGGTGAAGATGTGGGAGTCGTCGG (SEQ ID NO:6139), GGAAGGTGAAGATGTGGGAGTCGTCGG (SEQ ID NO:6140), GGAAGGTGAAGATGTGGGAGTCGTCGGA (SEQ ID NO:6141), AGGTGTCGTGGAAGGTGAAGATGTGGG (SEQ ID NO:6142), GGTGTCGTGGAAGGTGAAGATGTGGA (SEQ ID NO:6143) |
| Target647 | chr5:180486596-180486620 | GCGGTCGGTTATTGGGTGTTGGGGTTG (SEQ ID NO:6144), TTTGCGGTCGGTTATTGGGTGTTGGGG (SEQ ID NO:6145), TGCGGTCGGTTATTGGGTGTTGGGGTT (SEQ ID NO:6146), TTGCGGTCGGTTATTGGGTGTTGGGGT (SEQ ID NO:6147), CGGTCGGTTATTGGGTGTTGGGGTTGT (SEQ ID NO:6148), TGGAAGGTGAAGATGTGGGAGTCGTCGG (SEQ ID NO:6149), GGAAGGTGAAGATGTGGGAGTCGTCGG (SEQ ID NO:6150), GGAAGGTGAAGATGTGGGAGTCGTCGGA (SEQ ID NO:6151), AGGTGTCGTGGAAGGTGAAGATGTGGG (SEQ ID NO:6152), GGTGTCGTGGAAGGTGAAGATGTGGGA (SEQ ID NO:6153) |
| Target648 | chr5:180486679-180486697 | AGCGGGTAGATGGTTAGGGGATTCGGA (SEQ ID NO:6154), TCGGTAGCGGGTAGATGGTTAGGGGAT (SEQ ID NO:6155), ATCGGTAGCGGGTAGATGGTTAGGGGA (SEQ ID NO:6156), CGTCGTCGTGGGTTTTGGGTTTGAAGT (SEQ ID NO:6157), TGGTTAGGGGATTCGGATGTTCGTCGT (SEQ ID NO:6158) |
| Target649 | chr6:1378623-1378653 | GCGGTTGCGTTGTTTGAGGTTTCG (SEQ ID NO:6159) |
| Target650 | chr6:1378777-1378828 | CGGGGAAGAATTTGGTTAAGGGTCGGA (SEQ ID NO:6160), TCGGGGAAGAATTTGGTTAAGGGTCGG (SEQ ID NO:6161), TCGGGGAAGAATTTGGTTAAGGGTCGGA (SEQ ID NO:6162), TTCGGGGAAGAATTTGGTTAAGGGTCGG (SEQ ID NO:6163), CGGGGAAGAATTTGGTTAAGGGTCGGAT (SEQ ID NO:6164), TCGAATTGTTGGGGGGTGCGGAGTGTTT (SEQ ID NO:6165), TTCGAATTGTTGGGGGGTGCGGAGTGTT (SEQ ID NO:6166), TTTCGAATTGTTGGGGGGTGCGGAGTGT (SEQ ID NO:6167), TGTTTCGAATTGTTGGGGGGTGCGGAGT (SEQ ID NO:6168), AGGGCGGCGTTTAGAAGTTGTAGGTGG (SEQ ID NO:6169) |

FIGURE 5 CONTINUED

Target651    chr6:1378846-1378869    CGGGGAAGAATTTGGTTAAGGGTCGGA (SEQ ID NO:6170), TCGGGGAAGAATTTGGTTAAGGGTCGG (SEQ ID NO:6171), TCGGGGAAGAATTTGGTTAAGGGTCGGA (SEQ ID NO:6172), TTCGGGGAAGAATTTGGTTAAGGGTCGG (SEQ ID NO:6173), CGGGGAAGAATTTGGTTAAGGGTCGGAT (SEQ ID NO:6174), TCGAATTGTTGGGGGTGCGGAGTGTTT (SEQ ID NO:6175), TTCGAATTGTTGGGGGTGCGGAGTGTT (SEQ ID NO:6176), TTTCGAATTGTTGGGGGTGCGGAGTGT (SEQ ID NO:6177), TGTTTCGAATTGTTGGGGGTGCGGAGT (SEQ ID NO:6178), GTTTCGAATTGTTGGGGGTGCGGAGTGT (SEQ ID NO:6179)

Target652    chr6:1378947-1379043    GTAATTCGGGGTATGGAGTCGGCGGGG (SEQ ID NO:6180), AGTAATTCGGGGTATGGAGTCGGCGGG (SEQ ID NO:6181), CGGTCGGGGTTTGGAGAAGTAGCGTTG (SEQ ID NO:6182), GCGGTCGGGGTTTGGAGAAGTAGCGTT (SEQ ID NO:6183), CGGTCGGGGTTTGGAGAAGTAGCGTTGA (SEQ ID NO:6184), CGGAGTCGTCGGTTTAAGTCGGGAGCG (SEQ ID NO:6185), TTTAAGAGGGGTTTGGTGGGCGGTGTC (SEQ ID NO:6186), TTTTAAGAGGGGTTTGGTGGGCGGTGT (SEQ ID NO:6187), TTTTTAAGAGGGGTTTGGTGGGCGGTGTC (SEQ ID NO:6188), GGAGTCGTCGGTTTAAGTCGGGAGCG (SEQ ID NO:6189)

Target653    chr6:1379049-1379078    CGGTCGGGGTTTGGAGAAGTAGCGTTG (SEQ ID NO:6190), GCGGTCGGGGTTTGGAGAAGTAGCGTT (SEQ ID NO:6191), CGGTCGGGGTTTGGAGAAGTAGCGTTGA (SEQ ID NO:6192), GGTCGGGGTTTGGAGAAGTAGCGTTGA (SEQ ID NO:6193), GCGGTCGGGGTTTGGAGAAGTAGCGT (SEQ ID NO:6194), CGGAGTCGTCGGTTTAAGTCGGGAGCG (SEQ ID NO:6195), GGAGTCGTCGGTTTAAGTCGGGAGCG (SEQ ID NO:6196), CGGAGTCGTCGGTTTAAGTCGGGAGC (SEQ ID NO:6197), GTTTAAGTCGGGAGCGCGGCGGAG (SEQ ID NO:6198), GGTTTAAGTCGGGAGCGCGGCGGAG (SEQ ID NO:6199)

Target654    chr6:1379098-1379147    GCGTGTATTTGTTTCGTTTCGTCGCGT (SEQ ID NO:6200), TCGCGTGTATTTGTTTCGTTTCGTCGC (SEQ ID NO:6201), GCGTGTATTTGTTTCGTTTCGTCGCGTT (SEQ ID NO:6202), TTCGCGTGTATTTGTTTCGTTTCGTCGC (SEQ ID NO:6203), GTTCGCGTGTATTTGTTTCGTTTCGTCGC (SEQ ID NO:6204), CGGAGTCGTCGGTTTAAGTCGGGAGCG (SEQ ID NO:6205), GGAGTCGTCGGTTTAAGTCGGGAGCG (SEQ ID NO:6206), CGGAGTCGTCGGTTTAAGTCGGGAGC (SEQ ID NO:6207), TGGGGAGAATTGGGTTTTTGCGTTTGT (SEQ ID NO:6208), AGTTTGGGGAGAATTGGGTTTTTGCGT (SEQ ID NO:6209)

Target655    chr6:1379297-1379312    TTGGTTGGGGTTGGGATAGGCGTAGGG (SEQ ID NO:6210), GAAAGTCGTAGGGGCGCGTCGGTTTAC (SEQ ID NO:6211), GGAAAGTCGTAGGGGCGCGTCGGTTTA (SEQ ID NO:6212), GGTTGGGGTTGGGATAGGCGTAGGGAT (SEQ ID NO:6213), TGGTTGGGGTTGGGATAGGCGTAGGGA (SEQ ID NO:6214), TCGGTTTTGAAATTGACGGTGTAGAGTTTTTTGA (SEQ ID NO:6215), TGAAATTGACGGTGTAGAGTTTTTTGAATTCGGT (SEQ ID NO:6216), GTCGGTTTTGAAATTGACGGTGTAGAGTTTTTTG (SEQ ID NO:6217), GTCGGTTTTGAAATTGACGGTGTAGAGTTTTTTGA (SEQ ID NO:6218), TCGGTTTTGAAATTGACGGTGTAGAGTTTTTTGAA (SEQ ID NO:6219)

Target656    chr6:3247668-3247681    TGTTGTGAATTGGGGACGGTTGATTGTGT (SEQ ID NO:6220), GTTGTGAATTGGGGACGGTTGATTGTGT (SEQ ID NO:6221), TGTTGTGAATTGGGGACGGTTGATTGTG (SEQ ID NO:6222), TTGTGAATTGGGGACGGTTGATTGTGTC (SEQ ID NO:6223), GTTGTGAATTGGGGACGGTTGATTGTGTC (SEQ ID NO:6224), TGTGTGTTAGGTATTGTTTTGAGTGTTGGGAAGA (SEQ ID NO:6225), TTGTGTGTTAGGTATTGTTTTGAGTGTTGGGAAG (SEQ ID NO:6226), TTGTGTGTTAGGTATTGTTTTGAGTGTTGGGAAGA (SEQ ID NO:6227), TGTGTGTTAGGTATTGTTTTGAGTGTTGGGAAGAT (SEQ ID NO:6228), TTTGTGTGTTAGGTATTGTTTTGAGTGTTGGGAAG (SEQ ID NO:6229)

Target657    chr6:3247767-3247867    CGAGGCGGGGGTTATCGTTTTGAAGGG (SEQ ID NO:6230), GAGGCGGGGGTTATCGTTTTGAAGGGT (SEQ ID NO:6231), CGAGGCGGGGGTTATCGTTTTGAAGGGT (SEQ ID NO:6232), CGAGGCGGGGGTTATCGTTTTGAAGGGTA (SEQ ID NO:6233), AGGCGGGGGTTATCGTTTTGAAGGGTA (SEQ ID NO:6234), GGGAATATGGTTGTTCGGGAGGGGCGA (SEQ ID NO:6235), TCGGGAATATGGTTGTTCGGGAGGGGC (SEQ ID NO:6236), TGGTTGTTCGGGAGGGGCGATTTTTGT (SEQ ID NO:6237), CGGGAATATGGTTGTTCGGGAGGGGCG (SEQ ID NO:6238), GGGAATATGGTTGTTCGGGAGGGGCGAT (SEQ ID NO:6239)

Target658    chr6:6003886-6003983    TAAAAGTTGAGCGGCGGGAGGAGGAGG (SEQ ID NO:6240), GCGGGAGGAGGAGGAGGAGGAGGAAAT (SEQ ID NO:6241), AGGGATAAAAGTTGAGCGGCGGGAGGA (SEQ ID NO:6242), GGATAAAAGTTGAGCGGCGGGAGGAGG (SEQ ID NO:6243), GGGATAAAAGTTGAGCGGCGGGAGGAG (SEQ ID NO:6244), CGGGTTCGTCGGTTTTAGGGCGGAAAG (SEQ ID NO:6245), GGCGTTCGGGTTGTTTGGGTCGTTAGG (SEQ ID NO:6246), GGGTTCGTCGGTTTTAGGGCGGAAAGA (SEQ ID NO:6247), GCGTTCGGGTTGTTTTGGGTCGTTAGGT (SEQ ID NO:6248), GCGTTCGGGTTGTTTTGGGTCGTTAGG (SEQ ID NO:6249)

Target659    chr6:6003991-6004033    CGGGCGCGCGGTTGTGGTTATTTTTT (SEQ ID NO:6250), GCGGGCGCGCGGTTGTGGTTATTTTTT (SEQ ID NO:6251), GAGGCGCGGGATTGGAAGGATAGGTAT (SEQ ID NO:6252), AGGCGCGGGATTGGAAGGATAGGTATT (SEQ ID NO:6253), GCGGGCGCGCGGTTGTGGTTATTTTT (SEQ ID NO:6254), GGCGTTCGGGTTGTTTTGGGTCGTTAGG (SEQ ID NO:6255), GCGTTCGGGTTGTTTTGGGTCGTTAGGT (SEQ ID NO:6256), GCGTTCGGGTTGTTTTGGGTCGTTAGG (SEQ ID NO:6257), GGCGTTCGGGTTGTTTTGGGTCGTTAG (SEQ ID NO:6258), CGTTCGGGTTGTTTTGGGTCGTTAGGT (SEQ ID NO:6259)

FIGURE 5 CONTINUED

Target660    chr6:6004059-6004161    GCGTTAGGGCGGGGAAGAAAGGGTGAA (SEQ ID NO:6260), TGGGCGTCGGTTTGGTTTTCGGTAGTT (SEQ ID NO:6261), TTGGGCGTCGGTTTGGTTTTCGGTAGT (SEQ ID NO:6262), CGTTAGGGCGGGGAAGAAAGGGTGAAT (SEQ ID NO:6263), CGGGCGCGCGGTTGTGGTTATTTTTT (SEQ ID NO:6264), GGGTCGGGGGATTGAGGTGTTCGGTTT (SEQ ID NO:6265), GTTGGGGGTCGGGGGATTGAGGTGTTC (SEQ ID NO:6266), GGTCGGGGGATTGAGGTGTTCGGTTTT (SEQ ID NO:6267), TTGGGGGTCGGGGGATTGAGGTGTTC (SEQ ID NO:6268), GGGTCGGGGGATTGAGGTGTTCGGTT (SEQ ID NO:6269)

Target661    chr6:6004181-6004208    GCGTTAGGGCGGGGAAGAAAGGGTGAA (SEQ ID NO:6270), TGGGCGTCGGTTTGGTTTTCGGTAGTT (SEQ ID NO:6271), TTGGGCGTCGGTTTGGTTTTCGGTAGT (SEQ ID NO:6272), CGTTAGGGCGGGGAAGAAAGGGTGAAT (SEQ ID NO:6273), GCGTTAGGGCGGGGAAGAAAGGGTGA (SEQ ID NO:6274), GGGTCGGGGGATTGAGGTGTTCGGTTT (SEQ ID NO:6275), GTTGGGGGTCGGGGGATTGAGGTGTTC (SEQ ID NO:6276), GGTCGGGGGATTGAGGTGTTCGGTTTT (SEQ ID NO:6277), TTGGGGGTCGGGGGATTGAGGTGTTC (SEQ ID NO:6278), GGGTCGGGGGATTGAGGTGTTCGGTT (SEQ ID NO:6279)

Target662    chr6:6004217-6004389    GGAAGAGCGAGGCGGGTTTTGCGTTTT (SEQ ID NO:6280), TAGGAAGAGCGAGGCGGGTTTTGCGTT (SEQ ID NO:6281), TTGTAGGAAGAGCGAGGCGGGTTTTGC (SEQ ID NO:6282), TGTAGGAAGAGCGAGGCGGGTTTTGCG (SEQ ID NO:6283), GTAGGAAGAGCGAGGCGGGTTTTGCGT (SEQ ID NO:6284), TCGTTGTAAGGTGAATTCGGAGGTTTGAGA (SEQ ID NO:6285), GGTGAATTCGGAGGTTTGAGAAGGTTTACG (SEQ ID NO:6286), GGTGAATTCGGAGGTTTGAGAAGGTTTACGT (SEQ ID NO:6287), TGTAAGGTGAATTCGGAGGTTTGAGAAGGT (SEQ ID NO:6288), AGGTGAATTCGGAGGTTTGAGAAGGTTTACG (SEQ ID NO:6289)

Target663    chr6:10417266-10417517    CGGTTGAATCGGGTTGGAGGTTTGGCG (SEQ ID NO:6290), GGTTGAATCGGGTTGGAGGTTTGGCGT (SEQ ID NO:6291), TCGGTTGAATCGGGTTGGAGGTTTGGC (SEQ ID NO:6292), GGTTGAATCGGGTTGGAGGTTTGGCGTC (SEQ ID NO:6293), TTCGGTTGAATCGGGTTGGAGGTTTGGC (SEQ ID NO:6294), GTGGAAACGGGGGTTGAAATGGGGTGG (SEQ ID NO:6295), GGTGGAAACGGGGGTTGAAATGGGGTG (SEQ ID NO:6296), AGGTGGAAACGGGGGTTGAAATGGGGT (SEQ ID NO:6297), GGGTGGTAGAGGATGGAGGGCGGTTTT (SEQ ID NO:6298), ACGGGGGTTGAAATGGGGTGGTAGAGG (SEQ ID NO:6299)

Target664    chr6:10417531-10417544    TGCGGGTTTGGAAAGGTCGTTTTTATTTTTTG (SEQ ID NO:6300), TTGCGGGTTTGGAAAGGTCGTTTTTATTTTTG (SEQ ID NO:6301), TTTGCGGGTTTGGAAAGGTCGTTTTTATTTTTTG (SEQ ID NO:6302), TTTTCGTTGTTTCGCGTTTAATAGATTTTCGGTTTC (SEQ ID NO:6303), CGGGGGCGGTAGTTTAGAGTCGGTAGG (SEQ ID NO:6304), GGGGGCGGTAGTTTAGAGTCGGTAGGT (SEQ ID NO:6305), TCGGGGGCGGTAGTTTAGAGTCGGTAG (SEQ ID NO:6306), TCGGGGGCGGTAGTTTAGAGTCGGTAGG (SEQ ID NO:6307), ATCGGGGGCGGTAGTTTAGAGTCGGTA (SEQ ID NO:6308)

Target665    chr6:10417577-10417689    TGTAGGCGTTGATGAAAGGTTCGGGCG (SEQ ID NO:6309), GTAGGCGTTGATGAAAGGTTCGGGCGA (SEQ ID NO:6310), TAGGCGTTGATGAAAGGTTCGGGCGAG (SEQ ID NO:6311), GTGTAGGCGTTGATGAAAGGTTCGGGCG (SEQ ID NO:6312), CGTTGATGAAAGGTTCGGGCGAGCGT (SEQ ID NO:6313), CGGGGGCGGTAGTTTAGAGTCGGTAGG (SEQ ID NO:6314), GGGGGCGGTAGTTTAGAGTCGGTAGGT (SEQ ID NO:6315), TCGGGGGCGGTAGTTTAGAGTCGGTAG (SEQ ID NO:6316), TCGGGGGCGGTAGTTTAGAGTCGGTAGG (SEQ ID NO:6317), TGGCGTTGTTGTTTCGGGGTTTTGGTT (SEQ ID NO:6318)

Target666    chr6:10417836-10417842    GCGTTAGGTTTGGGGTTGGAGGTCGGA (SEQ ID NO:6319), AGCGTTAGGTTTGGGGTTGGAGGTCGG (SEQ ID NO:6320), ACGTGGGGGGTATAAAAAGGGCGTCGC (SEQ ID NO:6321), GTGGGGGGGTATAAAAAGGGCGTCGCG (SEQ ID NO:6322), CGTGGGGGGGTATAAAAAGGGCGTCGC (SEQ ID NO:6323), GGGTTTGTTGGGGTTTTCGGTTTTTATTGGGT (SEQ ID NO:6324), TGGGTTTGTTGGGGTTTTCGGTTTTTATTGGG (SEQ ID NO:6325), TGGGTTTGTTGGGGTTTTCGGTTTTTATTGGGT (SEQ ID NO:6326), TTGGGTTTGTTGGGGTTTTCGGTTTTTATTGGG (SEQ ID NO:6327), TTGGGTTTGTTGGGGTTTTCGGTTTTTATTGGGT (SEQ ID NO:6328)

Target667    chr6:10421386-10421420    TTTTAGACGGTGGAAATAGGGCGGTGA (SEQ ID NO:6329), AGACGGTGGAAATAGGGCGGTGATTAA (SEQ ID NO:6330), TTAGACGGTGGAAATAGGGCGGTGATT (SEQ ID NO:6331), TTTAGACGGTGGAAATAGGGCGGTGAT (SEQ ID NO:6332), TTTTTAGACGGTGGAAATAGGGCGGTGA (SEQ ID NO:6333), CGAAGCGGTGGTAGGTTGAAATCGTCGT (SEQ ID NO:6334), CGAAGCGGTGGTAGGTTGAAATCGTCG (SEQ ID NO:6335), GAAGCGGTGGTAGGTTGAAATCGTCGT (SEQ ID NO:6336), CGAAGCGGTGGTAGGTTGAAATCGTCGTT (SEQ ID NO:6337), AGCGGTGGTAGGTTGAAATCGTCGTTT (SEQ ID NO:6338)

Target668    chr6:10421442-10421620    ATTTCGGGTTTAGTCGGACGGGTCGGG (SEQ ID NO:6339), GACGTGTTTTAGGGTTAGGGTGGGGCG (SEQ ID NO:6340), AGACGTGTTTTAGGGTTAGGGTGGGGCG (SEQ ID NO:6341), GATTTCGGGTTTAGTCGGACGGGTCGG (SEQ ID NO:6342), TTTCGGGTTTAGTCGGACGGGTCGGG (SEQ ID NO:6343), GTTCGGTTCGGTTCGTTCGGTTGGGTT (SEQ ID NO:6344), TTCGGTTCGGTTCGTTCGGTTGGGTTC (SEQ ID NO:6345), AGGTTCGGTTCGTTCGGTTCGTTCGGTTGGG (SEQ ID NO:6346), CGGTTCGGTTCGTTCGGTTGGGTTCGA (SEQ ID NO:6347), TCGGTTCGGTTCGTTCGGTTGGGTTCG (SEQ ID NO:6348)

FIGURE 5 CONTINUED

| | | |
|---|---|---|
| Target669 | chr6:10421628-10422390 | TTTTTGGGGTGGGGGATTTGAGCGTGC (SEQ ID NO:6349), ACGTGTTTTAGGGTTAGGGTGGGGCGT (SEQ ID NO:6350), ATTTCGGGTTTAGTCGGACGGGTCGGG (SEQ ID NO:6351), GGGAGAGAGGCGGAGGGAGGTGAAATG (SEQ ID NO:6352), GCGGAGGGAGGTGAAATGCGGGAGTTA (SEQ ID NO:6353), GAGGGAGGTCGGGGTGGGGAAAGGTTTT (SEQ ID NO:6354), GGAGGTCGGGGTGGGGAAAGGTTTTGA (SEQ ID NO:6355), GGGCGTAGTTTCGTTGGTGCGGAGTTG (SEQ ID NO:6356), AGGAGGTCGGGGTGGGGAAAGGTTTTG (SEQ ID NO:6357), GGCGTAGTTTCGTTGGTGCGGAGTTGC (SEQ ID NO:6358) |
| Target670 | chr6:11785719-11785770 | TGGTAGTGAGTTTTTTCGGGGTTTAGGTTGT (SEQ ID NO:6359), TGGTAGTGAGTTTTTTCGGGGTTTAGGTTGTT (SEQ ID NO:6360), TTGGTAGTGAGTTTTTTCGGGGTTTAGGTTGT (SEQ ID NO:6361), TGGTAGTGAGTTTTTTCGGGGTTTAGGTTGTTT (SEQ ID NO:6362), TTGGTAGTGAGTTTTTTCGGGGTTTAGGTTGTT (SEQ ID NO:6363) |
| Target671 | chr6:11785994-11786090 | GTTGTTGGGTTGTGGGGAGGAGGTGGA (SEQ ID NO:6364), AGTTGTTGGGTTGTGGGGAGGAGGTGG (SEQ ID NO:6365), TTGTTGGGTTGTGGGGAGGAGGTGGAA (SEQ ID NO:6366), TGTTGGGTTGTGGGGAGGAGGTGGAAT (SEQ ID NO:6367), GTTGTTGGGTTGTGGGGAGGAGGTGGAA (SEQ ID NO:6368) |
| Target672 | chr6:16729533-16729698 | ACGGTTGGATTGAGAGAGTAAAGAGAAAATGAGTT (SEQ ID NO:6369), AACGGTTGGATTGAGAGAGTAAAGAGAAAATGAGT (SEQ ID NO:6370), AACGGTTGGATTGAGAGAGTAAAGAGAAAATGAGTT (SEQ ID NO:6371) |
| Target673 | chr6:19691747-19691781 | GTCGGGGTTTTGGAGTTTTCGGATTTTGT (SEQ ID NO:6372), AGTCGGGGTTTTGGAGTTTTCGGATTTTGT (SEQ ID NO:6373), CGGGGTTTTGGAGTTTTCGGATTTTGTTCG (SEQ ID NO:6374), AGTCGGGGTTTTGGAGTTTTCGGATTTTG (SEQ ID NO:6375), CGGGGTTTTGGAGTTTTCGGATTTTGTTCGT (SEQ ID NO:6376), GCGTTTGTTTATATGATGAAAGGCGGGTAGG (SEQ ID NO:6377), GCGTTTGTTTATATGATGAAAGGCGGGTAGGA (SEQ ID NO:6378), GCGTTTGTTTATATGATGAAAGGCGGGTAGGAT (SEQ ID NO:6379), GCGTTTGTTTATATGATGAAAGGCGGGTAGGATT (SEQ ID NO:6380), GCGTTTGTTTATATGATGAAAGGCGGGTAGGATTT (SEQ ID NO:6381) |
| Target674 | chr6:19691827-19692233 | TTTCGTTATTTGGGTCGCGGGTTGGGC (SEQ ID NO:6382), GCGTTAGGAGCGAGGCGTTTTTGGTGA (SEQ ID NO:6383), TTTTGGTAGAGGCGTCGGAGGAAGGGG (SEQ ID NO:6384), TATATTTAGGGCGGGGGAGGTCGGGGG (SEQ ID NO:6385), AGGAGCGAGGCGTTTTTGGTGATAGCG (SEQ ID NO:6386), GATGGCGGAGTAGTTTCGAGCGGGGAT (SEQ ID NO:6387), TAGATGGCGGAGTAGTTTCGAGCGGGG (SEQ ID NO:6388), TGGCGGAGTAGTTTCGAGCGGGGATAT (SEQ ID NO:6389), ATGGCGGAGTAGTTTCGAGCGGGGATA (SEQ ID NO:6390), AGATGGCGGAGTAGTTTCGAGCGGGGA (SEQ ID NO:6391) |
| Target675 | chr6:27173544-27173557 | CGGTTAATGTTATTGTCGGACGTTCGGGT (SEQ ID NO:6392), CGGTTAATGTTATTGTCGGACGTTCGGG (SEQ ID NO:6393), TCGGTTAATGTTATTGTCGGACGTTCGGG (SEQ ID NO:6394), TCGGTTAATGTTATTGTCGGACGTTCGGGT (SEQ ID NO:6395), TTCGGTTAATGTTATTGTCGGACGTTCGGG (SEQ ID NO:6396), TTTGGAAGAGTGTAAGAGAAAGGAATCGGGTT (SEQ ID NO:6397), TTTTGGAAGAGTGTAAGAGAAAGGAATCGGGT (SEQ ID NO:6398), AGGGGTTTTTGGAAGAGTGTAAGAGAAAGGAA (SEQ ID NO:6399), AAGGGGTTTTTGGAAGAGTGTAAGAGAAAGGA (SEQ ID NO:6400), GGGGTTTTTGGAAGAGTGTAAGAGAAAGGAATCGGG (SEQ ID NO:6401) |
| Target676 | chr6:27173745-27173857 | CGTGGTTGCGAGAGTTTTTTAGGGAGAGT (SEQ ID NO:6402), CGTGGTTGCGAGAGTTTTTTAGGGAGAG (SEQ ID NO:6403), CGTAGAAGTGATAGGGAGAGGGGGAAAGT (SEQ ID NO:6404), TCGTAGAAGTGATAGGGAGAGGGGGAAAGT (SEQ ID NO:6405), TCGTAGAAGTGATAGGGAGAGGGGGAAAG (SEQ ID NO:6406) |
| Target677 | chr6:30131458-30131521 | GGAGTGGACGGGTTGGGGAAGGTATCG (SEQ ID NO:6407), CGGAGTGGACGGGTTGGGGAAGGTATC (SEQ ID NO:6408), GAGATCGGAGTGGACGGGTTGGGGAAG (SEQ ID NO:6409), GTGGGTTGAGGAGATCGGAGTGGACGG (SEQ ID NO:6410), TTCGCGTGGGTTGAGGAGATCGGAGTG (SEQ ID NO:6411), CGCGGGGAGGTAGAGTCGGTAGAAGGT (SEQ ID NO:6412), TGGGTTTTTATTTGGGAGAGCGCGGGG (SEQ ID NO:6413), GAGCGCGGGGAGGTAGAGTCGGTAGAA (SEQ ID NO:6414), AGCGCGGGGAGGTAGAGTCGGTAGAAG (SEQ ID NO:6415), GCGGGGAGGTAGAGTCGGTAGAAGGTG (SEQ ID NO:6416) |
| Target678 | chr6:30131538-30131587 | GGAGTGGACGGGTTGGGGAAGGTATCG (SEQ ID NO:6417), CGGAGTGGACGGGTTGGGGAAGGTATC (SEQ ID NO:6418), GAGATCGGAGTGGACGGGTTGGGGAAG (SEQ ID NO:6419), GTGGGTTGAGGAGATCGGAGTGGACGG (SEQ ID NO:6420), CGTGGGTTGAGGAGATCGGAGTGGACG (SEQ ID NO:6421), CGCGGGGAGGTAGAGTCGGTAGAAGGT (SEQ ID NO:6422), GAGCGCGGGGAGGTAGAGTCGGTAGAA (SEQ ID NO:6423), AGCGCGGGGAGGTAGAGTCGGTAGAAG (SEQ ID NO:6424), GCGGGGAGGTAGAGTCGGTAGAAGGTG (SEQ ID NO:6425), ATTTGGGAGAGCGCGGGGAGGTAGAGT (SEQ ID NO:6426) |
| Target679 | chr6:30131613-30131692 | CGGGGTCGTTGGAGGATGCGGTGATTA (SEQ ID NO:6427), CGGGGTCGTTGGAGGATGCGGTGATTAT (SEQ ID NO:6428), GGGGTCGTTGGAGGATGCGGTGATTAT (SEQ ID NO:6429), CGGGGTCGTTGGAGGATGCGGTGATT (SEQ ID NO:6430), CGGGGTCGTTGGAGGATGCGGTGATTATT (SEQ ID NO:6431), AGGAATTTTACGGTGTGCGTTTGGTGC (SEQ ID NO:6432), |

FIGURE 5 CONTINUED

GCGGGTTTAGGGGGTATAGGGGGTTATGGG (SEQ ID NO:6433),
AGCGGGTTTAGGGGGTATAGGGGGTTATGGG (SEQ ID NO:6434),
GCGGGTTTAGGGGGTATAGGGGGTTATGGGA (SEQ ID NO:6435),
AGCGGGTTTAGGGGGTATAGGGGGTTATGGGA (SEQ ID NO:6436)

| | | |
|---|---|---|
| Target680 | chr6:32157485-32157591 | CGGGGTTTGTTGGGTTTGTGTGGGGTT (SEQ ID NO:6437), AACGGGGTTTGTTGGGTTTGTGTGGGG (SEQ ID NO:6438), TTTGTGTGGGGTTTCGGAGTGGGGGTA (SEQ ID NO:6439), TGTGTGGGGTTTCGGAGTGGGGGTATT (SEQ ID NO:6440), TTGTGTGGGGTTTCGGAGTGGGGGTAT (SEQ ID NO:6441), GGATTGGTGAGTGGGGAGTTTGGGGGT (SEQ ID NO:6442), GGGGTTTGGGATTGGTGAGTGGGGAGT (SEQ ID NO:6443), TGGGATTGGTGAGTGGGGAGTTTGGGG (SEQ ID NO:6444), GTGAGTGGGGAGTTTGGGGGTTTTGGC (SEQ ID NO:6445), GGGGAGTTTGGGGGTTTTGGCGAGTTT (SEQ ID NO:6446) |
| Target681 | chr6:32157605-32157670 | GTTTCGTTTAGGTTTTGGTCGGTGATGGT (SEQ ID NO:6447), ATCGGGAGGTTCGTTAGGGTTTTTAGGTT (SEQ ID NO:6448), CGTTATCGGGAGGTTCGTTAGGGTTTTTAGG (SEQ ID NO:6449), CGTTATCGGGAGGTTCGTTAGGGTTTTTAGGT (SEQ ID NO:6450), GTTATCGGGAGGTTCGTTAGGGTTTTTAGGT (SEQ ID NO:6451), GGATTGGTGAGTGGGGAGTTTGGGGGT (SEQ ID NO:6452), GGGGTTTGGGATTGGTGAGTGGGGAGT (SEQ ID NO:6453), TGGGATTGGTGAGTGGGGAGTTTGGGG (SEQ ID NO:6454), GAGAAGTAATTAGGCGGGGGGAGGGGC (SEQ ID NO:6455), GTTGGGGCGGAGGGAGTAGCGGTTTTA (SEQ ID NO:6456) |
| Target682 | chr6:36253000-36253007 | GGTGATTTATGTAGGGATTTTGAGTATTCGTCGGC (SEQ ID NO:6457), AGGTGATTTATGTAGGGATTTTGAGTATTCGTCGGC (SEQ ID NO:6458), AGGTGATTTATGTAGGGATTTTGAGTATTCGTCGG (SEQ ID NO:6459), TAGGTGATTTATGTAGGGATTTTGAGTATTCGTCGG (SEQ ID NO:6460), AGGGGGCGTAGTAGTTTTTGGGGAGGC (SEQ ID NO:6461), GGGGCGTAGTAGTTTTTGGGGAGGCGT (SEQ ID NO:6462), TTTTTAGAGTAGCGTGCGTGGTGGGCG (SEQ ID NO:6463), GGCGTAGTAGTTTTTGGGGAGGCGTCG (SEQ ID NO:6464), GGGCGTAGTAGTTTTTGGGGAGGCGTC (SEQ ID NO:6465) |
| Target683 | chr6:36253026-36253058 | GGTGATTTATGTAGGGATTTTGAGTATTCGTCGGC (SEQ ID NO:6466), AGGTGATTTATGTAGGGATTTTGAGTATTCGTCGGC (SEQ ID NO:6467), AGGTGATTTATGTAGGGATTTTGAGTATTCGTCGG (SEQ ID NO:6468), TAGGTGATTTATGTAGGGATTTTGAGTATTCGTCGG (SEQ ID NO:6469), TTTTTAGAGTAGCGTGCGTGGTGGGCG (SEQ ID NO:6470), GTTTTTAGAGTAGCGTGCGTGGTGGGCG (SEQ ID NO:6471), GGGATTGCGGGGTTTTAGGTTTAGGGC (SEQ ID NO:6472), TGTTTTTAGAGTAGCGTGCGTGGTGGGC (SEQ ID NO:6473), GTTTTTAGAGTAGCGTGCGTGGTGGGC (SEQ ID NO:6474) |
| Target684 | chr6:36253077-36253113 | ACGTTGTTTTGGGAGTAGGGTCGGCGG (SEQ ID NO:6475), GTTGTTTTGGGAGTAGGGTCGGCGGC (SEQ ID NO:6476), TACGTTGTTTTGGGAGTAGGGTCGGCGG (SEQ ID NO:6477), TACGTTGTTTTGGGAGTAGGGTCGGCG (SEQ ID NO:6478), CGTTGTTTTGGGAGTAGGGTCGGCGG (SEQ ID NO:6479), GGGATTGCGGGGTTTTAGGTTTAGGGCG (SEQ ID NO:6480), GGATTGCGGGGTTTTAGGTTTAGGGCGT (SEQ ID NO:6481), GGATTGCGGGGTTTTAGGTTTAGGGCG (SEQ ID NO:6482), TGGGATTGCGGGGTTTTAGGTTTAGGGC (SEQ ID NO:6483), GGGATTGCGGGGTTTTAGGTTTAGGGC (SEQ ID NO:6484) |
| Target685 | chr6:38682982-38683256 | GGTTGAGTGGTCGGGGTATCGGGGTTT (SEQ ID NO:6485), GGTTGGTGAGTATTTGGTCGGAGCGCG (SEQ ID NO:6486), CGGTTGGTGAGTATTTGGTCGGAGCGC (SEQ ID NO:6487), GCGGTTGGTGAGTATTTGGTCGGAGCG (SEQ ID NO:6488), GTCGGGGTATCGGGGTTTAGAGAGCGG (SEQ ID NO:6489), AGAAGGAAAGTGGGCGGGGAATTCGGT (SEQ ID NO:6490), GCGTTGTTTCGGGGGAGTTGTTTCGGT (SEQ ID NO:6491), TGCGTTGTTTCGGGGGAGTTGTTTCGG (SEQ ID NO:6492), CGGTTGCGTTGTTTCGGGGGAGTTGTT (SEQ ID NO:6493), TAGGGTTTTTCGGATAGGGGTCGGCG (SEQ ID NO:6494) |
| Target686 | chr6:41341524-41341631 | GCGGTAGAGAAGTTTGCGTTCGGGATT (SEQ ID NO:6495), TCGTGGGTTTATAGAGGGTGAAGGGGT (SEQ ID NO:6496), GCGGTAGAGAAGTTTGCGTTCGGGAT (SEQ ID NO:6497), GGGGTAGTTTATGTTGAGTGGGGGTGT (SEQ ID NO:6498), CGGGATTAGTAGAGTGAGTCGATCGGC (SEQ ID NO:6499), CGAAGTGAAGTTTGGACGCGAATGGGG (SEQ ID NO:6500), TCGAAGTGAAGTTTGGACGCGAATGGG (SEQ ID NO:6501), TCGAAGTGAAGTTTGGACGCGAATGGG (SEQ ID NO:6502), CGAAGTGAAGTTTGGACGCGAATGGG (SEQ ID NO:6503), GAAGTGAAGTTTGGACGCGAATGGGG (SEQ ID NO:6504) |
| Target687 | chr6:41341646-41341691 | GCGGTAGAGAAGTTTGCGTTCGGGATT (SEQ ID NO:6505), GCGGTAGAGAAGTTTGCGTTCGGGAT (SEQ ID NO:6506), CGGGATTAGTAGAGTGAGTCGATCGGC (SEQ ID NO:6507), GCGGTAGAGAAGTTTGCGTTCGGGATTA (SEQ ID NO:6508), TCGGGATTAGTAGAGTGAGTCGATCGGC (SEQ ID NO:6509) |
| Target688 | chr6:41341707-41341716 | GCGGTAGAGAAGTTTGCGTTCGGGATT (SEQ ID NO:6510), GCGGTAGAGAAGTTTGCGTTCGGGAT (SEQ ID NO:6511), GGGGTAGTTTATGTTGAGTGGGGGTGT (SEQ ID NO:6512), CGGGATTAGTAGAGTGAGTCGATCGGC (SEQ ID NO:6513), AGGGGTAGTTTATGTTGAGTGGGGGTGT (SEQ ID NO:6514), GGGGTGAGGTTATGGAAAGTTTCGAGGT (SEQ ID NO:6515), AGGGGTGAGGTTATGGAAAGTTTCGAGGT (SEQ ID NO:6516), AGGGGTGAGGTTATGGAAAGTTTCGAGG (SEQ ID NO:6517), |

FIGURE 5 CONTINUED

GAGGGGTGAGGTTATGGAAAGTTTCGAGGT (SEQ ID NO:6518),
GAGGGGTGAGGTTATGGAAAGTTTCGAGG (SEQ ID NO:6519)

Target689    chr6:41341733-41341747    GCGGTAGAGAAGTTTGCGTTCGGGATT (SEQ ID NO:6520), GCGGTAGAGAAGTTTGCGTTCGGGAT (SEQ ID NO:6521), CGGGATTAGTAGAGTGAGTCGATCGGC (SEQ ID NO:6522), GCGGTAGAGAAGTTTGCGTTCGGGATTA (SEQ ID NO:6523), TCGGGATTAGTAGAGTGAGTCGATCGGC (SEQ ID NO:6524), AGTGGTGGTTTGGAGGACGTTGGTTAC (SEQ ID NO:6525), TTAGTGGTGGTTTGGAGGACGTTGGTT (SEQ ID NO:6526), TTTAGTGGTGGTTTGGAGGACGTTGGT (SEQ ID NO:6527), TTTAGTGGTGGTTTGGAGGACGTTGGTT (SEQ ID NO:6528), TTTTAGTGGTGGTTTGGAGGACGTTGGT (SEQ ID NO:6529)

Target690    chr6:41341750-41341762    GAGAGAGTCGCGGTGGTTGTACGT (SEQ ID NO:6530), AGAGAGTCGCGGTGGTTGTACGT (SEQ ID NO:6531), GCGGTGGTTGTACGTGCGTGC (SEQ ID NO:6532)

Target691    chr6:41528224-41528958    ATTTTCGGTTAGGGAGGGGATGGGGCG (SEQ ID NO:6533), AATTGATGAGTTGGTAGGGCGGGCGGT (SEQ ID NO:6534), GCGGCGAGGCGTAGGGTGTTATGGTAA (SEQ ID NO:6535), GGTTAGGGAGGGGATGGGGCGGTTTTC (SEQ ID NO:6536), TTTTCGGTAGGACGCGCGTTTAGGAGC (SEQ ID NO:6537), GTTCGGAGTTTATTCGCGGGGGAGGGA (SEQ ID NO:6538), TGTTCGGAGTTTATTCGCGGGGGAGGG (SEQ ID NO:6539), AGGGGGGGATTTACGGGTTGGGGTGTTT (SEQ ID NO:6540), AAGGGGGGGATTTACGGGTTGGGGTGTT (SEQ ID NO:6541), AAAGGGGGGGATTTACGGGTTGGGGTGT (SEQ ID NO:6542)

Target692    chr6:42071961-42072043    AGGTTAGGAGGGGAGGTTAGGGAAGGCGT (SEQ ID NO:6543), GGAGTTGGTGGGGAAAGAGAAGGGAGGT (SEQ ID NO:6544), GGAGTTGGTGGGGAAAGAGAAGGGAGG (SEQ ID NO:6545), GGAGGTTAGGAGGGGAGGTTAGGAAGGCG (SEQ ID NO:6546), AGGAGTTGGTGGGGAAAGAGAAGGGAGG (SEQ ID NO:6547), GGAGGGGTGGAAAGTTAGGCGAGGGTT (SEQ ID NO:6548), AGGAGGGGTGGAAAGTTAGGCGAGGGT (SEQ ID NO:6549), GGAGGGGTGGAAAGTTAGGCGAGGGT (SEQ ID NO:6550), AGGAGGGGTGGAAAGTTAGGCGAGGG (SEQ ID NO:6551), AGGAGGGGTGGAAAGTTAGGCGAGGGTT (SEQ ID NO:6552)

Target693    chr6:42072072-42072628    GTGGGGTAGTTTTGGGTTTCGGTGCGG (SEQ ID NO:6553), GTTGTTTCGGGGAGGGGAGTTTTGGCG (SEQ ID NO:6554), TAGGTTGCGGTCGGTTATCGTGGGG (SEQ ID NO:6555), GCGTTTGTGTTTGGTTTTCGCGGCGT (SEQ ID NO:6556), TTGGGTTTCGGTGCGGTTTTTCGACGT (SEQ ID NO:6557), TCGGAGGTTTGTACGCGTCGAGGTTGT (SEQ ID NO:6558), GGTGCGGGAAGTTAGGAGGGGGTGGAAA (SEQ ID NO:6559), TTCGGTTGGTGCGGGAAGTTAGGAGGG (SEQ ID NO:6560), GGAGGGGTGGAAAGTTAGGCGAGGGTT (SEQ ID NO:6561), GGGTTCGGTTGGTGCGGGAAGTTAGGA (SEQ ID NO:6562)

Target694    chr6:50818149-50818202    TCGGGTTTATTTTTTCGGTTTGGGTTTCGT (SEQ ID NO:6563), TCGGGTTTATTTTTTCGGTTTGGGTTTCGTT (SEQ ID NO:6564), TTCGGGTTTATTTTTTCGGTTTGGGTTTCGT (SEQ ID NO:6565), TTCGGGTTTATTTTTTCGGTTTGGGTTTCGTT (SEQ ID NO:6566), TTTCGGGTTTATTTTTTCGGTTTGGGTTTCGT (SEQ ID NO:6567), GCGGTTTTTGTGTTCGGAGCGTGTGTT (SEQ ID NO:6568), CGGTTCGTTGGTTCGCGGTTTTTGTGT (SEQ ID NO:6569), TTGGTTCGCGGTTTTTGTGTTCGGAGC (SEQ ID NO:6570), CGTTGGTTCGCGGTTTTTGTGTTCGGA (SEQ ID NO:6571), TCGTTGGTTCGCGGTTTTTGTGTTCGG (SEQ ID NO:6572)

Target695    chr6:50818209-50818238    GTTGGGAGATTGGGTAATAATATACGTTTCGGGT (SEQ ID NO:6573), AGTTGGGAGATTGGGTAATAATATACGTTTCGGG (SEQ ID NO:6574), AGTTGGGAGATTGGGTAATAATATACGTTTCGGGT (SEQ ID NO:6575), GTTGGGAGATTGGGTAATAATATACGTTTCGGGTA (SEQ ID NO:6576), AGTTGGGAGATTGGGTAATAATATACGTTTCGGGTA (SEQ ID NO:6577), CGGTTCGACGTAGGTTGGCGCGG (SEQ ID NO:6578), GGTTCGACGTAGGTTGGCGCGGC (SEQ ID NO:6579), CGGTTCGACGTAGGTTGGCGCGGC (SEQ ID NO:6580), GTTCGACGTAGGTTGGCGCGGC (SEQ ID NO:6581), CGGTTCGACGTAGGTTGGCGCGG (SEQ ID NO:6582)

Target696    chr6:50818245-50818261    GTTGGGAGATTGGGTAATAATATACGTTTCGGGT (SEQ ID NO:6583), AGTTGGGAGATTGGGTAATAATATACGTTTCGGG (SEQ ID NO:6584), AGTTGGGAGATTGGGTAATAATATACGTTTCGGGT (SEQ ID NO:6585), GTTGGGAGATTGGGTAATAATATACGTTTCGGGTA (SEQ ID NO:6586), AGTTGGGAGATTGGGTAATAATATACGTTTCGGGTA (SEQ ID NO:6587), TAGTAGTTGGGGTTACGTTCGGGGGCG (SEQ ID NO:6588), AGTAGTTGGGGTTACGTTCGGGGGCG (SEQ ID NO:6589), ATAGTAGTTGGGGTTACGTTCGGGGGCG (SEQ ID NO:6590), ATAGTAGTTGGGGTTACGTTCGGGGGC (SEQ ID NO:6591), GTAGTTGGGGTTACGTTCGGGGGCG (SEQ ID NO:6592)

Target697    chr6:50818268-50818397    CGGGCGTAATTTTAGTTGTTGTGACGGGT (SEQ ID NO:6593), CGGGCGTAATTTTAGTTGTTGTGACGGG (SEQ ID NO:6594), TCGGGCGTAATTTTAGTTGTTGTGACGGG (SEQ ID NO:6595), TCGGGCGTAATTTTAGTTGTTGTGACGGGT (SEQ ID NO:6596), TCGGGCGTAATTTTAGTTGTTGTGACGG (SEQ ID NO:6597), TAGTAGTTGGGGTTACGTTCGGGGGCG (SEQ ID NO:6598), AGTAGTTGGGGTTACGTTCGGGGGCG (SEQ ID NO:6599), ATAGTAGTTGGGGTTACGTTCGGGGGCG (SEQ ID NO:6600), ATAGTAGTTGGGGTTACGTTCGGGGGC (SEQ ID NO:6601), GTAGTTGGGGTTACGTTCGGGGGCG (SEQ ID NO:6602)

FIGURE 5 CONTINUED

Target698    chr6:50818501-50818554    GGGGTTTGAAGGGGTTGTAGCGTGGGA (SEQ ID NO:6603), TGGGGTTTGAAGGGGGTTGTAGCGTGGG (SEQ ID NO:6604), TTGGGGTTTGAAGGGGTTGTAGCGTGG (SEQ ID NO:6605), GGGTTTGAAGGGGTTGTAGCGTGGGAA (SEQ ID NO:6606), GGGGTTTGAAGGGGTTGTAGCGTGGGAA (SEQ ID NO:6607), GGAGGAAAAGCGAAGAGTAGGGTGGGT (SEQ ID NO:6608), AGGAGGAAAAGCGAAGAGTAGGGTGGGT (SEQ ID NO:6609), AGGAGGAAAAGCGAAGAGTAGGGTGGG (SEQ ID NO:6610), GAGGAGGAAAAGCGAAGAGTAGGGTGGGT (SEQ ID NO:6611), GAGGAGGAAAAGCGAAGAGTAGGGTGGG (SEQ ID NO:6612)

Target699    chr6:56716141-56716204    CGTTATGGTTTTTTAGGAGGTAGATGGGCGA (SEQ ID NO:6613), TCGTTATGGTTTTTTAGGAGGTAGATGGGCG (SEQ ID NO:6614), TCGTTATGGTTTTTTAGGAGGTAGATGGGCGA (SEQ ID NO:6615), CGTTATGGTTTTTTAGGAGGTAGATGGGCGAA (SEQ ID NO:6616), TTCGTTATGGTTTTTTAGGAGGTAGATGGGCG (SEQ ID NO:6617), GGGGATGGAGTGGGGGAAGAGAGTTGC (SEQ ID NO:6618), GGATGGAGTGGGGGAAGAGAGTTGCGG (SEQ ID NO:6619), GGGGATGGAGTGGGGGAAGAGAGTTGCGG (SEQ ID NO:6620), GGGAAGGGGATGGAGTGGGGGAAGAGA (SEQ ID NO:6621), GATGGAGTGGGGGAAGAGAGTTGCGGA (SEQ ID NO:6622)

Target700    chr6:56716301-56716537    AGGTGTTTTTCGGAGTTGGGGATGCGG (SEQ ID NO:6623), GGTGTTTTTCGGAGTTGGGGATGCGGA (SEQ ID NO:6624), AGGTGTTTTTCGGAGTTGGGGATGCGGA (SEQ ID NO:6625), GGTGTTTTTCGGAGTTGGGGATGCGGAG (SEQ ID NO:6626), TGTTTTTCGGAGTTGGGGATGCGGAGT (SEQ ID NO:6627), ATTTAGTTTGGGGGTAGGGAGGGCGGC (SEQ ID NO:6628), GGCGGTGGTTGGTGGGGGAGATGTTTA (SEQ ID NO:6629), GCGGTGGTTGGTGGGGGAGATGTTTAA (SEQ ID NO:6630), TTTAGTTTGGGGGTAGGGAGGGCGGC (SEQ ID NO:6631), GATTTAGTTTGGGGGTAGGGAGGGCGGC (SEQ ID NO:6632)

Target701    chr6:75918081-75918119    TCGGAGTTGAGTAGTTATTTTTCGGGGATTTAAAGA (SEQ ID NO:6633), TGGAGAGGGTAATGTGTACGTTTTTGGGG (SEQ ID NO:6634), TGGAGAGGGTAATGTGTACGTTTTTGGGGA (SEQ ID NO:6635), GGAGAGGGTAATGTGTACGTTTTTGGGGA (SEQ ID NO:6636), TGCGGTTTTTAGTCGTAGGAAAGGGAAGT (SEQ ID NO:6637), AGTCGTAGGAAAGGGAAGTTCGTGATTGT (SEQ ID NO:6638)

Target702    chr6:85475878-85475883    AGGTTTGGTTGGGCGGTTTGTTCGTGT (SEQ ID NO:6639), GGTTTGGTTGGGCGGTTTGTTCGTGTT (SEQ ID NO:6640), AGGTTTGGTTGGGCGGTTTGTTCGTGTT (SEQ ID NO:6641), TAGGTTTGGTTGGGCGGTTTGTTCGTGT (SEQ ID NO:6642), TAGGTTTGGTTGGGCGGTTTGTTCGTG (SEQ ID NO:6643)

Target703    chr6:85475908-85475954    ACGCGCGGTTTTTGGAGGTCGGATATT (SEQ ID NO:6644), ACGCGCGGTTTTTGGAGGTCGGATAT (SEQ ID NO:6645), ACGCGCGGTTTTTGGAGGTCGGATATTA (SEQ ID NO:6646), CGCGCGGTTTTTGGAGGTCGGATATTA (SEQ ID NO:6647), AGCGGGAGTAGGAATTTGGTAGGCGAT (SEQ ID NO:6648), AGGTTTGGTTGGGCGGTTTGTTCGTGT (SEQ ID NO:6649), GGTTTGGTTGGGCGGTTTGTTCGTGTT (SEQ ID NO:6650), AGGTTTGGTTGGGCGGTTTGTTCGTGTT (SEQ ID NO:6651), TAGGTTTGGTTGGGCGGTTTGTTCGTGTT (SEQ ID NO:6652), TAGGTTTGGTTGGGCGGTTTGTTCGTG (SEQ ID NO:6653)

Target704    chr6:85476171-85476211    GGTTTTGCGATCGGTTTAGAGTTGTGTGG (SEQ ID NO:6654), GGTTTTGCGATCGGTTTAGAGTTGTGTGGT (SEQ ID NO:6655), AGGTTTTGCGATCGGTTTAGAGTTGTGTGG (SEQ ID NO:6656), AGGTTTTGCGATCGGTTTAGAGTTGTGTGGT (SEQ ID NO:6657), GTTTTGCGATCGGTTTAGAGTTGTGTGGT (SEQ ID NO:6658), TGGGGCGGGGTATTTTAGTTGAACGGA (SEQ ID NO:6659), TTGGGGCGGGGTATTTTAGTTGAACGG (SEQ ID NO:6660), TGGGGCGGGGTATTTTAGTTGAACGGAA (SEQ ID NO:6661), TTGGGGCGGGGTATTTTAGTTGAACGGA (SEQ ID NO:6662), GGGGCGGGGTATTTTAGTTGAACGGAA (SEQ ID NO:6663)

Target705    chr6:85476373-85476389    GAGTGGGAGTGGGATAAGGCGGGAGTT (SEQ ID NO:6664), GGAGTGGGAGTGGGATAAGGCGGGAGT (SEQ ID NO:6665), GGAGTGGGAGTGGGATAAGGCGGGAG (SEQ ID NO:6666), GGGAGTGGGAGTGGGATAAGGCGGGAG (SEQ ID NO:6667), AGTGGGAGTGGGATAAGGCGGGAGTTA (SEQ ID NO:6668)

Target706    chr6:85476905-85476922    AGGGCGTCGAGGATAGGATAAGGCGTT (SEQ ID NO:6669), TAGGGCGTCGAGGATAGGATAAGGCGT (SEQ ID NO:6670), GGGCGTCGAGGATAGGATAAGGCGTTT (SEQ ID NO:6671), AGGGCGTCGAGGATAGGATAAGGCGTTT (SEQ ID NO:6672), AGTGTGAGTAGGGCGTCGAGGATAGGA (SEQ ID NO:6673), GGAGTCGAGGTTGGAGTGGGTTGTAGT (SEQ ID NO:6674), AGGAGTCGAGGTTGGAGTGGGTTGTAGT (SEQ ID NO:6675), AGGAGTCGAGGTTGGAGTGGGTTGTAG (SEQ ID NO:6676), TTAGGAGTCGAGGTTGGAGTGGGTTGT (SEQ ID NO:6677), GGAGTCGAGGTTGGAGTGGGTTGTAGTT (SEQ ID NO:6678)

Target707    chr6:85477151-85477187    TCGAGTTGGTTGGGCGGAGTGGTAGTT (SEQ ID NO:6679), TTCGAGTTGGTTGGGCGGAGTGGTAGT (SEQ ID NO:6680), CGAGTTGGTTGGGCGGAGTGGTAGTTT (SEQ ID NO:6681), TCGAGTTGGTTGGGCGGAGTGGTAGTTT (SEQ ID NO:6682), TTCGAGTTGGTTGGGCGGAGTGGTAGTT (SEQ ID NO:6683), TGATTTGTAAAGTGCGAGGGTTTGGCGT (SEQ ID NO:6684), GATTTGTAAAGTGCGAGGGTTTGGCGT (SEQ ID NO:6685), TGATTTGTAAAGTGCGAGGGTTTGGCG (SEQ ID NO:6686), TGTAAAGTGCGAGGGTTTGGCGTTTTT (SEQ ID NO:6687), TTGTAAAGTGCGAGGGTTTGGCGTTTT (SEQ ID NO:6688)

FIGURE 5 CONTINUED

| | | |
|---|---|---|
| Target708 | chr6:85477236-85477254 | AGTAAAGAAAGCGGGGATAGGGCGCGT (SEQ ID NO:6689), GAGTAAAGAAAGCGGGGATAGGGCGCG (SEQ ID NO:6690), AAGAAAGCGGGGATAGGGCGCGTAATC (SEQ ID NO:6691), AGAGTAAAGAAAGCGGGGATAGGGCGCG (SEQ ID NO:6692), GAGTAAAGAAAGCGGGGATAGGGCGCGT (SEQ ID NO:6693) |
| Target709 | chr6:99295742-99295866 | GTGGCGTTGCGGTGAAAGTCGGTGTTT (SEQ ID NO:6694), TGGCGTTGCGGTGAAAGTCGGTGTTTA (SEQ ID NO:6695), ATTTTGGAGTCGTCGGGAGTGGCGTTG (SEQ ID NO:6696), TGGCGTTGCGGTGAAAGTCGGTGTTT (SEQ ID NO:6697), GTGGCGTTGCGGTGAAAGTCGGTGTTTA (SEQ ID NO:6698), GCGTCGGTAGAATGGTTTTTGGGGAGGT (SEQ ID NO:6699), TGCGTCGGTAGAATGGTTTTTGGGGAGG (SEQ ID NO:6700), TGCGTCGGTAGAATGGTTTTTGGGGAGGT (SEQ ID NO:6701), GCGTCGGTAGAATGGTTTTTGGGGAGG (SEQ ID NO:6702), TGGTTGGGCGTTTTAGGGGTTTTTCGT (SEQ ID NO:6703) |
| Target710 | chr6:99295933-99296103 | GTTTGGCGTTTGGGGAGTCGGGGTTTT (SEQ ID NO:6704), TTGGCGTTTGGGGAGTCGGGGTTTTTG (SEQ ID NO:6705), GCGTTTGGGGAGTCGGGGTTTTTGTGT (SEQ ID NO:6706), TTGGGTGAGAGCGGAGGGGTTTTTGGGA (SEQ ID NO:6707), GGAGTCGGGGTTTTTGTGTGTGTCGGG (SEQ ID NO:6708), TATGCGGTAAGAGGGGAGGTCGGGAGGG (SEQ ID NO:6709), TTATGCGGTAAGAGGGGAGGTCGGGAGG (SEQ ID NO:6710), GTAAGAGGGGAGGTCGGGAGGGCGGAAG (SEQ ID NO:6711), TTATGCGGTAAGAGGGGAGGTCGGGAGGG (SEQ ID NO:6712), TAAGAGGGGAGGTCGGGAGGGCGGAAG (SEQ ID NO:6713) |
| Target711 | chr6:99296148-99296200 | CGGTTTCGTTGCGGGAGGTTAGAGGGT (SEQ ID NO:6714), GTTGCGGGAGGTTAGAGGGTTGCGTTT (SEQ ID NO:6715), TTCGTTGCGGGAGGTTAGAGGGTTGCG (SEQ ID NO:6716), TGCGGGAGGTTAGAGGGTTGCGTTTC (SEQ ID NO:6717), TTTCGTTGCGGGAGGTTAGAGGGTTGC (SEQ ID NO:6718), TTTGGGTTTTGAAAGGTGGCGGGGTGG (SEQ ID NO:6719), TGGTTTGGGTTTTGAAAGGTGGCGGGG (SEQ ID NO:6720), GGTTTGGGTTTTGAAAGGTGGCGGGGT (SEQ ID NO:6721), GTTTGGGTTTTGAAAGGTGGCGGGGTG (SEQ ID NO:6722), TTGGTTTGGGTTTTGAAAGGTGGCGGGG (SEQ ID NO:6723) |
| Target712 | chr6:99296227-99296254 | GAGTAGTGGGGTTTCGGGGAGTAGCGG (SEQ ID NO:6724), GGAGTAGTGGGGTTTCGGGGAGTAGCG (SEQ ID NO:6725), AGAGGGGAGTAGTGGGGTTTCGGGGAG (SEQ ID NO:6726), AGGGGAGTAGTGGGGTTTCGGGGAGTA (SEQ ID NO:6727), GGGAGTAGTGGGGTTTCGGGGAGTAGC (SEQ ID NO:6728), TTTGGGTTTTGAAAGGTGGCGGGGTGG (SEQ ID NO:6729), TGGTTTGGGTTTTGAAAGGTGGCGGGG (SEQ ID NO:6730), GGTTTGGGTTTTGAAAGGTGGCGGGGT (SEQ ID NO:6731), GGTTTGGGGTCGTTTGGGGAGGGGATTA (SEQ ID NO:6732), GTTTGGGTTTTGAAAGGTGGCGGGGTG (SEQ ID NO:6733) |
| Target713 | chr6:99296263-99296330 | GAGTAGTGGGGTTTCGGGGAGTAGCGG (SEQ ID NO:6734), GGAGTAGTGGGGTTTCGGGGAGTAGCG (SEQ ID NO:6735), AGAGGGGAGTAGTGGGGTTTCGGGGAG (SEQ ID NO:6736), AGGGGAGTAGTGGGGTTTCGGGGAGTA (SEQ ID NO:6737), GGGAGTAGTGGGGTTTCGGGGAGTAGC (SEQ ID NO:6738), TTTGGGTTTTGAAAGGTGGCGGGGTGG (SEQ ID NO:6739), TGGTTTGGGTTTTGAAAGGTGGCGGGG (SEQ ID NO:6740), GGTTTGGGTTTTGAAAGGTGGCGGGGT (SEQ ID NO:6741), GGTTTGGGGTCGTTTGGGGAGGGGATTA (SEQ ID NO:6742), TTGGGTTTTGAAAGGTGGCGGGGTGGT (SEQ ID NO:6743) |
| Target714 | chr6:100050797-100050813 | TGCGGGTTTATTCGGTAGCGGTCGGTA (SEQ ID NO:6744), AGTGCGGGTTTATTCGGTAGCGGTCGG (SEQ ID NO:6745), GAGTGCGGGTTTATTCGGTAGCGGTCG (SEQ ID NO:6746), GTGCGGGTTTATTCGGTAGCGGTCGGT (SEQ ID NO:6747), GCGGGTTTATTCGGTAGCGGTCGGTAG (SEQ ID NO:6748), GCGAGCGTGTTGTTGAATTGTAATGTTTCGGG (SEQ ID NO:6749), GCGTGTTGTTGAATTGTAATGTTTCGGGGT (SEQ ID NO:6750), GCGTGTTGTTGAATTGTAATGTTTCGGGG (SEQ ID NO:6751), AGCGTGTTGTTGAATTGTAATGTTTCGGGG (SEQ ID NO:6752), AGCGTGTTGTTGAATTGTAATGTTTCGGGGT (SEQ ID NO:6753) |
| Target715 | chr6:100051019-100051034 | TGGAGAATTTCGGTTAAAAGGTAATTTGAGAGGGA (SEQ ID NO:6754), TTGGAGAATTTCGGTTAAAAGGTAATTTGAGAGGGA (SEQ ID NO:6755), TGGAGAATTTCGGTTAAAAGGTAATTTGAGAGGGAT (SEQ ID NO:6756), GTTGGAGAATTTCGGTTAAAAGGTAATTTGAGAGGG (SEQ ID NO:6757), GGCGGCGATGGGTTTTGGGAACGTTAT (SEQ ID NO:6758), TAATTGTATGGTCGGTGGATGCGCGGC (SEQ ID NO:6759), GGCGGCGATGGGTTTTGGGAACGTTATT (SEQ ID NO:6760), AATTGTATGGTCGGTGGATGCGCGGC (SEQ ID NO:6761), GGCGGCGATGGGTTTTGGGAACGTTA (SEQ ID NO:6762) |
| Target716 | chr6:100051064-100051132 | GGCGTTCGGGTTGCGTTTTGGTTGTTA (SEQ ID NO:6763), GGCGTTCGGGTTGCGTTTTGGTTGTT (SEQ ID NO:6764), GGCGTTCGGGTTGCGTTTTGGTTGTTAT (SEQ ID NO:6765), GCGTTCGGGTTGCGTTTTGGTTGTTAT (SEQ ID NO:6766), GGCGTTCGGGTTGCGTTTTGGTTGT (SEQ ID NO:6767), GGCGGCGATGGGTTTTGGGAACGTTAT (SEQ ID NO:6768), TAAGGTCGGGTTTGAATAGGGCGCGCGG (SEQ ID NO:6769), TCGGGCGGGCGGGTTTAGTTTGGATTAG (SEQ ID NO:6770), GCGCGGGTGGGATATTAAGGTCGGGTT (SEQ ID NO:6771), GAGGCGCGGGTGGGATATTAAGGTCGG (SEQ ID NO:6772) |
| Target717 | chr6:100051147-100051154 | GGCGTGTTATTTGGTGGCGTTTTTAGAGT (SEQ ID NO:6773), TCGGGTTGCGTTTTGGTTGTTATTTTGGA (SEQ ID NO:6774), CGGGTTGCGTTTTGGTTGTTATTTTGGAGT (SEQ ID NO:6775), CGGGTTGCGTTTTGGTTGTTATTTTGGAG (SEQ ID NO:6776), TCGGGTTGCGTTTTGGTTGTTATTTTGGAG (SEQ ID NO:6777), TAAGGTCGGGTTTGAATAGGGCGCGCGG (SEQ ID NO:6778), |

FIGURE 5 CONTINUED

TCGGGCGGGCGGGTTAGTTTGGATTAG (SEQ ID NO:6779), GCGCGGGTGGGATATTAAGGTCGGGTT
{SEQ ID NO:6780}, GAGGCGCGGGTGGGATATTAAGGTCGG {SEQ ID NO:6781},
GTCGGGCGGGCGGGTTAGTTTGGATTA (SEQ ID NO:6782)

Target718   chr6:100051186-100051194   GGCGTGTTATTTGGTGGCGTTTTTAGAGT (SEQ ID NO:6783), GGCGTGTTATTTGGTGGCGTTTTTAGAGTT
{SEQ ID NO:6784}, TTGGTGGCGTTTTTAGAGTTTATCGTCGTC (SEQ ID NO:6785),
TTTGGTGGCGTTTTTAGAGTTTATCGTCGTC (SEQ ID NO:6786),
GGCGTGTTATTTGGTGGCGTTTTTAGAGTTTA (SEQ ID NO:6787),
TCGGGCGGGCGGGTTAGTTTGGATTAG (SEQ ID NO:6788), GTCGGGCGGGCGGGTTAGTTTGGATTA
{SEQ ID NO:6789}, CGGGCGGGCGGGTTAGTTTGGATTAGT (SEQ ID NO:6790),
GGGCGGGCGGGTTAGTTTGGATTAGTT {SEQ ID NO:6791}, GGCGGGCGGGTTAGTTTGGATTAGTTGC
{SEQ ID NO:6792}

Target719   chr6:106429346-106429563   TCGTTGGGGAAATTCGTAGGGGTGCGG {SEQ ID NO:6793}, CGTTGGGGAAATTCGTAGGGGTGCGGT
{SEQ ID NO:6794}, GTTGGGGAAATTCGTAGGGGTGCGGTT (SEQ ID NO:6795),
TGGGGAAATTCGTAGGGGTGCGGTTTG {SEQ ID NO:6796}, TTCGTTGGGGAAATTCGTAGGGGTGCG
{SEQ ID NO:6797}, GGTTTTCGGAAAGGCGAGGAGGAGCGA (SEQ ID NO:6798),
GTTTTCGGAAAGGCGAGGAGGAGCGAG {SEQ ID NO:6799}, TTTTCGGAAAGGCGAGGAGGAGCGAGC
{SEQ ID NO:6800}, CGTAGGCGTGTCGTGTGAGTTTTTGCG (SEQ ID NO:6801),
CGTAGGCGTGTCGTGTGAGTTTTTGCGT (SEQ ID NO:6802)

Target720   chr6:106429659-106429674   GGTTTGCGGGGTTTTTGGGGGCGTATT (SEQ ID NO:6803), TGGGGAAATTCGTAGGGGTGCGGTTTG
{SEQ ID NO:6804}, GTTTGCGGGGTTTTTGGGGGCGTATTT (SEQ ID NO:6805),
GGTTTGCGGGGTTTTTGGGGGCGTAT (SEQ ID NO:6806), GGTTTGCGGGGTTTTTGGGGGCGTATTT {SEQ
ID NO:6807}, TCGTGTGGTTTTCGTCGTAGTGGAGTT {SEQ ID NO:6808},
TTCGTGTGGTTTTCGTCGTAGTGGAGT (SEQ ID NO:6809), CGTGTGGTTTTCGTCGTAGTGGAGTTGT {SEQ
ID NO:6810}, CGTGTGGTTTTCGTCGTAGTGGAGTTG (SEQ ID NO:6811),
TCGTGTGGTTTTCGTCGTAGTGGAGTTGT (SEQ ID NO:6812)

Target721   chr6:106433873-106434266   TGGACGCGGGGTTTTTAGTTCGGAGGT (SEQ ID NO:6813), TGGGTAGGGCGTCGGGGTTTTCGGATTT {SEQ
ID NO:6814}, TTGGGTAGGGCGTCGGGGTTTTCGGATT (SEQ ID NO:6815),
TTTGGGTAGGGCGTCGGGGTTTTCGGAT (SEQ ID NO:6816), TTGTTTTGGGGTTTGGGTAGGGCGTCG {SEQ
ID NO:6817}, GTTTCGGCGGGGAGAGGAAGCGTTTTGG {SEQ ID NO:6818},
TGGGTAGAAGTCGCGCGTGTGTTCGAG (SEQ ID NO:6819), TTTCGGCGGGGAGAGGAAGCGTTTTGGT
{SEQ ID NO:6820}, GTGGGTAGAAGTCGCGCGTGTGTTCGA (SEQ ID NO:6821),
TTCGGCGGGAGAGGAAGCGTTTTGGTC (SEQ ID NO:6822)

Target722   chr6:106434387-106434393   CGGGGCGAGTAAAAGTAGGATTTCGGT (SEQ ID NO:6823), TCGGGGCGAGTAAAAGTAGGATTTCGGT
{SEQ ID NO:6824}, TCGGGGCGAGTAAAAGTAGGATTTCGG (SEQ ID NO:6825},
CGGGGCGAGTAAAAGTAGGATTTCGGTCG (SEQ ID NO:6826),
CGGGGCGAGTAAAAGTAGGATTTCGGTT (SEQ ID NO:6827)

Target723   chr6:137814512-137814524   CGGGTTCGTTCGTTGTTTATTTGAGTAAGTTTTTGG (SEQ ID NO:6828),
CGGGTTCGTTCGTTGTTTATTTGAGTAAGTTTTTG (SEQ ID NO:6829),
GGGTTCGTTCGTTGTTTATTTGAGTAAGTTTTTGGA (SEQ ID NO:6830),
CGTTGTTTATTTGAGTAAGTTTTTGGATTCGGTCGA (SEQ ID NO:6831),
TCGTTGTTTATTTGAGTAAGTTTTTGGATTCGGTCG (SEQ ID NO:6832),
TGGGTAGCGGTTTTTAGTATTGGGTTGGT (SEQ ID NO:6833),
TGGGTAGCGGTTTTTAGTATTGGGTTGGTT (SEQ ID NO:6834),
TTGGGTAGCGGTTTTTAGTATTGGGTTGGT (SEQ ID NO:6835),
GTTGGGTAGCGGTTTTTAGTATTGGGTTGG (SEQ ID NO:6836),
GTTGGGTAGCGGTTTTTAGTATTGGGTTGGT (SEQ ID NO:6837)

Target724   chr6:137814558-137814568   TTGGTTGTGGAGAGAGCGGATAGGTGC (SEQ ID NO:6838), CGGGTTATGTTGGTTGTGGAGAGAGCGG
{SEQ ID NO:6839}, GTTGGTTGTGGAGAGAGCGGATAGGTGC (SEQ ID NO:6840),
TGTTGGTTGTGGAGAGAGCGGATAGGTGC (SEQ ID NO:6841),
CGGGTTATGTTGGTTGTGGAGAGAGCGGA (SEQ ID NO:6842),
TGGGTAGCGGTTTTTAGTATTGGGTTGGT (SEQ ID NO:6843),
TGGGTAGCGGTTTTTAGTATTGGGTTGGTT (SEQ ID NO:6844),
TTGGGTAGCGGTTTTTAGTATTGGGTTGGT (SEQ ID NO:6845),
GTTGGGTAGCGGTTTTTAGTATTGGGTTGG (SEQ ID NO:6846),
GTTGGGTAGCGGTTTTTAGTATTGGGTTGGT (SEQ ID NO:6847)

Target725   chr6:137814636-137814655   GCGGCGGCGGTATTTGGTAGATGGTGT (SEQ ID NO:6848), GCGGCGGCGGTATTTGGTAGATGGTGT {SEQ
ID NO:6849}, CGGCGGCGGTATTTGGTAGATGGTGTA (SEQ ID NO:6850),
GCGGCGGCGGTATTTGGTAGATGGTGTA (SEQ ID NO:6851), TTGGTTGTGGAGAGAGCGGATAGGTGC
{SEQ ID NO:6852}, CGGGTGTATTTTATTTTGGGCGGCGCGT (SEQ ID NO:6853),
TCGGTGTATTTTATTTTGGGCGGCGCGC (SEQ ID NO:6854), TCGGTGTATTTTATTTTGGGCGGCGCGT (SEQ
ID NO:6855), CGGTGTATTTTATTTTGGGCGGCGCGTT (SEQ ID NO:6856),
TTCGGTGTATTTTATTTTGGGCGGCGCG (SEQ ID NO:6857)

Target726   chr6:137814666-137814690   GAGGGCGTTTTGAGTAGCGAGTGGGGA (SEQ ID NO:6858), AGGGCGTTTTGAGTAGCGAGTGGGGAG
{SEQ ID NO:6859}, TGGAGGGCGTTTTGAGTAGCGAGTGGG (SEQ ID NO:6860),
GGCGTTTTGAGTAGCGAGTGGGGAGGT (SEQ ID NO:6861), CGTGGAGGGCGTTTTGAGTAGCGAGTG
{SEQ ID NO:6862}, CGGTGTATTTTATTTTGGGCGGCGCGT (SEQ ID NO:6863),

FIGURE 5 CONTINUED

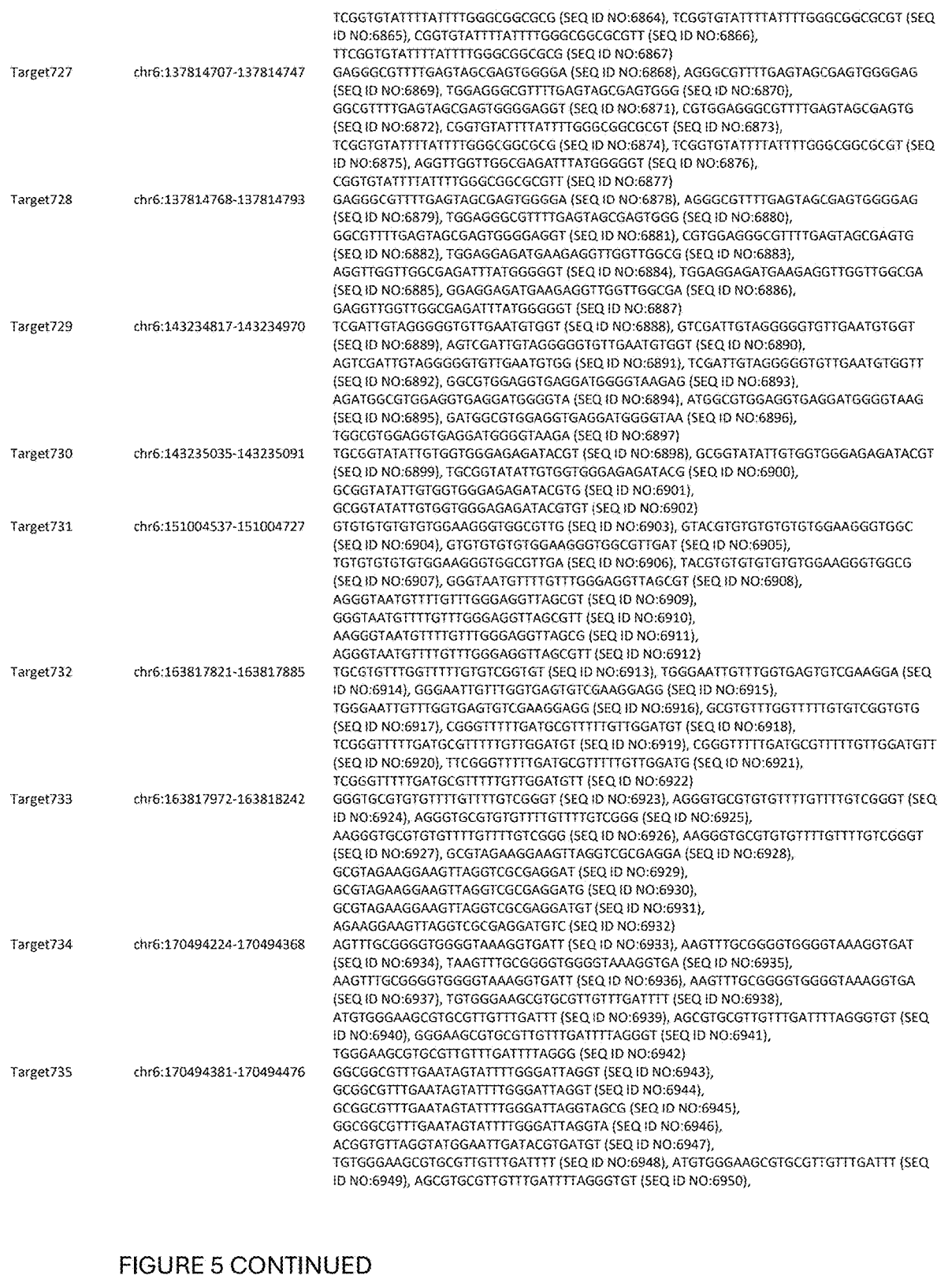

| | | |
|---|---|---|
| | | TCGGTGTATTTTATTTTGGGCGGCGCG (SEQ ID NO:6864), TCGGTGTATTTTATTTTGGGCGGCGCGT (SEQ ID NO:6865), CGGTGTATTTTATTTTGGGCGGCGCGTT (SEQ ID NO:6866), TTCGGTGTATTTTATTTTGGGCGGCGCG (SEQ ID NO:6867) |
| Target727 | chr6:137814707-137814747 | GAGGGCGTTTTGAGTAGCGAGTGGGGA (SEQ ID NO:6868), AGGGCGTTTTGAGTAGCGAGTGGGGAG (SEQ ID NO:6869), TGGAGGGCGTTTTGAGTAGCGAGTGGG (SEQ ID NO:6870), GGCGTTTTGAGTAGCGAGTGGGGAGGT (SEQ ID NO:6871), CGTGGAGGGCGTTTTGAGTAGCGAGTG (SEQ ID NO:6872), CGGTGTATTTTATTTTGGGCGGCGCGT (SEQ ID NO:6873), TCGGTGTATTTTATTTTGGGCGGCGCG (SEQ ID NO:6874), TCGGTGTATTTTATTTTGGGCGGCGCGT (SEQ ID NO:6875), AGGTTGGTTGGCGAGATTTATGGGGGT (SEQ ID NO:6876), CGGTGTATTTTATTTTGGGCGGCGCGTT (SEQ ID NO:6877) |
| Target728 | chr6:137814768-137814793 | GAGGGCGTTTTGAGTAGCGAGTGGGGA (SEQ ID NO:6878), AGGGCGTTTTGAGTAGCGAGTGGGGAG (SEQ ID NO:6879), TGGAGGGCGTTTTGAGTAGCGAGTGGG (SEQ ID NO:6880), GGCGTTTTGAGTAGCGAGTGGGGAGGT (SEQ ID NO:6881), CGTGGAGGGCGTTTTGAGTAGCGAGTG (SEQ ID NO:6882), TGGAGGAGATGAAGAGGTTGGTTGGCG (SEQ ID NO:6883), AGGTTGGTTGGCGAGATTTATGGGGGT (SEQ ID NO:6884), TGGAGGAGATGAAGAGGTTGGTTGGCGA (SEQ ID NO:6885), GGAGGAGATGAAGAGGTTGGTTGGCGA (SEQ ID NO:6886), GAGGTTGGTTGGCGAGATTTATGGGGGT (SEQ ID NO:6887) |
| Target729 | chr6:143234817-143234970 | TCGATTGTAGGGGGTGTTGAATGTGGT (SEQ ID NO:6888), GTCGATTGTAGGGGGTGTTGAATGTGGT (SEQ ID NO:6889), AGTCGATTGTAGGGGGTGTTGAATGTGGT (SEQ ID NO:6890), AGTCGATTGTAGGGGGTGTTGAATGTGG (SEQ ID NO:6891), TCGATTGTAGGGGGTGTTGAATGTGGTT (SEQ ID NO:6892), GGCGTGGAGGTGAGGATGGGGTAAGAG (SEQ ID NO:6893), AGATGGCGTGGAGGTGAGGATGGGGTA (SEQ ID NO:6894), ATGGCGTGGAGGTGAGGATGGGGTAAG (SEQ ID NO:6895), GATGGCGTGGAGGTGAGGATGGGGTAA (SEQ ID NO:6896), TGGCGTGGAGGTGAGGATGGGGTAAGA (SEQ ID NO:6897) |
| Target730 | chr6:143235035-143235091 | TGCGGTATATTGTGGTGGGAGAGATACGT (SEQ ID NO:6898), GCGGTATATTGTGGTGGGAGAGATACGT (SEQ ID NO:6899), TGCGGTATATTGTGGTGGGAGAGATACG (SEQ ID NO:6900), GCGGTATATTGTGGTGGGAGAGATACGTG (SEQ ID NO:6901), GCGGTATATTGTGGTGGGAGAGATACGTGT (SEQ ID NO:6902) |
| Target731 | chr6:151004537-151004727 | GTGTGTGTGTGGAAGGGTGGCGTTG (SEQ ID NO:6903), GTACGTGTGTGTGTGTGGAAGGGTGGC (SEQ ID NO:6904), GTGTGTGTGTGGAAGGGTGGCGTTGAT (SEQ ID NO:6905), TGTGTGTGTGTGGAAGGGTGGCGTTGA (SEQ ID NO:6906), TACGTGTGTGTGTGTGGAAGGGTGGCG (SEQ ID NO:6907), GGGTAATGTTTTGTTTGGGAGGTTAGCGT (SEQ ID NO:6908), AGGGTAATGTTTTGTTTGGGAGGTTAGCGT (SEQ ID NO:6909), GGGTAATGTTTTGTTTGGGAGGTTAGCGTT (SEQ ID NO:6910), AAGGGTAATGTTTTGTTTGGGAGGTTAGCG (SEQ ID NO:6911), AGGGTAATGTTTTGTTTGGGAGGTTAGCGTT (SEQ ID NO:6912) |
| Target732 | chr6:163817821-163817885 | TGCGTGTTTGGTTTTTGTGTCGGTGT (SEQ ID NO:6913), TGGGAATTGTTTGGTGAGTGTCGAAGGA (SEQ ID NO:6914), GGGAATTGTTTGGTGAGTGTCGAAGGAGG (SEQ ID NO:6915), TGGGAATTGTTTGGTGAGTGTCGAAGGAGG (SEQ ID NO:6916), GCGTGTTTGGTTTTTGTGTCGGTGTG (SEQ ID NO:6917), CGGGTTTTTGATGCGTTTTTGTTGGATGT (SEQ ID NO:6918), TCGGGTTTTTGATGCGTTTTTGTTGGATGT (SEQ ID NO:6919), CGGGTTTTTGATGCGTTTTTGTTGGATGTT (SEQ ID NO:6920), TTCGGGTTTTTGATGCGTTTTTGTTGGATG (SEQ ID NO:6921), TCGGGTTTTTGATGCGTTTTTGTTGGATGTT (SEQ ID NO:6922) |
| Target733 | chr6:163817972-163818242 | GGGTGCGTGTGTTTTGTTTTGTCGGGT (SEQ ID NO:6923), AGGGTGCGTGTGTTTTGTTTTGTCGGGT (SEQ ID NO:6924), AGGGTGCGTGTGTTTTGTTTTGTCGGG (SEQ ID NO:6925), AAGGGTGCGTGTGTTTTGTTTTGTCGGG (SEQ ID NO:6926), AAGGGTGCGTGTGTTTTGTTTTGTCGGGT (SEQ ID NO:6927), GCGTAGAAGGAAGTTAGGTCGCGAGGA (SEQ ID NO:6928), GCGTAGAAGGAAGTTAGGTCGCGAGGAT (SEQ ID NO:6929), GCGTAGAAGGAAGTTAGGTCGCGAGGATG (SEQ ID NO:6930), GCGTAGAAGGAAGTTAGGTCGCGAGGATGT (SEQ ID NO:6931), AGAAGGAAGTTAGGTCGCGAGGATGTC (SEQ ID NO:6932) |
| Target734 | chr6:170494224-170494368 | AGTTTGCGGGGTGGGGTAAAGGTGATT (SEQ ID NO:6933), AAGTTTGCGGGGTGGGGTAAAGGTGAT (SEQ ID NO:6934), TAAGTTTGCGGGGTGGGGTAAAGGTGA (SEQ ID NO:6935), AAGTTTGCGGGGTGGGGTAAAGGTGATT (SEQ ID NO:6936), AAGTTTGCGGGGTGGGGTAAAGGTGA (SEQ ID NO:6937), TGTGGGAAGCGTGCGTTGTTTGATTTT (SEQ ID NO:6938), ATGTGGGAAGCGTGCGTTGTTTGATTT (SEQ ID NO:6939), AGCGTGCGTTGTTTGATTTTAGGGTGT (SEQ ID NO:6940), GGGAAGCGTGCGTTGTTTGATTTTAGGGT (SEQ ID NO:6941), TGGGAAGCGTGCGTTGTTTGATTTTAGGG (SEQ ID NO:6942) |
| Target735 | chr6:170494381-170494476 | GGCGGCGTTTGAATAGTATTTTGGGATTAGGT (SEQ ID NO:6943), GCGGCGTTTGAATAGTATTTTGGGATTAGGT (SEQ ID NO:6944), GCGGCGTTTGAATAGTATTTTGGGATTAGGTAGCG (SEQ ID NO:6945), GGCGGCGTTTGAATAGTATTTTGGGATTAGGTA (SEQ ID NO:6946), ACGGTGTTAGGTATGGAATTGATACGTGATGT (SEQ ID NO:6947), TGTGGGAAGCGTGCGTTGTTTGATTTT (SEQ ID NO:6948), ATGTGGGAAGCGTGCGTTGTTTGATTT (SEQ ID NO:6949), AGCGTGCGTTGTTTGATTTTAGGGTGT (SEQ ID NO:6950), |

FIGURE 5 CONTINUED

GGGAAGCGTGCGTTGTTTGATTTTAGGGT (SEQ ID NO:6951), TGGGAAGCGTGCGTTGTTTGATTTTAGGG (SEQ ID NO:6952)

| | | |
|---|---|---|
| Target736 | chr7:391221-391545 | AGAGGAAGTCGGCGGGGGTTAAAGCGTT (SEQ ID NO:6953), TTGGTGGGGGTTGTAGAGGAAGTCGGC (SEQ ID NO:6954), CGGGTTGGTGGGGGGTTGTAGAGGAAGT (SEQ ID NO:6955), GGGTTGTAGAGGAAGTCGGCGGGGGTTA (SEQ ID NO:6956), TCGGGTTGGTGGGGGTTGTAGAGGAAG (SEQ ID NO:6957), TTCGGTTGTTTTTAACGCGCGTGTGAG (SEQ ID NO:6958), TGTTTCGGTTGTTTTTAACGCGCGTGT (SEQ ID NO:6959), TTTCGGTTGTTTTTAACGCGCGTGTGA (SEQ ID NO:6960), TGTTTCGGTTGTTTTTAACGCGCGTGTG (SEQ ID NO:6961), GTTTCGGTTGTTTTTAACGCGCGTGTG (SEQ ID NO:6962) |
| Target737 | chr7:641200-641348 | GTTGATGGAGGTGTTTGGTGTTCGTGT (SEQ ID NO:6963), AGTTGATGGAGGTGTTTGGTGTTCGTGT (SEQ ID NO:6964), AAGTTGATGGAGGTGTTTGGTGTTCGTGT (SEQ ID NO:6965), AAGTTGATGGAGGTGTTTGGTGTTCGTG (SEQ ID NO:6966), TGAAGTTGATGGAGGTGTTTGGTGTTCGT (SEQ ID NO:6967), GGTAGGGGTGGGCGTTAGGGAGTGTTC (SEQ ID NO:6968), CGGGGTCGGGCGTAGGAGTTGTTTGTA (SEQ ID NO:6969), TTAGGGTAGGGGTGGGCGTTAGGGAGT (SEQ ID NO:6970), AGTTAGGGTAGGGGTGGGCGTTAGGGA (SEQ ID NO:6971), GTAGGGGTGGGCGTTAGGGAGTGTTCG (SEQ ID NO:6972) |
| Target738 | chr7:641360-641449 | GTTGATGGAGGTGTTTGGTGTTCGTGT (SEQ ID NO:6973), AGTTGATGGAGGTGTTTGGTGTTCGTGT (SEQ ID NO:6974), AAGTTGATGGAGGTGTTTGGTGTTCGTGT (SEQ ID NO:6975), AAGTTGATGGAGGTGTTTGGTGTTCGTG (SEQ ID NO:6976), TGAAGTTGATGGAGGTGTTTGGTGTTCGT (SEQ ID NO:6977), GTGGGATGGTCGGGTTTTTTGCGGGAA (SEQ ID NO:6978), TACGTGGGATGGTCGGGTTTTTTGCGG (SEQ ID NO:6979), TGGGATGGTCGGGTTTTTTGCGGGAAT (SEQ ID NO:6980), ACGTGGGATGGTCGGGTTTTTTGCGG (SEQ ID NO:6981), GTGGGATGGTCGGGTTTTTTGCGGGAAT (SEQ ID NO:6982) |
| Target739 | chr7:1263851-1263861 | AAGTGTTCGCGGTGGTGGTTCGAGTTC (SEQ ID NO:6983), GAAAGTGTTCGCGGTGGTGGTTCGAGT (SEQ ID NO:6984), AAAGTGTTCGCGGTGGTGGTTCGAGT (SEQ ID NO:6985), AAAGTGTTCGCGGTGGTGGTTCGAGTTC (SEQ ID NO:6986), GAAAGTGTTCGCGGTGGTGGTTCGAGTT (SEQ ID NO:6987) |
| Target740 | chr7:1275046-1275070 | AGATAGGTGTGGAGGGCGGTTGTGGTT (SEQ ID NO:6988), AAGATAGGTGTGGAGGGCGGTTGTGGT (SEQ ID NO:6989), TCGAAGATAGGTGTGGAGGGCGGTTGT (SEQ ID NO:6990), AGGTGTGGAGGGCGGTTGTGGTTTAGC (SEQ ID NO:6991), CGAAGATAGGTGTGGAGGGCGGTTGTG (SEQ ID NO:6992), GACGGAGAGCGTCGGGTTTTTGGTTCG (SEQ ID NO:6993), AGAGCGTCGGGTTTTTGGTTCGGAGGT (SEQ ID NO:6994), GAGAGCGTCGGGTTTTTGGTTCGGAGG (SEQ ID NO:6995), GGAGAGCGTCGGGTTTTTGGTTCGGAG (SEQ ID NO:6996), GAGCGTCGGGTTTTTGGTTCGGAGGTT (SEQ ID NO:6997) |
| Target741 | chr7:1275258-1275268 | AGGGGCGGTTTTTAGGTTTTCGAGGTG (SEQ ID NO:6998), GGGGCGGTTTTTAGGTTTTCGAGGTGA (SEQ ID NO:6999), AGGGGCGGTTTTTAGGTTTTCGAGGTGA (SEQ ID NO:7000), AAGGGGCGGTTTTTAGGTTTTCGAGGT (SEQ ID NO:7001), GGGGCGGTTTTTAGGTTTTCGAGGTGAG (SEQ ID NO:7002), CGTTCGGTCGGGGTAGGAGTGAAGTCG (SEQ ID NO:7003), GTTCGGTCGGGGTAGGAGTGAAGTCGC (SEQ ID NO:7004), CGGTCGAGCGGGTTTTGAGTTGGGTTT (SEQ ID NO:7005), TCGTTCGGTCGGGGTAGGAGTGAAGTC (SEQ ID NO:7006), TTCGTTCGGTCGGGGTAGGAGTGAAGT (SEQ ID NO:7007) |
| Target742 | chr7:1275593-1275598 | GTTTATGGATTCGGAGGAGATCGCGCG (SEQ ID NO:7008), AGTTTATGGATTCGGAGGAGATCGCGCG (SEQ ID NO:7009), GAGTTTATGGATTCGGAGGAGATCGCGCG (SEQ ID NO:7010), CGAGTTTATGGATTCGGAGGAGATCGCGC (SEQ ID NO:7011), TCGTCGGGTTAAGTGGAGGAAGAAGGA (SEQ ID NO:7012), GTTGTCGGAGTTGGGCGCGTTGTGTAG (SEQ ID NO:7013), AGTTGGGCGCGTTGTGTAGGGATAGGT (SEQ ID NO:7014), CGCGTTGTGTAGGGATAGGTCGTCGGG (SEQ ID NO:7015), TTGGGCGCGTTGTGTAGGGATAGGTCG (SEQ ID NO:7016), CGGAGTTGGGCGCGTTGTGTAGGGATA (SEQ ID NO:7017) |
| Target743 | chr7:1275704-1275723 | GGAGTTGGAGAAGATGGAGAAGAAGAAGCG (SEQ ID NO:7018), GGAGTTGGAGAAGATGGAGAAGAAGAAGCGT (SEQ ID NO:7019), AGGAGTTGGAGAAGATGGAGAAGAAGAAGCG (SEQ ID NO:7020), AGGAGTTGGAGAAGATGGAGAAGAAGAAGCGT (SEQ ID NO:7021), GAGTTGGAGAAGATGGAGAAGAAGAAGCGT (SEQ ID NO:7022), CGAGGCGTGCGTTTCGGGGTTTTTGG (SEQ ID NO:7023), CGAGGCGTGCGTTTCGGGGTTTTTG (SEQ ID NO:7024), GAGGCGTGCGTTTCGGGGTTTTTGGC (SEQ ID NO:7025), GAGGCGTGCGTTTCGGGGTTTTTGG (SEQ ID NO:7026), GAGGCGTGCGTTTCGGGGTTTTTGGCG (SEQ ID NO:7027) |
| Target744 | chr7:1275734-1275749 | CGAGAAGAAGTTGTTGAAGAGTTAGGGTCGT (SEQ ID NO:7028), ACGAGAAGAAGTTGTTGAAGAGTTAGGGTCG (SEQ ID NO:7029), ACGAGAAGAAGTTGTTGAAGAGTTAGGGTCGT (SEQ ID NO:7030), GAGTTAGGGTCGTTATTTGTATTCGTTCGGC (SEQ ID NO:7031), AGAGTTAGGGTCGTTATTTGTATTCGTTCGGC (SEQ ID NO:7032), GTAGGTGTCGGGTGTAGGCGGTTCGTC (SEQ ID NO:7033), GTCGTAGGTGTCGGGTGTAGGCGGTTC (SEQ ID NO:7034), GTAGGTGTCGGGTGTAGGCGGTTCGT (SEQ ID NO:7035), GTCGTAGGTGTCGGGTGTAGGCGGTT (SEQ ID NO:7036), TAGGTGTCGGGTGTAGGCGGTTCGTC (SEQ ID NO:7037) |

FIGURE 5 CONTINUED

Target745    chr7:1594934-1595023    CGTTTCGGGTTAGTGCGGAGGTGAGGA (SEQ ID NO:7038), GTGCGGAGGTGAGGAAGAGTTAGGGGG (SEQ ID NO:7039), TGCGGAGGTGAGGAAGAGTTAGGGGGT (SEQ ID NO:7040), GGAGGTTCGGGGGCGGAAGGGTTTATT (SEQ ID NO:7041), ACGTTTCGGGTTAGTGCGGAGGTGAGG (SEQ ID NO:7042), TGTTTTAGGGGATTTTGGAGATAGTCGGCGT (SEQ ID NO:7043), TGTTTTAGGGGATTTTGGAGATAGTCGGCGTT (SEQ ID NO:7044), ATGTTTTAGGGGATTTTGGAGATAGTCGGCGT (SEQ ID NO:7045), TGTTTTAGGGGATTTTGGAGATAGTCGGCGTTT (SEQ ID NO:7046), ATGTTTTAGGGGATTTTGGAGATAGTCGGCGTT (SEQ ID NO:7047)

Target746    chr7:4859441-4859485    GTCGGGAGGTTGACGGGGTTTTGTTTT (SEQ ID NO:7048), TCGGGAGGTTGACGGGGTTTTGTTTTT (SEQ ID NO:7049), GTCGGGAGGTTGACGGGGTTTTGTTTTT (SEQ ID NO:7050), CGGGAGGTTGACGGGGTTTTGTTTTTTCG (SEQ ID NO:7051), CGGGAGGTTGACGGGGTTTTGTTTTTTCGG (SEQ ID NO:7052), TGTTTGGTTCGGCGATGGGAGTTAGGGT (SEQ ID NO:7053), GTTTGGTTCGGCGATGGGAGTTAGGGT (SEQ ID NO:7054), TGTTTGGTTCGGCGATGGGAGTTAGGG (SEQ ID NO:7055), TCGGCGATGGGAGTTAGGGTTTAGGGA (SEQ ID NO:7056), GTGTTTGGTTCGGCGATGGGAGTTAGGG (SEQ ID NO:7057)

Target747    chr7:4859645-4859668    CGGGGATTATATGGGATTTAGTTGTTTGCGG (SEQ ID NO:7058), CGGGGATTATATGGGATTTAGTTGTTTGCGGT (SEQ ID NO:7059), ACGGGGATTATATGGGATTTAGTTGTTTGCGG (SEQ ID NO:7060), ACGGGGATTATATGGGATTTAGTTGTTTGCGGT (SEQ ID NO:7061), CGGGGATTATATGGGATTTAGTTGTTTGCGGTT (SEQ ID NO:7062), TCGTGTGATAGGGGGACGGGGTTAGTT (SEQ ID NO:7063), TTCGTGTGATAGGGGGACGGGGTTAGT (SEQ ID NO:7064), GGTTTTTTCGTGTGATAGGGGGACGGGG (SEQ ID NO:7065), TTTTTCGTGTGATAGGGGGACGGGGTT (SEQ ID NO:7066), TTTTTTCGTGTGATAGGGGGACGGGGT (SEQ ID NO:7067)

Target748    chr7:4859824-4859837    TGTGGGGGTCGGAATAAAAGGGGTTTT (SEQ ID NO:7068), TTGTGGGGGTCGGAATAAAAGGGGTTT (SEQ ID NO:7069), TTTGTGGGGGTCGGAATAAAAGGGGTT (SEQ ID NO:7070), TTTTGTGGGGGTCGGAATAAAAGGGGT (SEQ ID NO:7071), TTGTGGGGGTCGGAATAAAAGGGGTTTT (SEQ ID NO:7072), GTCGGTAGGTGGTTTTGGGATGGAGGT (SEQ ID NO:7073), AGTCGGTAGGTGGTTTTGGGATGGAGGT (SEQ ID NO:7074), AGTCGGTAGGTGGTTTTGGGATGGAGG (SEQ ID NO:7075), GGGATGGAGGTAATTTCGGAGTTGCGGT (SEQ ID NO:7076), TGGGATGGAGGTAATTTCGGAGTTGCGG (SEQ ID NO:7077)

Target749    chr7:4859918-4859926    GTTAGGTTTGTAGGGAGAGGCGACGGG (SEQ ID NO:7078), AGTTAGGTTTGTAGGGAGAGGCGACGGG (SEQ ID NO:7079), AGTTAGGTTTGTAGGGAGAGGCGACGG (SEQ ID NO:7080), GAGTTAGGTTTGTAGGGAGAGGCGACGGG (SEQ ID NO:7081), GAGTTAGGTTTGTAGGGAGAGGCGACGG (SEQ ID NO:7082), GGGGTTTTTGGGTTTTCGGGATTATAGCGT (SEQ ID NO:7083), TGGGGTTTTTGGGTTTTCGGGATTATAGCG (SEQ ID NO:7084), GGGGTTTTTGGGTTTTCGGGATTATAGCG (SEQ ID NO:7085), TGGGGTTTTTGGGTTTTCGGGATTATAGCGT (SEQ ID NO:7086), GGGTTTTTGGGTTTTCGGGATTATAGCGT (SEQ ID NO:7087)

Target750    chr7:27196023-27196321    CGTAGGAGGCGTAGGGTAGGTTGTCGT (SEQ ID NO:7088), TGGTCGTAGGAGGCGTAGGGTAGGTTGT (SEQ ID NO:7089), GGTCGTAGGAGGCGTAGGGTAGGTTGT (SEQ ID NO:7090), TGGTCGTAGGAGGCGTAGGGTAGGTTG (SEQ ID NO:7091), TCGTAGGAGGCGTAGGGTAGGTTGTCGT (SEQ ID NO:7092), CGGAGGCGGTTATGTGGGCGGTTAC (SEQ ID NO:7093), GCGGAGGCGGTTATGTGGGCGGTTAC (SEQ ID NO:7094), TGGGGTTTGGTGTAAATTTGGGGGGTGT (SEQ ID NO:7095), TGTGAGGATTGTTGAGATTGGCGGAGG (SEQ ID NO:7096), GCGGAGGCGGTTATGTGGGCGGTTA (SEQ ID NO:7097)

Target751    chr7:27196351-27196515    GCGGAAAAAGATTTGGAGGTTTCGCGGG (SEQ ID NO:7098), GCGGAAAAAGATTTGGAGGTTTCGCGGGA (SEQ ID NO:7099), GCGGAAAAAGATTTGGAGGTTTCGCGG (SEQ ID NO:7100), CGGAAAAAGATTTGGAGGTTTCGCGGG (SEQ ID NO:7101), CGGAAAAAGATTTGGAGGTTTCGCGGGA (SEQ ID NO:7102), TGGGTAGGCGGATAGGAGAGGGATGGG (SEQ ID NO:7103), GGCGGATAGGAGAGGGATGGGGAGGAT (SEQ ID NO:7104), GGTAGGCGGATAGGAGAGGGATGGGA (SEQ ID NO:7105), TAGGCGGATAGGAGAGGGATGGGGAGG (SEQ ID NO:7106), GGGTTTGGGTAGGCGGATAGGAGAGGG (SEQ ID NO:7107)

Target752    chr7:27196518-27196556    TCGTATTGGGGTTTGCGGACGTTAGGC (SEQ ID NO:7108), TTCGTATTGGGGTTTGCGGACGTTAGGC (SEQ ID NO:7109), GCGGAAAAAGATTTGGAGGTTTCGCGGG (SEQ ID NO:7110), GCGGAAAAAGATTTGGAGGTTTCGCGGGA (SEQ ID NO:7111), GCGGAAAAAGATTTGGAGGTTTCGCGG (SEQ ID NO:7112), CGGGGTAGGTTGTTGCGGGGGGATAGAG (SEQ ID NO:7113), TGGGTAGGCGGATAGGAGAGGGATGGG (SEQ ID NO:7114), GGCGGATAGGAGAGGGATGGGGAGGAT (SEQ ID NO:7115), GGTAGGCGGATAGGAGAGGGATGGGA (SEQ ID NO:7116), TAGGCGGATAGGAGAGGGATGGGGAGG (SEQ ID NO:7117)

Target753    chr7:27196751-27196772    TGTTTCGCGGTGGTTTTGTGGGTAGGA (SEQ ID NO:7118), AGTTTGTTTCGCGGTGGTTTTGTGGGT (SEQ ID NO:7119), TTGTTTCGCGGTGGTTTTGTGGGTAGG (SEQ ID NO:7120), TTGTTTCGCGGTGGTTTTGTGGGTAGGA (SEQ ID NO:7121), TGTTTCGCGGTGGTTTTGTGGGTAGGAT (SEQ ID NO:7122), TCGATTAAGGAAAGGAAGTTGGGAGACGTT (SEQ ID NO:7123), TTCGATTAAGGAAAGGAAGTTGGGAGACGT (SEQ ID NO:7124),

FIGURE 5 CONTINUED

CGATTAAGGAAAGGAAGTTGGGAGACGTTGA (SEQ ID NO:7125),
TCGATTAAGGAAAGGAAGTTGGGAGACGTTG (SEQ ID NO:7126),
TCGATTAAGGAAAGGAAGTTGGGAGACGTTGA (SEQ ID NO:7127)

Target754    chr7:27204751-27204835    GGGTGTACGTAGGGGTGGTGGTGATGG (SEQ ID NO:7128), GGGGTGTACGTAGGGGTGGTGGTGATGG (SEQ ID NO:7129), TCGGGCGTGGGTTTTAGTTAGGAGCGT (SEQ ID NO:7130), GTTTGGGGGTGTACGTAGGGGTGGTGG (SEQ ID NO:7131), AGGTCGGTTGGAGGGTAAGTTCGCGAA (SEQ ID NO:7132), GCGACGGTGTTTGGCGTTTCGTGGAAT (SEQ ID NO:7133), CGACGGTGTTTGGCGTTTCGTGGAATT (SEQ ID NO:7134), GCGACGGTGTTTGGCGTTTCGTGGAATT (SEQ ID NO:7135), GCGACGGTGTTTGGCGTTTCGTGGAA (SEQ ID NO:7136), AAGGCGACGGTGTTTGGCGTTTCGTG (SEQ ID NO:7137)

Target755    chr7:27204848-27204864    GGGTGTACGTAGGGGTGGTGGTGATGG (SEQ ID NO:7138), GGGGTGTACGTAGGGGTGGTGGTGATGG (SEQ ID NO:7139), TCGGGCGTGGGTTTTAGTTAGGAGCGT (SEQ ID NO:7140), GTTTGGGGGTGTACGTAGGGGTGGTGG (SEQ ID NO:7141), GTACGTAGGGGTGGTGGTGATGGTGGT (SEQ ID NO:7142), GCGACGGTGTTTGGCGTTTCGTGGAAT (SEQ ID NO:7143), CGACGGTGTTTGGCGTTTCGTGGAATT (SEQ ID NO:7144), TGGGTTAGTTTTTTCGGTAGGCGGCGA (SEQ ID NO:7145), GCGACGGTGTTTGGCGTTTCGTGGAATT (SEQ ID NO:7146), GCGACGGTGTTTGGCGTTTCGTGGAA (SEQ ID NO:7147)

Target756    chr7:27204879-27205108    GGGTGTACGTAGGGGTGGTGGTGATGG (SEQ ID NO:7148), GGGGTGTACGTAGGGGTGGTGGTGATGG (SEQ ID NO:7149), ACGGGTTGAAGTCGGGGTGTTCGGTTA (SEQ ID NO:7150), TACGGGTTGAAGTCGGGGTGTTCGGTT (SEQ ID NO:7151), TGTACGGGTTGAAGTCGGGGTGTTCGG (SEQ ID NO:7152), TGGGTTAGTTTTTTCGGTAGGCGGCGA (SEQ ID NO:7153), CGTGGATTCGTTTTTGTTGGGCGTCGA (SEQ ID NO:7154), TGGGTTAGTTTTTTCGGTAGGCGGCGAC (SEQ ID NO:7155), GGGTTAGTTTTTTCGGTAGGCGGCGAC (SEQ ID NO:7156), CGTGGATTCGTTTTTGTTGGGCGTCGAC (SEQ ID NO:7157)

Target757    chr7:27205114-27205214    ATCGTGTTTAGCGTTTGGTTCGTTCGG (SEQ ID NO:7158), TCGTGTTTAGCGTTTGGTTCGTTCGG (SEQ ID NO:7159), TATCGTGTTTAGCGTTTGGTTCGTTCGG (SEQ ID NO:7160), TTATCGTGTTTAGCGTTTGGTTCGTTCGG (SEQ ID NO:7161), ATTATCGTGTTTAGCGTTTGGTTCGTTCGG (SEQ ID NO:7162), CGTACGGTTAATGGGGGCGCGGG (SEQ ID NO:7163), CGTACGGTTAATGGGGGCGCGG (SEQ ID NO:7164), GTACGGTTAATGGGGGCGCGGG (SEQ ID NO:7165), GTGATTTACGCGTTATTGTTTTGTTGGACGG (SEQ ID NO:7166), AGTGATTTACGCGTTATTGTTTTGTTGGACGG (SEQ ID NO:7167)

Target758    chr7:27205338-27205351    GGGGGGAGACGGGAGAGTATAGAGATAAGG (SEQ ID NO:7168), GGGGGGAGACGGGAGAGTATAGAGATAAGGT (SEQ ID NO:7169), GGGGGAGACGGGAGAGTATAGAGATAAGGT (SEQ ID NO:7170), GGGGGAGACGGGAGAGTATAGAGATAAGG (SEQ ID NO:7171), GGGGGGAGACGGGAGAGTATAGAGATAAG (SEQ ID NO:7172)

Target759    chr7:27205810-27205823    GGTTAGATTGTTGTGTTTGGTTGGCGAGT (SEQ ID NO:7173), AGGTTAGATTGTTGTGTTTGGTTGGCGAGT (SEQ ID NO:7174), AGGTTAGATTGTTGTGTTTGGTTGGCGAG (SEQ ID NO:7175), GGTTAGATTGTTGTGTTTGGTTGGCGAGTT (SEQ ID NO:7176), AAGGTTAGATTGTTGTGTTTGGTTGGCGAG (SEQ ID NO:7177), TTTGGAGTGTTTTGGTAGGGTCGGCGG (SEQ ID NO:7178), TTGGAGTGTTTTGGTAGGGTCGGCGGC (SEQ ID NO:7179), TGTTTTGGTAGGGTCGGCGGCGGTTTC (SEQ ID NO:7180), GTTTGGAGTGTTTTGGTAGGGTCGGCGG (SEQ ID NO:7181), GTTTTGGTAGGGTCGGCGGCGGTTTC (SEQ ID NO:7182)

Target760    chr7:27205848-27205864    GGTTAGATTGTTGTGTTTGGTTGGCGAGT (SEQ ID NO:7183), AGGTTAGATTGTTGTGTTTGGTTGGCGAGT (SEQ ID NO:7184), AGGTTAGATTGTTGTGTTTGGTTGGCGAG (SEQ ID NO:7185), GGTTAGATTGTTGTGTTTGGTTGGCGAGTT (SEQ ID NO:7186), AAGGTTAGATTGTTGTGTTTGGTTGGCGAG (SEQ ID NO:7187), TTTGGAGTGTTTTGGTAGGGTCGGCGG (SEQ ID NO:7188), TTGGAGTGTTTTGGTAGGGTCGGCGGC (SEQ ID NO:7189), TGTTTTGGTAGGGTCGGCGGCGGTTTC (SEQ ID NO:7190), GTTTGGAGTGTTTTGGTAGGGTCGGCGG (SEQ ID NO:7191), GTTTTGGTAGGGTCGGCGGCGGTTTC (SEQ ID NO:7192)

Target761    chr7:27205943-27205964    AGGTAGGGATCGGTCGTTTAGGGAGT (SEQ ID NO:7193), TTAGGTAGGGATCGGTCGTTTAGGGAGT (SEQ ID NO:7194), AGGTAGGGATCGGTCGTTTAGGGAGTAT (SEQ ID NO:7195), AGGTAGGGATCGGTCGTTTAGGGAGTATC (SEQ ID NO:7196), TTTAGGTAGGGATCGGTCGTTTAGGGAGT (SEQ ID NO:7197), TCGTTTTGGTGGCGGTTGGTCGTTTTT (SEQ ID NO:7198), TTCGTTTTGGTGGCGGTTGGTCGTTTT (SEQ ID NO:7199), TTTCGTTTTGGTGGCGGTTGGTCGTT (SEQ ID NO:7200), TTTTCGTTTTGGTGGCGGTTGGTCGTT (SEQ ID NO:7201), ATTTTCGTTTTGGTGGCGGTTGGTCGT (SEQ ID NO:7202)

Target762    chr7:27206025-27206045    GGAGGAGTTGGTTAGGAGGGAGCGGTT (SEQ ID NO:7203), CGGAGGAGTTGGTTAGGAGGGAGCGGT (SEQ ID NO:7204), ACGGAGGAGTTGGTTAGGAGGGAGCGG (SEQ ID NO:7205), CGGAGGAGTTGGTTAGGAGGGAGCGG (SEQ ID NO:7206), TACGGAGGAGTTGGTTAGGAGGGAGCG (SEQ ID NO:7207), TTAGTTGATGAGAAAGGCGGGTTGGGC (SEQ ID NO:7208), GTTAGTTGATGAGAAAGGCGGGTTGGGC (SEQ ID NO:7209), TGTTAGTTGATGAGAAAGGCGGGTTGGGC (SEQ ID NO:7210), TAGTTGATGAGAAAGGCGGGTTGGGC (SEQ ID NO:7211), TTGTTAGTTGATGAGAAAGGCGGGTTGGGC (SEQ ID NO:7212)

FIGURE 5 CONTINUED

Target763    chr7:27206073-27206083    TTTGAGGGTTTGGTTGGTTGTGCGGCG (SEQ ID NO:7213), GGAGGAGTTGGTTAGGAGGGAGCGGTT
(SEQ ID NO:7214), CGGAGGAGTTGGTTAGGAGGGAGCGGT (SEQ ID NO:7215),
ACGGAGGAGTTGGTTAGGAGGGAGCGG (SEQ ID NO:7216), TTTTGAGGGTTTGGTTGGTTGTGCGGC
(SEQ ID NO:7217), TTAGTTGATGAGAAAGGCGGGTTGGGC (SEQ ID NO:7218),
GTTAGTTGATGAGAAAGGCGGGTTGGGC (SEQ ID NO:7219),
TGTTAGTTGATGAGAAAGGCGGGTTGGGC (SEQ ID NO:7220), TGAGGTTGGAGTATAGGGTTGGGTCGT
(SEQ ID NO:7221), TAGTTGATGAGAAAGGCGGGTTGGGC (SEQ ID NO:7222)

Target764    chr7:27206104-27206166    TTTGAGGGTTTGGTTGGTTGTGCGGCG (SEQ ID NO:7223), GGAGGAGTTGGTTAGGAGGGAGCGGTT
(SEQ ID NO:7224), CGGAGGAGTTGGTTAGGAGGGAGCGGT (SEQ ID NO:7225),
ACGGAGGAGTTGGTTAGGAGGGAGCGG (SEQ ID NO:7226), TTTTGAGGGTTTGGTTGGTTGTGCGGC
(SEQ ID NO:7227), TTAGTTGATGAGAAAGGCGGGTTGGGC (SEQ ID NO:7228),
GTTAGTTGATGAGAAAGGCGGGTTGGGC (SEQ ID NO:7229),
TGTTAGTTGATGAGAAAGGCGGGTTGGGC (SEQ ID NO:7230), TGAGGTTGGAGTATAGGGTTGGGTCGT
(SEQ ID NO:7231), TAGTTGATGAGAAAGGCGGGTTGGGC (SEQ ID NO:7232)

Target765    chr7:27206311-27206378    AGCGTTGTAAGTTTGGTTGCGTTTCGT (SEQ ID NO:7233), TCGTATCGATGTGGTTTGTTTCGGGGT (SEQ
ID NO:7234), GCGTTGTAAGTTTGGTTGCGTTTCGTG (SEQ ID NO:7235),
AGCGTTGTAAGTTTGGTTGCGTTTCGTG (SEQ ID NO:7236), GCGTTGTAAGTTTGGTTGCGTTTCGTGA
(SEQ ID NO:7237), CGGGTTTTTTAGGTTTCGGAGTTGCGGGG (SEQ ID NO:7238),
GCGGGTTTTTTAGGTTTCGGAGTTGCGG (SEQ ID NO:7239), CGGTGCGGGTTTTTTAGGTTTCGGAGT
(SEQ ID NO:7240), TGCGGGTTTTTTAGGTTTCGGAGTTGCGG (SEQ ID NO:7241),
TCGGTGCGGGTTTTTTAGGTTTCGGAGT (SEQ ID NO:7242)

Target766    chr7:27225123-27225128    TATGTTGGTTGGGGGGTTTTTCGGCGC (SEQ ID NO:7243), TTATGTTGGTTGGGGGGGTTTTTCGGCGC
(SEQ ID NO:7244), ATGTTGGTTGGGGGGGTTTTTCGGCGC (SEQ ID NO:7245),
TTATGTTGGTTGGGGGGGTTTTTCGGCG (SEQ ID NO:7246), TTTATGTTGGTTGGGGGGGTTTTTCGGCGC
(SEQ ID NO:7247), ATTCGGGGAGTTGCGGGTGGGAGGTG (SEQ ID NO:7248),
ATTCGGGGAGTTGCGGGTGGGAGG (SEQ ID NO:7249), ATTCGGGGAGTTGCGGGTGGGAGGTGG (SEQ
ID NO:7250), GTTGCGGGTGGGAGGTGGGGACGAGAG (SEQ ID NO:7251),
GAGTTGCGGGTGGGAGGTGGGGACGAG (SEQ ID NO:7252)

Target767    chr7:27225418-27225629    CGTCGTTGTGTGGTTTGTGGTTTCGGA (SEQ ID NO:7253), TCGTCGTTGTGTGGTTTGTGGTTTCGG (SEQ
ID NO:7254), TCGTCGTTGTGTGGTTTGTGGTTTCGGA (SEQ ID NO:7255),
CGTCGTTGTGTGGTTTGTGGTTTCGGAG (SEQ ID NO:7256), CGTCGTTGTGTGGTTTGTGGTTTCGGAGT
(SEQ ID NO:7257), GGTTGTTGGCGGTTTAGGGACGGAAGG (SEQ ID NO:7258),
GTTGTTGGCGGTTTAGGGACGGAAGGT (SEQ ID NO:7259), TGGTTGTTGGCGGTTTAGGGACGGAAG
(SEQ ID NO:7260), TCGCGGGGAGAAGTCGTTTTGGTTGTT (SEQ ID NO:7261),
GGGGAGAAGTCGTTTTGGTTGTTGGCGG (SEQ ID NO:7262)

Target768    chr7:27244531-27244538    TGCGTTAGTTTTGAGGAGTTCGGGCGT (SEQ ID NO:7263), TTGCGTTAGTTTTGAGGAGTTCGGGCGT
(SEQ ID NO:7264), TTGCGTTAGTTTTGAGGAGTTCGGGCG (SEQ ID NO:7265),
TTTGCGTTAGTTTTGAGGAGTTCGGGCG (SEQ ID NO:7266), TTTGCGTTAGTTTTGAGGAGTTCGGGCGT
(SEQ ID NO:7267)

Target769    chr7:27244603-27244632    CGCGTTCGGATTTTTTAGAGTTGGCGT (SEQ ID NO:7268), CGCGTTCGGATTTTTTAGAGTTGGCGTA (SEQ
ID NO:7269), CGCGTTCGGATTTTTTAGAGTTGGCGTAA (SEQ ID NO:7270),
CGCGTTCGGATTTTTTAGAGTTGGCGTAAA (SEQ ID NO:7271),
CGCGTTCGGATTTTTTAGAGTTGGCGTAAAT (SEQ ID NO:7272),
TGAAGAGCGATTAGTGGTATTGTCGGGG (SEQ ID NO:7273), TGAAGAGCGATTAGTGGTATTGTCGGGGA
(SEQ ID NO:7274), GAAGAGCGATTAGTGGTATTGTCGGGGA (SEQ ID NO:7275),
GTGAAGAGCGATTAGTGGTATTGTCGGGG (SEQ ID NO:7276),
AGTGAAGAGCGATTAGTGGTATTGTCGGGG (SEQ ID NO:7277)

Target770    chr7:27244755-27244811    AGGGAGTTTGGTGAAGGGTTCGGTTGG (SEQ ID NO:7278), GGGAGTTTGGTGAAGGGTTCGGTTGGA
(SEQ ID NO:7279), AGGGAGTTTGGTGAAGGGTTCGGTTGGA (SEQ ID NO:7280),
GAGGGAGTTTGGTGAAGGGTTCGGTTGG (SEQ ID NO:7281),
AGAGGGAGTTTGGTGAAGGGTTCGGTTGG (SEQ ID NO:7282), AAGTCGGTGTTTTTCGCGGGTTGGTCG
(SEQ ID NO:7283), AGTCGGTGTTTTTCGCGGGTTGGTCG (SEQ ID NO:7284),
TAAGTCGGTGTTTTTCGCGGGTTGGTCG (SEQ ID NO:7285), GTAAGTCGGTGTTTTTCGCGGGTTGGT
(SEQ ID NO:7286), AGTAAGTCGGTGTTTTTCGCGGGTTGGT (SEQ ID NO:7287)

Target771    chr7:27244856-27244875    AGTTCGCGGGGGATATCGGTTTGTTGG (SEQ ID NO:7288), GTTCGCGGGGGATATCGGTTTGTTGGA (SEQ
ID NO:7289), AGTTCGCGGGGGATATCGGTTTGTTGGA (SEQ ID NO:7290),
AGGGAGTTTGGTGAAGGGTTCGGTTGGA (SEQ ID NO:7291), GGGAGTTTGGTGAAGGGTTCGGTTGGA
(SEQ ID NO:7292), TTTTTTGGGTTAGTGGTAGCGTCGGGT (SEQ ID NO:7293),
TGGGTTAGTGGTAGCGTCGGGTATAGA (SEQ ID NO:7294), TTTTTGGGTTAGTGGTAGCGTCGGGTA (SEQ
ID NO:7295), TTTTGGGTTAGTGGTAGCGTCGGGTAT (SEQ ID NO:7296),
TGGGTTAGTGGTAGCGTCGGGTATAGAG (SEQ ID NO:7297)

Target772    chr7:27244885-27244898    TTGCGGGTTATTTAGTCGGGGCGTTGG (SEQ ID NO:7298), TGCGGGTTATTTAGTCGGGGCGTTGGG (SEQ
ID NO:7299), AGTTCGCGGGGGATATCGGTTTGTTGG (SEQ ID NO:7300),
GTTCGCGGGGGATATCGGTTTGTTGGA (SEQ ID NO:7301), AGTTCGCGGGGGATATCGGTTTGTTGGA
(SEQ ID NO:7302), TTAAGTTAGGGTGGGGTGGGCGTTCGC (SEQ ID NO:7303),
ATTAAGTTAGGGTGGGGTGGGCGTTCG (SEQ ID NO:7304), TAAGTTAGGGTGGGGTGGGCGTTCGC (SEQ

FIGURE 5 CONTINUED

ID NO:7305), ATTAAGTTAGGGTGGGGTGGGCGTTCGC (SEQ ID NO:7306),
TATTAAGTTAGGGTGGGGTGGGCGTTCGC (SEQ ID NO:7307)

| Target773 | chr7:27244907-27244918 | TTGCGGGGTTATTTAGTCGGGGCGTTGG (SEQ ID NO:7308), TGCGGGGTTATTTAGTCGGGGCGTTGGG (SEQ ID NO:7309), AGTTCGCGGGGGGATATCGGTTTGTTGG (SEQ ID NO:7310), GTTCGCGGGGGGATATCGGTTTGTTGGA (SEQ ID NO:7311), AGTTCGCGGGGGGATATCGGTTTGTTGGA (SEQ ID NO:7312), TTAAGTTAGGGTGGGGTGGGCGTTCGC (SEQ ID NO:7313), ATTAAGTTAGGGTGGGGTGGGCGTTCG (SEQ ID NO:7314), TAAGTTAGGGTGGGGTGGGCGTTCGC (SEQ ID NO:7315), ATTAAGTTAGGGTGGGGTGGGCGTTCGC (SEQ ID NO:7316), TATTAAGTTAGGGTGGGGTGGGCGTTCGC (SEQ ID NO:7317) |
| Target774 | chr7:27260168-27260259 | TAGTTTTACGGAGGAGGTCGGGTCGCG (SEQ ID NO:7318), GTTGGCGGGGGATTTTGTAGGTCGGGTC (SEQ ID NO:7319), TTGGCGGGGATTTTGTAGGTCGGGTCG (SEQ ID NO:7320), GGTTGGCGGGGATTTTGTAGGTCGGGT (SEQ ID NO:7321), GGGTTGGCGGGGATTTTGTAGGTCGGG (SEQ ID NO:7322), TTCGTGGGGTTGTGGTTTTTCGCGGTC (SEQ ID NO:7323), TTTCGTGGGGTTGTGGTTTTTCGCGGT (SEQ ID NO:7324), TTTTCGGGTAAGTCGGGTAGGCGGGAG (SEQ ID NO:7325), GGTAAGTCGGGTAGGCGGGAGGTTGTT (SEQ ID NO:7326), ATTTTCGGGTAAGTCGGGTAGGCGGGA (SEQ ID NO:7327) |
| Target775 | chr7:27260274-27260311 | TAGTTTTACGGAGGAGGTCGGGTCGCG (SEQ ID NO:7328), GTTGGCGGGGGATTTTGTAGGTCGGGTC (SEQ ID NO:7329), TTGGCGGGGATTTTGTAGGTCGGGTCG (SEQ ID NO:7330), GGTTGGCGGGGATTTTGTAGGTCGGGT (SEQ ID NO:7331), GGGTTGGCGGGGGATTTTGTAGGTCGGG (SEQ ID NO:7332), AGTCGGGTAGGCGGGAGGTTGTTTTGT (SEQ ID NO:7333), TTTTCGGGTAAGTCGGGTAGGCGGGAG (SEQ ID NO:7334), GGTAAGTCGGGTAGGCGGGAGGTTGTT (SEQ ID NO:7335), ATTTTCGGGTAAGTCGGGTAGGCGGGA (SEQ ID NO:7336), AAGTCGGGTAGGCGGGAGGTTGTTTTGT (SEQ ID NO:7337) |
| Target776 | chr7:27260366-27260397 | TCGGTTTGTTCGGGGATGTGGGTGGAT (SEQ ID NO:7338), TTCGGTTTGTTCGGGGATGTGGGTGGA (SEQ ID NO:7339), GTTCGGTTTGTTCGGGGATGTGGGTGG (SEQ ID NO:7340), TGTTCGGTTTGTTCGGGGATGTGGGTG (SEQ ID NO:7341), CGGTTTGTTCGGGGATGTGGGTGGATT (SEQ ID NO:7342), GCGAGGGGTTACGTTGTTGGTTAGGGGC (SEQ ID NO:7343), CGAGGGGTTACGTTGTTGGTTAGGGGCG (SEQ ID NO:7344), TGCGAGGGGTTACGTTGTTGGTTAGGGG (SEQ ID NO:7345), TGCGAGGGGTTACGTTGTTGGTTAGGGGC (SEQ ID NO:7346), TTGCGAGGGGTTACGTTGTTGGTTAGGGG (SEQ ID NO:7347) |
| Target777 | chr7:27260417-27260467 | TCGGTTTGTTCGGGGATGTGGGTGGAT (SEQ ID NO:7348), TTCGGTTTGTTCGGGGATGTGGGTGGA (SEQ ID NO:7349), TCGTTCGGTGGGAGGAATTCGGGGTTT (SEQ ID NO:7350), TTCGTTCGGTGGGAGGAATTCGGGGTT (SEQ ID NO:7351), TTTCGTTCGGTGGGAGGAATTCGGGGT (SEQ ID NO:7352), GCGAGGGGTTACGTTGTTGGTTAGGGGC (SEQ ID NO:7353), CGAGGGGTTACGTTGTTGGTTAGGGGCG (SEQ ID NO:7354), TGCGAGGGGTTACGTTGTTGGTTAGGGG (SEQ ID NO:7355), TGCGAGGGGTTACGTTGTTGGTTAGGGGC (SEQ ID NO:7356), TTGCGAGGGGTTACGTTGTTGGTTAGGGG (SEQ ID NO:7357) |
| Target778 | chr7:27283367-27283410 | GTGTTTTGAGTGCGGGGTGTTGAGGGG (SEQ ID NO:7358), GGGGTGTTGAGGGGGGCGGATGTAAGTT (SEQ ID NO:7359), AGTGTTTTGAGTGCGGGGTGTTGAGGG (SEQ ID NO:7360), TGTTTTGAGTGCGGGGTGTTGAGGGGG (SEQ ID NO:7361), GTTTTGAGTGCGGGGTGTTGAGGGGG (SEQ ID NO:7362), CGGCGTTTGATTTTGTTTTCGTTTGGGG (SEQ ID NO:7363), TCGGATCGGCGTTTGATTTTGTTTTCGT (SEQ ID NO:7364), CGGCGTTTGATTTTGTTTTCGTTTGGGGA (SEQ ID NO:7365), TCGGCGTTTGATTTTGTTTTCGTTTGGGG (SEQ ID NO:7366), TCGGCGTTTGATTTTGTTTTCGTTTGGGGA (SEQ ID NO:7367) |
| Target779 | chr7:27283425-27283434 | GGCGGATGTAAGTTTTGGATTTGGGGG (SEQ ID NO:7368), GGCGGATGTAAGTTTTGGATTTGGGGGA (SEQ ID NO:7369), GGCGGATGTAAGTTTTGGATTTGGGGGAT (SEQ ID NO:7370), GGCGGATGTAAGTTTTGGATTTGGGGGATT (SEQ ID NO:7371), GGCGGATGTAAGTTTTGGATTTGGGGGATTCG (SEQ ID NO:7372), TGGTCGGAGGGGTTGTAGTATTCGGGGTT (SEQ ID NO:7373), TTGGTCGGAGGGGTTGTAGTATTCGGGGT (SEQ ID NO:7374), TGGTCGGAGGGGTTGTAGTATTCGGGGTGT (SEQ ID NO:7375), GGTCGGAGGGGTTGTAGTATTCGGGGTGT (SEQ ID NO:7376), TGGTCGGAGGGGTTGTAGTATTCGGGGTTG (SEQ ID NO:7377) |
| Target780 | chr7:27283528-27283562 | GGGTGTAAGAGGTATGGAGGCGCGGAA (SEQ ID NO:7378), AGGGTGTAAGAGGTATGGAGGCGCGGA (SEQ ID NO:7379), TAGGGTGTAAGAGGTATGGAGGCGCGG (SEQ ID NO:7380), TAGGGTGTAAGAGGTATGGAGGCGCGGA (SEQ ID NO:7381), AGGTATGGAGGCGCGGAAGTTAGGAGT (SEQ ID NO:7382), ACGTGTAAATTGGTCGGAGGGTTGTAGT (SEQ ID NO:7383), GACGTGTAAATTGGTCGGAGGGTTGTAGT (SEQ ID NO:7384), GACGTGTAAATTGGTCGGAGGGTTGTAGTA (SEQ ID NO:7385), GACGTGTAAATTGGTCGGAGGGTTGTAGTAT (SEQ ID NO:7386), ACGTGTAAATTGGTCGGAGGGTTGTAGTATT (SEQ ID NO:7387) |
| Target781 | chr7:27283600-27283614 | TGCGGTTTATTTGGGTAGTTCGGGTGT (SEQ ID NO:7388), TGCGGTTTATTTGGGTAGTTCGGGTGTT (SEQ ID NO:7389), TTGCGGTTTATTTGGGTAGTTCGGGTGT (SEQ ID NO:7390), GCGGTTTATTTGGGTAGTTCGGGTGTTGT (SEQ ID NO:7391), TGCGGTTTATTTGGGTAGTTCGGGTGTTG (SEQ ID NO:7392), AGGAAGGAAAGGGGAAGGGGGGAGGAT (SEQ ID NO:7393), AGGAAAGGGGAAGGGGGGAGGATTCGA (SEQ ID NO:7394), TAGGAAGGAAAGGGGAAGGGGGGAGGA |

FIGURE 5 CONTINUED (SEQ ID NO:7395), AAGGAAAGGGGAAGGGGGGAGGATTCG (SEQ ID NO:7396), GGAAAGGGGAAGGGGGGAGGATTCGAT (SEQ ID NO:7397)

| | | |
|---|---|---|
| Target782 | chr7:29603009-29603473 | CGCGATGGGGTTAAGGGATAGTTGTTGCG (SEQ ID NO:7398), GCGATGGGGTTAAGGGATAGTTGTTGCGG (SEQ ID NO:7399), GCGATGGGGTTAAGGGATAGTTGTTGCG (SEQ ID NO:7400), CGCGATGGGGTTAAGGGATAGTTGTTGC (SEQ ID NO:7401), AGGGGGGAAAAATAAATCGCGATGGGGT (SEQ ID NO:7402), ACGGCGGAGATTTGAGATTCGGAGGTT (SEQ ID NO:7403), AACGGCGGAGATTTGAGATTCGGAGGT (SEQ ID NO:7404), TGAGGTTGTAGGTGGGTTTCGTTGGGT (SEQ ID NO:7405), CGGAGGTTGAGGTTGTAGGTGGGTTTCG (SEQ ID NO:7406), CGGAGGTTGAGGTTGTAGGTGGGTTTCGT (SEQ ID NO:7407) |
| Target783 | chr7:29605642-29605961 | GTGGTAAGTCGGGGAAGGGGTGGAGTG (SEQ ID NO:7408), GTGTGGTAAGTCGGGGAAGGGGTGGAG (SEQ ID NO:7409), TGGTAAGTCGGGGAAGGGGTGGAGTGA (SEQ ID NO:7410), TGTGGTAAGTCGGGGAAGGGGTGGAGT (SEQ ID NO:7411), TAAGTCGGGGAAGGGGTGGAGTGAACG (SEQ ID NO:7412), ATACGTGGGTTGCGGGGTGGATGTTGA (SEQ ID NO:7413), TGGGTTGCGGGGTGGATGTTGAGGTAG (SEQ ID NO:7414), GTGGGTTGCGGGGTGGATGTTGAGGTA (SEQ ID NO:7415), TACGTGGGTTGCGGGGTGGATGTTGAG (SEQ ID NO:7416), TGGTCGGAGGGTTTAGGGGTTTTCGGT (SEQ ID NO:7417) |
| Target784 | chr7:29605992-29606278 | CGATAGCGGCGATGTTGGTAGTTTCGG (SEQ ID NO:7418), CGATAGCGGCGATGTTGGTAGTTTCGG (SEQ ID NO:7419), CGGAGATTACGTGGAGAAAGGGGTCGT (SEQ ID NO:7420), AGGAAGTCGTAGTGGGGGTGTCGTTTT (SEQ ID NO:7421), AAGGAAGTCGTAGTGGGGGTGTCGTTT (SEQ ID NO:7422), TTGTTGGTTTAGTTCGGGTTGGGCGGC (SEQ ID NO:7423), TTTGTTTGGTTTGGGGGGGTTCGTCGGC (SEQ ID NO:7424), TCGGGTTTGGAATTGGGGGTTTGGGGT (SEQ ID NO:7425), GGGGGTTTGGGGTAGTGTTGGGTAGGT (SEQ ID NO:7426), TGGGGGTTTGGGGTAGTGTTGGGTAGG (SEQ ID NO:7427) |
| Target785 | chr7:29606320-29606352 | TTTCGGAGGCGGGTAGGTTTTCGGAGG (SEQ ID NO:7428), GGCGGGTAGGTTTTCGGAGGAGGTAGG (SEQ ID NO:7429), GCGTTACGTTGTTTTCGGAGGCGGGTA (SEQ ID NO:7430), GCGGGTAGGTTTTCGGAGGAGGTAGGT (SEQ ID NO:7431), TTCGGAGGCGGGTAGGTTTTCGGAGGA (SEQ ID NO:7432), TAAGGGGGCGGGTTTGAAGTTTCGGGT (SEQ ID NO:7433), CGTAAGGGGGCGGGTTTGAAGTTTCGG (SEQ ID NO:7434), GGGCGGGTTTGAAGTTTCGGGTTTGGA (SEQ ID NO:7435), GTAAGGGGGCGGGTTTGAAGTTTCGGG (SEQ ID NO:7436), TCGGGTTTGGAATTGGGGGTTTGGGGT (SEQ ID NO:7437) |
| Target786 | chr7:35293506-35293532 | CGTTTCGGGGCGTTCGGTAGGACG (SEQ ID NO:7438), AGGGTTTATCGAGTATTACGGCGGGTG (SEQ ID NO:7439), GAGGGTTTATCGAGTATTACGGCGGGT (SEQ ID NO:7440), AGAGGGTTTATCGAGTATTACGGCGGGT (SEQ ID NO:7441), AGAGGGTTTATCGAGTATTACGGCGGG (SEQ ID NO:7442), GTTTTAGAGGGAGGAAGGACGCGGAGG (SEQ ID NO:7443), AGTTTTAGAGGGAGGAAGGACGCGGAGG (SEQ ID NO:7444), AGTTTTAGAGGGAGGAAGGACGCGGAG (SEQ ID NO:7445), TAGTTTTAGAGGGAGGAAGGACGCGGA (SEQ ID NO:7446), TTTTAGAGGGAGGAAGGACGCGGAGG (SEQ ID NO:7447) |
| Target787 | chr7:35293652-35293659 | TGGGGTTGGGGATAGTCGGGATGTTTT (SEQ ID NO:7448), TTGGGGTTGGGGATAGTCGGGATGTTT (SEQ ID NO:7449), TTTGGGGTTGGGGATAGTCGGGATGTT (SEQ ID NO:7450), TTTTGGGGTTGGGGATAGTCGGGATGT (SEQ ID NO:7451), TTGGGGTTGGGGATAGTCGGGATGTTTT (SEQ ID NO:7452), GGCGTAGGGTAGCGAGCGTTAGGGTTT (SEQ ID NO:7453), GCGTTGATTGGTTGCGGGTTTTCGGGA (SEQ ID NO:7454), AGGCGTAGGGTAGCGAGCGTTAGGGTT (SEQ ID NO:7455), GGCGTAGGGTAGCGAGCGTTAGGGGTT (SEQ ID NO:7456), GGCGTTGATTGGTTGCGGGTTTTCGGG (SEQ ID NO:7457) |
| Target788 | chr7:35293670-35293797 | GCGGCGCGGAATTACGGATAGTGAGTT (SEQ ID NO:7458), GCGGCGCGGAATTACGGATAGTGAGTTT (SEQ ID NO:7459), GCGGCGCGGAATTACGGATAGTGAGT (SEQ ID NO:7460), TGGGGTTGGGGATAGTCGGGATGTTTT (SEQ ID NO:7461), TTGGGGTTGGGGATAGTCGGGATGTTT (SEQ ID NO:7462), AGACGGCGTTGATTGGTTGCGGGTTTT (SEQ ID NO:7463), GGCGTAGGGTAGCGAGCGTTAGGGTTT (SEQ ID NO:7464), GAGACGGCGTTGATTGGTTGCGGGTTT (SEQ ID NO:7465), GCGTTGATTGGTTGCGGGTTTTCGGGA (SEQ ID NO:7466), GTTTTCGGCGGCGGAATTAGGAAGCGG (SEQ ID NO:7467) |
| Target789 | chr7:35293979-35293999 | CGCGTGGTTTGTCGTTTCGGTTGTTCG (SEQ ID NO:7468), GCGTGGTTTGTCGTTTCGGTTGTTCGG (SEQ ID NO:7469), GTTCGCGTGGTTTGTCGTTTCGGTTGT (SEQ ID NO:7470), TCGCGTGGTTTGTCGTTTCGGTTGTTCG (SEQ ID NO:7471), GCGTGGTTTGTCGTTTCGGTTGTTCGGT (SEQ ID NO:7472) |
| Target790 | chr7:35294157-35294186 | AGGGAAGCGTTTAGTAGAATTCGGCGTT (SEQ ID NO:7473), AGGGAAGCGTTTAGTAGAATTCGGCGTT (SEQ ID NO:7474), TAGGGAAGCGTTTAGTAGAATTCGGCGT (SEQ ID NO:7475), GGGAAGCGTTTAGTAGAATTCGGCGTTT (SEQ ID NO:7476), AGGGAAGCGTTTAGTAGAATTCGGCGTTT (SEQ ID NO:7477), CGAGTATGGATTTGGTTAGTTGGCGTCGG (SEQ ID NO:7478), CGAGTATGGATTTGGTTAGTTGGCGTCGG (SEQ ID NO:7479), AGTATGGATTTGGTTAGTTGGCGTCGGT (SEQ ID NO:7480), TCGAGTATGGATTTGGTTAGTTGGCGTCGG (SEQ ID NO:7481), TCGAGTATGGATTTGGTTAGTTGGCGTCGGT (SEQ ID NO:7482) |
| Target791 | chr7:35297344-35297475 | AGTCGGGAGGGCGGGTTTGAGTTTTGT (SEQ ID NO:7483), GAGTCGGGAGGGCGGGTTTGAGTTTTG (SEQ ID NO:7484), GTCGGGAGGGCGGGTTTGAGTTTTGTT (SEQ ID NO:7485), CGAGTCGGGAGGGCGGGTTTGAGTTTT (SEQ ID NO:7486), TCGGGAGGGCGGGTTTGAGTTTTGTTT (SEQ |

FIGURE 5 CONTINUED

ID NO:7487), TGGTGCGGAGGTTTTTTGGGTCGGTTC (SEQ ID NO:7488), GTGCGGAGGTTTTTTGGGTCGGTTCGA (SEQ ID NO:7489), GGTGCGGAGGTTTTTTGGGTCGGTTCG (SEQ ID NO:7490), TGGTGCGGAGGTTTTTTGGGTCGGTT (SEQ ID NO:7491), TGCGGAGGTTTTTTGGGTCGGTTCGA (SEQ ID NO:7492)

| Target792 | chr7:35297483-35297501 | AGTCGGGAGGGCGGGTTTGAGTTTTGT (SEQ ID NO:7493), GAGTCGGGAGGGCGGGTTTGAGTTTTG (SEQ ID NO:7494), GTCGGGAGGGCGGGTTTGAGTTTTGTT (SEQ ID NO:7495), CGAGTCGGGAGGGCGGGTTTGAGTTTT (SEQ ID NO:7496), TCGGGAGGGCGGGTTTGAGTTTTGTTT (SEQ ID NO:7497), TGGTGCGGAGGTTTTTTGGGTCGGTTC (SEQ ID NO:7498), GTGCGGAGGTTTTTTGGGTCGGTTCGA (SEQ ID NO:7499), GGTGCGGAGGTTTTTTGGGTCGGTTCG (SEQ ID NO:7500), TTGGTGCGGAGGTTTTTTGGGTCGGTT (SEQ ID NO:7501), TTTGGTGCGGAGGTTTTTTGGGTCGGT (SEQ ID NO:7502) |

| Target793 | chr7:35297516-35297533 | AGTCGGGAGGGCGGGTTTGAGTTTTGT (SEQ ID NO:7503), GAGTCGGGAGGGCGGGTTTGAGTTTTG (SEQ ID NO:7504), GTCGGGAGGGCGGGTTTGAGTTTTGTT (SEQ ID NO:7505), CGAGTCGGGAGGGCGGGTTTGAGTTTT (SEQ ID NO:7506), TCGGGAGGGCGGGTTTGAGTTTTGTTT (SEQ ID NO:7507), TGGTGCGGAGGTTTTTTGGGTCGGTTC (SEQ ID NO:7508), GTGCGGAGGTTTTTTGGGTCGGTTCGA (SEQ ID NO:7509), GGTGCGGAGGTTTTTTGGGTCGGTTCG (SEQ ID NO:7510), TTGGTGCGGAGGTTTTTTGGGTCGGTT (SEQ ID NO:7511), TTTGGTGCGGAGGTTTTTTGGGTCGGT (SEQ ID NO:7512) |

| Target794 | chr7:35297556-35297579 | CGGGAGGGCGGGTTTGAGTTTTGTTTT (SEQ ID NO:7513), CGGGAGGGCGGGTTTGAGTTTTGTTTTT (SEQ ID NO:7514), CGGGAGGGCGGGTTTGAGTTTTGTTT (SEQ ID NO:7515), GGGAGGGCGGGTTTGAGTTTTGTTTTT (SEQ ID NO:7516), CGGGAGGGCGGGTTTGAGTTTTGTTTTTT (SEQ ID NO:7517), TGGTGCGGAGGTTTTTTGGGTCGGTTC (SEQ ID NO:7518), GTGCGGAGGTTTTTTGGGTCGGTTCGA (SEQ ID NO:7519), GGTGCGGAGGTTTTTTGGGTCGGTTCG (SEQ ID NO:7520), TTGGTGCGGAGGTTTTTTGGGTCGGTT (SEQ ID NO:7521), TTTGGTGCGGAGGTTTTTTGGGTCGGT (SEQ ID NO:7522) |

| Target795 | chr7:35297699-35297709 | AGTTTTTGGATGGGGTGTGAGTGCGCG (SEQ ID NO:7523), GTTTTTGGATGGGGTGTGAGTGCGCGC (SEQ ID NO:7524), AAGTTTTTGGATGGGGTGTGAGTGCGCG (SEQ ID NO:7525), TTTTTGGATGGGGTGTGAGTGCGCGC (SEQ ID NO:7526), AAGTTTTTGGATGGGGTGTGAGTGCGC (SEQ ID NO:7527), TCGGTTTTGGAGATGGGCGCGAAG (SEQ ID NO:7528), TCGGTTTTATAGTTGGGCGAGATTGAGGT (SEQ ID NO:7529), CGGTTTTGGAGATGGGCGCGAAG (SEQ ID NO:7530), CGGTTTTATAGTTGGGCGAGATTGAGGTTTC (SEQ ID NO:7531), CGGTTTTGGAGATGGGCGCGAA (SEQ ID NO:7532) |

| Target796 | chr7:55242342-55242742 | GTTGTAGGGTTGCGGGGGCGTTATAGT (SEQ ID NO:7533), AGTTGTAGGGTTGCGGGGGCGTTATAGT (SEQ ID NO:7534), AGTTGTAGGGTTGCGGGGGCGTTATAG (SEQ ID NO:7535), TGTAGGGTTGCGGGGGCGTTATAGTTT (SEQ ID NO:7536), TTGTAGGGTTGCGGGGGCGTTATAGTT (SEQ ID NO:7537), GGGAGAGGTTAGTGTTGTTTTTAAGGGGAGGG (SEQ ID NO:7538), TGGGAGAGGTTAGTGTTGTTTTTAAGGGGAGGG (SEQ ID NO:7539), GGGAGAGGTTAGTGTTGTTTTTAAGGGGAGGGA (SEQ ID NO:7540), GGAGAGGTTAGTGTTGTTTTTAAGGGGAGGG (SEQ ID NO:7541), GGGGAGAGGTTAGTGTTGTTTTTAAGGGGAGG (SEQ ID NO:7542) |

| Target797 | chr7:55249057-55249088 | GGAGGTAGTCGAAGGGTATGAGTTGCGT (SEQ ID NO:7543), GGAGGTAGTCGAAGGGTATGAGTTGCG (SEQ ID NO:7544), AGGAGGTAGTCGAAGGGTATGAGTTGCGT (SEQ ID NO:7545), AGGAGGTAGTCGAAGGGTATGAGTTGCG (SEQ ID NO:7546), AGGTAGTCGAAGGGTATGAGTTGCGTG (SEQ ID NO:7547) |

| Target798 | chr7:55259233-55259800 | TGGGTTGGTTAAATTGTTGGGTGCGGA (SEQ ID NO:7548), TTGGGTTGGTTAAATTGTTGGGTGCGG (SEQ ID NO:7549), TGGGTTGGTTAAATTGTTGGGTGCGGAA (SEQ ID NO:7550), TTGGGTTGGTTAAATTGTTGGGTGCGGA (SEQ ID NO:7551), GGGTTGGTTAAATTGTTGGGTGCGGAA (SEQ ID NO:7552), ACGTTTTTGGTTGTTAGGTCGCGGTGT (SEQ ID NO:7553), ACGTTTTTGGTTGTTAGGTCGCGGTGTA (SEQ ID NO:7554), TACGTTTTTGGTTGTTAGGTCGCGGTGT (SEQ ID NO:7555), GTACGTTTTTGGTTGTTAGGTCGCGGT (SEQ ID NO:7556), CGTTTTTGGTTGTTAGGTCGCGGTGTA (SEQ ID NO:7557) |

| Target799 | chr7:67016016-67016255 | TGGGGGTACGGTTGGTTTTGTTATAGTCGT (SEQ ID NO:7558), GGGGGTACGGTTGGTTTTGTTATAGTCGT (SEQ ID NO:7559), TGGGGGTACGGTTGGTTTTGTTATAGTCG (SEQ ID NO:7560), GGTTTATTTGGGGGTACGGTTGGTTTTGT (SEQ ID NO:7561), AGGTTTATTTGGGGGTACGGTTGGTTTTGT (SEQ ID NO:7562), AGATGGAAAGTTGTTCGGGTAGCGTCG (SEQ ID NO:7563), GATGGAAAGTTGTTCGGGTAGCGTCGA (SEQ ID NO:7564), ACGGAAAGTTACGGTTGCGGTTGTAAT (SEQ ID NO:7565), AGATGGAAAGTTGTTCGGGTAGCGTCGA (SEQ ID NO:7566), GAGATGGAAAGTTGTTCGGGTAGCGTCG (SEQ ID NO:7567) |

| Target800 | chr7:70111632-70111709 | TGGGGATGAGTTAGTTCGTTGGAGGGG (SEQ ID NO:7568), TGGGGATGAGTTAGTTCGTTGGAGGGGA (SEQ ID NO:7569), GGGGATGAGTTAGTTCGTTGGAGGGGA (SEQ ID NO:7570), GGGGATGAGTTAGTTCGTTGGAGGGGAGT (SEQ ID NO:7571), TGGGGATGAGTTAGTTCGTTGGAGGGGAG (SEQ ID NO:7572), GCGGGTTTTGAGTAGTCGTTTTGTATGGT (SEQ ID NO:7573), AGCGGGTTTTGAGTAGTCGTTTTGTATGGT (SEQ ID NO:7574), AGGGTTTTCGTATTAGAGCGGGTTTTGAGT (SEQ ID NO:7575), GAGCGGGTTTTGAGTAGTCGTTTTGTATGG (SEQ ID NO:7576), GAGCGGGTTTTGAGTAGTCGTTTTGTATGGT (SEQ ID NO:7577) |

FIGURE 5 CONTINUED

Target801    chr7:70111742-70111820    AGTGCGAGGGTTTTGGTTTAGGGTAGT (SEQ ID NO:7578), GCGAGGGTTTTGGTTTAGGGTAGTAGGGT (SEQ ID NO:7579), TGCGAGGGTTTTGGTTTAGGGTAGTAGGG (SEQ ID NO:7580), TGCGAGGGTTTTGGTTTAGGGTAGTAGGGT (SEQ ID NO:7581), GCGAGGGTTTTGGTTTAGGGTAGTAGGG (SEQ ID NO:7582), AGGGTTTTCGTATTAGAGCGGGTTTTGAGT (SEQ ID NO:7583), AGGGTTTTCGTATTAGAGCGGGTTTTGAGTA (SEQ ID NO:7584), TAGGGTTTTCGTATTAGAGCGGGTTTTGAGT (SEQ ID NO:7585), TGAGTTAGGGTTTTCGTATTAGAGCGGGTTT (SEQ ID NO:7586), TTGAGTTAGGGTTTTCGTATTAGAGCGGGTT (SEQ ID NO:7587)

Target802    chr7:70574860-70575061    GGAGGTATTGTTTTGGGAGTTGTTTTTGGTGT (SEQ ID NO:7588), AGGAGGTATTGTTTTGGGAGTTGTTTTTGGTG (SEQ ID NO:7589), AGGAGGTATTGTTTTGGGAGTTGTTTTTGGTGT (SEQ ID NO:7590), GGAGGTATTGTTTTGGGAGTTGTTTTTGGTGTT (SEQ ID NO:7591), AAGGAGGTATTGTTTTGGGAGTTGTTTTTGGTG (SEQ ID NO:7592), TGAGGTTTTTAGGTATGTTGTTTAAGGGGGTTTAGG (SEQ ID NO:7593), AGGTTTTTAGGTATGTTGTTTAAGGGGGTTTAGGAT (SEQ ID NO:7594), AGTATTGAGGTTTTTAGGTATGTTGTTTAAGGGGGT (SEQ ID NO:7595)

Target803    chr7:71801500-71802283    GTTCGCGGGGTGGGTGTTTTAGTGTCG (SEQ ID NO:7596), AAGGTGGTCGGCGCGGTTTTTAGTTCG (SEQ ID NO:7597), CGAGGGAAGAAGAAAAGAGAGCGCGCG (SEQ ID NO:7598), CGGTTTTTAGTTCGCGGGGTGGGTGTT (SEQ ID NO:7599), GGTAAGTTAGGGAGTCGGCGGCGGTAT (SEQ ID NO:7600), TTGGGGGATTCGTTGGGGAGGAGTTGG (SEQ ID NO:7601), GTGTTGTCGGCGGTAAGGTTTTGGGGG (SEQ ID NO:7602), GGTGTTGTCGGCGGTAAGGTTTTGGGG (SEQ ID NO:7603), TAGAGCGAGGAGTGTGGTGTTGTCGGC (SEQ ID NO:7604), GGATTCGTTGGGGAGGAGTTGGGGAGG (SEQ ID NO:7605)

Target804    chr7:71802362-71802405    TCGGGTTTTTGGGTTCGTTTTGGTCGT (SEQ ID NO:7606), GTCGGGTTTTTGGGTTCGTTTTGGTCGT (SEQ ID NO:7607), GTCGGGTTTTTGGGTTCGTTTTGGTCG (SEQ ID NO:7608), GCGTTTAGGAGTCGGGTTTTTGGGTTCG (SEQ ID NO:7609), GCGTTTAGGAGTCGGGTTTTTGGGTTCGT (SEQ ID NO:7610), CGTGTATGTGTATGCGTGTGTGTGT (SEQ ID NO:7611), TCGTGTATGTGTATGCGTGTGTGTGT (SEQ ID NO:7612), TGTCGTGTATGTGTATGCGTGTGTGTGT (SEQ ID NO:7613), TGTGTCGTGTATGTGTATGCGTGTGTGT (SEQ ID NO:7614), TGTGTGTCGTGTATGTGTATGCGTGTGT (SEQ ID NO:7615)

Target805    chr7:97361421-97361463    CGTGGGGAGAATGTTACGTGGGTTTGG (SEQ ID NO:7616), CGTGGGGAGAATGTTACGTGGGTTTGGA (SEQ ID NO:7617), TGGGGAGAATGTTACGTGGGTTTGGAGGT (SEQ ID NO:7618), GGGGAGAATGTTACGTGGGTTTGGAGGT (SEQ ID NO:7619), TGGGGAGAATGTTACGTGGGTTTGGAGG (SEQ ID NO:7620), CGACGGATAGTTCGCGGGGTGTTGAG (SEQ ID NO:7621), GATAGATGCGGGGCGGGGTGATTCGG (SEQ ID NO:7622), GGATAGATGCGGGGCGGGGTGATTCG (SEQ ID NO:7623), GATAGATGCGGGGCGGGGTGATTCGGG (SEQ ID NO:7624), GGATAGATGCGGGGCGGGGTGATTCGG (SEQ ID NO:7625)

Target806    chr7:97361489-97361578    TCGTCGTAGTAAGTGTTCGCGCGGTGT (SEQ ID NO:7626), CGTAGTAAGTGTTCGCGCGGTGTTGGT (SEQ ID NO:7627), CGTCGTAGTAAGTGTTCGCGCGGTGTT (SEQ ID NO:7628), TAGTAAGTGTTCGCGCGGTGTTGGTCG (SEQ ID NO:7629), TCGTAGTAAGTGTTCGCGCGGTGTTGG (SEQ ID NO:7630), GATAGATGCGGGGCGGGGTGATTCGG (SEQ ID NO:7631), GGATAGATGCGGGGCGGGGTGATTCG (SEQ ID NO:7632), GATAGATGCGGGGCGGGGTGATTCGGG (SEQ ID NO:7633), GGATAGATGCGGGGCGGGGTGATTCGG (SEQ ID NO:7634), GATAGATGCGGGGCGGGGTGATTCG (SEQ ID NO:7635)

Target807    chr7:97361586-97361598    TCGTCGTAGTAAGTGTTCGCGCGGTGT (SEQ ID NO:7636), CGTAGTAAGTGTTCGCGCGGTGTTGGT (SEQ ID NO:7637), CGTCGTAGTAAGTGTTCGCGCGGTGTT (SEQ ID NO:7638), TAGTAAGTGTTCGCGCGGTGTTGGTCG (SEQ ID NO:7639), TCGTAGTAAGTGTTCGCGCGGTGTTGG (SEQ ID NO:7640), TAGGTGGAAGATAAAGAGGGGCGTTGG (SEQ ID NO:7641), TGTAGGTGGAAGATAAAGAGGGGCGTTGG (SEQ ID NO:7642), GTAGGTGGAAGATAAAGAGGGGCGTTGG (SEQ ID NO:7643), AGGTGGAAGATAAAGAGGGGCGTTGG (SEQ ID NO:7644), TGTAGGTGGAAGATAAAGAGGGGCGTTG (SEQ ID NO:7645)

Target808    chr7:98739441-98739878    GCGTTATTAAGTCGTAGGTTCGCGGTAGAGC (SEQ ID NO:7646), TGAGAGTGAGAAAGGGAAGACGAGGATGT (SEQ ID NO:7647), GCGTTATTAAGTCGTAGGTTCGCGGTAGA (SEQ ID NO:7648), GCGGTAGAGCGTTGCGTTTATTTTTGAAGG (SEQ ID NO:7649), TGGTTTAGAATTTTTGGAGTTCGGGGGGA (SEQ ID NO:7650), CGATTTGGTGGCGCGGATGTGATGTTA (SEQ ID NO:7651), CGATTTGGTGGCGCGGATGTGATGTT (SEQ ID NO:7652), CGATTTGGTGGCGCGGATGTGATGTTAA (SEQ ID NO:7653), TGGTGGCGCGGATGTGATGTTAATTTGT (SEQ ID NO:7654), GGTGGCGCGGATGTGATGTTAATTTGT (SEQ ID NO:7655)

Target809    chr7:121950250-121950507    TCGCGTCGATTCGTTGGTTTTGGTCGT (SEQ ID NO:7656), CGCGTCGATTCGTTGGTTTTGGTCGTT (SEQ ID NO:7657), TCGCGTCGATTCGTTGGTTTTGGTCGTT (SEQ ID NO:7658), CGCGTCGATTCGTTGGTTTTGGTCGTTT (SEQ ID NO:7659), TCGCGTCGATTCGTTGGTTTTGGTCGTTT (SEQ ID NO:7660), TTTTTTGGGTAGTCGGGGGTAGGGGGC (SEQ ID NO:7661), TAGTCGGGGGTAGGGGGCGTTAAGGTC (SEQ ID NO:7662), GCGGGGTATTTTCGGGTCGGAGTGGTT

FIGURE 5 CONTINUED

{SEQ ID NO:7663}, GTAGTCGGGGGTAGGGGGCGTTAAGGT {SEQ ID NO:7664},
GCGGGGTATTTTCGGGTCGGAGTGGTTA {SEQ ID NO:7665}

| Target810 | chr7:121950519-121950555 | GGAGTTTCGTTTTATTTAGGATTCGGTGGTTAGC {SEQ ID NO:7666}, AGGAGTTTCGTTTTATTTAGGATTCGGTGGTTAGC {SEQ ID NO:7667}, CGGTTGGGTTTTTATTTTTCGGTTTTTGTTTACGA {SEQ ID NO:7668}, TCGGTTGGGTTTTTATTTTTCGGTTTTTGTTTACG {SEQ ID NO:7669}, GGGAGTTTTAGTTCGGTAGCGGCGTTC {SEQ ID NO:7670}, GGGAGTTTTAGTTCGGTAGCGGCGTT {SEQ ID NO:7671}, GGAGTTTTAGTTCGGTAGCGGCGTTC {SEQ ID NO:7672}, GGGAGTTTTAGTTCGGTAGCGGCGT {SEQ ID NO:7673}, AGTTCGGTGGTTTTCGGTTTTGTTAACGT {SEQ ID NO:7674} |
|---|---|---|
| Target811 | chr7:121950564-121950713 | GGCGGTTGGGAGTTGGGGCGTAATTTT {SEQ ID NO:7675}, TCGAGAAGTTTGGAGGCGGTTGGGAGT {SEQ ID NO:7676}, GAAGTTTGGAGGCGGTTGGGAGTTGGG {SEQ ID NO:7677}, AGGCGGTTGGGAGTTGGGGCGTAATTT {SEQ ID NO:7678}, AAGTTTGGAGGCGGTTGGGAGTTGGGG {SEQ ID NO:7679}, TCGGCGGGATTTGATCGAAGGTAGCGT {SEQ ID NO:7680}, GGCGGTGGTGGTTTAGAGGTTCGAGGT {SEQ ID NO:7681}, TGTAGAGGAGAAGGGGAGGAGCGCGAT {SEQ ID NO:7682}, ATGTAGAGGAGAAGGGGAGGAGCGCGA {SEQ ID NO:7683}, AGTTGGGGCGGTGGTGGTTTAGAGGTT {SEQ ID NO:7684} |
| Target812 | chr7:121950721-121950736 | GGCGGTTGGGAGTTGGGGCGTAATTTT {SEQ ID NO:7685}, TCGAGAAGTTTGGAGGCGGTTGGGAGT {SEQ ID NO:7686}, GAAGTTTGGAGGCGGTTGGGAGTTGGG {SEQ ID NO:7687}, AGGCGGTTGGGAGTTGGGGCGTAATTT {SEQ ID NO:7688}, AAGTTTGGAGGCGGTTGGGAGTTGGGG {SEQ ID NO:7689}, GGCGGTGGTGGTTTAGAGGTTCGAGGT {SEQ ID NO:7690}, TGTAGAGGAGAAGGGGAGGAGCGCGAT {SEQ ID NO:7691}, ATGTAGAGGAGAAGGGGAGGAGCGCGA {SEQ ID NO:7692}, AGTTGGGGCGGTGGTGGTTTAGAGGTT {SEQ ID NO:7693}, TTGGGGCGGTGGTGGTTTAGAGGTTCG {SEQ ID NO:7694} |
| Target813 | chr7:121950760-121950800 | TCGGGTTGGGGTTTTTAAGCGTTCGGT {SEQ ID NO:7695}, GTCGGGTTGGGGTTTTTAAGCGTTCGGT {SEQ ID NO:7696}, TGTCGGGTTGGGGTTTTTAAGCGTTCGG {SEQ ID NO:7697}, GTCGGGTTGGGGTTTTTAAGCGTTCGG {SEQ ID NO:7698}, CGGGTTGGGGTTTTTAAGCGTTCGGTT {SEQ ID NO:7699}, TGTAGAGGAGAAGGGGAGGAGCGCGAT {SEQ ID NO:7700}, ATGTAGAGGAGAAGGGGAGGAGCGCGA {SEQ ID NO:7701}, AATGTAGAGGAGAAGGGGAGGAGCGCG {SEQ ID NO:7702}, GTAGAGGAGAAGGGGAGGAGCGCGATT {SEQ ID NO:7703}, TAGAGGAGAAGGGGAGGAGCGCGATTG {SEQ ID NO:7704} |
| Target814 | chr7:127991924-127991947 | GGTCGGATTGGTCGTCGTAGTTTAGGGC {SEQ ID NO:7705}, AGGTCGGATTGGTCGTCGTAGTTTAGGGC {SEQ ID NO:7706}, GTCGGATTGGTCGTCGTAGTTTAGGGC {SEQ ID NO:7707}, GGTCGGATTGGTCGTCGTAGTTTAGGG {SEQ ID NO:7708}, AGGTCGGATTGGTCGTCGTAGTTTAGGG {SEQ ID NO:7709}, TTGGGAGGGTCGGGTTTTAAGGGCGTT {SEQ ID NO:7710}, TTTGGGAGGGTCGGGTTTTAAGGGCGT {SEQ ID NO:7711}, TGGGAGGGTCGGGTTTTAAGGGCGTTA {SEQ ID NO:7712}, GGGCGTTTTTGGGAGGGTCGGGTTTTA {SEQ ID NO:7713}, TTTTGGGAGGGTCGGGTTTTAAGGGCG {SEQ ID NO:7714} |
| Target815 | chr7:127992031-127992040 | GCGGTAGGGGTGTGGCGTTTTTGAAGT {SEQ ID NO:7715}, TGCGGTAGGGGTGTGGCGTTTTTGAAG {SEQ ID NO:7716}, CGTTTTTGCGGTAGGGGTGTGGCGTTT {SEQ ID NO:7717}, TTGCGGTAGGGGTGTGGCGTTTTTGAA {SEQ ID NO:7718}, TTTGCGGTAGGGGTGTGGCGTTTTTGA {SEQ ID NO:7719}, CGTTTCGCGCGGGTTGTACGTTTTTT {SEQ ID NO:7720}, CGTTTCGCGCGGGTTGTACGTTTTT {SEQ ID NO:7721}, GCGTATCGTTCGTTGCGGTTTTTGC {SEQ ID NO:7722}, CGTTTCGCGCGGGTTGTACGTTTT {SEQ ID NO:7723}, GTTTCGCGCGGGTTGTACGTTTTTT {SEQ ID NO:7724} |
| Target816 | chr7:127992042-127992177 | TTCGGAAAGGAAAGCGGCGAGAAAGGC {SEQ ID NO:7725}, GCGGTAGGGGTGTGGCGTTTTTGAAGT {SEQ ID NO:7726}, TGCGGTAGGGGTGTGGCGTTTTTGAAG {SEQ ID NO:7727}, CGTTTTTGCGGTAGGGGTGTGGCGTTT {SEQ ID NO:7728}, TTGCGGTAGGGGTGTGGCGTTTTTGAA {SEQ ID NO:7729}, TGTTTGTTGTTGGTTCGGTCGCGTTCG {SEQ ID NO:7730}, GGTTTGTTTGTTGTTGGTTCGGTCGCGT {SEQ ID NO:7731}, TGGTTTGTTTGTTGTTGGTTCGGTCGCG {SEQ ID NO:7732}, GGTTTGTTTGTTGGTTCGGTCGCG {SEQ ID NO:7733}, TTGTTTGTTGTTGGTTCGGTCGCGTTCG {SEQ ID NO:7734} |
| Target817 | chr7:127992225-127992241 | GAGTCGTAGGGGTCGTAGCGGGCG {SEQ ID NO:7735}, CGAGTCGTAGGGGTCGTAGCGGGC {SEQ ID NO:7736}, AGTCGTAGGGGTCGTAGCGGGC {SEQ ID NO:7737}, CGAGTCGTAGGGGTCGTAGCGGGCG {SEQ ID NO:7738}, GAGTCGTAGGGGTCGTAGCGGGC {SEQ ID NO:7739}, TGTTTGTTGTTGGTTCGGTCGCGTTCG {SEQ ID NO:7740}, GGTTTGTTTGTTGTTGGTTCGGTCGCGT {SEQ ID NO:7741}, TGGTTTGTTTGTTGTTGGTTCGGTCGCG {SEQ ID NO:7742}, GGTTTGTTTGTTGTTGGTTCGGTCGCG {SEQ ID NO:7743}, TTGTTTGTTGTTGGTTCGGTCGCGTTCG {SEQ ID NO:7744} |
| Target818 | chr7:127992316-127992331 | CGCGGTCGGGTTAGTAGTAGGTAGGTT {SEQ ID NO:7745}, CGCGGTCGGGTTAGTAGTAGGTAGGT {SEQ ID NO:7746}, GCGTAGTTAGGTCGGTGGGGTATCG {SEQ ID NO:7747}, CGCGGTCGGGTTAGTAGTAGGTAGGTTAGTT {SEQ ID NO:7748}, GCGGAAGGTTTTGTAGTAGTAGTTAGGCGAGCG {SEQ ID NO:7749}, TGTTGTTGTTGTCGGTCGGGATTACGC {SEQ ID NO:7750}, TGGATTTGTTGTTGTTGTCGGTCGGGA {SEQ ID NO:7751}, TTGTTGTTGTTGTCGGTCGGGATTACGC {SEQ ID NO:7752}, |

FIGURE 5 CONTINUED

TTGGATTTGTTGTTGTTGTCGGTCGGG (SEQ ID NO:7753), TTGGATTTGTTGTTGTTGTCGGTCGGGA (SEQ ID NO:7754)

Target819    chr7:127992352-127992375    CGCGGTCGGGTTAGTAGTAGGTAGGTT (SEQ ID NO:7755), GAGCGCGGGTAGTCGATTTTTGTGTTT (SEQ ID NO:7756), CGCGGTCGGGTTAGTAGTAGGTAGGT (SEQ ID NO:7757), GAGCGCGGGTAGTCGATTTTTGTGTT (SEQ ID NO:7758), GAGCGCGGGTAGTCGATTTTTGTGTTTA (SEQ ID NO:7759), TGTTGTTGTTGTCGGTCGGGATTACGC (SEQ ID NO:7760), TGGATTTGTTGTTGTTGTCGGTCGGGA (SEQ ID NO:7761), TTGTTGTTGTTGTCGGTCGGGATTACGC (SEQ ID NO:7762), TTGGATTTGTTGTTGTTGTCGGTCGGG (SEQ ID NO:7763), TTGGATTTGTTGTTGTTGTCGGTCGGGA (SEQ ID NO:7764)

Target820    chr7:150329236-150329322    TGTTTGTGAGTTGGTGTAGAGGTAAGTTTGAGT (SEQ ID NO:7765), TTGTTTGTGAGTTGGTGTAGAGGTAAGTTTGAGT (SEQ ID NO:7766), TTTGTTTGTGAGTTGGTGTAGAGGTAAGTTTGAGT (SEQ ID NO:7767), TTGTTTGTGAGTTGGTGTAGAGGTAAGTTTGAGTA (SEQ ID NO:7768), TTTTGTTTGTGAGTTGGTGTAGAGGTAAGTTTGAGT (SEQ ID NO:7769)

Target821    chr7:150329374-150329487    CGTTGGAGATGGAGGAATAGGAAGTGGGT (SEQ ID NO:7770), CGTTGGAGATGGAGGAATAGGAAGTGGG (SEQ ID NO:7771), TCGTTGGAGATGGAGGAATAGGAAGTGGGT (SEQ ID NO:7772), TCGTTGGAGATGGAGGAATAGGAAGTGGG (SEQ ID NO:7773), TGGAGATGGAGGAATAGGAAGTGGGTAGG (SEQ ID NO:7774)

Target822    chr7:150655169-150655189    TAGTAGAAGAAGCGTGGGTTGGGGCGG (SEQ ID NO:7775), TAGAAGAAGCGTGGGTTGGGGCGGAAC (SEQ ID NO:7776), GTAGAAGAAGCGTGGGTTGGGGCGGAA (SEQ ID NO:7777), TTTCGCGGCGTTTTTATCGGTGTTGGC (SEQ ID NO:7778), TAGAAGAAGCGTGGGTTGGGGCGGAA (SEQ ID NO:7779), GAGGTTATGCGCGTCGGGGTGTTGTTT (SEQ ID NO:7780), AGGTTATGCGCGTCGGGGTGTTGTTTT (SEQ ID NO:7781), GAGGTTATGCGCGTCGGGGTGTTGTTTT (SEQ ID NO:7782), GGTTATGCGCGTCGGGGTGTTGTTTTT (SEQ ID NO:7783), GAGGTTATGCGCGTCGGGGTGTTGTT (SEQ ID NO:7784)

Target823    chr7:150655204-150655212    TAGTAGAAGAAGCGTGGGTTGGGGCGG (SEQ ID NO:7785), CGGGGGGTAGTATTTCGGCGCGTATGGT (SEQ ID NO:7786), TAGAAGAAGCGTGGGTTGGGGCGGAAC (SEQ ID NO:7787), GTAGAAGAAGCGTGGGTTGGGGCGGAA (SEQ ID NO:7788), TTTCGCGGCGTTTTTATCGGTGTTGGC (SEQ ID NO:7789), AGTTGTAGTTTGGTTCGGACGCGTTTT (SEQ ID NO:7790), GCGTTCGGTTAGTTTTTATCGTTTCGGGCG (SEQ ID NO:7791), CGCGTTCGGTTAGTTTTTATCGTTTCGGGC (SEQ ID NO:7792), GCGTTCGGTTAGTTTTTATCGTTTCGGGCGT (SEQ ID NO:7793), CGCGTTCGGTTAGTTTTTATCGTTTCGGGCG (SEQ ID NO:7794)

Target824    chr7:150655214-150655222    TAGTAGAAGAAGCGTGGGTTGGGGCGG (SEQ ID NO:7795), CGGGGGGTAGTATTTCGGCGCGTATGGT (SEQ ID NO:7796), TAGAAGAAGCGTGGGTTGGGGCGGAAC (SEQ ID NO:7797), GTAGAAGAAGCGTGGGTTGGGGCGGAA (SEQ ID NO:7798), TTTCGCGGCGTTTTTATCGGTGTTGGC (SEQ ID NO:7799), AGTTGTAGTTTGGTTCGGACGCGTTTT (SEQ ID NO:7800), GCGTTCGGTTAGTTTTTATCGTTTCGGGCG (SEQ ID NO:7801), CGCGTTCGGTTAGTTTTTATCGTTTCGGGC (SEQ ID NO:7802), GCGTTCGGTTAGTTTTTATCGTTTCGGGCGT (SEQ ID NO:7803), CGCGTTCGGTTAGTTTTTATCGTTTCGGGCG (SEQ ID NO:7804)

Target825    chr7:150655234-150655258    CGGGGGGTAGTATTTCGGCGCGTATGGT (SEQ ID NO:7805), TTTCGCGGCGTTTTTATCGGTGTTGGC (SEQ ID NO:7806), GCGGGGGTAGTATTTCGGCGCGTATGG (SEQ ID NO:7807), GGGTTTCGCGGCGTTTTTATCGGTGTT (SEQ ID NO:7808), GCGTTTTTATCGGTGTTGGCGTGGCG (SEQ ID NO:7809), GCGTGCGTTGGTGGGTTTCGGTTTTTC (SEQ ID NO:7810), CGTGCGTTGGTGGGTTTCGGTTTTTCG (SEQ ID NO:7811), GGCGTGCGTTGGTGGGTTTCGGTTTTT (SEQ ID NO:7812), GTGCGTTGGTGGGTTTCGGTTTTTCGT (SEQ ID NO:7813), TGCGTTGGTGGGTTTCGGTTTTTCGTT (SEQ ID NO:7814)

Target826    chr7:150655285-150655344    CGGGGGTAGTATTTCGGCGCGTATGGT (SEQ ID NO:7815), GCGGGGGTAGTATTTCGGCGCGTATGG (SEQ ID NO:7816), CGGGGGGTAGTATTTCGGCGCGTATGGT (SEQ ID NO:7817), GGGGGTAGTATTTCGGCGCGTATGGTT (SEQ ID NO:7818), GCGGGGGGTAGTATTTCGGCGCGTATG (SEQ ID NO:7819), GCGTGCGTTGGTGGGTTTCGGTTTTTC (SEQ ID NO:7820), CGTGCGTTGGTGGGTTTCGGTTTTTCG (SEQ ID NO:7821), GGCGTGCGTTGGTGGGTTTCGGTTTTT (SEQ ID NO:7822), GTGCGTTGGTGGGTTTCGGTTTTTCGT (SEQ ID NO:7823), TGCGTTGGTGGGTTTCGGTTTTTCGTT (SEQ ID NO:7824)

Target827    chr7:150655351-150655380    TTGCGGGGCGGAGAGTCGGGATTTATT (SEQ ID NO:7825), GTTGCGGGGCGGAGAGTCGGGATTTAT (SEQ ID NO:7826), TGCGGGGCGGAGAGTCGGGATTTATTA (SEQ ID NO:7827), TGCGGGGCGGAGAGTCGGGATTTATT (SEQ ID NO:7828), TTGCGGGGCGGAGAGTCGGGATTTAT (SEQ ID NO:7829), GCGGCGTGCGTTGGTGGGTTTT (SEQ ID NO:7830), TGGATAATTACGTGGTAGGGTTCGGGTTC (SEQ ID NO:7831), GCGGCGTGCGTTGGTGGGGTTT (SEQ ID NO:7832), CGTGGTGGTGGACGTGGATTTGAC (SEQ ID NO:7833), ATGGATAATTACGTGGTAGGGTTCGGGTTC (SEQ ID NO:7834)

FIGURE 5 CONTINUED

| | | |
|---|---|---|
| Target828 | chr7:150655454-150655472 | TTGCGGGGCGGAGAGTCGGGATTTATT (SEQ ID NO:7835), GTTGCGGGGCGGAGAGTCGGGATTTAT (SEQ ID NO:7836), TGCGGGGCGGAGAGTCGGGATTTATTA (SEQ ID NO:7837), TGCGGGGCGGAGAGTCGGGATTTATT (SEQ ID NO:7838), TTGCGGGGCGGAGAGTCGGGATTTAT (SEQ ID NO:7839), CGGGAGTCGTCGGTGCGGTCG (SEQ ID NO:7840), GGAGTCGTCGGTGCGGTCGGG (SEQ ID NO:7841), GGGAGTCGTCGGTGCGGTCGG (SEQ ID NO:7842), GAGTCGTCGGTGCGGTCGGGC (SEQ ID NO:7843), GGGAGTCGTCGGTGCGGTCGGG (SEQ ID NO:7844) |
| Target829 | chr7:150655495-150655502 | GGGTTAGCGATTCGTTGTTGGGTGTCG (SEQ ID NO:7845), AGGGTTAGCGATTCGTTGTTGGGTGTCG (SEQ ID NO:7846), AGGGTTAGCGATTCGTTGTTGGGTGTC (SEQ ID NO:7847), CGATTCGTTGTTGGGTGTCGCGGGC (SEQ ID NO:7848), TAGGGTTAGCGATTCGTTGTTGGGTGTCG (SEQ ID NO:7849), CGGGAGTCGTCGGTGCGGTCG (SEQ ID NO:7850), GGAGTCGTCGGTGCGGTCGGG (SEQ ID NO:7851), GGGAGTCGTCGGTGCGGTCGG (SEQ ID NO:7852), GAGTCGTCGGTGCGGTCGGGC (SEQ ID NO:7853), GGGAGTCGTCGGTGCGGTCGGG (SEQ ID NO:7854) |
| Target830 | chr7:150655541-150655557 | GGGTTAGCGATTCGTTGTTGGGTGTCG (SEQ ID NO:7855), AGGGTTAGCGATTCGTTGTTGGGTGTCG (SEQ ID NO:7856), AGGGTTAGCGATTCGTTGTTGGGTGTC (SEQ ID NO:7857), CGATTCGTTGTTGGGTGTCGCGGGC (SEQ ID NO:7858), TAGGGTTAGCGATTCGTTGTTGGGTGTCG (SEQ ID NO:7859), AGCGGTTGGGGGGTTTATTTTTTAGGTTTTGT (SEQ ID NO:7860), GCGGTTGGGGGGTTTATTTTTTAGGTTTTGTTCG (SEQ ID NO:7861), GCGGTTGGGGGGTTTATTTTTTAGGTTTTGTTCGT (SEQ ID NO:7862), AGCGGTTGGGGGGTTTATTTTTTAGGTTTTGTT (SEQ ID NO:7863), AGCGGTTGGGGGGTTTATTTTTTAGGTTTTGTTCG (SEQ ID NO:7864) |
| Target831 | chr7:150655572-150655595 | TTTAGGCGGAAGGTTTTGGCGCGGTT (SEQ ID NO:7865), TTTTAGGCGGAAGGTTTTGGCGCGGTT (SEQ ID NO:7866), AGTTTTAGGCGGAAGGTTTTGGCGCGG (SEQ ID NO:7867), TTAGGCGGAAGGTTTTGGCGCGGTTG (SEQ ID NO:7868), GTTTTAGGCGGAAGGTTTTGGCGCGGT (SEQ ID NO:7869), GGAAGTGGGGATGGGGGGGTGTTCGTT (SEQ ID NO:7870), GAAGTGGGGATGGGGGGGTTGTTCGTTT (SEQ ID NO:7871), AGTGGGGATGGGGGGGTTGTTCGTTTT (SEQ ID NO:7872), AAGTGGGGATGGGGGGGTTGTTCGTTTT (SEQ ID NO:7873), GGAAGTGGGGATGGGGGGGTTGTTCGT (SEQ ID NO:7874) |
| Target832 | chr7:154409589-154409878 | AGGTTATCGGGAGGCGTCGTGTTTTT (SEQ ID NO:7875), TAGGTTATCGGGAGGCGTCGTGTTTTT (SEQ ID NO:7876), TTAGGTTATCGGGAGGCGTCGTGTTTT (SEQ ID NO:7877), TTTAGGTTATCGGGAGGCGTCGTGTTT (SEQ ID NO:7878), TTTTAGGTTATCGGGAGGCGTCGTGTT (SEQ ID NO:7879), GGGGGAAAGTTTGTGTGAGTAGATAGTATTGTGGG (SEQ ID NO:7880), GGGGAAAGTTTGTGTGAGTAGATAGTATTGTGGG (SEQ ID NO:7881), GGGGGAAAGTTTGTGTGAGTAGATAGTATTGTGG (SEQ ID NO:7882), AGGGGGAAAGTTTGTGTGAGTAGATAGTATTGTGGG (SEQ ID NO:7883), GGGGGAAAGTTTGTGTGAGTAGATAGTATTGTGGGA (SEQ ID NO:7884) |
| Target833 | chr7:155302254-155302259 | CGCGTAGTTAAGGGTAGTTTCGGGGAGGG (SEQ ID NO:7885), CGCGTAGTTAAGGGTAGTTTCGGGGAGG (SEQ ID NO:7886), GCGTAGTTAAGGGTAGTTTCGGGGAGGGT (SEQ ID NO:7887), GCGTAGTTAAGGGTAGTTTCGGGGAGGG (SEQ ID NO:7888), AGGGGATTTGAAGTTAGTTGAGCGCGT (SEQ ID NO:7889) |
| Target834 | chr7:155302342-155302375 | CGAGAGAGAGAGCGCGCGTTTAGTTGG (SEQ ID NO:7890), TCGGGGTTGTTTTTTGGTTGCGCGTTTT (SEQ ID NO:7891), TTCGGGGTTGTTTTTTGGTTGCGCGTTTT (SEQ ID NO:7892), TTTCGGGGTTGTTTTTTGGTTGCGCGTT (SEQ ID NO:7893), TTTTCGGGGTTGTTTTTTGGTTGCGCGT (SEQ ID NO:7894), GTTTGGGAGATGGGGCGTTCGTTCGTG (SEQ ID NO:7895), AGGAGTTCGTTTGGGAGATGGGGCGTT (SEQ ID NO:7896), GAGGAGTTCGTTTGGGAGATGGGGCGT (SEQ ID NO:7897), TTTGGGAGATGGGGCGTTCGTTCGTGA (SEQ ID NO:7898), AGTTCGTTTGGGAGATGGGGCGTTCGT (SEQ ID NO:7899) |
| Target835 | chr7:156400350-156400882 | GTTACGGAGGAGAAGTTGGGGGTGGGG (SEQ ID NO:7900), GAGTTAGGTAGAGGAGGCGGCGGTTCG (SEQ ID NO:7901), GGAGTTAGGTAGAGGAGGCGGCGGTTC (SEQ ID NO:7902), TTTTCGAACGAGGCGGGTAGGGAGAGG (SEQ ID NO:7903), TGGGGGTGGGGGATTTAGGAATTGCGG (SEQ ID NO:7904), AGCGGCGTTTGAGTTCGGATGTTTCGG (SEQ ID NO:7905), CGGAGCGGCGTTTGAGTTCGGATGTTT (SEQ ID NO:7906), TTTTCGTTTGTAGTTCGGTGCGCGGGG (SEQ ID NO:7907), CGCGGGGTGTTTTTGTTGTTGGAGGGT (SEQ ID NO:7908), CGTAGTGGGAGGAACGGTTTGGAGGGG (SEQ ID NO:7909) |
| Target836 | chr7:156400926-156401053 | TTTTGTAGTTCGGTGGGTTTCGCGGCG (SEQ ID NO:7910), GTAGTTCGGTGGGTTTCGCGGCGTTTT (SEQ ID NO:7911), AGTTCGGTGGGTTTCGCGCGCGTTTTA (SEQ ID NO:7912), TAGTTCGGTGGGTTTCGCGGCGTTTTT (SEQ ID NO:7913), CGGTGGGTTTCGCGGCGTTTTTATTCG (SEQ ID NO:7914), GAGGGGCGGATGGGTTTAGGTAGGGG (SEQ ID NO:7915), GGGGCGGATGGGTTTAGGTAGGGGTT (SEQ ID NO:7916), CGTAGTGGGAGGAACGGTTTGGAGGGG (SEQ ID NO:7917), AGTGGGAGGAACGGTTTGGAGGGGAAG (SEQ ID NO:7918), GGAAGGAGTTTGGTTGGACGTTGCGGT (SEQ ID NO:7919) |
| Target837 | chr7:156796576-156796588 | CGCGTTTTGAGGTAGAGGAGTGGTTGCG (SEQ ID NO:7920), GCGTTTTGAGGTAGAGGAGTGGTTGCGT (SEQ ID NO:7921), GCGTTTTGAGGTAGAGGAGTGGTTGCG (SEQ ID NO:7922), CGCGTTTTGAGGTAGAGGAGTGGTTGC (SEQ ID NO:7923), TCGCGTTTTGAGGTAGAGGAGTGGTTGC (SEQ ID NO:7924), GCGTTTTATTTGGGTGATTATCGCGGGGC (SEQ ID NO:7925), CGTTTTATTTGGGTGATTATCGCGGGGC (SEQ ID NO:7926), GCGTTTTATTTGGGTGATTATCGCGGGGG |

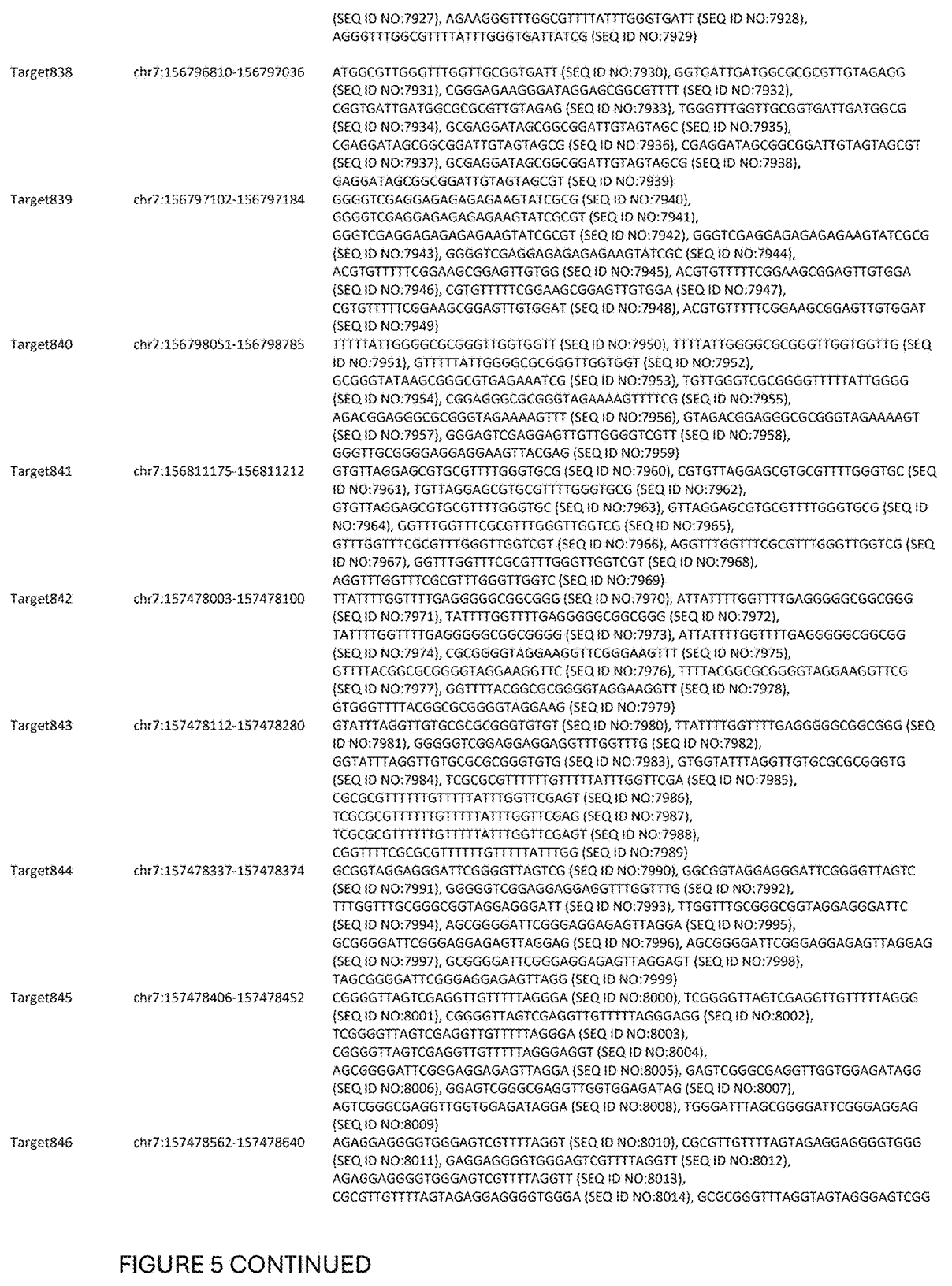

FIGURE 5 CONTINUED (SEQ ID NO:7927), AGAAGGGTTTGGCGTTTTATTTGGGTGATT (SEQ ID NO:7928),
AGGGTTTGGCGTTTTATTTGGGTGATTATCG (SEQ ID NO:7929)

Target838     chr7:156796810-156797036     ATGGCGTTGGGTTTGGTTGCGGTGATT (SEQ ID NO:7930), GGTGATTGATGGCGCGCGTTGTAGAGG
(SEQ ID NO:7931), CGGGAGAAGGGATAGGAGCGGCGTTTT (SEQ ID NO:7932),
CGGTGATTGATGGCGCGCGTTGTAGAG (SEQ ID NO:7933), TGGGTTTGGTTGCGGTGATTGATGGCG
(SEQ ID NO:7934), GCGAGGATAGCGGCGGATTGTAGTAGC (SEQ ID NO:7935),
CGAGGATAGCGGCGGATTGTAGTAGCG (SEQ ID NO:7936), CGAGGATAGCGGCGGATTGTAGTAGCGT
(SEQ ID NO:7937), GCGAGGATAGCGGCGGATTGTAGTAGCGC (SEQ ID NO:7938),
GAGGATAGCGGCGGATTGTAGTAGCGT (SEQ ID NO:7939)

Target839     chr7:156797102-156797184     GGGGTCGAGGAGAGAGAGAAGTATCGCG (SEQ ID NO:7940),
GGGGTCGAGGAGAGAGAGAAGTATCGCGT (SEQ ID NO:7941),
GGGTCGAGGAGAGAGAGAAGTATCGCGT (SEQ ID NO:7942), GGGTCGAGGAGAGAGAGAAGTATCGCGG
(SEQ ID NO:7943), GGGGTCGAGGAGAGAGAGAAGTATCGC (SEQ ID NO:7944),
ACGTGTTTTTCGGAAGCGGAGTTGTGG (SEQ ID NO:7945), ACGTGTTTTTCGGAAGCGGAGTTGTGGA
(SEQ ID NO:7946), CGTGTTTTTCGGAAGCGGAGTTGTGGA (SEQ ID NO:7947),
CGTGTTTTTCGGAAGCGGAGTTGTGGAT (SEQ ID NO:7948), ACGTGTTTTTCGGAAGCGGAGTTGTGGAT
(SEQ ID NO:7949)

Target840     chr7:156798051-156798785     TTTTTATTGGGGCGCGGGTTGGTGGTT (SEQ ID NO:7950), TTTTTATTGGGGCGCGGGTTGGTGGTTG (SEQ
ID NO:7951), GTTTTTATTGGGGCGCGGGTTGGTGGT (SEQ ID NO:7952),
GCGGGTATAAGCGGGCGTGAGAAATCG (SEQ ID NO:7953), TGTTGGGTCGCGGGGTTTTTATTGGGG
(SEQ ID NO:7954), CGGAGGGGCGCGGGTAGAAAAGTTTTCG (SEQ ID NO:7955),
AGACGGAGGGGCGCGGGTAGAAAAGTTT (SEQ ID NO:7956), GTAGACGGAGGGGCGCGGGTAGAAAAGT
(SEQ ID NO:7957), GGGAGTCGAGGAGTTGTTGGGGTCGTT (SEQ ID NO:7958),
GGGTTGCGGGGAGGAGGAAGTTACGAG (SEQ ID NO:7959)

Target841     chr7:156811175-156811212     GTGTTAGGAGCGTGCGTTTTGGGTGCG (SEQ ID NO:7960), CGTGTTAGGAGCGTGCGTTTTGGGTGC (SEQ
ID NO:7961), TGTTAGGAGCGTGCGTTTTGGGTGCG (SEQ ID NO:7962),
GTGTTAGGAGCGTGCGTTTTGGGTGC (SEQ ID NO:7963), GTTAGGAGCGTGCGTTTTGGGTGCG (SEQ ID
NO:7964), GGTTTGGTTTCGCGTTTGGGTTGGTCG (SEQ ID NO:7965),
GTTTGGTTTCGCGTTTGGGTTGGTCGT (SEQ ID NO:7966), AGGTTTGGTTTCGCGTTTGGGTTGGTCG (SEQ
ID NO:7967), GGTTTGGTTTCGCGTTTGGGTTGGTCGT (SEQ ID NO:7968),
AGGTTTGGTTTCGCGTTTGGGTTGGTC (SEQ ID NO:7969)

Target842     chr7:157478003-157478100     TTATTTTGGTTTTGAGGGGGCGGCGGG (SEQ ID NO:7970), ATTATTTTGGTTTTGAGGGGGCGGCGGG
(SEQ ID NO:7971), TATTTTGGTTTTGAGGGGGCGGCGGG (SEQ ID NO:7972),
TATTTTGGTTTTGAGGGGGCGGCGGG (SEQ ID NO:7973), ATTATTTTGGTTTTGAGGGGGCGGCGG
(SEQ ID NO:7974), CGCGGGTAGGAAGGTTCGGGAAGTTT (SEQ ID NO:7975),
GTTTTACGGCGCGGGGTAGGAAGGTTC (SEQ ID NO:7976), TTTTACGGCGCGGGGTAGGAAGGTTCG
(SEQ ID NO:7977), GGTTTTACGGCGCGGGGTAGGAAGGTT (SEQ ID NO:7978),
GTGGGTTTTACGGCGCGGGGTAGGAAG (SEQ ID NO:7979)

Target843     chr7:157478112-157478280     GTATTTAGGTTGTGCGCGCGGGTGTGT (SEQ ID NO:7980), TTATTTTGGTTTTGAGGGGGCGGCGGG (SEQ
ID NO:7981), GGGGGTCGGAGGAGGAGGTTTGGTTTG (SEQ ID NO:7982),
GGTATTTAGGTTGTGCGCGCGGGTGTG (SEQ ID NO:7983), GTGGTATTTAGGTTGTGCGCGCGGGTG
(SEQ ID NO:7984), TCGCGCGTTTTTTGTTTTTATTTGGTTCGA (SEQ ID NO:7985),
CGCGCGTTTTTTGTTTTTATTTGGTTCGAGT (SEQ ID NO:7986),
TCGCGCGTTTTTTGTTTTTATTTGGTTCGAG (SEQ ID NO:7987),
TCGCGCGTTTTTTGTTTTTATTTGGTTCGAGT (SEQ ID NO:7988),
CGGTTTTCGCGCGTTTTTTGTTTTTATTTGG (SEQ ID NO:7989)

Target844     chr7:157478337-157478374     GCGGTAGGAGGGATTCGGGGTTAGTCG (SEQ ID NO:7990), GGCGGTAGGAGGGATTCGGGGTTAGTC
(SEQ ID NO:7991), GGGGGTCGGAGGAGGAGGTTTGGTTTG (SEQ ID NO:7992),
TTTGGTTTGCGGGCGGTAGGAGGGATT (SEQ ID NO:7993), TTGGTTTGCGGGCGGTAGGAGGGATTC
(SEQ ID NO:7994), AGCGGGGATTCGGGAGGAGAGTTAGGA (SEQ ID NO:7995),
GCGGGGATTCGGGAGGAGAGTTAGGAG (SEQ ID NO:7996), AGCGGGGATTCGGGAGGAGAGTTAGGAG
(SEQ ID NO:7997), GCGGGGATTCGGGAGGAGAGTTAGGAGT (SEQ ID NO:7998),
TAGCGGGGATTCGGGAGGAGAGTTAGG (SEQ ID NO:7999)

Target845     chr7:157478406-157478452     CGGGGTTAGTCGAGGTTGTTTTTAGGGA (SEQ ID NO:8000), TCGGGGTTAGTCGAGGTTGTTTTTAGGG
(SEQ ID NO:8001), CGGGGTTAGTCGAGGTTGTTTTTAGGGAGG (SEQ ID NO:8002),
TCGGGGTTAGTCGAGGTTGTTTTTAGGGA (SEQ ID NO:8003),
CGGGGTTAGTCGAGGTTGTTTTTAGGGAGGT (SEQ ID NO:8004),
AGCGGGGATTCGGGAGGAGAGTTAGGA (SEQ ID NO:8005), GAGTCGGGCGAGGTTGGTGGAGATAGG
(SEQ ID NO:8006), GGAGTCGGGCGAGGTTGGTGGAGATAG (SEQ ID NO:8007),
AGTCGGGCGAGGTTGGTGGAGATAGGA (SEQ ID NO:8008), TGGGATTTAGCGGGGATTCGGGAGGAG
(SEQ ID NO:8009)

Target846     chr7:157478562-157478640     AGAGGAGGGGTGGGAGTCGTTTTAGGT (SEQ ID NO:8010), CGCGTTGTTTTAGTAGAGGAGGGGTGGG
(SEQ ID NO:8011), GAGGAGGGGTGGGAGTCGTTTTAGGTT (SEQ ID NO:8012),
AGAGGAGGGGTGGGAGTCGTTTTAGGTT (SEQ ID NO:8013),
CGCGTTGTTTTAGTAGAGGAGGGGTGGGA (SEQ ID NO:8014), GCGCGGGTTTAGGTAGTAGGGAGTCGG

FIGURE 5 CONTINUED

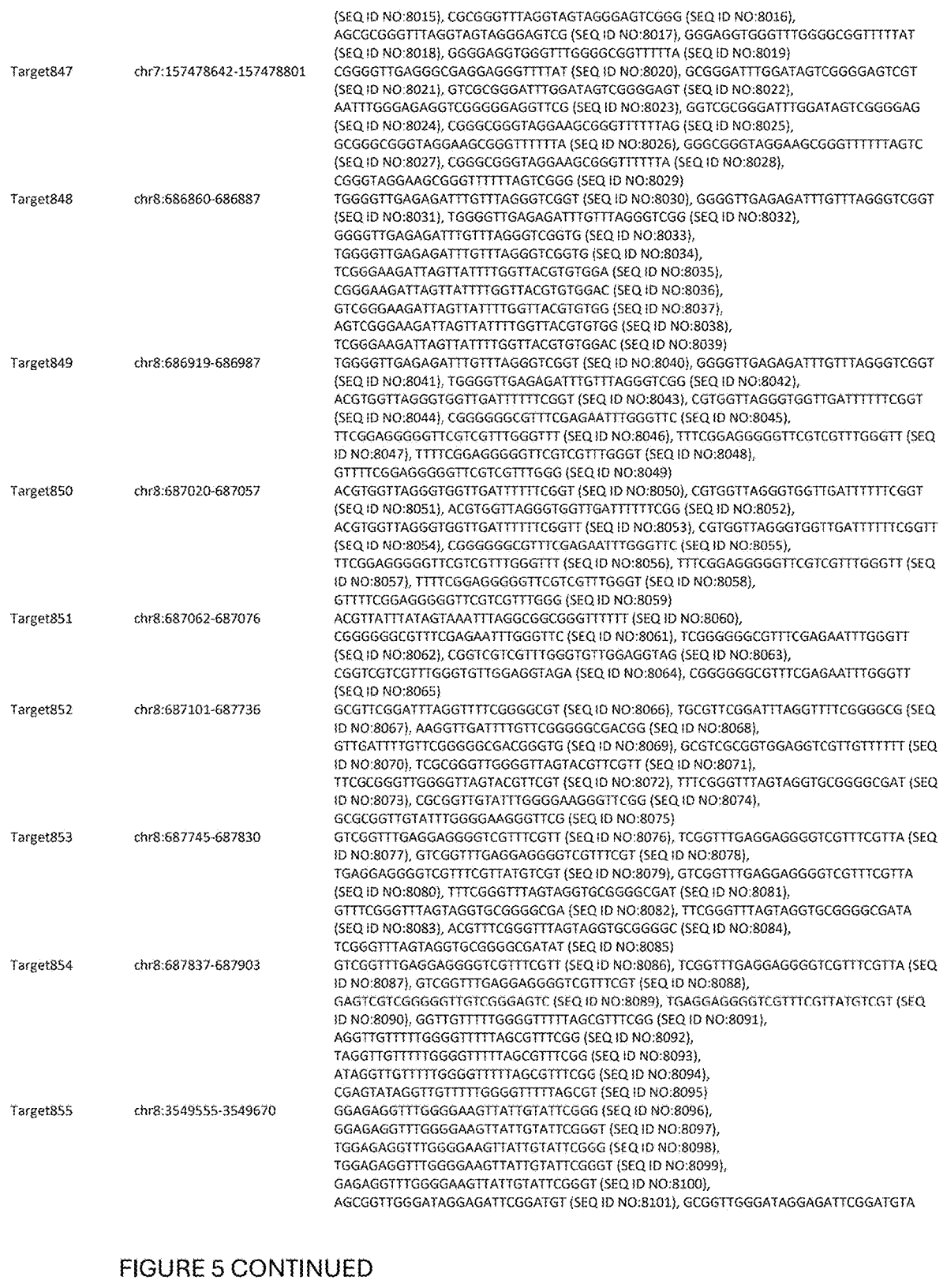

|  |  |  |
|---|---|---|
|  |  | {SEQ ID NO:8015}, CGCGGGTTTAGGTAGTAGGGAGTCGGG {SEQ ID NO:8016}, AGCGCGGGTTTAGGTAGTAGGGAGTCG {SEQ ID NO:8017}, GGGGAGGTGGGTTTGGGGCGGTTTTTAT {SEQ ID NO:8018}, GGGGAGGTGGGTTTGGGGCGGTTTTTA {SEQ ID NO:8019} |
| Target847 | chr7:157478642-157478801 | CGGGGTTGAGGGCGAGGAGGGTTTTAT {SEQ ID NO:8020}, GCGGGATTTGGATAGTCGGGGAGTCGT {SEQ ID NO:8021}, GTCGCGGGATTTGGATAGTCGGGGAGT {SEQ ID NO:8022}, AATTTGGGAGAGGTCGGGGGAGGTTCG {SEQ ID NO:8023}, GGTCGCGGGATTTGGATAGTCGGGGAG {SEQ ID NO:8024}, CGGGCGGGTAGGAAGCGGGTTTTTTAG {SEQ ID NO:8025}, GCGGGCGGGTAGGAAGCGGGTTTTTTA {SEQ ID NO:8026}, GGGCGGGTAGGAAGCGGGTTTTTTAGTC {SEQ ID NO:8027}, CGGGCGGGTAGGAAGCGGGTTTTTTA {SEQ ID NO:8028}, CGGGTAGGAAGCGGGTTTTTTAGTCGGG {SEQ ID NO:8029} |
| Target848 | chr8:686860-686887 | TGGGGTTGAGAGATTTGTTTAGGGTCGGT {SEQ ID NO:8030}, GGGGTTGAGAGATTTGTTTAGGGTCGGT {SEQ ID NO:8031}, TGGGGTTGAGAGATTTGTTTAGGGGTCGG {SEQ ID NO:8032}, GGGGTTGAGAGATTTGTTTAGGGTCGGTG {SEQ ID NO:8033}, TGGGGTTGAGAGATTTGTTTAGGGTCGGTG {SEQ ID NO:8034}, TCGGGAAGATTAGTTATTTTGGTTACGTGTGGA {SEQ ID NO:8035}, CGGGAAGATTAGTTATTTTGGTTACGTGTGGAC {SEQ ID NO:8036}, GTCGGGAAGATTAGTTATTTTGGTTACGTGTGG {SEQ ID NO:8037}, AGTCGGGAAGATTAGTTATTTTGGTTACGTGTGG {SEQ ID NO:8038}, TCGGGAAGATTAGTTATTTTGGTTACGTGTGGAC {SEQ ID NO:8039} |
| Target849 | chr8:686919-686987 | TGGGGTTGAGAGATTTGTTTAGGGTCGGT {SEQ ID NO:8040}, GGGGTTGAGAGATTTGTTTAGGGTCGGT {SEQ ID NO:8041}, TGGGGTTGAGAGATTTGTTTAGGGTCGG {SEQ ID NO:8042}, ACGTGGTTAGGGTGGTTGATTTTTTCGGT {SEQ ID NO:8043}, CGTGGTTAGGGTGGTTGATTTTTTCGGT {SEQ ID NO:8044}, CGGGGGGGCGTTTCGAGAATTTGGGTTC {SEQ ID NO:8045}, TTCGGAGGGGGGTTCGTCGTTTGGGTTT {SEQ ID NO:8046}, TTTCGGAGGGGGGTTCGTCGTTTGGGTT {SEQ ID NO:8047}, TTTTCGGAGGGGGGTTCGTCGTTTGGGT {SEQ ID NO:8048}, GTTTTCGGAGGGGGGTTCGTCGTTTGGG {SEQ ID NO:8049} |
| Target850 | chr8:687020-687057 | ACGTGGTTAGGGTGGTTGATTTTTTCGGT {SEQ ID NO:8050}, CGTGGTTAGGGTGGTTGATTTTTTCGGT {SEQ ID NO:8051}, ACGTGGTTAGGGTGGTTGATTTTTTCGG {SEQ ID NO:8052}, ACGTGGTTAGGGTGGTTGATTTTTTCGGTT {SEQ ID NO:8053}, CGTGGTTAGGGTGGTTGATTTTTTCGGTT {SEQ ID NO:8054}, CGGGGGGCGTTTCGAGAATTTGGGTTC {SEQ ID NO:8055}, TTCGGAGGGGGGTTCGTCGTTTGGGTTT {SEQ ID NO:8056}, TTTCGGAGGGGGGTTCGTCGTTTGGGTT {SEQ ID NO:8057}, TTTTCGGAGGGGGGTTCGTCGTTTGGGT {SEQ ID NO:8058}, GTTTTCGGAGGGGGGTTCGTCGTTTGGG {SEQ ID NO:8059} |
| Target851 | chr8:687062-687076 | ACGTTATTTATAGTAAATTTAGGCGGCGGGTTTTT {SEQ ID NO:8060}, CGGGGGGGCGTTTCGAGAATTTGGGTTC {SEQ ID NO:8061}, TCGGGGGGCGTTTCGAGAATTTGGGTT {SEQ ID NO:8062}, CGGTCGTCGTTTGGGTGTTGGAGGTAG {SEQ ID NO:8063}, CGGTCGTCGTTTGGGTGTTGGAGGTAGA {SEQ ID NO:8064}, CGGGGGGGCGTTTCGAGAATTTGGGTT {SEQ ID NO:8065} |
| Target852 | chr8:687101-687736 | GCGTTCGGATTTAGGTTTTCGGGGCGT {SEQ ID NO:8066}, TGCGTTCGGATTTAGGTTTTCGGGGCG {SEQ ID NO:8067}, AAGGTTGATTTTGTTCGGGGGGCGACGG {SEQ ID NO:8068}, GTTGATTTTGTTCGGGGGCGACGGGTG {SEQ ID NO:8069}, GCGTCGCGGTGGAGGTCGTTGTTTTTT {SEQ ID NO:8070}, TCGCGGGTTGGGGTTAGTACGTTCGTT {SEQ ID NO:8071}, TTCGCGGGTTGGGGTTAGTACGTTCGT {SEQ ID NO:8072}, TTTCGGGTTTAGTAGGTGCGGGGCGAT {SEQ ID NO:8073}, CGCGGTTGTATTTGGGGAAGGGTTCGG {SEQ ID NO:8074}, GCGCGGTTGTATTTGGGGAAGGGTTCG {SEQ ID NO:8075} |
| Target853 | chr8:687745-687830 | GTCGGTTTGAGGAGGGGTCGTTTCGTT {SEQ ID NO:8076}, TCGGTTTGAGGAGGGGTCGTTTCGTTA {SEQ ID NO:8077}, GTCGGTTTGAGGAGGGGTCGTTTCGT {SEQ ID NO:8078}, TGAGGAGGGGTCGTTTCGTTATGTCGT {SEQ ID NO:8079}, GTCGGTTTGAGGAGGGGTCGTTTCGTTA {SEQ ID NO:8080}, TTTCGGGTTTAGTAGGTGCGGGGCGAT {SEQ ID NO:8081}, GTTTCGGGTTTAGTAGGTGCGGGGCGA {SEQ ID NO:8082}, TTCGGGTTTAGTAGGTGCGGGGCGATA {SEQ ID NO:8083}, ACGTTTCGGGTTTAGTAGGTGCGGGGC {SEQ ID NO:8084}, TCGGGTTTAGTAGGTGCGGGGCGATAT {SEQ ID NO:8085} |
| Target854 | chr8:687837-687903 | GTCGGTTTGAGGAGGGGTCGTTTCGTT {SEQ ID NO:8086}, TCGGTTTGAGGAGGGGTCGTTTCGTTA {SEQ ID NO:8087}, GTCGGTTTGAGGAGGGGTCGTTTCGT {SEQ ID NO:8088}, GAGTCGTCGGGGGTTGTCGGGAGTC {SEQ ID NO:8089}, TGAGGAGGGGTCGTTTCGTTATGTCGT {SEQ ID NO:8090}, GGTTGTTTTTGGGGTTTTTAGCGTTTCGG {SEQ ID NO:8091}, AGGTTGTTTTTGGGGTTTTTAGCGTTTCGG {SEQ ID NO:8092}, TAGGTTGTTTTTGGGGTTTTTAGCGTTTCGG {SEQ ID NO:8093}, ATAGGTTGTTTTTGGGGTTTTTAGCGTTTCGG {SEQ ID NO:8094}, CGAGTATAGGTTGTTTTTGGGGTTTTTAGCGT {SEQ ID NO:8095} |
| Target855 | chr8:3549555-3549670 | GGAGAGGTTTGGGGAAGTTATTGTATTCGGG {SEQ ID NO:8096}, GGAGAGGTTTGGGGAAGTTATTGTATTCGGGT {SEQ ID NO:8097}, TGGAGAGGTTTGGGGAAGTTATTGTATTCGGG {SEQ ID NO:8098}, TGGAGAGGTTTGGGGAAGTTATTGTATTCGGGT {SEQ ID NO:8099}, GAGAGGTTTGGGGAAGTTATTGTATTCGGGT {SEQ ID NO:8100}, AGCGGTTGGGATAGGAGATTCGGATGT {SEQ ID NO:8101}, GCGGTTGGGATAGGAGATTCGGATGTA |

FIGURE 5 CONTINUED

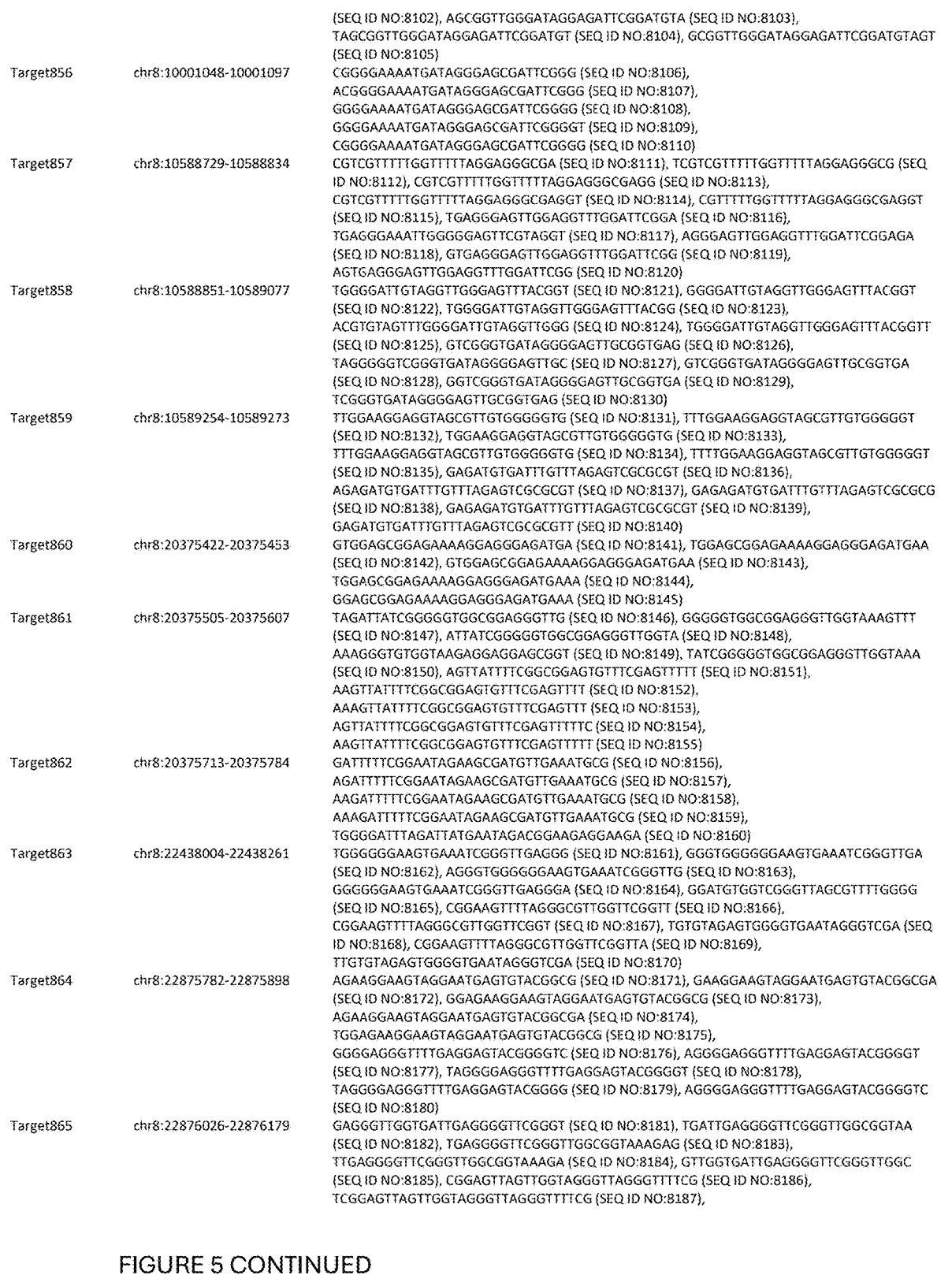

|  |  |  |
|---|---|---|
|  |  | (SEQ ID NO:8102), AGCGGTTGGGATAGGAGATTCGGATGTA (SEQ ID NO:8103), TAGCGGTTGGGATAGGAGATTCGGATGT (SEQ ID NO:8104), GCGGTTGGGATAGGAGATTCGGATGTAGT (SEQ ID NO:8105) |
| Target856 | chr8:10001048-10001097 | CGGGGAAAATGATAGGGAGCGATTCGGG (SEQ ID NO:8106), ACGGGGAAAATGATAGGGAGCGATTCGGG (SEQ ID NO:8107), GGGGAAAATGATAGGGAGCGATTCGGGG (SEQ ID NO:8108), GGGGAAAATGATAGGGAGCGATTCGGGGT (SEQ ID NO:8109), CGGGGAAAATGATAGGGAGCGATTCGGGG (SEQ ID NO:8110) |
| Target857 | chr8:10588729-10588834 | CGTCGTTTTTGGTTTTTAGGAGGGCGA (SEQ ID NO:8111), TCGTCGTTTTTGGTTTTTAGGAGGGCG (SEQ ID NO:8112), CGTCGTTTTTGGTTTTTAGGAGGGCGAGG (SEQ ID NO:8113), CGTCGTTTTTGGTTTTTAGGAGGGCGAGGT (SEQ ID NO:8114), CGTTTTTGGTTTTTAGGAGGGCGAGGT (SEQ ID NO:8115), TGAGGGAGTTGGAGGTTTGGATTCGGA (SEQ ID NO:8116), TGAGGGAAATTGGGGGAGTTCGTAGGT (SEQ ID NO:8117), AGGGAGTTGGAGGTTTGGATTCGGAGA (SEQ ID NO:8118), GTGAGGGAGTTGGAGGTTTGGATTCGG (SEQ ID NO:8119), AGTGAGGGAGTTGGAGGTTTGGATTCGG (SEQ ID NO:8120) |
| Target858 | chr8:10588851-10589077 | TGGGGATTGTAGGTTGGGAGTTTACGGT (SEQ ID NO:8121), GGGGATTGTAGGTTGGGAGTTTACGGT (SEQ ID NO:8122), TGGGGATTGTAGGTTGGGAGTTTACGG (SEQ ID NO:8123), ACGTGTAGTTTGGGGATTGTAGGTTGGG (SEQ ID NO:8124), TGGGGATTGTAGGTTGGGAGTTTACGTT (SEQ ID NO:8125), GTCGGGTGATAGGGGAGTTGCGGTGAG (SEQ ID NO:8126), TAGGGGGTCGGGTGATAGGGGAGTTGC (SEQ ID NO:8127), GTCGGGTGATAGGGGAGTTGCGGTGA (SEQ ID NO:8128), GGTCGGGTGATAGGGGAGTTGCGGTGA (SEQ ID NO:8129), TCGGGTGATAGGGGAGTTGCGGTGAG (SEQ ID NO:8130) |
| Target859 | chr8:10589254-10589273 | TTGGAAGGAGGTAGCGTTGTGGGGGTG (SEQ ID NO:8131), TTTGGAAGGAGGTAGCGTTGTGGGGGT (SEQ ID NO:8132), TGGAAGGAGGTAGCGTTGTGGGGGTG (SEQ ID NO:8133), TTTGGAAGGAGGTAGCGTTGTGGGGGTG (SEQ ID NO:8134), TTTTGGAAGGAGGTAGCGTTGTGGGGGT (SEQ ID NO:8135), GAGATGTGATTTGTTTAGAGTCGCGCGT (SEQ ID NO:8136), AGAGATGTGATTTGTTTAGAGTCGCGCGT (SEQ ID NO:8137), GAGAGATGTGATTTGTTTAGAGTCGCGCG (SEQ ID NO:8138), GAGAGATGTGATTTGTTTAGAGTCGCGCGT (SEQ ID NO:8139), GAGATGTGATTTGTTTAGAGTCGCGCGT (SEQ ID NO:8140) |
| Target860 | chr8:20375422-20375453 | GTGGAGCGGAGAAAAGGAGGGAGATGA (SEQ ID NO:8141), TGGAGCGGAGAAAAGGAGGGAGATGAA (SEQ ID NO:8142), GTGGAGCGGAGAAAAGGAGGGAGATGAA (SEQ ID NO:8143), TGGAGCGGAGAAAAGGAGGGAGATGAAA (SEQ ID NO:8144), GGAGCGGAGAAAAGGAGGGAGATGAAA (SEQ ID NO:8145) |
| Target861 | chr8:20375505-20375607 | TAGATTATCGGGGGTGGCGGAGGGGTTG (SEQ ID NO:8146), GGGGGTGGCGGAGGGGTTGGTAAAGTTT (SEQ ID NO:8147), ATTATCGGGGGTGGCGGAGGGGTTGGTA (SEQ ID NO:8148), AAAGGGGTGTGGTAAGAGGAGGAGCGGT (SEQ ID NO:8149), TATCGGGGGTGGCGGAGGGGTTGGTAAA (SEQ ID NO:8150), AGTTATTTTCGGCGGAGTGTTTCGAGTTTT (SEQ ID NO:8151), AAGTTATTTTCGGCGGAGTGTTTCGAGTTTT (SEQ ID NO:8152), AAAGTTATTTTCGGCGGAGTGTTTCGAGTTT (SEQ ID NO:8153), AGTTATTTTCGGCGGAGTGTTTCGAGTTTTTC (SEQ ID NO:8154), AAGTTATTTTCGGCGGAGTGTTTCGAGTTTTT (SEQ ID NO:8155) |
| Target862 | chr8:20375713-20375784 | GATTTTTCGGAATAGAAGCGATGTTGAAATGCG (SEQ ID NO:8156), AGATTTTTCGGAATAGAAGCGATGTTGAAATGCG (SEQ ID NO:8157), AAGATTTTTCGGAATAGAAGCGATGTTGAAATGCG (SEQ ID NO:8158), AAAGATTTTTCGGAATAGAAGCGATGTTGAAATGCG (SEQ ID NO:8159), TGGGGATTTAGATTATGAATAGACGGAAGAGGAAGA (SEQ ID NO:8160) |
| Target863 | chr8:22438004-22438261 | TGGGGGGGAAGTGAAATCGGGTTGAGGG (SEQ ID NO:8161), GGGTGGGGGGGAAGTGAAATCGGGTTGA (SEQ ID NO:8162), AGGGTGGGGGGGAAGTGAAATCGGGTTG (SEQ ID NO:8163), GGGGGGAAGTGAAATCGGGTTGAGGGA (SEQ ID NO:8164), GGATGTGGTCGGGTTAGCGTTTTGGGG (SEQ ID NO:8165), CGGAAGTTTTAGGGCGTTGGTTCGGTT (SEQ ID NO:8166), CGGAAGTTTTAGGGCGTTGGTTCGGT (SEQ ID NO:8167), TGTGTAGAGTGGGGTGAATAGGGTCGA (SEQ ID NO:8168), CGGAAGTTTTAGGGCGTTGGTTCGGTTA (SEQ ID NO:8169), TTGTGTAGAGTGGGGTGAATAGGGTCGA (SEQ ID NO:8170) |
| Target864 | chr8:22875782-22875898 | AGAAGGAAGTAGGAATGAGTGTACGGCG (SEQ ID NO:8171), GAAGGAAGTAGGAATGAGTGTACGGCGA (SEQ ID NO:8172), GGAGAAGGAAGTAGGAATGAGTGTACGGCG (SEQ ID NO:8173), AGAAGGAAGTAGGAATGAGTGTACGGCGA (SEQ ID NO:8174), TGGAGAAGGAAGTAGGAATGAGTGTACGGCG (SEQ ID NO:8175), GGGGGAGGGTTTTGAGGAGTACGGGGTC (SEQ ID NO:8176), AGGGGAGGGTTTTGAGGAGTACGGGGT (SEQ ID NO:8177), TAGGGGAGGGTTTTGAGGAGTACGGGGT (SEQ ID NO:8178), TAGGGGAGGGTTTTGAGGAGTACGGGG (SEQ ID NO:8179), AGGGGAGGGTTTTGAGGAGTACGGGGTC (SEQ ID NO:8180) |
| Target865 | chr8:22876026-22876179 | GAGGGTTGGTGATTGAGGGGTTCGGGT (SEQ ID NO:8181), TGATTGAGGGGTTCGGGTTGGCGGTAA (SEQ ID NO:8182), TGAGGGGTTCGGGTTGGCGGTAAAGAG (SEQ ID NO:8183), TTGAGGGGTTCGGGTTGGCGGTAAAGA (SEQ ID NO:8184), GTTGGTGATTGAGGGGTTCGGGTTGGC (SEQ ID NO:8185), CGGAGTTAGTTGGTAGGGTTAGGGTTTTCG (SEQ ID NO:8186), TCGGAGTTAGTTGGTAGGGTTAGGGTTTTCG (SEQ ID NO:8187), |

FIGURE 5 CONTINUED

TGTGTTGTTTTCGGAGTTAGTTGGTAGGGT (SEQ ID NO:8188),
TGTTTTCGGAGTTAGTTGGTAGGGTTAGGGT (SEQ ID NO:8189),
GTTTTCGGAGTTAGTTGGTAGGGTTAGGGT (SEQ ID NO:8190)

Target866  chr8:23563902-23563929  GCGGCGGCGGTGATAGAAAGTTGGATG (SEQ ID NO:8191), CGGCGGCGGTGATAGAAAGTTGGATGG (SEQ ID NO:8192), AGAGGTTTATAACGTTGGTGGCGGCGG (SEQ ID NO:8193), GGCGGCGGTGATAGAAAGTTGGATGGT (SEQ ID NO:8194), GCGGCGGCGGTGATAGAAAGTTGGAT (SEQ ID NO:8195)

Target867  chr8:23563960-23564121  GAAGGGGGTGGAGGTGACGGGGTTTAG (SEQ ID NO:8196), AGGGGGTGGAGGTGACGGGGTTTAGTA (SEQ ID NO:8197), GGGGGTGGAGGTGACGGGGTTTAGTAG (SEQ ID NO:8198), AGAAGGGGGTGGAGGTGACGGGGTTTA (SEQ ID NO:8199), TTGATCGAGAAGGGGGTGGAGGTGACG (SEQ ID NO:8200), TGCGGGGTTTGTAGCGATAAGACGGGA (SEQ ID NO:8201), TGGGTTTGTTTGCGGGGTTTGTAGCGA (SEQ ID NO:8202), TTGCGGGGTTTGTAGCGATAAGACGGG (SEQ ID NO:8203), TGCGGGGTTTGTAGCGATAAGACGGGAA (SEQ ID NO:8204), TTGCGGGGTTTGTAGCGATAAGACGGGA (SEQ ID NO:8205)

Target868  chr8:23564145-23564241  GAAGGGGGTGGAGGTGACGGGGTTTAG (SEQ ID NO:8206), AGGGGGTGGAGGTGACGGGGTTTAGTA (SEQ ID NO:8207), GGGGGTGGAGGTGACGGGGTTTAGTAG (SEQ ID NO:8208), AGAAGGGGGTGGAGGTGACGGGGTTTA (SEQ ID NO:8209), TTGATCGAGAAGGGGGTGGAGGTGACG (SEQ ID NO:8210), GGGAAGAAAGCGTTGGGGGAGGAAGGT (SEQ ID NO:8211), TGCGGGGTTTGTAGCGATAAGACGGGA (SEQ ID NO:8212), TGGGTTTGTTTGCGGGGTTTGTAGCGA (SEQ ID NO:8213), GGAAGAAAGCGTTGGGGGAGGAAGGTG (SEQ ID NO:8214), CGGGAAGAAAGCGTTGGGGGAGGAAGG (SEQ ID NO:8215)

Target869  chr8:23564354-23564375  TGGTAGGTTCGGGTTTAGGGTCGGGTG (SEQ ID NO:8216), GGTAGGTTCGGGTTTAGGGTCGGGTGA (SEQ ID NO:8217), TTGGTAGGTTCGGGTTTAGGGTCGGGT (SEQ ID NO:8218), TGGTAGGTTCGGGTTTAGGGTCGGGTGA (SEQ ID NO:8219), GTTGGTAGGTTCGGGTTTAGGGTCGGGT (SEQ ID NO:8220), TTGGGGATTGGAGAGGATTCGACGGGC (SEQ ID NO:8221), ATTGGGGATTGGAGAGGATTCGACGGGC (SEQ ID NO:8222), AGGAAGGCGATTGGGGATTGGAGAGGA (SEQ ID NO:8223), TGGGGATTGGAGAGGATTCGACGGGC (SEQ ID NO:8224), AGGCGATTGGGGATTGGAGAGGATTCG (SEQ ID NO:8225)

Target870  chr8:23564418-23564470  CGTGGAGAGATAGTGTTGCGCGCG (SEQ ID NO:8226), AAGAAAACGTGGAGAGATAGTGTTGCGC (SEQ ID NO:8227), AAAGAAAACGTGGAGAGATAGTGTTGCGC (SEQ ID NO:8228), GTGGAGAGATAGTGTTGCGCGCG (SEQ ID NO:8229), CGTGGAGAGATAGTGTTGCGCGC (SEQ ID NO:8230), ACGGAGATTTAAGTCGCGCGTAGTATTGT (SEQ ID NO:8231), ACGGAGATTTAAGTCGCGCGTAGTATTGTT (SEQ ID NO:8232), ACGGAGATTTAAGTCGCGCGTAGTATTGTTT (SEQ ID NO:8233), CGGAGATTTAAGTCGCGCGTAGTATTGTTT (SEQ ID NO:8234), ACGGAGATTTAAGTCGCGCGTAGTATTGTTT (SEQ ID NO:8235)

Target871  chr8:25907747-25907758  AGTCGGTAGGGGAAAGTTCGAGGGATT (SEQ ID NO:8236), TTAGTCGGTAGGGGAAAGTTCGAGGGA (SEQ ID NO:8237), TAGTCGGTAGGGGAAAGTTCGAGGGAT (SEQ ID NO:8238), GTTAGTCGGTAGGGGAAAGTTCGAGGG (SEQ ID NO:8239), GTCGGTAGGGGAAAGTTCGAGGGATTT (SEQ ID NO:8240), AGTGTACGTGTGAAATGTGGCGGCGT (SEQ ID NO:8241), TAGTGTACGTGTGAAATGTGGCGGCGT (SEQ ID NO:8242), AGTGTACGTGTGAAATGTGGCGGCGT (SEQ ID NO:8243), TAGTGTACGTGTGAAATGTGGCGGCGTC (SEQ ID NO:8244), TTAGTGTACGTGTGAAATGTGGCGGCGT (SEQ ID NO:8245)

Target872  chr8:25907796-25907867  GGCGGAGGTGTGAGCGATGTGTTGATT (SEQ ID NO:8246), TTTTTTCGGATCGCGGCGGAGGTGTGA (SEQ ID NO:8247), CGGCGGAGGTGTGAGCGATGTGTTGAT (SEQ ID NO:8248), TTTTTTCGGATCGCGGCGGAGGTGTG (SEQ ID NO:8249), TTTTTCGGATCGCGGCGGAGGTGTGAG (SEQ ID NO:8250), GAAAAGGTAGTCGGGTTGGGGGTGGGT (SEQ ID NO:8251), GGGGTGGGTAGGTAGTAGTGAGCGGGA (SEQ ID NO:8252), AGGAAAAGGTAGTCGGGTTGGGGGTGG (SEQ ID NO:8253), AGTGTACGTGTGAAATGTGGCGGCGTC (SEQ ID NO:8254), TGGGGGTGGGTAGGTAGTAGTGAGCGG (SEQ ID NO:8255)

Target873  chr8:25907880-25907894  GCGGAGGTGTGAGCGATGTGTTGATTA (SEQ ID NO:8256), GCGGAGGTGTGAGCGATGTGTTGATT (SEQ ID NO:8257), GCGGAGGTGTGAGCGATGTGTTGATTAT (SEQ ID NO:8258), GCGGAGGTGTGAGCGATGTGTTGAT (SEQ ID NO:8259), GCGGAGGTGTGAGCGATGTGTTGATTATT (SEQ ID NO:8260), GAAAAGGTAGTCGGGTTGGGGGTGGGT (SEQ ID NO:8261), GGGGTGGGTAGGTAGTAGTGAGCGGGA (SEQ ID NO:8262), AGGAAAAGGTAGTCGGGTTGGGGGTGG (SEQ ID NO:8263), TGGGGGTGGGTAGGTAGTAGTGAGCGG (SEQ ID NO:8264), GGTAGTCGGGTTGGGGGTGGGTAGGTA (SEQ ID NO:8265)

Target874  chr8:25907900-25907907  GAAAAGGTAGTCGGGTTGGGGGTGGGT (SEQ ID NO:8266), GGGGTGGGTAGGTAGTAGTGAGCGGGA (SEQ ID NO:8267), AGGAAAAGGTAGTCGGGTTGGGGGTGG (SEQ ID NO:8268), TGGGGGTGGGTAGGTAGTAGTGAGCGG (SEQ ID NO:8269), GGTAGTCGGGTTGGGGGTGGGTAGGTA (SEQ ID NO:8270)

Target875  chr8:25908055-25908102  TTTGAGGATGGGGGAGATTTTGGCGGC (SEQ ID NO:8271), TTGAGGATGGGGGAGATTTTGGCGGCG (SEQ ID NO:8272), ATTTGAGGATGGGGGAGATTTTGGCGGC (SEQ ID NO:8273), TTGAGGATGGGGGAGATTTTGGCGGC (SEQ ID NO:8274), TGAGGATGGGGGAGATTTTGGCGGCG (SEQ ID NO:8275), TGCGTGTGTGTGTTGGAGGAGGAGGTT (SEQ ID NO:8276), AGTGCGTGTGTGTGTTGGAGGAGGAGG (SEQ ID NO:8277), AGGTGGAGGTGATCGTGATGGTGTGCG

FIGURE 5 CONTINUED (SEQ ID NO:8278), CGAGTGCGTGTGTGTGTTGGAGGAGGA (SEQ ID NO:8279),
GTGCGTGTGTGTGTTGGAGGAGGAGGT (SEQ ID NO:8280)

| | | |
|---|---|---|
| Target876 | chr8:38757667-38758053 | TGCGGCGTGGATTAAATGAGATAGCGT (SEQ ID NO:8281), GGTTGCGGCGTGGATTAAATGAGATAGCG (SEQ ID NO:8282), TTGCGGCGTGGATTAAATGAGATAGCGT (SEQ ID NO:8283), GGTTGCGGCGTGGATTAAATGAGATAGCG (SEQ ID NO:8284), TTGCGGCGTGGATTAAATGAGATAGCG (SEQ ID NO:8285), AAATGTAGAAGATTCGCGCGGGTTTGC (SEQ ID NO:8286), CGTTGGGATTTTTTCGGTGTGATGCGA (SEQ ID NO:8287), TCGTTGGGATTTTTTCGGTGTGATGCG (SEQ ID NO:8288), GGAATTAAGAGAGTTGTTGTGCGCGGGT (SEQ ID NO:8289), TCGTTGGGATTTTTTCGGTGTGATGCGA (SEQ ID NO:8290) |
| Target877 | chr8:38758076-38758134 | GGGTACGGTGTAGGCGTTTGTGGTTTT (SEQ ID NO:8291), ATTCGGGAGGTTGGGGTAGAAGGATCG (SEQ ID NO:8292), GGGTACGGTGTAGGCGTTTGTGGTTT (SEQ ID NO:8293), TTCGGGAGGTTGGGGTAGAAGGATCG (SEQ ID NO:8294), GGGTACGGTGTAGGCGTTTGTGGTTTTA (SEQ ID NO:8295), TTTGTCGTTTAGGTTGGAGTGCGGTGG (SEQ ID NO:8296), GGTTTTGTCGTTTAGGTTGGAGTGCGGT (SEQ ID NO:8297), TGGTTTTGTCGTTTAGGTTGGAGTGCGG (SEQ ID NO:8298), TTTTGTCGTTTAGGTTGGAGTGCGGTGG (SEQ ID NO:8299), TGGTTTTGTCGTTTAGGTTGGAGTGCGG (SEQ ID NO:8300) |
| Target878 | chr8:55370650-55371091 | GCGGTGATGGTCGGGTTGGGTTTTTGT (SEQ ID NO:8301), GGGAGCGGGGTAGGTTTGGAGCGTTAT (SEQ ID NO:8302), GGGATATGAAGGTGAAGGGCGAGGCGT (SEQ ID NO:8303), GTTGAGGGGAGCGGGGTAGGTTTGGAG (SEQ ID NO:8304), GCGATAGGTTAGAATACGGGCGGCGGT (SEQ ID NO:8305), AGCGCGTTTTGGGTTTGGTTTTGGTCG (SEQ ID NO:8306), AAAGTTGTTTTGGAGGGTCGGAGGGCG (SEQ ID NO:8307), AGGCGGAAAGTTGTTTTGGAGGGTCGG (SEQ ID NO:8308), GGCGGAAAGTTGTTTTGGAGGGTCGGA (SEQ ID NO:8309), AAGTTGTTTTGGAGGGTCGGAGGGCGG (SEQ ID NO:8310) |
| Target879 | chr8:55371122-55371160 | TGACGTTTAAAATTAGGGGTGTGTAGCGGT (SEQ ID NO:8311), TGACGTTTAAAATTAGGGGTGTGTAGCGGTT (SEQ ID NO:8312), TTGACGTTTAAAATTAGGGGTGTGTAGCGGT (SEQ ID NO:8313), GCGAGTTTGACGTTTAAAATTAGGGGTGTGT (SEQ ID NO:8314), TGCGAGTTTGACGTTTAAAATTAGGGGTGTG (SEQ ID NO:8315), GTCGTTCGGAGGTGTCGGGAAGTCGTT (SEQ ID NO:8316), TCGTTCGGAGGTGTCGGGAAGTCGTTT (SEQ ID NO:8317), AAAGTTGTTTTGGAGGGTCGGAGGGCG (SEQ ID NO:8318), AGGCGGAAAGTTGTTTTGGAGGGTCGG (SEQ ID NO:8319), GGCGGAAAGTTGTTTTGGAGGGTCGGA (SEQ ID NO:8320) |
| Target880 | chr8:55371173-55371214 | TGACGTTTAAAATTAGGGGTGTGTAGCGGT (SEQ ID NO:8321), TGACGTTTAAAATTAGGGGTGTGTAGCGGTT (SEQ ID NO:8322), TTGACGTTTAAAATTAGGGGTGTGTAGCGGT (SEQ ID NO:8323), GCGAGTTTGACGTTTAAAATTAGGGGTGTGT (SEQ ID NO:8324), TGCGAGTTTGACGTTTAAAATTAGGGGTGTG (SEQ ID NO:8325), GTCGTTCGGAGGTGTCGGGAAGTCGTT (SEQ ID NO:8326), TCGTTCGGAGGTGTCGGGAAGTCGTTT (SEQ ID NO:8327), CGTTCGGAGGTGTCGGGAAGTCGTTTT (SEQ ID NO:8328), GTCGTTCGGAGGTGTCGGGAAGTCGT (SEQ ID NO:8329), TCGTTCGGAGGTGTCGGGAAGTCGTTTT (SEQ ID NO:8330) |
| Target881 | chr8:55379448-55379488 | CGTTGTCGGGTAGGGATCGGGCGA (SEQ ID NO:8331), CGTTGTCGGGTAGGGATCGGGCG (SEQ ID NO:8332), GCGTTAAGGTTTCGGAAGTTTTTAGCGGG (SEQ ID NO:8333), GCGTTAAGGTTTCGGAAGTTTTTAGCGGGA (SEQ ID NO:8334), AGGGAAGAGGGAGGGGATTTGTGTTTTTGT (SEQ ID NO:8335) |
| Target882 | chr8:55379496-55379518 | TTTTTCGTCGTTGAGGTGGAGTTCGGC (SEQ ID NO:8336), GTTTTTCGTCGTTGAGGTGGAGTTCGGC (SEQ ID NO:8337), AGTTTTTCGTCGTTGAGGTGGAGTTCGGC (SEQ ID NO:8338), TTTTCGTCGTTGAGGTGGAGTTCGGC (SEQ ID NO:8339), CGTTGTCGGGTAGGGATCGGGCGA (SEQ ID NO:8340), TCGGGTTAGTTTTAGTTTACGGCGTGGT (SEQ ID NO:8341), TCGGGTTAGTTTTAGTTTACGGCGTGGTT (SEQ ID NO:8342), TTCGGGTTAGTTTTAGTTTACGGCGTGGT (SEQ ID NO:8343), TTCGGGTTAGTTTTAGTTTACGGCGTGGTT (SEQ ID NO:8344), TTTCGGGTTAGTTTTAGTTTACGGCGTGGT (SEQ ID NO:8345) |
| Target883 | chr8:55379566-55379574 | TGGAGTTCGGCGGCGGGAGTTTAGATT (SEQ ID NO:8346), GTGGAGTTCGGCGGCGGGAGTTTAGAT (SEQ ID NO:8347), GGAGTTCGGCGGCGGGAGTTTAGATTT (SEQ ID NO:8348), TGGAGTTCGGCGGCGGGAGTTTAGATTT (SEQ ID NO:8349), TGGAGTTCGGCGGCGGGAGTTTAGAT (SEQ ID NO:8350), AGATGTTTCGACGGTTGCGCGGGTTTT (SEQ ID NO:8351), GAGATGTTTCGACGGTTGCGCGGGTTT (SEQ ID NO:8352), GATGTTTCGACGGTTGCGCGGGTTTTC (SEQ ID NO:8353), ATGTTTCGACGGTTGCGCGGGTTTTCG (SEQ ID NO:8354), GAGATGTTTCGACGGTTGCGCGGGTT (SEQ ID NO:8355) |
| Target884 | chr8:55379583-55379839 | TGGAGTTCGGCGGCGGGAGTTTAGATT (SEQ ID NO:8356), CGTCGTGGGTTGGGATTGGTTCGGAAC (SEQ ID NO:8357), ACGTCGTGGGTTGGGATTGGTTCGGAA (SEQ ID NO:8358), CGGGGTAGGTTTGGAGCGTCGTGAGTA (SEQ ID NO:8359), TACGTCGTGGGTTGGGATTGGTTCGGA (SEQ ID NO:8360), AGATGTTTCGACGGTTGCGCGGGTTTT (SEQ ID NO:8361), GAGATGTTTCGACGGTTGCGCGGGTTT (SEQ ID NO:8362), GACGCGGAGGAAAAGAAGGTGGTGAGC |

FIGURE 5 CONTINUED (SEQ ID NO:8363), CGGACGCGGAGGAAAAGAAGGTGGTGA (SEQ ID NO:8364), TCGGACGCGGAGGAAAAGAAGGTGGTG (SEQ ID NO:8365)

| Target885 | chr8:55382674-55382690 | GAGGTGGGCGTAGGAGGAGGAGTTGTT (SEQ ID NO:8366), CGAGGTGGGCGTAGGAGGAGGAGTTGT (SEQ ID NO:8367), AGGTGGGCGTAGGAGGAGGAGTTGTTT (SEQ ID NO:8368), CGAGGTGGGCGTAGGAGGAGGAGTTG (SEQ ID NO:8369), GAGGTGGGCGTAGGAGGAGGAGTTGTTT (SEQ ID NO:8370), TTTGCGCGGGGAAGGGTAGGTTTAGGT (SEQ ID NO:8371), CGCGGGGAAGGGTAGGTTTAGGTCGTT (SEQ ID NO:8372), GGAAAGTTTTGCGCGGGGAAGGGTAGG (SEQ ID NO:8373), GGGAAAGTTTTGCGCGGGGAAGGGTAG (SEQ ID NO:8374), TTGCGCGGGGAAGGGTAGGTTTAGGTC (SEQ ID NO:8375) |

| Target886 | chr8:55382691-55382762 | GAGGTGGGCGTAGGAGGAGGAGTTGTT (SEQ ID NO:8376), CGAGGTGGGCGTAGGAGGAGGAGTTGT (SEQ ID NO:8377), AGGTGGGCGTAGGAGGAGGAGTTGTTT (SEQ ID NO:8378), CGAGGTGGGCGTAGGAGGAGGAGTTG (SEQ ID NO:8379), GAGGTGGGCGTAGGAGGAGGAGTTGTTT (SEQ ID NO:8380), TAGGGCGTGGGTAGTGGTGGTAGTGGA (SEQ ID NO:8381), TTTGCGCGGGGAAGGGTAGGTTTAGGT (SEQ ID NO:8382), CGCGGGGAAGGGTAGGTTTAGGTCGTT (SEQ ID NO:8383), GGAAAGTTTTGCGCGGGGAAGGGTAGG (SEQ ID NO:8384), GGGAAAGTTTTGCGCGGGGAAGGGTAG (SEQ ID NO:8385) |

| Target887 | chr8:55382784-55382817 | GCGTAGTTTTGGGCGGTTTGGGTTTGT (SEQ ID NO:8386), GCGTAGTTTTGGGCGGTTTGGGTTTGTT (SEQ ID NO:8387), GCGGGGATTTTGCGGGATTAGGTTAGA (SEQ ID NO:8388), GCGTAGTTTTGGGCGGTTTGGGTTTGTTT (SEQ ID NO:8389), CGTAGTTTTGGGCGGTTTGGGTTTGTT (SEQ ID NO:8390), TAGGGCGTGGGTAGTGGTGGTAGTGGA (SEQ ID NO:8391), GTAGGGCGTGGGTAGTGGTGGTAGTGG (SEQ ID NO:8392), CGGGGTAGCGATCGGTAGGAGGGAAAG (SEQ ID NO:8393), TGGGTAGTGGTGGTAGTGGAGCGGGAG (SEQ ID NO:8394), GGGTAGTGGTGGTAGTGGAGCGGGAGT (SEQ ID NO:8395) |

| Target888 | chr8:55382870-55382887 | GCGTAGTTTTGGGCGGTTTGGGTTTGT (SEQ ID NO:8396), GCGTAGTTTTGGGCGGTTTGGGTTTGTT (SEQ ID NO:8397), GCGTAGTTTTGGGCGGTTTGGGTTTGTTT (SEQ ID NO:8398), CGTAGTTTTGGGCGGTTTGGGTTTGTT (SEQ ID NO:8399), GCGTAGTTTTGGGCGGTTTGGGTTTG (SEQ ID NO:8400), TAGGTTTAGCGATGAGGGGGTTGCGGG (SEQ ID NO:8401), TTGTTGGTGCGGGGTAGGTTTGGGGTA (SEQ ID NO:8402), TGTTGGTGCGGGGTAGGTTTGGGGTAG (SEQ ID NO:8403), TAGCGATGAGGGGGTTGCGGGTTTGTA (SEQ ID NO:8404), TTAGCGATGAGGGGGTTGCGGGTTTGT (SEQ ID NO:8405) |

| Target889 | chr8:55382910-55382918 | GTTTTCGTTTGATCGCGTGGAGTCGGA (SEQ ID NO:8406), TCGTTTGATCGCGTGGAGTCGGATTTC (SEQ ID NO:8407), TTCGTTTGATCGCGTGGAGTCGGATTT (SEQ ID NO:8408), TTTCGTTTGATCGCGTGGAGTCGGATT (SEQ ID NO:8409), TTTTCGTTTGATCGCGTGGAGTCGGAT (SEQ ID NO:8410), TAGGTTTAGCGATGAGGGGGTTGCGGG (SEQ ID NO:8411), TTGTTGGTGCGGGGTAGGTTTGGGGTA (SEQ ID NO:8412), TGTTGGTGCGGGGTAGGTTTGGGGTAG (SEQ ID NO:8413), TAGCGATGAGGGGGTTGCGGGTTTGTA (SEQ ID NO:8414), TTAGCGATGAGGGGGTTGCGGGTTTGT (SEQ ID NO:8415) |

| Target890 | chr8:55382987-55383035 | GTTTTCGTTTGATCGCGTGGAGTCGGA (SEQ ID NO:8416), TCGTTTGATCGCGTGGAGTCGGATTTC (SEQ ID NO:8417), TTCGTTTGATCGCGTGGAGTCGGATTT (SEQ ID NO:8418), TTTCGTTTGATCGCGTGGAGTCGGATT (SEQ ID NO:8419), TTTTCGTTTGATCGCGTGGAGTCGGAT (SEQ ID NO:8420), TTTCGTTGGTTGCGTGGGGTTAGCGTC (SEQ ID NO:8421), GTTGGTTGCGTGGGGTTAGCGTCGTTT (SEQ ID NO:8422), ATTTCGTTGGTTGCGTGGGGTTAGCGT (SEQ ID NO:8423), GGTTGCGTGGGGTTAGCGTCGTTTAGT (SEQ ID NO:8424), TGGTTGCGTGGGGTTAGCGTCGTTTAG (SEQ ID NO:8425) |

| Target891 | chr8:56901515-56901792 | GAGTTTGCGTTTCGGGTGGGAGAGAGT (SEQ ID NO:8426), GCGTTTCGGGTGGGAGAGAGTTTGTTGG (SEQ ID NO:8427), TGCGTTTCGGGTGGGAGAGAGTTTGTT (SEQ ID NO:8428), TTGCGTTTCGGGTGGGAGAGAGTTTGT (SEQ ID NO:8429), AGAGTTTGCGTTTCGGGTGGGAGAGAGT (SEQ ID NO:8430) |

| Target892 | chr8:67873476-67873541 | AGGTCGTTTTTTCGGTCGGTTTTTCGT (SEQ ID NO:8431), GAGGTCGTTTTTTCGGTCGGTTTTTCGT (SEQ ID NO:8432), AGGTCGTTTTTTCGGTCGGTTTTTCGTT (SEQ ID NO:8433), GAGGTCGTTTTTTCGGTCGGTTTTTCGT (SEQ ID NO:8434), AGGTCGTTTTTTCGGTCGGTTTTTCGTTT (SEQ ID NO:8435), TTTTCGGGTGAGGCGGGAAGTCGATCG (SEQ ID NO:8436), CGCGGGGTTGGGGTCGAGATTAGGATA (SEQ ID NO:8437), TCGCGGGGTTGGGGTCGAGATTAGGAT (SEQ ID NO:8438), TTTTTCGGGTGAGGCGGGAAGTCGATC (SEQ ID NO:8439), CGCGGGGTTGGGGTCGAGATTAGGAT (SEQ ID NO:8440) |

| Target893 | chr8:67873588-67873596 | TTGGTTTCGGTTTTAGTTTCGCGGTGC (SEQ ID NO:8441), TTTGGTTTCGGTTTTAGTTTCGCGGTGC (SEQ ID NO:8442), AGGTCGTTTTTTCGGTCGGTTTTTCGT (SEQ ID NO:8443), TGGTTTCGGTTTTAGTTTCGCGGTGC (SEQ ID NO:8444), GAGGTCGTTTTTTCGGTCGGTTTTTCGT (SEQ ID NO:8445), TGCGCGGCGATGGTTATTTGTATTCGGT (SEQ ID NO:8446), GCGCGGCGATGGTTATTTGTATTCGGT (SEQ ID NO:8447), TGCGCGGCGATGGTTATTTGTATTCGG (SEQ ID NO:8448), GCGCGGCGATGGTTATTTGTATTCGGTT (SEQ ID NO:8449), TTGCGCGGCGATGGTTATTTGTATTCGG (SEQ ID NO:8450) |

| Target894 | chr8:67873600-67874082 | GGCGTCGTTTTGTAGGTTGCGGGTGAG (SEQ ID NO:8451), AAAGGATCGAAGGTGCGGTGAGGTCGG (SEQ ID NO:8452), GTTGGCGTTGAGGGGGTTGTTCGTTGG (SEQ ID NO:8453), GGTGAGATGCGCGATGTAGGTGGTGG (SEQ ID NO:8454), GCGTCGTTTTGTAGGTTGCGGGTGAGA |

FIGURE 5 CONTINUED (SEQ ID NO:8455), CGTACGGGGAGAATTAGGGGGGTTGCGT (SEQ ID NO:8456),
TTTCGTTGGGTTGTTGGTGGGCGTACG (SEQ ID NO:8457), TTGGTGGGCGTACGGGGAGAATTAGGG
(SEQ ID NO:8458), GGGCGTACGGGGAGAATTAGGGGGGTTG (SEQ ID NO:8459),
GGTTGTTGGTGGGCGTACGGGGAGAAT (SEQ ID NO:8460)

Target895          chr8:70946939-70946971          AAGCGGTTCGGAGTTGTAGGAAGGGCG (SEQ ID NO:8461), GGTTCGGAGTTGTAGGAAGGGCGTCGG
(SEQ ID NO:8462), CGGTTCGGAGTTGTAGGAAGGGCGTCG (SEQ ID NO:8463),
GAAGCGGTTCGGAGTTGTAGGAAGGGC (SEQ ID NO:8464), GCGGTTCGGAGTTGTAGGAAGGGCGTC
(SEQ ID NO:8465), CGTAGTCGGGTATTTTTGCGGCGCG (SEQ ID NO:8466)

Target896          chr8:70947164-70947176          AGATTTAGAGGCGGGTTGGGGACGTGA (SEQ ID NO:8467), GATTTAGAGGCGGGTTGGGGACGTGAG
(SEQ ID NO:8468), AGATTTAGAGGCGGGTTGGGGACGTGAG (SEQ ID NO:8469),
GGGGCGGGGTTTGCGGTTTTTAGATTT (SEQ ID NO:8470), TAGATTTAGAGGCGGGTTGGGGACGTG
(SEQ ID NO:8471), GAGGGGACGTTTAAGGTTATCGCGGCG (SEQ ID NO:8472),
GGAGGGGACGTTTAAGGTTATCGCGGC (SEQ ID NO:8473), GGGGAGGGGACGTTTAAGGTTATCGCGG
(SEQ ID NO:8474), GGGGAGGGGACGTTTAAGGTTATCGCG (SEQ ID NO:8475),
CGGGGAGGGGACGTTTAAGGTTATCGC (SEQ ID NO:8476)

Target897          chr8:70981730-70981761          TCGTAGGGGGCGGTGGAATTAAAGTGT (SEQ ID NO:8477), CGTAGGGGGCGGTGGAATTAAAGTGTT
(SEQ ID NO:8478), TCGTAGGGGGCGGTGGAATTAAAGTGTT (SEQ ID NO:8479),
TTCGTAGGGGGCGGTGGAATTAAAGTGT (SEQ ID NO:8480), GGGGGCGGTGGAATTAAAGTGTTAGGT
(SEQ ID NO:8481), TGAGTTCGGGTTTGGGTTTATAGAGGGAGT (SEQ ID NO:8482),
TGTTGAGTTCGGGTTTGGGTTTATAGAGGG (SEQ ID NO:8483),
GTTGAGTTCGGGTTTGGGTTTATAGAGGGA (SEQ ID NO:8484),
TGTTGAGTTCGGGTTTGGGTTTATAGAGGGA (SEQ ID NO:8485),
TGAGTTCGGGTTTGGGTTTATAGAGGGAGTT (SEQ ID NO:8486)

Target898          chr8:70981881-70981917          GAAGGGGGGTATGGCGGGGGGTAGTAGA (SEQ ID NO:8487), AAGGGGGGTATGGCGGGGGGTAGTAGAC
(SEQ ID NO:8488), TATTCGGAAGGGGAAGGGGGGTATGGC (SEQ ID NO:8489),
GGAAGGGGGGTATGGCGGGGGGTAGTAG (SEQ ID NO:8490), AAGGGGGGTATGGCGGGGGGTAGTAGA
(SEQ ID NO:8491), TGGAGGTCGTAGCGTTTGTTGTTTTCGT (SEQ ID NO:8492),
GGAGGTCGTAGCGTTTGTTGTTTTCGT (SEQ ID NO:8493), TGGAGGTCGTAGCGTTTGTTGTTTTCG (SEQ
ID NO:8494), GGTAGTTGGAGGTCGTAGCGTTTGTTGT (SEQ ID NO:8495),
TGGAGGTCGTAGCGTTTGTTGTTTTCGTT (SEQ ID NO:8496)

Target899          chr8:70982012-70982028          GGGGTATGGCGGGGGTAGTAGACGTTG (SEQ ID NO:8497), GAAGGGGGGTATGGCGGGGGTAGTAGA
(SEQ ID NO:8498), GGGTATGGCGGGGGTAGTAGACGTTGC (SEQ ID NO:8499),
GTATGGCGGGGGTAGTAGACGTTGCGG (SEQ ID NO:8500), GGTATGGCGGGGGTAGTAGACGTTGCG
(SEQ ID NO:8501), CGGGATGGTTTTATTTCGGTTAAGTGAGGTCG (SEQ ID NO:8502),
CGGGATGGTTTTATTTCGGTTAAGTGAGGTCGT (SEQ ID NO:8503),
TCGGGATGGTTTTATTTCGGTTAAGTGAGGT (SEQ ID NO:8504),
TCGGGATGGTTTTATTTCGGTTAAGTGAGGTCG (SEQ ID NO:8505),
CGGTTTCGGGATGGTTTTATTTCGGTTAAGT (SEQ ID NO:8506)

Target900          chr8:70982082-70982109          TTTGCGGGTTGTTTTTCGGCGGGTAGT (SEQ ID NO:8507), AGGTTTTGCGGGTTGTTTTTCGGCGGG (SEQ
ID NO:8508), TTGCGGGTTGTTTTTCGGCGGGTAGTA (SEQ ID NO:8509),
GGTTTTGCGGGTTGTTTTTCGGCGGGT (SEQ ID NO:8510), GTTTTGCGGGTTGTTTTTCGGCGGGTA (SEQ
ID NO:8511), GGATTTGGGGTTGGTTGGGGTGGAGGA (SEQ ID NO:8512),
ATTTGGGGTTGGTTGGGGTGGAGGAGG (SEQ ID NO:8513), TGGATTTGGGGTTGGTTGGGGTGGAGG
(SEQ ID NO:8514), GTTGGTTGGGGTGGAGGAGGTTGGTGG (SEQ ID NO:8515),
GGTTGGTTGGGGTGGAGGAGGTTGGTG (SEQ ID NO:8516)

Target901          chr8:70982112-70982155          TTTGCGGGTTGTTTTTCGGCGGGTAGT (SEQ ID NO:8517), AGGTTTTGCGGGTTGTTTTTCGGCGGG (SEQ
ID NO:8518), TTGCGGGTTGTTTTTCGGCGGGTAGTA (SEQ ID NO:8519),
GGTTTTGCGGGTTGTTTTTCGGCGGGT (SEQ ID NO:8520), GTTTTGCGGGTTGTTTTTCGGCGGGTA (SEQ
ID NO:8521), GGATTTGGGGTTGGTTGGGGTGGAGGA (SEQ ID NO:8522),
ATTTGGGGTTGGTTGGGGTGGAGGAGG (SEQ ID NO:8523), TGGATTTGGGGTTGGTTGGGGTGGAGG
(SEQ ID NO:8524), GTTGGTTGGGGTGGAGGAGGTTGGTGG (SEQ ID NO:8525),
GGTTGGTTGGGGTGGAGGAGGTTGGTG (SEQ ID NO:8526)

Target902          chr8:70984131-70984156          CGGGTGGTCGTTTTGTTTTTTCGGGGG (SEQ ID NO:8527), CGGGTGGTCGTTTTGTTTTTTCGGGGGT (SEQ
ID NO:8528), TCGGGTGGTCGTTTTGTTTTTTCGGGGG (SEQ ID NO:8529),
GGGTGGTCGTTTTGTTTTTTCGGGGGT (SEQ ID NO:8530), TCGGGTGGTCGTTTTGTTTTTTCGGGG (SEQ
ID NO:8531), ATGCGGTTTTTGGGCGTTCGGTATGGG (SEQ ID NO:8532),
GCGGTTTTTGGGCGTTCGGTATGGGTT (SEQ ID NO:8533), TGCGGTTTTTGGGCGTTCGGTATGGG (SEQ
ID NO:8534), GCGGTTTTTGGGCGTTCGGTATGGGT (SEQ ID NO:8535),
TGCGGTTTTTGGGCGTTCGGTATGGGT (SEQ ID NO:8536)

Target903          chr8:70984158-70984365          AGAAAGAAGCGTCGAGGGTGGGGGAAA (SEQ ID NO:8537), GAAGCGTCGAGGGTGGGGGAAACGTAG
(SEQ ID NO:8538), GAAAGAAGCGTCGAGGGTGGGGGAAAC (SEQ ID NO:8539),
AAAGAAGCGTCGAGGGTGGGGGAAACG (SEQ ID NO:8540), TAGAAAGAAGCGTCGAGGGTGGGGGAA
(SEQ ID NO:8541), ATGCGGTTTTTGGGCGTTCGGTATGGG (SEQ ID NO:8542),
GGTCGGGGGTAGGCGAGGAATTTGTT (SEQ ID NO:8543), GCGGTTTTTGGGCGTTCGGTATGGGTT
(SEQ ID NO:8544), AAGAGGAAGTAGCGGTCGGGGGGTAGG (SEQ ID NO:8545),
TCGTTGTTAGGTCGGGGGGTGAGGTTGT (SEQ ID NO:8546)

FIGURE 5 CONTINUED

| Target904 | chr8:70984378-70984394 | AGAAAGAAGCGTCGAGGGTGGGGGAAA (SEQ ID NO:8547), GAAGCGTCGAGGGTGGGGGAAACGTAG (SEQ ID NO:8548), GAAAGAAGCGTCGAGGGTGGGGGAAAC (SEQ ID NO:8549), AAAGAAGCGTCGAGGGTGGGGGAAACG (SEQ ID NO:8550), TAGAAAGAAGCGTCGAGGGTGGGGGAA (SEQ ID NO:8551), AAGAGGAAGTAGCGGTCGGGGGGTAGG (SEQ ID NO:8552), TCGTTGTTAGGTCGGGGGTGAGGTTGT (SEQ ID NO:8553), GTTAAGAGGAAGTAGCGGTCGGGGGGT (SEQ ID NO:8554), AGTCGTTGTTAGGTCGGGGGTGAGGTT (SEQ ID NO:8555), AAGTCGTTGTTAGGTCGGGGGTGAGGT (SEQ ID NO:8556) |
|---|---|---|
| Target905 | chr8:70984421-70984445 | AGAAAGAAGCGTCGAGGGTGGGGGAAA (SEQ ID NO:8557), GAAGCGTCGAGGGTGGGGGAAACGTAG (SEQ ID NO:8558), GAAAGAAGCGTCGAGGGTGGGGGAAAC (SEQ ID NO:8559), AAAGAAGCGTCGAGGGTGGGGGAAACG (SEQ ID NO:8560), TAGAAAGAAGCGTCGAGGGTGGGGGAA (SEQ ID NO:8561), TCGTTGTTAGGTCGGGGGTGAGGTTGT (SEQ ID NO:8562), AGTCGTTGTTAGGTCGGGGGTGAGGTT (SEQ ID NO:8563), AAGTCGTTGTTAGGTCGGGGGTGAGGT (SEQ ID NO:8564), GTCGTTGTTAGGTCGGGGGTGAGGTTGT (SEQ ID NO:8565), GTCGTTGTTAGGTCGGGGGTGAGGTTG (SEQ ID NO:8566) |
| Target906 | chr8:70984535-70984567 | GCGGTTTGGAAGAGAGAGGGAAAGGAGG (SEQ ID NO:8567), AGCGGTTTGGAAGAGAGAGGGAAAGGA (SEQ ID NO:8568), AGCGGTTTGGAAGAGAGAGGGAAAGGAGG (SEQ ID NO:8569), GCGGTTTGGAAGAGAGAGGGAAAGGAGGA (SEQ ID NO:8570), TGGTAGCGGTTTGGAAGAGAGAGGGAA (SEQ ID NO:8571), GGTTGCGGGCGTTTTGAAGATTCGGGA (SEQ ID NO:8572), TCGGTTGCGGGCGTTTTGAAGATTCGG (SEQ ID NO:8573), GGAGTTTAGAAGTTCGGTTGCGGGCGT (SEQ ID NO:8574), CGGTTGCGGGCGTTTTGAAGATTCGGG (SEQ ID NO:8575), AGGAGTTTAGAAGTTCGGTTGCGGGCG (SEQ ID NO:8576) |
| Target907 | chr8:92606987-92607479 | GCGGTTGGATGTGAGGGCGATTTGGTT (SEQ ID NO:8577), GGTAGGCGGTTGGATGTGAGGGCGATT (SEQ ID NO:8578), ATTGGTAGGCGGTTGGATGTGAGGGCG (SEQ ID NO:8579), AATTGGTAGGCGGTTGGATGTGAGGGC (SEQ ID NO:8580), GTAGGCGGTTGGATGTGAGGGCGATTT (SEQ ID NO:8581), TGGAGTAGTGAGGTAGGAAGGGGATATTCGT (SEQ ID NO:8582), GGAGTAGTGAGGTAGGAAGGGGATATTCGT (SEQ ID NO:8583), TGGAGTAGTGAGGTAGGAAGGGGATATTCG (SEQ ID NO:8584), TGGTTGGTGAGGAAGTTGAAGGTTAAGGAA (SEQ ID NO:8585), ATGGTTGGTGAGGAAGTTGAAGGTTAAGGA (SEQ ID NO:8586) |
| Target908 | chr8:97171868-97171902 | CGTGTTGAGGTTTCGGAGTAGTCGGGA (SEQ ID NO:8587), TCGTGTTGAGGTTTCGGAGTAGTCGGG (SEQ ID NO:8588), TCGTGTTGAGGTTTCGGAGTAGTCGGGA (SEQ ID NO:8589), CGTGTTGAGGTTTCGGAGTAGTCGGGAG (SEQ ID NO:8590), CGTGTTGAGGTTTCGGAGTAGTCGGGAGT (SEQ ID NO:8591), GGGTGGGATGGTTAGTCGGGTTGGAGT (SEQ ID NO:8592), TGGGTGGGATGGTTAGTCGGGTTGGAG (SEQ ID NO:8593), TTGCGTTGGGTGGGATGGTTAGTCGGG (SEQ ID NO:8594), GCGTTGGGTGGGATGGTTAGTCGGGTT (SEQ ID NO:8595), TTGGGTGGGATGGTTAGTCGGGTTGGA (SEQ ID NO:8596) |
| Target909 | chr8:97171960-97172022 | GCGGCGTTAGGATTAGGGGGTTGTTCG (SEQ ID NO:8597), CGCGGCGTTAGGATTAGGGGGTTGTTC (SEQ ID NO:8598), TCGGAGGGCGTAGGGGTTTTAGTTCGGT (SEQ ID NO:8599), GCGCGGCGTTAGGATTAGGGGGTTGTT (SEQ ID NO:8600), GTCGGAGGGCGTAGGGGTTTTAGTTCGGT (SEQ ID NO:8601), TCGCGCGGGGTTTTTCGTTGGTTTTTGT (SEQ ID NO:8602), GTCGCGCGGGGTTTTTCGTTGGTTTTTG (SEQ ID NO:8603), GTCGCGCGGGGTTTTTCGTTGGTTTTTGT (SEQ ID NO:8604), CGGGTAGTTTTTTGGTTTTGGCGTCGCG (SEQ ID NO:8605), GGCGTCGGGTAGTTTTTTGGTTTTGGCG (SEQ ID NO:8606) |
| Target910 | chr8:97172128-97172151 | GTGGGATTTTTTAGTGTCGGTTTTGTTTAGGGT (SEQ ID NO:8607), TGTGGGATTTTTTAGTGTCGGTTTTGTTTAGGG (SEQ ID NO:8608), TGTGGGATTTTTTAGTGTCGGTTTTGTTTAGGGT (SEQ ID NO:8609), GTGGGATTTTTTAGTGTCGGTTTTGTTTAGGGTT (SEQ ID NO:8610), TTGTGGGATTTTTTAGTGTCGGTTTTGTTTAGGG (SEQ ID NO:8611), AGGCGGATGAATTCGGTTGGAGAGGGG (SEQ ID NO:8612), GTTGGAGAGGGGTCGGGATGGGGATTG (SEQ ID NO:8613), GGAGGACGGGAGGTAGTAGGCGGATGA (SEQ ID NO:8614), AATTCGGTTGGAGAGGGGTCGGGATGG (SEQ ID NO:8615), AGAGGGGTCGGGATGGGGATTGATGGA (SEQ ID NO:8616) |
| Target911 | chr8:99960237-99960958 | TAGTCGGGGGTTGGGAGGAGAGTTCGT (SEQ ID NO:8617), AGGTTAGTGCGGGGCGAGGTGAGTTTT (SEQ ID NO:8618), ATTTTCGAGGTTAGTGCGGGGCGAGGT (SEQ ID NO:8619), AGTTCGTGGATAGGAGGAGGGGGCGAT (SEQ ID NO:8620), GGTTGGGTTGGGTTGGGTGTTGTTCGG (SEQ ID NO:8621), TTAGGTTTTTAGGGGGTGGGGTGGGGG (SEQ ID NO:8622), CGGATGGTAAGTCGGCGTGTAAGAGCG (SEQ ID NO:8623), CGTTGTCGTCGCGTTTTGTGGTCGTTT (SEQ ID NO:8624), CGGATGGTAAGTCGGCGTGTAAGAGCGA (SEQ ID NO:8625), TCGGATGGTAAGTCGGCGTGTAAGAGCG (SEQ ID NO:8626) |
| Target912 | chr8:99960991-99961662 | CGGGTGGGGAGGGAGATTTAGGTGTGG (SEQ ID NO:8627), GTTTTCGGGGGGGTTTTGGAGTCGGGTG (SEQ ID NO:8628), GTTTTGGAGTCGGGTGGGGAGGGAGAT (SEQ ID NO:8629), TTTTCGGGGGGGTTTTGGAGTCGGGTGG (SEQ ID NO:8630), GGTTTTCGGGGGGGTTTTGGAGTCGGGT (SEQ ID NO:8631), AAAAGGTAGGGTCGGGAAGGGGAAGCG (SEQ ID NO:8632), TCGTGATGGTGGAGCGGGTGATTTCGT (SEQ ID NO:8633), CGTGATGGTGGAGCGGGTGATTTCGTG (SEQ ID NO:8634), ATTAGAGGTCGGAGGGCGTGGGGTTTC (SEQ ID NO:8635), GAATTAGAGGTCGGAGGGCGTGGGGTT (SEQ ID NO:8636) |

FIGURE 5 CONTINUED

Target913    chr8:99986368-99986430    TCGTTAGTGTTTTTAGGGGAGGTTGCGGA (SEQ ID NO:8637), TCGTTAGTGTTTTTAGGGGAGGTTGCGGAA (SEQ ID NO:8638), ATCGTTAGTGTTTTTAGGGGAGGTTGCGGA (SEQ ID NO:8639), AGGGGAGGTTGCGGAAAAGTAGAGGTAATG (SEQ ID NO:8640), GGGGAGGTTGCGGAAAAGTAGAGGTAATGA (SEQ ID NO:8641), GGGTTTGTGGGGGAGGGTCGAGTTGGAT (SEQ ID NO:8642), TTGGGTTTGTGGGGGAGGGTCGAGTTGG (SEQ ID NO:8643), GGTTTGTGGGGGAGGGTCGAGTTGGATG (SEQ ID NO:8644), GGGTTTGTGGGGGAGGGTCGAGTTGGA (SEQ ID NO:8645), GGTTTGTGGGGGAGGGTCGAGTTGGATGT (SEQ ID NO:8646)

Target914    chr8:99986453-99986707    GCGGGGTTGGGTTCGGTCGGTATAAGT (SEQ ID NO:8647), TCGGTGAGGCGTTCGGTATGGATTGGG (SEQ ID NO:8648), ATTCGAGACGGAGCGGGGGTTATACGG (SEQ ID NO:8649), CGGTGAGGCGTTCGGTATGGATTGGGT (SEQ ID NO:8650), GGAGCGGTTTTGGGCGATGGGTTTGAC (SEQ ID NO:8651), CGGAAGGCGGGAAAATGCGAGTGGTTT (SEQ ID NO:8652), CGGAAGGCGGGAAAATGCGAGTGGTT (SEQ ID NO:8653), CGGAAGGCGGGAAAATGCGAGTGGTTTT (SEQ ID NO:8654), TCGTAGGGTTTTTGGGTTGTTCGCGGA (SEQ ID NO:8655), GGAAGGCGGGAAAATGCGAGTGGTTTT (SEQ ID NO:8656)

Target915    chr8:99986725-99986813    ATTCGAGACGGAGCGGGGGTTATACGG (SEQ ID NO:8657), TTCGGGTGGGGGATAGGTCGTCGAGTT (SEQ ID NO:8658), TTTTCGGGTGGGGGATAGGTCGTCGAGT (SEQ ID NO:8659), TTTTCGGGTGGGGGATAGGTCGTCGAG (SEQ ID NO:8660), TCGGGTGGGGGATAGGTCGTCGAGTTC (SEQ ID NO:8661), CGGAAGGCGGGAAAATGCGAGTGGTTT (SEQ ID NO:8662), GCGTAGGGAAGGGCGGATTTTCGGGAT (SEQ ID NO:8663), CGGAAGGCGGGAAAATGCGAGTGGTT (SEQ ID NO:8664), CGGAAGGCGGGAAAATGCGAGTGGTTTT (SEQ ID NO:8665), TCGTAGGGTTTTTGGGTTGTTCGCGGA (SEQ ID NO:8666)

Target916    chr8:99986839-99987001    TTTTGCGGGAGGAGGAGAGGGTTTCGG (SEQ ID NO:8667), GGGTTTTGCGGGAGGAGGAGAGGGTTT (SEQ ID NO:8668), TTCGGGTGGGGGATAGGTCGTCGAGTT (SEQ ID NO:8669), TTTCGGGTGGGGGATAGGTCGTCGAGT (SEQ ID NO:8670), TTTTCGGGTGGGGGATAGGTCGTCGAG (SEQ ID NO:8671), TAATAGGGGAGGGAGGCGGTGGAGGAG (SEQ ID NO:8672), TTAATAGGGGAGGGAGGCGGTGGAGGA (SEQ ID NO:8673), GGGAGGGAGGCGGTGGAGGAGATTTTA (SEQ ID NO:8674), TTTAATAGGGGAGGGAGGCGGTGGAGG (SEQ ID NO:8675), TTAATAGGGGAGGGAGGCGGTGGAGGAG (SEQ ID NO:8676)

Target917    chr8:102504296-102504696    TCGGAGAAGGGTTTTATTTGAGCGCGT (SEQ ID NO:8677), CGGAGAAGGGGTTTTATTTGAGCGCGTT (SEQ ID NO:8678), TCGGAGAAGGGGTTTTATTTGAGCGCGTT (SEQ ID NO:8679), CGGAGAAGGGGTTTTATTTGAGCGCGT (SEQ ID NO:8680), TCGGAGAAGGGGTTTTATTTGAGCGCG (SEQ ID NO:8681), CGAGTTGCGCGATGATTGGTTGGGGAG (SEQ ID NO:8682), AGGGATTGTGGGTCGAGCGGAAGAGTT (SEQ ID NO:8683), GAGTTGCGCGATGATTGGTTGGGGAGT (SEQ ID NO:8684), AGTTGCGCGATGATTGGTTGGGGAGTT (SEQ ID NO:8685), GAGTAGAAAGTGGCGGATTTGGGCGGT (SEQ ID NO:8686)

Target918    chr8:104384375-104384474    GGTGGGAGGGATAGGGCGGTAGTGAGA (SEQ ID NO:8687), TTTTGGGAAGGGTGGGAGGGATAGGGC (SEQ ID NO:8688), GAAGGGTGGGAGGGATAGGGCGGTAGT (SEQ ID NO:8689), TGGGAGGGATAGGGCGGTAGTGAGAGT (SEQ ID NO:8690), AAGGGTGGGAGGGATAGGGCGGTAGTG (SEQ ID NO:8691), AGAGTTGGACGGATGTTTTGTGGGGGT (SEQ ID NO:8692), GTTGGACGGATGTTTTGTGGGGGTTGT (SEQ ID NO:8693), AGTTGGACGGATGTTTTGTGGGGGTTGT (SEQ ID NO:8694), AGTTGGACGGATGTTTTGTGGGGGTTG (SEQ ID NO:8695), GAGTTGGACGGATGTTTTGTGGGGGTT (SEQ ID NO:8696)

Target919    chr8:104384518-104384585    GGATTTGGGTTTGGGTTAGGGCGGTGT (SEQ ID NO:8697), TGGATTTGGGTTTGGGTTAGGGCGGTG (SEQ ID NO:8698), TGGATTTGGGTTTGGGTTAGGGCGGTGT (SEQ ID NO:8699), ATGGATTTGGGTTTGGGTTAGGGCGGT (SEQ ID NO:8700), TGGGGTTGGTGGTTACGTTTGTTTGCG (SEQ ID NO:8701), AGAGTTGGACGGATGTTTTGTGGGGGT (SEQ ID NO:8702), GTTGGACGGATGTTTTGTGGGGGTTGT (SEQ ID NO:8703), AGTTGGACGGATGTTTTGTGGGGGTTGT (SEQ ID NO:8704), AGTTGGACGGATGTTTTGTGGGGGTTG (SEQ ID NO:8705), GAGTTGGACGGATGTTTTGTGGGGGTT (SEQ ID NO:8706)

Target920    chr8:104384675-104384817    CGGAAAGGGAAATGAAGGGGTTCGGCG (SEQ ID NO:8707), GGAAAGGGAAATGAAGGGGTTCGGCGT (SEQ ID NO:8708), TCGGAAAGGGAAATGAAGGGGGTTCGGC (SEQ ID NO:8709), GTCGGAAAGGGAAATGAAGGGGTTCGGC (SEQ ID NO:8710), TCGGAAAGGGAAATGAAGGGGTTCGGCG (SEQ ID NO:8711), AGGTTTTTAGAGGGTTAGCGTCGGGTT (SEQ ID NO:8712), AGGTTTTTAGAGGGTTAGCGTCGGGTTT (SEQ ID NO:8713), AGGTTTTTAGAGGGTTAGCGTCGGGTTTT (SEQ ID NO:8714), TAGGTTTTTAGAGGGTTAGCGTCGGGTTT (SEQ ID NO:8715), AGGTTTTTAGAGGGTTAGCGTCGGGTTTTT (SEQ ID NO:8716)

Target921    chr8:104384851-104384941    GGAAATGAACGGTTCGAGTGTTTTTTAGGGG (SEQ ID NO:8717), GGAAATGAACGGTTCGAGTGTTTTTTAGGGGT (SEQ ID NO:8718), TGGAAATGAACGGTTCGAGTGTTTTTTAGGGG (SEQ ID NO:8719), TGGAAATGAACGGTTCGAGTGTTTTTTAGGGGT (SEQ ID NO:8720), GAAATGAACGGTTCGAGTGTTTTTTAGGGGT (SEQ ID NO:8721)

Target922    chr8:105478778-105478799    TCGTCGAGAAGGGGCGTTTGAAAGGGA (SEQ ID NO:8722), GTCGTCGAGAAGGGGCGTTTGAAAGGG (SEQ ID NO:8723), GGTTGTCGTCGAGAAGGGGCGTTTGAA (SEQ ID NO:8724), CGGTTGTCGTCGAGAAGGGGCGTTTGA (SEQ ID NO:8725), TGTCGTCGAGAAGGGGCGTTTGAAAGG (SEQ ID NO:8726), TTTCGCGGTATTTACGGAGGTTCGGGT (SEQ ID NO:8727), CGCGGTATTTACGGAGGTTCGGGTAGT (SEQ ID NO:8728), TCGCGGTATTTACGGAGGTTCGGGTAGT

FIGURE 5 CONTINUED

{SEQ ID NO:8729}, TCGCGGTATTTACGGAGGTTCGGGTAG {SEQ ID NO:8730},
GTTTCGCGGTATTTACGGAGGTTCGGG {SEQ ID NO:8731}

| | | |
|---|---|---|
| Target923 | chr8:105478816-105479009 | GCGGGGCGGGTATTTTGGTGTTTTGGT {SEQ ID NO:8732}, GGCGGGGCGGGTATTTTGGTGTTTTGG {SEQ ID NO:8733}, CGGCGGGGCGGGTATTTTGGTGTTTTG {SEQ ID NO:8734}, CGGGGGCGGGTATTTTGGTGTTTTGGTG {SEQ ID NO:8735}, GCGAGGCGGTTTTGTTGAGGATTTCGG {SEQ ID NO:8736}, GAGGTGGTCGCACGTGTTGGTGGAGGAC {SEQ ID NO:8737}, GAGGTGGTCGACGTGTTGGTGGAGGA {SEQ ID NO:8738}, AGGTGGTCGACGTGTTGGTGGAGGAC {SEQ ID NO:8739}, GGAGGTGGTCGACGTGTTGGTGGAGGA {SEQ ID NO:8740}, TCGGAGGTGGTCGACGTGTTGGTGGAG {SEQ ID NO:8741} |
| Target924 | chr8:105479061-105479141 | TGTATGTGCGTGTGTGTCGATGTTTT {SEQ ID NO:8742}, TGTATGTGCGTGTGTGTGTCGATGTTTTC {SEQ ID NO:8743}, AGTTCGGGGGTTGTCGGTGGGGATTTT {SEQ ID NO:8744}, GAGGTGGTCGACGTGTTGGTGGAGGAT {SEQ ID NO:8745}, GTTCGGGGGTTGTCGGTGGGGATTTTG {SEQ ID NO:8746}, TCGGGGGTTGTCGGTGGGGATTTTGTA {SEQ ID NO:8747}, TTCGGGGGTTGTCGGTGGGGATTTTGT {SEQ ID NO:8748} |
| Target925 | chr8:105479283-105479327 | CGGGGTTTTATTCGGTTCGGGTTGCGC {SEQ ID NO:8749}, GCGGGGTTTTATTCGGTTCGGGTTGCG {SEQ ID NO:8750}, CGCGGGGGTTTTATTCGGTTCGGGTTGC {SEQ ID NO:8751}, GCGCGGGGTTTTATTCGGTTCGGGTTG {SEQ ID NO:8752}, GCGCGGGGTTTTATTCGGTTCGGGTT {SEQ ID NO:8753}, TCGGGGGGGAGGAGTCGTATATGCGGTT {SEQ ID NO:8754}, TTCGGGGGGAGGAGTCGTATATGCGGT {SEQ ID NO:8755}, TTTCGGGGGGAGGAGTCGTATATGCGG {SEQ ID NO:8756}, CGGGGGGAGGAGTCGTATATGCGGTTA {SEQ ID NO:8757}, TCGGGGGGAGGAGTCGTATATGCGGTTA {SEQ ID NO:8758} |
| Target926 | chr8:116679514-116680058 | TTGAGGCGGGTGTATTAAGGGATGCGA {SEQ ID NO:8759}, TGAGGCGGGTGTATTAAGGGATGCGAT {SEQ ID NO:8760}, TGTTTTGAGTCGTTTTGAGGCGGGTGT {SEQ ID NO:8761}, TTTGAGGCGGGTGTATTAAGGGATGCG {SEQ ID NO:8762}, TTTGAGGCGGGTGTATTAAGGGATGCGA {SEQ ID NO:8763}, GGGGTTCGTGATAAGCGGGGCGTAGAT {SEQ ID NO:8764}, CGCGGGTTAGGGGATATTGGTCGGTGA {SEQ ID NO:8765}, TCGGGAGGGTCGGGAGGGTTTTAGAGA {SEQ ID NO:8766}, TGTCGCGCGGGTTAGGGGATATTGGTC {SEQ ID NO:8767}, AGGGTCGGGAGGGTTTTAGAGACGGGT {SEQ ID NO:8768} |
| Target927 | chr8:116680083-116680187 | CGAGTTTTTAGAAAATTTGTAGTGGCGGCGG {SEQ ID NO:8769}, ACGAGTTTTTAGAAAATTTGTAGTGGCGGCGG {SEQ ID NO:8770}, ACGAGTTTTTAGAAAATTTGTAGTGGCGGCG {SEQ ID NO:8771}, TACGAGTTTTTAGAAAATTTGTAGTGGCGGCGG {SEQ ID NO:8772}, TACGAGTTTTTAGAAAATTTGTAGTGGCGGCG {SEQ ID NO:8773}, GGGGTTCGTGATAAGCGGGGCGTAGAT {SEQ ID NO:8774}, TTGGAGGTGGTTGGATTCGAGGGGTCG {SEQ ID NO:8775}, GGAGGTGGTTGGATTCGAGGGGTCGTC {SEQ ID NO:8776}, CGTAGCGGAGGAGTTGGAGGTGGTTGG {SEQ ID NO:8777}, TTTTTGGGGGTTCGTGATAAGCGGGGC {SEQ ID NO:8778} |
| Target928 | chr8:142696266-142696666 | ACGGAGGTTCGGGAAGGGGTTTTAGGA {SEQ ID NO:8779}, AACGGAGGTTCGGGAAGGGGTTTTAGG {SEQ ID NO:8780}, AACGGAGGTTCGGGAAGGGGTTTTAGGA {SEQ ID NO:8781}, ACGGAGGTTCGGGAAGGGGTTTTAGGAT {SEQ ID NO:8782}, CGGAGGTTCGGGAAGGGGTTTTAGGAT {SEQ ID NO:8783}, GTAGGTCGGGGGCGGGGGAAAATGTAT {SEQ ID NO:8784}, GTTTATAGTGTAGGTCGGGGGCGGGGG {SEQ ID NO:8785}, TATAGTGTAGGTCGGGGGCGGGGGAAA {SEQ ID NO:8786}, TTATAGTGTAGGTCGGGGGCGGGGGAA {SEQ ID NO:8787}, TTTATAGTGTAGGTCGGGGGCGGGGGA {SEQ ID NO:8788} |
| Target929 | chr8:142850598-142850645 | GGCGAGGTTGGTAGGTATATGCGTGGG {SEQ ID NO:8789}, GGCGAGGTTGGTAGGTATATGCGTGGG {SEQ ID NO:8790}, AGGCGAGGTTGGTAGGTATATGCGTGGG {SEQ ID NO:8791}, GCGAGGTTGGTAGGTATATGCGTGGGT {SEQ ID NO:8792}, AGGCGAGGTTGGTAGGTATATGCGTGG {SEQ ID NO:8793}, GGGAGGTTTGTGTGGGGAGGATAGGGT {SEQ ID NO:8794}, GGGAGGTTTGTGTGGGGAGGATAGGGTT {SEQ ID NO:8795}, GGGAGGTTTGTGTGGGGAGGATAGGGTTG {SEQ ID NO:8796}, GGAGGTTTGTGTGGGGAGGATAGGGTT {SEQ ID NO:8797}, AGGTTTGTGTGGGGAGGATAGGGTTGT {SEQ ID NO:8798} |
| Target930 | chr8:143667621-143667639 | AGAAGTTGGTCGGGTGTAGGTTGCGGG {SEQ ID NO:8799}, GTTGGTCGGGTGTAGGTTGCGGGGTAG {SEQ ID NO:8800}, AGGTTGCGGGGTAGGTATGAGGGGAGG {SEQ ID NO:8801}, GTCGGGTGTAGGTTGCGGGGTAGGTAT {SEQ ID NO:8802}, CGGGTGTAGGTTGCGGGGTAGGTATGA {SEQ ID NO:8803} |
| Target931 | chr8:144105681-144105731 | GCGGGAGGGAGTTCGGGTTGTGTTTTG {SEQ ID NO:8804}, GTAGCGGGAGGGAGTTCGGGTTGTGTT {SEQ ID NO:8805}, GAGTAGCGGGAGGGAGTTCGGGTTGTG {SEQ ID NO:8806}, TAGGAGTAGCGGGAGGGAGTTCGGGTT {SEQ ID NO:8807}, TTAGGAGTAGCGGGAGGGAGTTCGGGT {SEQ ID NO:8808}, GGGGGTTTAGTTTCGGGTCGGTGTGGA {SEQ ID NO:8809}, GGAGGGGGTTTAGTTTCGGGTCGGTGT {SEQ ID NO:8810}, AGGGGGGTTTAGTTTCGGGTCGGTGTGG {SEQ ID NO:8811}, GCGGAGAGGAGGGGGTTTAGTTTCGGG {SEQ ID NO:8812}, GGGTTGCGGAGAGGAGGGGGTTTAGTT {SEQ ID NO:8813} |
| Target932 | chr8:144105767-144105871 | GCGGATGAGTTTTTGGAGGATGGGCGG {SEQ ID NO:8814}, CGCGGATGAGTTTTTGGAGGATGGGCG {SEQ ID NO:8815}, TCGCGGATGAGTTTTTGGAGGATGGGC {SEQ ID NO:8816}, CGGATGAGTTTTTGGAGGATGGGCGGT {SEQ ID NO:8817}, TGGGGGAGGGAGAGGAAGAGAGTTTCGT |

FIGURE 5 CONTINUED (SEQ ID NO:8818), TTTATAGGGGTTGAGCGGTGGGGGGTG (SEQ ID NO:8819), GCGGGGGTGTTAAGGGGGTAGAGGGTTG (SEQ ID NO:8820), GGGTTGCGGAGAGGGAGGGGGTTTAGTT (SEQ ID NO:8821), GAAGTGGGGTTGGATGGGGTTGCGGAGA (SEQ ID NO:8822), ATGGGTTGCGGAGAGGAGGGGGTTTAG (SEQ ID NO:8823)

Target933     chr8:144105875-144105903     GCGGATGAGTTTTTGGAGGATGGGCGG (SEQ ID NO:8824), CGCGGATGAGTTTTTGGAGGATGGGCG (SEQ ID NO:8825), TTTTGGAGGATGGGCGGTTCGTTTCG (SEQ ID NO:8826), TCGCGGATGAGTTTTTGGAGGATGGGC (SEQ ID NO:8827), CGGATGAGTTTTTGGAGGATGGGCGGT (SEQ ID NO:8828), AAGGGGGTAGAGGTTGTGGATGGGGGA (SEQ ID NO:8829), TTTATAGGGGTTGAGCGGTGGGGGGTG (SEQ ID NO:8830), GCGGGGGTGTTAAGGGGGTAGAGGTTG (SEQ ID NO:8831), TAGAGGGCGGGGGTGTTAAGGGGGTAG (SEQ ID NO:8832), GTAGAGGGCGGGGGTGTTAAGGGGGTA (SEQ ID NO:8833)

Target934     chr8:144105994-144106052     AGGAGTCGTTAGTTTGTGGGTTCGGGA (SEQ ID NO:8834), GGAGTCGTTAGTTTGTGGGTTCGGGAT (SEQ ID NO:8835), AGGAGTCGTTAGTTTGTGGGTTCGGGAT (SEQ ID NO:8836), TAGGAGTCGTTAGTTTGTGGGTTCGGG (SEQ ID NO:8837), TAGGAGTCGTTAGTTTGTGGGTTCGGGA (SEQ ID NO:8838), GTTGACGGAGGGGTGGAGGTATCGTGG (SEQ ID NO:8839), GGTTGACGGAGGGGTGGAGGTATCGTG (SEQ ID NO:8840), AGATTTGTTGGGGGTTGACGGAGGGGT (SEQ ID NO:8841), GATTTGTTGGGGGTTGACGGAGGGGTG (SEQ ID NO:8842), ATTTGTTGGGGGTTGACGGAGGGGTG (SEQ ID NO:8843)

Target935     chr8:145104273-145105390     GGGCGGCGTTGTTGTTGTTGTTGTTGG (SEQ ID NO:8844), TTCGTGGTGTTGTAGGCGAGGTTGGGT (SEQ ID NO:8845), AGTCGTTCGTGGTGTTGTAGGCGAGGT (SEQ ID NO:8846), TGGAGTCGTTCGTGGTGTTGTAGGCGA (SEQ ID NO:8847), TAGGCGAGGTTGGGTAGTTTGGACGGG (SEQ ID NO:8848), ATGGTTTCGGTCGGTCGTTGGTTGTGC (SEQ ID NO:8849), GGCGGGGTGTAGGCGAATGTAGGGGATT (SEQ ID NO:8850), GGTCGTTGGTTGTGCGGTAGGTTGTCG (SEQ ID NO:8851), CGGTCGTTGGTTGTGCGGTAGGTTGTC (SEQ ID NO:8852), GTCGGTCGTTGGTTGTGCGGTAGGTTG (SEQ ID NO:8853)

Target936     chr8:145105404-145106067     GGTGGTTGGGTTTGCGGTATTGGGACG (SEQ ID NO:8854), ATCGGAGCGGGAAGTGGATTTGGGGAG (SEQ ID NO:8855), GAGTTTTCGGGTGGTTGGGTTTGCGGT (SEQ ID NO:8856), GGGTGGTTGGGTTTGCGGTATTGGGAC (SEQ ID NO:8857), TTTAGGGGGAGGGTATCGGAGCGGGAA (SEQ ID NO:8858), TTTAGCGCGGTTTTTGGGGGATTCGGG (SEQ ID NO:8859), GGGAAGGTCGGTTAGGTAGAGGTGGCG (SEQ ID NO:8860), CGGGAAGGTCGGTTAGGTAGAGGTGGC (SEQ ID NO:8861), GGAGGTGTTTAGCGCGGTTTTTGGGGG (SEQ ID NO:8862), TGGTGGAGTACGGAGGTGTTTAGCGCG (SEQ ID NO:8863)

Target937     chr8:145106087-145106384     GGTAAGTATAGATGAGGGGCGCGCGGT (SEQ ID NO:8864), GGTGGGGCGGGGTTTTTCGGGTTTTTA (SEQ ID NO:8865), AGGTAAGTATAGATGAGGGGCGCGCGG (SEQ ID NO:8866), AAGTATAGATGAGGGGCGCGCGGTTGG (SEQ ID NO:8867), GGAAAGGTTAGTGTTTGCGGGGGGCGAT (SEQ ID NO:8868), GGCCGGTGGTTATGGGGGATTCGGAGGAT (SEQ ID NO:8869), GGTTTTCGTGGTTTATGGGGGCGGGTG (SEQ ID NO:8870), TTGTTCGGTGGGGAGGGGATTGCGTAG (SEQ ID NO:8871), TTATGGGGGCGGGTGATGGACGTTGTT (SEQ ID NO:8872), TTTATGGGGGCGGGTGATGGACGTTGT (SEQ ID NO:8873)

Target938     chr9:1042442-1042462     GGAAGGGTTTGATACGGAATTTGATTAAGGTTGG (SEQ ID NO:8874), TGGAAGGGTTTGATACGGAATTTGATTAAGGTTGG (SEQ ID NO:8875), GGAAGGGTTTGATACGGAATTTGATTAAGGTTGGA (SEQ ID NO:8876), TGGAAGGGTTTGATACGGAATTTGATTAAGGTTGGA (SEQ ID NO:8877), AGTTGGAAGGGTTTGATACGGAATTTGATTAAGGT (SEQ ID NO:8878), TCGGAGGGTTTTTGCGTTTTTGGGGTT (SEQ ID NO:8879), TTCGGAGGGTTTTTGCGTTTTTGGGGT (SEQ ID NO:8880), GTTCGGAGGGTTTTTGCGTTTTTGGGGT (SEQ ID NO:8881), GTTCGGAGGGTTTTTGCGTTTTTGGGG (SEQ ID NO:8882), AGTTCGGAGGGTTTTTGCGTTTTTGGGG (SEQ ID NO:8883)

Target939     chr9:1042502-1042523     CGGAGTAGTCGTTTGAGGGTTGGAAGG (SEQ ID NO:8884), CGGAGTAGTCGTTTGAGGGTTGGAAGGA (SEQ ID NO:8885), TCGGAGTAGTCGTTTGAGGGTTGGAAGG (SEQ ID NO:8886), TCGGAGTAGTCGTTTGAGGGTTGGAAGGA (SEQ ID NO:8887), TCGGAGTAGTCGTTTGAGGGGTTGGAAG (SEQ ID NO:8888), GGCGGTCGGGGGAGGATAGTGATC (SEQ ID NO:8889), GGCGGTCGGGGGAGGATAGTGAT (SEQ ID NO:8890), GGCGGTCGGGGGAGGATAGTGA (SEQ ID NO:8891), GCGGTCGGGGGAGGATAGTGATC (SEQ ID NO:8892), GGCGGTCGGGGGAGGATAGTG (SEQ ID NO:8893)

Target940     chr9:1042552-1042664     GGGGGCGTTGGGTTTTAGGTTCGGATG (SEQ ID NO:8894), GGAAGTCGGGGGCGTTGGGTTTTAGGT (SEQ ID NO:8895), AGTCGGGGGCGTTGGGTTTTAGGTTCG (SEQ ID NO:8896), GGGGGCGTTGGGTTTTAGGTTCGGATGT (SEQ ID NO:8897), CGGGGGCGTTGGGTTTTAGGTTCGGAT (SEQ ID NO:8898), AAACGTTAGGGTTATTCGCGGCGGGTC (SEQ ID NO:8899), AAACGTTAGGGTTATTCGCGGCGGGTCG (SEQ ID NO:8900), CGTTAGGGTTATTCGCGGCGGGTCGTC (SEQ ID NO:8901), TAAACGTTAGGGTTATTCGCGGCGGGT (SEQ ID NO:8902), GTTAGGGTTATTCGCGGCGGGTCGTC (SEQ ID NO:8903)

Target941     chr9:1042682-1042693     GGGGGCGTTGGGTTTTAGGTTCGGATG (SEQ ID NO:8904), GGAAGTCGGGGGCGTTGGGTTTTAGGT (SEQ ID NO:8905), AGTCGGGGGCGTTGGGTTTTAGGTTCG (SEQ ID NO:8906), GGGGCGTTGGGTTTTAGGTTCGGATGT (SEQ ID NO:8907), CGGGGGCGTTGGGTTTTAGGTTCGGAT (SEQ ID NO:8908), AAACGTTAGGGTTATTCGCGGCGGGTC (SEQ ID NO:8909),

FIGURE 5 CONTINUED

|  |  |  |
|---|---|---|
|  |  | AACGTTAGGGTTATTCGCGGCGGGTCG (SEQ ID NO:8910), CGTTAGGGTTATTCGCGGCGGGTCGTC (SEQ ID NO:8911), TAAACGTTAGGGTTATTCGCGGCGGGT (SEQ ID NO:8912), GTTAGGGTTATTCGCGGCGGGTCGTC (SEQ ID NO:8913) |
| Target942 | chr9:1042703-1042744 | GGGGGCGTTGGGTTTTAGGTTCGGATG (SEQ ID NO:8914), GGAAGTCGGGGGCGTTGGGTTTTAGGT (SEQ ID NO:8915), AGTCGGGGGCGTTGGGTTTTAGGTTCG (SEQ ID NO:8916), GGGGCGTTGGGTTTTAGGTTCGGATGT (SEQ ID NO:8917), CGGGGGCGTTGGGTTTTAGGTTCGGAT (SEQ ID NO:8918), AAACGTTAGGGTTATTCGCGGCGGGTCG (SEQ ID NO:8919), AACGTTAGGGTTATTCGCGGCGGGTCG (SEQ ID NO:8920), CGTTAGGGTTATTCGCGGCGGGTCGTC (SEQ ID NO:8921), TAAACGTTAGGGTTATTCGCGGCGGGT (SEQ ID NO:8922), GTTAGGGTTATTCGCGGCGGGTCGTC (SEQ ID NO:8923) |
| Target943 | chr9:1042753-1042760 | GGGTTTTAGGTTCGGATGTTGAGCGCGG (SEQ ID NO:8924), TGGGTTTTAGGTTCGGATGTTGAGCGCG (SEQ ID NO:8925), GGTTTTAGGTTCGGATGTTGAGCGCGG (SEQ ID NO:8926), GGGTTTTAGGTTCGGATGTTGAGCGCG (SEQ ID NO:8927), GGTTTTAGGTTCGGATGTTGAGCGCGGA (SEQ ID NO:8928), GTCGAAAATTTATTGACGCGGCGAGGT (SEQ ID NO:8929), TCGAAAATTTATTGACGCGGCGAGGTT (SEQ ID NO:8930), GTCGAAAATTTATTGACGCGGCGAGGTT (SEQ ID NO:8931), TCGAAAATTTATTGACGCGGCGAGGT (SEQ ID NO:8932), CGAAAATTTATTGACGCGGCGAGGTTAGG (SEQ ID NO:8933) |
| Target944 | chr9:1042852-1042870 | AGTGTTGTTAGTTTGGTTTCGTCGCGT (SEQ ID NO:8934), AGGATCGTTAGAGTTGGGGGGGAGATTAAAGT (SEQ ID NO:8935), AGTGTTGTTAGTTTGGTTTCGTCGCGTTAAT (SEQ ID NO:8936), GAGGATCGTTAGAGTTGGGGGGGAGATTAAAG (SEQ ID NO:8937), TTTGGTTTCGTCGCGTTAATAAATTTTCGGC (SEQ ID NO:8938) |
| Target945 | chr9:13323162-13323186 | GGTCGTTTTTGTGGTGATTTCGTCGTGG (SEQ ID NO:8939), GGTCGTTTTTGTGGTGATTTCGTCGTGGT (SEQ ID NO:8940), TGGTCGTTTTTGTGGTGATTTCGTCGTGG (SEQ ID NO:8941), TGGTCGTTTTTGTGGTGATTTCGTCGTGGT (SEQ ID NO:8942), TCGTTTTTGTGGTGATTTCGTCGTGGT (SEQ ID NO:8943), TGCGGGGAAGAATGATAATTACGTAGGGAG (SEQ ID NO:8944), TGCGGGGAAGAATGATAATTACGTAGGGAGA (SEQ ID NO:8945), ATGCGGGGAAGAATGATAATTACGTAGGGAG (SEQ ID NO:8946), GCGGGGAAGAATGATAATTACGTAGGGAGAA (SEQ ID NO:8947), TGCGGGGAAGAATGATAATTACGTAGGGAGA (SEQ ID NO:8948) |
| Target946 | chr9:13323204-13323239 | GGTCGTTTTTGTGGTGATTTCGTCGTGG (SEQ ID NO:8949), GGTCGTTTTTGTGGTGATTTCGTCGTGGT (SEQ ID NO:8950), TGGTCGTTTTTGTGGTGATTTCGTCGTGG (SEQ ID NO:8951), TGGTCGTTTTTGTGGTGATTTCGTCGTGGT (SEQ ID NO:8952), TCGTTTTTGTGGTGATTTCGTCGTGGT (SEQ ID NO:8953), CGACGAAGGAGTTGGTGGAGAGTAGGA (SEQ ID NO:8954), ACGAAGGAGTTGGTGGAGAGTAGGATCGG (SEQ ID NO:8955), CGAAGGAGTTGGTGGAGAGTAGGATCGG (SEQ ID NO:8956), CGAAGGAGTTGGTGGAGAGTAGGATCGGA (SEQ ID NO:8957), ACGAAGGAGTTGGTGGAGAGTAGGATCGGA (SEQ ID NO:8958) |
| Target947 | chr9:13323300-13323322 | TGGTTGTTGTTTAAGGAGTTCGGCGAGA (SEQ ID NO:8959), TTGGTTGTTGTTTAAGGAGTTCGGCGAG (SEQ ID NO:8960), TTGGTTGTTGTTTAAGGAGTTCGGCGAGA (SEQ ID NO:8961), TGGTTGTTGTTTAAGGAGTTCGGCGAGAT (SEQ ID NO:8962), TTTGGTTGTTGTTTAAGGAGTTCGGCGAG (SEQ ID NO:8963), TCGGAGTTAGGAGTTGGGCGTTGAGAA (SEQ ID NO:8964), TTCGGAGTTAGGAGTTGGGCGTTGAGA (SEQ ID NO:8965), CGACGAAGGAGTTGGTGGAGAGTAGGA (SEQ ID NO:8966), CGGAGTTAGGAGTTGGGCGTTGAGAAG (SEQ ID NO:8967), CGGAGTTAGGAGTTGGGCGTTGAGAAGA (SEQ ID NO:8968) |
| Target948 | chr9:14346424-14346730 | ACGTGTGATAGGAGTCGTTTGGTTAAGTGG (SEQ ID NO:8969), CGTGTGATAGGAGTCGTTTGGTTAAGTGGA (SEQ ID NO:8970), ACGTGTGATAGGAGTCGTTTGGTTAAGTGGA (SEQ ID NO:8971), CGTGTGATAGGAGTCGTTTGGTTAAGTGGAA (SEQ ID NO:8972), ACGTGTGATAGGAGTCGTTTGGTTAAGTGGAA (SEQ ID NO:8973), GCGTGGATTGTTGGGTTTGGGGACGTT (SEQ ID NO:8974), GACGTGTGGCGTGGATTGTTGGGTTT (SEQ ID NO:8975), ACGTGTGGCGTGGATTGTTGGGTTTG (SEQ ID NO:8976), GTGGCGTGGATTGTTGGGTTTGGGGAC (SEQ ID NO:8977), GGATTGTTGGGTTTGGGGACGTTGGGC (SEQ ID NO:8978) |
| Target949 | chr9:14346914-14347026 | GTTTCGGGTGAGGGTGGGGTAAGAGGT (SEQ ID NO:8979), AGTTTCGGGTGAGGGTGGGGTAAGAGG (SEQ ID NO:8980), AGTTTCGGGTGAGGGTGGGGTAAGAGGT (SEQ ID NO:8981), TTTCGGGTGAGGGTGGGGTAAGAGGTA (SEQ ID NO:8982), TCGGGTGAGGGTGGGGTAAGAGGTATT (SEQ ID NO:8983), GTGGGGGTTAGGGGTTTTTTGGTCGCG (SEQ ID NO:8984), TGGGGGGTTAGGGGTTTTTTGGTCGCGA (SEQ ID NO:8985), GGCGGGTTGTTTTTCGAGTGGGGGTTA (SEQ ID NO:8986), GGGGGTTAGGGGTTTTTTGGTCGCGAT (SEQ ID NO:8987), AGTGGGGGTTAGGGGTTTTTTGGTCGC (SEQ ID NO:8988) |
| Target950 | chr9:14347063-14347101 | GCGAAGGGTGCGTTTTTTGAGTTTTACGT (SEQ ID NO:8989), GCGAAGGGTGCGTTTTTTGAGTTTTACG (SEQ ID NO:8990), GCGAAGGGTGCGTTTTTTGAGTTTTACGTCG (SEQ ID NO:8991), GCGAAGGGTGCGTTTTTTGAGTTTTACGTC (SEQ ID NO:8992), CGAAGGGTGCGTTTTTTGAGTTTTACGTCG (SEQ ID NO:8993), CGGCGGGGAATTGCGGGTTTGTAGTTT (SEQ ID NO:8994), CGGCGGGGAATTGCGGGTTTGTAGTT (SEQ ID NO:8995), |

FIGURE 5 CONTINUED

CGGCGGGGAATTGCGGGTTTGTAGTTTA (SEQ ID NO:8996), CGGCGGGGAATTGCGGGTTTGTAGT (SEQ ID NO:8997), CGGCGGGGAATTGCGGGTTTGTAGTTTAG (SEQ ID NO:8998)

Target951    chr9:14347122-14347127    GGGAGTTGGAAGGTAGGTAGACGCGCG (SEQ ID NO:8999), CGGGAGTTGGAAGGTAGGTAGACGCGC (SEQ ID NO:9000), TCGGGAGTTGGAAGGTAGGTAGACGCG (SEQ ID NO:9001), GTCGGGAGTTGGAAGGTAGGTAGACGCG (SEQ ID NO:9002), GTCGGGAGTTGGAAGGTAGGTAGACGC (SEQ ID NO:9003), CGGCGGGGAATTGCGGGTTTGTAGTTT (SEQ ID NO:9004), CGGCGGGGAATTGCGGGTTTGTAGTT (SEQ ID NO:9005), CGGCGGGGAATTGCGGGTTTGTAGTTTA (SEQ ID NO:9006), CGGCGGGGAATTGCGGGTTTGTAGT (SEQ ID NO:9007), CGGCGGGGAATTGCGGGTTTGTAGTTTAG (SEQ ID NO:9008)

Target952    chr9:14347212-14347232    GGTAGGTAGACGCGCGAGGTTTGGGAA (SEQ ID NO:9009), TAGGTAGACGCGCGAGGTTTGGGAAGG (SEQ ID NO:9010), AAGGTAGGTAGACGCGCGAGGTTTGGG (SEQ ID NO:9011), GTTGGAAGGTAGGTAGACGCGCGAGGT (SEQ ID NO:9012), AGTTGGAAGGTAGGTAGACGCGCGAGG (SEQ ID NO:9013), GCGCGGTGGTGGAGTTTTCGAAGGTAT (SEQ ID NO:9014), CGCGCGGTGGTGGAGTTTTCGAAGGTA (SEQ ID NO:9015), GCGCGGTGGTGGAGTTTTCGAAGGTATT (SEQ ID NO:9016), GCGCGGTGGTGGAGTTTTCGAAGGTA (SEQ ID NO:9017), CGCGCGGTGGTGGAGTTTTCGAAGGTAT (SEQ ID NO:9018)

Target953    chr9:19788625-19788640    TGTAGGTGGTTGGGGAATGGAAGCGTT (SEQ ID NO:9019), TTGTAGGTGGTTGGGGAATGGAAGCGT (SEQ ID NO:9020), CGTTTGTAGGTGGTTGGGGAATGGAAGCG (SEQ ID NO:9021), AGGTGGTTGGGGAATGGAAGCGTTTTT (SEQ ID NO:9022), TGTAGGTGGTTGGGGAATGGAAGCGTTT (SEQ ID NO:9023), TGTTTTTGGTTTGGGATGGGGGGCGTG (SEQ ID NO:9024), TTGTTTTTGGTTTGGGATGGGGGGCGT (SEQ ID NO:9025), GTTTTTGGTTTGGGATGGGGGGCGTGG (SEQ ID NO:9026), TCGGGGCGTGGATTTGGAGTTTTCGTT (SEQ ID NO:9027), TGTGTTTCGGGGCGTGGATTTGGAGTT (SEQ ID NO:9028)

Target954    chr9:19788803-19788819    AAGGGTAGGAGAGGCGGGGGTTTTAAA (SEQ ID NO:9029), AGGGGTAGGAGAGGCGGGGGTTTTAAAT (SEQ ID NO:9030), TGGTTAATTTTTAGCGGGGTTTGGGGCGT (SEQ ID NO:9031), GGTTAATTTTTAGCGGGGTTTGGGGCGT (SEQ ID NO:9032), TGGTTAATTTTTAGCGGGGTTTGGGGCG (SEQ ID NO:9033), TGTCGTTGTAGTCGTTGTGGCGGTCGT (SEQ ID NO:9034), GTCGTTGTAGTCGTTGTGGCGGTCGTT (SEQ ID NO:9035), TTGTCGTTGTAGTCGTTGTGGCGGTCG (SEQ ID NO:9036), TCGTTGTAGTCGTTGTGGCGGTCGTTT (SEQ ID NO:9037), TGTCGTTGTAGTCGTTGTGGCGGTCGTT (SEQ ID NO:9038)

Target955    chr9:19788835-19788913    TGGTTAATTTTTAGCGGGGTTTGGGGCGT (SEQ ID NO:9039), GGTTAATTTTTAGCGGGGTTTGGGGCGT (SEQ ID NO:9040), TGGTTAATTTTTAGCGGGGTTTGGGGCG (SEQ ID NO:9041), GGTTAATTTTTAGCGGGGTTTGGGGCG (SEQ ID NO:9042), GTTAATTTTTAGCGGGGTTTGGGGCGT (SEQ ID NO:9043), AGAGTTCGGGTTTTAGAGCGGGTAGGC (SEQ ID NO:9044), TAGAGTTCGGGTTTTAGAGCGGGTAGGC (SEQ ID NO:9045), GAGTTCGGGTTTTAGAGCGGGTAGGC (SEQ ID NO:9046), GCGTTCGGGGGTTTCGTCGTGTGC (SEQ ID NO:9047), TTAGAGTTCGGGTTTTAGAGCGGGTAGGC (SEQ ID NO:9048)

Target956    chr9:19788925-19788946    GTATACGGCGGGGTTTTCGAGCG (SEQ ID NO:9049), CGTATTTATTAGGATAAGATGGGAGGACGCGT (SEQ ID NO:9050), TCGTATTTATTAGGATAAGATGGGAGGACGCGT (SEQ ID NO:9051), TTCGTATTTATTAGGATAAGATGGGAGGACGCG (SEQ ID NO:9052), CGTTCGTATTTATTAGGATAAGATGGGAGGACGCG (SEQ ID NO:9053), GATTCGGAGCGTCGGGTTTATAGCGGT (SEQ ID NO:9054), TTCGGAGCGTCGGGTTTATAGCGGTTT (SEQ ID NO:9055), AGATTCGGAGCGTCGGGTTTATAGCGGT (SEQ ID NO:9056), AGATTCGGAGCGTCGGGTTTATAGCGG (SEQ ID NO:9057), ATTCGGAGCGTCGGGTTTATAGCGGTT (SEQ ID NO:9058)

Target957    chr9:19788948-19788965    GTATACGGCGGGGTTTTCGAGCG (SEQ ID NO:9059), CGTATTTATTAGGATAAGATGGGAGGACGCGT (SEQ ID NO:9060), TCGTATTTATTAGGATAAGATGGGAGGACGCGT (SEQ ID NO:9061), TTCGTATTTATTAGGATAAGATGGGAGGACGCG (SEQ ID NO:9062), CGTTCGTATTTATTAGGATAAGATGGGAGGACGCG (SEQ ID NO:9063), GGTAGCGTTAGATTCGGAGCGTCGGGT (SEQ ID NO:9064), GGTCGGGTAGCGTTAGATTCGGAGCGT (SEQ ID NO:9065), TCGGGTAGCGTTAGATTCGGAGCGTCG (SEQ ID NO:9066), GGGGGTCGGGTAGCGTTAGATTCGGAG (SEQ ID NO:9067), GGGGTCGGGTAGCGTTAGATTCGGAGC (SEQ ID NO:9068)

Target958    chr9:19789000-19789041    CGGGTTGGGTTCGGGAGGAGATTGAGT (SEQ ID NO:9069), AGTCGGGTTGGGTTCGGGAGGAGATTG (SEQ ID NO:9070), GTCGGGTTGGGTTCGGGAGGAGATTGA (SEQ ID NO:9071), TCGGGTTGGGTTCGGGAGGAGATTGAG (SEQ ID NO:9072), GTTAGTCGGGTTGGGTTCGGGAGGAGA (SEQ ID NO:9073), GGTAGCGTTAGATTCGGAGCGTCGGGT (SEQ ID NO:9074), GGTCGGGTAGCGTTAGATTCGGAGCGT (SEQ ID NO:9075), TCGGGTAGCGTTAGATTCGGAGCGTCG (SEQ ID NO:9076), GGGGGTCGGGTAGCGTTAGATTCGGAG (SEQ ID NO:9077), GGGGTCGGGTAGCGTTAGATTCGGAGC (SEQ ID NO:9078)

Target959    chr9:19789051-19789060    CGGGTTGGGTTCGGGAGGAGATTGAGT (SEQ ID NO:9079), AGTCGGGTTGGGTTCGGGAGGAGATTG (SEQ ID NO:9080), GTCGGGTTGGGTTCGGGAGGAGATTGA (SEQ ID NO:9081), TCGGGTTGGGTTCGGGAGGAGATTGAG (SEQ ID NO:9082), GTTAGTCGGGTTGGGTTCGGGAGGAGA (SEQ ID NO:9083), GGTCGGGTAGCGTTAGATTCGGAGCGT (SEQ ID NO:9084), GGGGGTCGGGTAGCGTTAGATTCGGAG (SEQ ID NO:9085), GGGGTCGGGTAGCGTTAGATTCGGAGC

FIGURE 5 CONTINUED (SEQ ID NO:9086), GGGTCGGGTAGCGTTAGATTCGGAGCG (SEQ ID NO:9087),
ATAGTTTAGAGGGAGGGGTCGGCGGGG (SEQ ID NO:9088)

Target960          chr9:19789107-19789137          CGGGGTTGGGTTCGGGAGGAGATTGAGT (SEQ ID NO:9089), AGTCGGGTTGGGTTCGGGAGGAGATTG (SEQ ID NO:9090), GTCGGGTTGGGTTCGGGAGGAGATTGA (SEQ ID NO:9091), TCGGGTTGGGTTCGGGAGGAGATTGAG (SEQ ID NO:9092), GTTAGTCGGGTTGGGTTCGGGAGGAGA (SEQ ID NO:9093), AGGAGGCGTGGAGTAAAGGATTCGGGA (SEQ ID NO:9094), GGAGGCGTGGAGTAAAGGATTCGGGAGT (SEQ ID NO:9095), GGAGGCGTGGAGTAAAGGATTCGGGAG (SEQ ID NO:9096), AGGAGGCGTGGAGTAAAGGATTCGGGAG (SEQ ID NO:9097), GAGGCGTGGAGTAAAGGATTCGGGAGT (SEQ ID NO:9098)

Target961          chr9:19789174-19789196          GGCGTTTCGAGTTTGGCGTTGTTC (SEQ ID NO:9099), AGCGCGTTTAGTTTTCGAGTTTTTTGTTTTACG (SEQ ID NO:9100), TAGCGCGTTTAGTTTTCGAGTTTTTTGTTTTACG (SEQ ID NO:9101), GTAGCGCGTTTAGTTTTCGAGTTTTTTGTTTTACG (SEQ ID NO:9102), TGCGGAGAAATTTTTTAAGAGACGGTTGTTAGC (SEQ ID NO:9103), TTGCGGAGAAATTTTTTAAGAGACGGTTGTTAGC (SEQ ID NO:9104), ATTGCGGAGAAATTTTTTAAGAGACGGTTGTTAGC (SEQ ID NO:9105), TATTGCGGAGAAATTTTTTAAGAGACGGTTGTTAGC (SEQ ID NO:9106)

Target962          chr9:27690403-27690589          AGGAGTTATCGGGGAGGAGTTAAGATGGT (SEQ ID NO:9107), AGGAGTTATCGGGGAGGAGTTAAGATGGT (SEQ ID NO:9108), AAGGAGTTATCGGGGAGGAGTTAAGATGGT (SEQ ID NO:9109), AAGGAGTTATCGGGGAGGAGTTAAGATGGTT (SEQ ID NO:9110), AAAGGAGTTATCGGGGAGGAGTTAAGATGGT (SEQ ID NO:9111), ACGTTGGGAGTTGTAGATCGGAGTTGTT (SEQ ID NO:9112), ACGTTGGGAGTTGTAGATCGGAGTTGTTT (SEQ ID NO:9113), ACGTTGGGAGTTGTAGATCGGAGTTGTTTT (SEQ ID NO:9114), TACGTTGGGAGTTGTAGATCGGAGTTGTTT (SEQ ID NO:9115), TTACGTTGGGAGTTGTAGATCGGAGTTGTT (SEQ ID NO:9116)

Target963          chr9:36986037-36986057          GGAAGAAAGAGTGGTAGTCGTATTTAGGAGGATTTG (SEQ ID NO:9117), AGAGTGGTAGTCGTATTTAGGAGGATTTGTTTGTTT (SEQ ID NO:9118), AAGAGTGGTAGTCGTATTTAGGAGGATTTGTTTGTT (SEQ ID NO:9119), AAAGAGTGGTAGTCGTATTTAGGAGGATTTGTTTGT (SEQ ID NO:9120), GTTAGTTTTTCGGGGTTTCGGGGGGCG (SEQ ID NO:9121), TGTTAGTTTTTCGGGGTTTCGGGGGGC (SEQ ID NO:9122), GGTAGTCGGGGAGTTGGGTAGCGGAGTA (SEQ ID NO:9123), TTAGTTTTTCGGGGTTTCGGGGGGGCG (SEQ ID NO:9124), TTAGTTTTTCGGGGTTTCGGGGGGGCG (SEQ ID NO:9125)

Target964          chr9:36986101-36986118          TTTTCGTTTCGGCGCGTATTATTTGTTTCG (SEQ ID NO:9126), GTTTTCGTTTCGGCGCGTATTATTTGTTTCG (SEQ ID NO:9127), GTTAGTTTTTCGGGGTTTCGGGGGGCG (SEQ ID NO:9128), TGTTAGTTTTTCGGGGTTTCGGGGGGC (SEQ ID NO:9129), GGTAGTCGGGGAGTTGGGTAGCGGAGTA (SEQ ID NO:9130), TTAGTTTTTCGGGGTTTCGGGGGGCGC (SEQ ID NO:9131), TTAGTTTTTCGGGGTTTCGGGGGGGCG (SEQ ID NO:9132)

Target965          chr9:36986131-36986144          TCGTTTCGGCGCGTATTATTTGTTTCGT (SEQ ID NO:9133), TCGTTTCGGCGCGTATTATTTGTTTCGTT (SEQ ID NO:9134), TTCGTTTCGGCGCGTATTATTTGTTTCGT (SEQ ID NO:9135), CGTTTCGGCGCGTATTATTTGTTTCGTTG (SEQ ID NO:9136), CGTTTCGGCGCGTATTATTTGTTTCGTTGT (SEQ ID NO:9137), GTTAGTTTTTCGGGGTTTCGGGGGGCG (SEQ ID NO:9138), GTTCGCGGCGGTTAGGAGAGGTTCGTA (SEQ ID NO:9139), TGTTAGTTTTTCGGGGTTTCGGGGGGC (SEQ ID NO:9140), TTAGTTTTTCGGGGTTTCGGGGGGGCGC (SEQ ID NO:9141), TTCGCGGCGGTTAGGAGAGGTTCGTA (SEQ ID NO:9142)

Target966          chr9:36986179-36986243          TCGGGGTTTCGGAAAGTTGGTATTCGT (SEQ ID NO:9143), TCGGGGTTTCGGAAAGTTGGTATTCGTT (SEQ ID NO:9144), CGGGGTTTCGGAAAGTTGGTATTCGTTGT (SEQ ID NO:9145), CGGGGTTTCGGAAAGTTGGTATTCGTTG (SEQ ID NO:9146), TCGGGGTTTCGGAAAGTTGGTATTCGTTG (SEQ ID NO:9147), GTTCGCGGCGGTTAGGAGAGGTTCGTA (SEQ ID NO:9148), TTCGGTTCGTTGATTGTCGCGCGGTTC (SEQ ID NO:9149), GTTCGGTTCGTTGATTGTCGCGCGGTT (SEQ ID NO:9150), GTGGTTCGGTTCGTTGATTGTCGCGCG (SEQ ID NO:9151), TTCGGTTCGTTGATTGTCGCGCGGTT (SEQ ID NO:9152)

Target967          chr9:36986257-36986324          TCGGGGTTTCGGAAAGTTGGTATTCGT (SEQ ID NO:9153), TCGGGGTTTCGGAAAGTTGGTATTCGTT (SEQ ID NO:9154), CGTTGGGATTTGTAGGGCGCGTCG (SEQ ID NO:9155), CGGGGTTTCGGAAAGTTGGTATTCGTTGT (SEQ ID NO:9156), CGGGGTTTCGGAAAGTTGGTATTCGTTG (SEQ ID NO:9157), TTCGGTTCGTTGATTGTCGCGCGGTTC (SEQ ID NO:9158), GTTCGGTTCGTTGATTGTCGCGCGGTT (SEQ ID NO:9159), GTGGTTCGGTTCGTTGATTGTCGCGCG (SEQ ID NO:9160), TTCGGTTCGTTGATTGTCGCGCGGTT (SEQ ID NO:9161), TCGGTTCGTTGATTGTCGCGCGGTTC (SEQ ID NO:9162)

Target968          chr9:36986334-36986514          CGTTGGGATTTGTAGGGCGCGTCGTC (SEQ ID NO:9163), CGTTGGGATTTGTAGGGCGCGTCGT (SEQ ID NO:9164), GTTGGGATTTGTAGGGCGCGTCGTC (SEQ ID NO:9165), CGTTGGGATTTGTAGGGCGCGTCG (SEQ ID NO:9166), GTTGGGATTTGTAGGGCGCGTCGT (SEQ ID NO:9167), GTCGGGGGCGGAGGGTAGACGATTTTT (SEQ ID NO:9168), GAGGAGTTTTTAGGGTCGGGGGCGGAG (SEQ ID NO:9169), GTTTTTAGGGTCGGGGGCGGAGGGTAG (SEQ ID NO:9170),

FIGURE 5 CONTINUED

CGTAAAGAGAAGGTTGAGCGCGGCGTT {SEQ ID NO:9171}, TTTTTAGGGTCGGGGGCGGAGGGTAGA {SEQ ID NO:9172}

Target969   chr9:36986536-36986617   CGCGTAGGAAATTTAGGTGATTTTTTGGAAGTCG {SEQ ID NO:9173}, CGCGTAGGAAATTTAGGTGATTTTTTGGAAGTCGT {SEQ ID NO:9174}, TCGCGTAGGAAATTTAGGTGATTTTTTGGAAGTCG {SEQ ID NO:9175}, TCGCGTAGGAAATTTAGGTGATTTTTTGGAAGTCGT {SEQ ID NO:9176}, GCGTAGGAAATTTAGGTGATTTTTTGGAAGTCGT {SEQ ID NO:9177}, GTCGGGGGCGGAGGGTAGACGATTTTT {SEQ ID NO:9178}, GAGGAGTTTTTAGGGTCGGGGGCGGAG {SEQ ID NO:9179}, GTTTTTAGGGTCGGGGGCGGAGGGTAG {SEQ ID NO:9180}, CGGTTCGGGCGTTTCGTGGGTTTAGTT {SEQ ID NO:9181}, GACGGAGGAGTTTTTAGGGTCGGGGGC {SEQ ID NO:9182}

Target970   chr9:36986640-36986658   CGGTTTTGGGGATTTTTTCGTCGGAGT {SEQ ID NO:9183}, TCGGTTTTGGGGATTTTTTCGTCGGAGT {SEQ ID NO:9184}, TCGGTTTTGGGGATTTTTTCGTCGGAG {SEQ ID NO:9185}, CGGTTTTGGGGATTTTTTCGTCGGAGTT {SEQ ID NO:9186}, TCGGTTTTGGGGATTTTTTCGTCGGAGTT {SEQ ID NO:9187}, AGAGAGGTCGAGGTTTTTGCGGGGAGG {SEQ ID NO:9188}, AGAGGTCGAGGTTTTTGCGGGGAGGTC {SEQ ID NO:9189}, GAGAGGTCGAGGTTTTTGCGGGGAGGT {SEQ ID NO:9190}, CGAGGTTTTTGCGGGGAGGTCGGTTTT {SEQ ID NO:9191}, CGGTTCGGGCGTTTCGTGGGTTTAGTT {SEQ ID NO:9192}

Target971   chr9:36986702-36986710   GGATTTTCGGTCGGTGGGCGGGAGTTA {SEQ ID NO:9193}, ATTTTCGGTCGGTGGGCGGGAGTTAGG {SEQ ID NO:9194}, GTCGGTGGGCGGGAGTTAGGTTTACGG {SEQ ID NO:9195}, GGTCGGTGGGCGGGAGTTAGGTTTACG {SEQ ID NO:9196}, CGGTCGGTGGGCGGGAGTTAGGTTTAC {SEQ ID NO:9197}, AGAGAGGTCGAGGTTTTTGCGGGGAGG {SEQ ID NO:9198}, AGAGGTCGAGGTTTTTGCGGGGAGGTC {SEQ ID NO:9199}, GAGAGGTCGAGGTTTTTGCGGGGAGGT {SEQ ID NO:9200}, CGAGGTTTTTGCGGGGAGGTCGGTTTT {SEQ ID NO:9201}, TCGAGGTTTTTGCGGGGAGGTCGGTTT {SEQ ID NO:9202}

Target972   chr9:36986762-36986789   GGATTTTCGGTCGGTGGGCGGGAGTTA {SEQ ID NO:9203}, ATTTTCGGTCGGTGGGCGGGAGTTAGG {SEQ ID NO:9204}, GTCGGTGGGCGGGAGTTAGGTTTACGG {SEQ ID NO:9205}, GGTCGGTGGGCGGGAGTTAGGTTTACG {SEQ ID NO:9206}, CGGTCGGTGGGCGGGAGTTAGGTTTAC {SEQ ID NO:9207}, TGAAGGAGGTTTAGGGATTCGCGGTGT {SEQ ID NO:9208}, TGAAGGAGGTTTAGGGATTCGCGGTGTT {SEQ ID NO:9209}, TTGAAGGAGGTTTAGGGATTCGCGGTGT {SEQ ID NO:9210}, GAAGGAGGTTTAGGGATTCGCGGTGTT {SEQ ID NO:9211}, TTGAAGGAGGTTTAGGGATTCGCGGTG {SEQ ID NO:9212}

Target973   chr9:36986828-36986849   CGAGGAGGAAGGGATCGGTTTTTTCGT {SEQ ID NO:9213}, GGAGGAAGGGATCGGTTTTTTCGTAGGG {SEQ ID NO:9214}, AGGAGGAAGGGATCGGTTTTTTCGTAGGG {SEQ ID NO:9215}, GGAGGAAGGGATCGGTTTTTTCGTAGGGA {SEQ ID NO:9216}, CGAGGAGGAAGGGATCGGTTTTTTCGTAGGG {SEQ ID NO:9217}, TGGGTATGGGTTGGACGGGATTTCGGT {SEQ ID NO:9218}, TGGGTATGGGTTGGACGGGATTTCGTT {SEQ ID NO:9219}, TTGGGTATGGGTTGGACGGGATTTCGGT {SEQ ID NO:9220}, GGGTATGGGTTGGACGGGATTTCGGTT {SEQ ID NO:9221}, TTGGGTATGGGTTGGACGGGATTTCGG {SEQ ID NO:9222}

Target974   chr9:36987001-36987017   GGTTCGAAGGAGATGGTGGTCGGGGTT {SEQ ID NO:9223}, CGAAGGAGATGGTGGTCGGGGTTTCGT {SEQ ID NO:9224}, AGGTTCGAAGGAGATGGTGGTCGGGGT {SEQ ID NO:9225}, TAGGTTCGAAGGAGATGGTGGTCGGGG {SEQ ID NO:9226}, GGTTCGAAGGAGATGGTGGTCGGGGTTT {SEQ ID NO:9227}, TTTGTTTCGGAGGGGTTGTGGGGGAAGA {SEQ ID NO:9228}, TGTTTCGGAGGGGTTGTGGGGGAAGATT {SEQ ID NO:9229}, TTGTTTCGGAGGGGTTGTGGGGGAAGAT {SEQ ID NO:9230}, ATTTGTTTCGGAGGGGTTGTGGGGGAAG {SEQ ID NO:9231}, TTGTTTCGGAGGGGTTGTGGGGGAAGATT {SEQ ID NO:9232}

Target975   chr9:82188645-82188755   GGGTAAGTGTTTGTGTGTATTTGTCGGGG {SEQ ID NO:9233}, AGGGTAAGTGTTTGTGTGTATTTGTCGGGG {SEQ ID NO:9234}, GGGTAAGTGTTTGTGTGTATTTGTCGGGGA {SEQ ID NO:9235}, AGGGTAAGTGTTTGTGTGTATTTGTCGGGGA {SEQ ID NO:9236}, GGAGGGTAAGTGTTTGTGTGTATTTGTCGGGG {SEQ ID NO:9237}

Target976   chr9:82188897-82188984   CGAAATTGGGGAGATTTGGAAAACGTTGAGG {SEQ ID NO:9238}, CGAAATTGGGGAGATTTGGAAAACGTTGAGGT {SEQ ID NO:9239}, GAAATTGGGGAGATTTGGAAAACGTTGAGGT {SEQ ID NO:9240}, AAATTGGGGAGATTTGGAAAACGTTGAGGTT {SEQ ID NO:9241}, CGAAATTGGGGAGATTTGGAAAACGTTGAGGTT {SEQ ID NO:9242}

Target977   chr9:82189045-82189118   CGGGAGAATGAAAGGTTGGGAAGATTTTGGGG {SEQ ID NO:9243}, CGGGAGAATGAAAGGTTGGGAAGATTTTGGGGT {SEQ ID NO:9244}, CGGGAGAATGAAAGGTTGGGAAGATTTTGGG {SEQ ID NO:9245}, GGGAGAATGAAAGGTTGGGAAGATTTTGGGG {SEQ ID NO:9246}, GGGAGAATGAAAGGTTGGGAAGATTTTGGGGT {SEQ ID NO:9247}

Target978   chr9:100616347-100616704   GGTCGGGGTTTTAGGGGAGGTTACGGG {SEQ ID NO:9248}, GGGTCGGGGTTTTAGGGGAGGTTACGG {SEQ ID NO:9249}, GGGGTCGGGGTTTTAGGGGAGGTTACG {SEQ ID NO:9250}, AGTAGGGGTCGGGGTTTTAGGGGAGGT {SEQ ID NO:9251}, CGGGGTTTTAGGGGAGGTTACGGGTCG

FIGURE 5 CONTINUED

|  |  | (SEQ ID NO:9252), CGGTTTCGCGCGGGATTTTGAGGAAGT (SEQ ID NO:9253), AGTCGTTGAGTGTGAGGTTGTGGCGGA (SEQ ID NO:9254), TTGGGGTTGTCGCGGGTAGAAGGGGAAG (SEQ ID NO:9255), TTTGGGGTTGTCGCGGGTAGAAGGGGAA (SEQ ID NO:9256), TTTTGGGGTTGTCGCGGGTAGAAGGGGA (SEQ ID NO:9257) |
| Target979 | chr9:100616709-100616748 | GGTAGTAGATTGGAGGCGGCGCGGTTA (SEQ ID NO:9258), CGACGTCGCGGGGTAGTAGATTGGAGG (SEQ ID NO:9259), GACGTCGCGGGGTAGTAGATTGGAGGC (SEQ ID NO:9260), CGACGGCGGCGCGTAGTTTGTATAGAC (SEQ ID NO:9261), ACGTCGCGGGGTAGTAGATTGGAGGC (SEQ ID NO:9262) |
| Target980 | chr9:100616754-100616762 | GGTAGTAGATTGGAGGCGGCGCGGTTA (SEQ ID NO:9263), CGACGTCGCGGGGTAGTAGATTGGAGG (SEQ ID NO:9264), GACGTCGCGGGGTAGTAGATTGGAGGC (SEQ ID NO:9265), CGACGGCGGCGCGTAGTTTGTATAGAC (SEQ ID NO:9266), ACGTCGCGGGGTAGTAGATTGGAGGC (SEQ ID NO:9267) |
| Target981 | chr9:100616774-100616782 | GGTAGTAGATTGGAGGCGGCGCGGTTA (SEQ ID NO:9268), CGACGTCGCGGGGTAGTAGATTGGAGG (SEQ ID NO:9269), GACGTCGCGGGGTAGTAGATTGGAGGC (SEQ ID NO:9270), CGACGGCGGCGCGTAGTTTGTATAGAC (SEQ ID NO:9271), ACGTCGCGGGGTAGTAGATTGGAGGC (SEQ ID NO:9272) |
| Target982 | chr9:100616796-100616817 | GGTAGTAGATTGGAGGCGGCGCGGTTA (SEQ ID NO:9273), CGACGTCGCGGGGTAGTAGATTGGAGG (SEQ ID NO:9274), GACGTCGCGGGGTAGTAGATTGGAGGC (SEQ ID NO:9275), TCGACGGTGCGGGTTTTAGTTTTGGGT (SEQ ID NO:9276), ACGTCGCGGGGTAGTAGATTGGAGGC (SEQ ID NO:9277) |
| Target983 | chr9:100616838-100616863 | CGTTGGTCGCGTCGTTTTTAGTTTATTATTTCGC (SEQ ID NO:9278), GTTGGTCGCGTCGTTTTTAGTTTATTATTTCGC (SEQ ID NO:9279), TCGACGGTGCGGGTTTTAGTTTTGGGT (SEQ ID NO:9280), TGCGGGTTGGTAGTCGGTGGTGGTAG (SEQ ID NO:9281), TGCGGGTTTTAGTTTTGGGTTGAGCGGT (SEQ ID NO:9282), GCGGGTTTTAGTTTTGGGTTGAGCGGT (SEQ ID NO:9283), TGCGGGTTTTAGTTTTGGGTTGAGCGG (SEQ ID NO:9284) |
| Target984 | chr9:112810205-112810273 | TGGTGGAGGAGGGGATGAGAGATTGAA (SEQ ID NO:9285), ATGGTGGAGGAGGGGATGAGAGATTGA (SEQ ID NO:9286), TGGTGGAGGAGGGGATGAGAGATTGAAA (SEQ ID NO:9287), ATGGTGGAGGAGGGGATGAGAGATTGA (SEQ ID NO:9288), TGGTGGAGGAGGGGATGAGAGATTGA (SEQ ID NO:9289), TCGTGTAGTGGTAGTCGGTGGTTCGGT (SEQ ID NO:9290), CGTGTAGTGGTAGTCGGTGGTTCGGTGT (SEQ ID NO:9291), CGTGTAGTGGTAGTCGGTGGTTCGGTG (SEQ ID NO:9292), TCGTGTAGTGGTAGTCGGTGGTTCGGTG (SEQ ID NO:9293), GCGGAGGGGAAGGAGGTAGTTGATTCGT (SEQ ID NO:9294) |
| Target985 | chr9:112810283-112810306 | CGTTGGTTTTGTTAGTATACGCGTTTTGATATCGG (SEQ ID NO:9295), TCGTTGGTTTTGTTAGTATACGCGTTTTGATATCGG (SEQ ID NO:9296), TCGTTGGTTTTGTTAGTATACGCGTTTTGATATCG (SEQ ID NO:9297), TTCGTTGGTTTTGTTAGTATACGCGTTTTGATATCG (SEQ ID NO:9298), CGATGGGGTTTAGAGGTTGAGGTGTGG (SEQ ID NO:9299), CGATGGGGTTTAGAGGTTGAGGTGTGGA (SEQ ID NO:9300), TCGATGGGGTTTAGAGGTTGAGGTGTGG (SEQ ID NO:9301), TCGATGGGGTTTAGAGGTTGAGGTGTGGA (SEQ ID NO:9302), CGCGTGTTTGAGGATTTTTTCGATGGGGT (SEQ ID NO:9303) |
| Target986 | chr9:112810400-112810743 | CGTGGTGTTAGGTAAGGGACGAGGGGT (SEQ ID NO:9304), TCGTGGTGTTAGGTAAGGGACGAGGGGG (SEQ ID NO:9305), TCGTGGTGTTAGGTAAGGGACGAGGGGT (SEQ ID NO:9306), CGTGGTGTTAGGTAAGGGACGAGGGGTT (SEQ ID NO:9307), ACGGAGGGTAGTAGGAAGGTTTTGGCG (SEQ ID NO:9308), GGGGTGGCGTGTCGTTGTGTGTGTATG (SEQ ID NO:9309), GGAGGGGATGGATGGGCGGGTAAAGTT (SEQ ID NO:9310), GAGGGAAAGACGGAGGGATGGATGGGG (SEQ ID NO:9311), GGGTGGCGTGTCGTTGTGTGTGTATGT (SEQ ID NO:9312), AGGGATGGATGGGGCGGGTAAAGTTGA (SEQ ID NO:9313) |
| Target987 | chr9:120507235-120507278 | GCGGGGTTGTTTAGATTTTGCGGGCGA (SEQ ID NO:9314), CGGGGTTGTTTAGATTTTGCGGGCGAG (SEQ ID NO:9315), GCGGGGTTGTTTAGATTTTGCGGGCG (SEQ ID NO:9316), GCGGGGTTGTTTAGATTTTGCGGGCGAG (SEQ ID NO:9317), CGGGGTTGTTTAGATTTTGCGGGCGA (SEQ ID NO:9318) |
| Target988 | chr9:120507296-120507309 | GGAGACGTCGGGGTTTTCGGTTTTGAGT (SEQ ID NO:9319), GGAGACGTCGGGGTTTTCGGTTTTGAG (SEQ ID NO:9320), GAGACGTCGGGGTTTTCGGTTTTGAGT (SEQ ID NO:9321), AGACGTCGGGGTTTTCGGTTTTGAGTT (SEQ ID NO:9322), TCGGTTTTGAGTTTTTGGAGCGTTCGC (SEQ ID NO:9323), GCGGGGTTGTTTAGATTTTGCGGGCGA (SEQ ID NO:9324), CGGGGTTGTTTAGATTTTGCGGGCG (SEQ ID NO:9325), GCGGGGTTGTTTAGATTTTGCGGGCG (SEQ ID NO:9326), GCGGGGTTGTTTAGATTTTGCGGGCGAG (SEQ ID NO:9327), CGGGGTTGTTTAGATTTTGCGGGCGA (SEQ ID NO:9328) |
| Target989 | chr9:120507342-120507366 | GGAGACGTCGGGGTTTTCGGTTTTGAGT (SEQ ID NO:9329), GGAGACGTCGGGGTTTTCGGTTTTGAG (SEQ ID NO:9330), GAGACGTCGGGGTTTTCGGTTTTGAGT (SEQ ID NO:9331), AGACGTCGGGGTTTTCGGTTTTGAGTT (SEQ ID NO:9332), TCGGTTTTGAGTTTTTGGAGCGTTCGC (SEQ ID NO:9333), GCGGGGTTGTTTAGATTTTGCGGGCGA (SEQ ID NO:9334), CGGGGTTGTTTAGATTTTGCGGGCGAG (SEQ ID NO:9335), GCGGGGTTGTTTAGATTTTGCGGGCG (SEQ ID NO:9336), GCGGGGTTGTTTAGATTTTGCGGGCGAG (SEQ ID NO:9337), CGGGGTTGTTTAGATTTTGCGGGCGA (SEQ ID NO:9338) |

FIGURE 5 CONTINUED

| | | |
|---|---|---|
| *Target990* | chr9:120507384-120507395 | CGCGTTCGTTCGTTCGTAGGATTTGGG (SEQ ID NO:9339), CGCGTTCGTTCGTTCGTAGGATTTGGGT (SEQ ID NO:9340), CGTAGGATTTGGGTAGTTTCGCGGGGA (SEQ ID NO:9341), TCGTAGGATTTGGGTAGTTTCGCGGGG (SEQ ID NO:9342), TCGTAGGATTTGGGTAGTTTCGCGGGGA (SEQ ID NO:9343), TGTATAATGGGTTGCGCGTAGAGTCGG (SEQ ID NO:9344), AGTAGTCGGCGGTTTGAAAGGAGGTTT (SEQ ID NO:9345), AAGTAGTCGGCGGTTTGAAAGGAGGTT (SEQ ID NO:9346), AAAGTAGTCGGCGGTTTGAAAGGAGGT (SEQ ID NO:9347), GCGTTAGTTGTATAATGGGTTGCGCGT (SEQ ID NO:9348) |
| *Target991* | chr9:120507402-120507434 | GGGTAGTTTCGCGGGGATTCGGTTTTGC (SEQ ID NO:9349), TGGGTAGTTTCGCGGGGATTCGGTTTT (SEQ ID NO:9350), TTGGGTAGTTTCGCGGGGATTCGGTTT (SEQ ID NO:9351), TTTGGGTAGTTTCGCGGGGATTCGGTT (SEQ ID NO:9352), GGTAGTTTCGCGGGGATTCGGTTTTGC (SEQ ID NO:9353), AGTAGTCGGCGGTTTGAAAGGAGGTTT (SEQ ID NO:9354), AAGTAGTCGGCGGTTTGAAAGGAGGTT (SEQ ID NO:9355), AAAGTAGTCGGCGGTTTGAAAGGAGGT (SEQ ID NO:9356), AGTCGGCGGTTTGAAAGGAGGTTTAGA (SEQ ID NO:9357), TGAAAGTAGTCGGCGGTTTGAAAGGAGG (SEQ ID NO:9358) |
| *Target992* | chr9:126776105-126776130 | GGAGTTCGGTTTGGGTTCGTGGTTGGC (SEQ ID NO:9359), GTGGGGGGAAGCGCGTCGTATGTTTTG (SEQ ID NO:9360), AATGGGTTTTTTGGGGTGGGGGGAAGC (SEQ ID NO:9361), GAGTTCGGTTTGGGTTCGTGGTTGGCG (SEQ ID NO:9362), TGGCGAGGGGTTGCGTAGGTAGGTTTGG (SEQ ID NO:9363), ACGGTATGGTTTGCGAAGGGAGGGAGG (SEQ ID NO:9364), GGACGGTATGGTTTGCGAAGGGAGGGA (SEQ ID NO:9365), AGGGAGGGAGGCGGAAGATAGTAGCGT (SEQ ID NO:9366), TGGACGGTATGGTTTGCGAAGGGAGGG (SEQ ID NO:9367), TTGCGAAGGGAGGGAGGCGGAAGATAG (SEQ ID NO:9368) |
| *Target993* | chr9:126776169-126776209 | GTGGGGGGAAGCGCGTCGTATGTTTTG (SEQ ID NO:9369), AATGGGTTTTTTGGGGTGGGGGGAAGC (SEQ ID NO:9370), TGGAAATGGGTTTTTTGGGGTGGGGGG (SEQ ID NO:9371), GGAAATGGGTTTTTTGGGGTGGGGGGA (SEQ ID NO:9372), GGGGGAAGCGCGTCGTATGTTTTGGTA (SEQ ID NO:9373), ACGGTATGGTTTGCGAAGGGAGGGAGG (SEQ ID NO:9374), GGACGGTATGGTTTGCGAAGGGAGGGA (SEQ ID NO:9375), AGGGAGGGAGGCGGAAGATAGTAGCGT (SEQ ID NO:9376), TGGACGGTATGGTTTGCGAAGGGAGGG (SEQ ID NO:9377), TTGCGAAGGGAGGGAGGCGGAAGATAG (SEQ ID NO:9378) |
| *Target994* | chr9:126776235-126776288 | AGGGAGTTGTGGGTGTCGGTTTTTCGG (SEQ ID NO:9379), GAGGGAGTTGTGGGTGTCGGTTTTTCG (SEQ ID NO:9380), GAGGGAGTTGTGGGTGTCGGTTTTTCG (SEQ ID NO:9381), AGAGGGAGTTGTGGGTGTCGGTTTTTCGG (SEQ ID NO:9382), AGAGGGAGTTGTGGGTGTCGGTTTTTCG (SEQ ID NO:9383), CGGCGCGGTTATTGTTGATGGACGGTA (SEQ ID NO:9384), CGGCGCGGTTATTGTTGATGGACGGT (SEQ ID NO:9385), CGGCGCGGTTATTGTTGATGGACGGTAT (SEQ ID NO:9386), GCGGCGCGGTTATTGTTGATGGACGGT (SEQ ID NO:9387), GCGGCGCGGTTATTGTTGATGGACGG (SEQ ID NO:9388) |
| *Target995* | chr9:126776345-126776386 | CGGTTGCGGGGGTAAGATTTCGGATCG (SEQ ID NO:9389), CGTCGGTTGCGGGGGTAAGATTTCGGA (SEQ ID NO:9390), GGTTGCGGGGGTAAGATTTCGGATCGT (SEQ ID NO:9391), GTCGGTTGCGGGGGTAAGATTTCGGAT (SEQ ID NO:9392), GCGTCGGTTGCGGGGGTAAGATTTCG (SEQ ID NO:9393), GGGGAGGGGTTTTGAGGGGTAGTTGGG (SEQ ID NO:9394), GGGGGAGGGGTTTTGAGGGGTAGTTGG (SEQ ID NO:9395), GGGGGGAGGGGTTTTGAGGGGTAGTTG (SEQ ID NO:9396), GAGATTGGGGGGGAGGGGTTTTGAGGGG (SEQ ID NO:9397), AGGGGTTTTGAGGGGTAGTTGGGTGGG (SEQ ID NO:9398) |
| *Target996* | chr9:126778240-126778255 | GGGTCGGGGAATTGGGGTAGCGAAGGAA (SEQ ID NO:9399), GTTGAGGGTCGGGAATTGGGGTAGCGA (SEQ ID NO:9400), CGAGGTAGGGCGGCGAGGGTTTTAAGA (SEQ ID NO:9401), AACGAGGTAGGGCGGCGAGGGTTTTAA (SEQ ID NO:9402), GAACGAGGTAGGGCGGCGAGGGTTTTA (SEQ ID NO:9403) |
| *Target997* | chr9:126778345-126778398 | AAGGGCGGTAGGTTTGGGGAATTCGGG (SEQ ID NO:9404), GGGCGGTAGGTTTGGGGAATTCGGGTT (SEQ ID NO:9405), GGCGGTAGGTTTGGGGAATTCGGGTTT (SEQ ID NO:9406), TAAGGGCGGTAGGTTTGGGGAATTCGGG (SEQ ID NO:9407), GCGGTAGGTTTGGGGAATTCGGGTTTGG (SEQ ID NO:9408), CGGCGCGAGGTTAGGTTTGTTTCGGTT (SEQ ID NO:9409), TCGGCGCGAGGTTAGGTTTGTTTCGGT (SEQ ID NO:9410), CGGCGCGAGGTTAGGTTTGTTTCGGTTT (SEQ ID NO:9411), CGGCGCGAGGTTAGGTTTGTTTCGGT (SEQ ID NO:9412), TCGGCGCGAGGTTAGGTTTGTTTCGG (SEQ ID NO:9413) |
| *Target998* | chr9:126778411-126778443 | TTTTTGGCGTTTGTTGGGGTGAGGGTCG (SEQ ID NO:9414), AAGGGCGGTAGGTTTGGGGAATTCGGG (SEQ ID NO:9415), GGGCGGTAGGTTTGGGGAATTCGGGTT (SEQ ID NO:9416), GGCGGTAGGTTTGGGGAATTCGGGTTT (SEQ ID NO:9417), TTTTTGGCGTTTGTTGGGGTGAGGGTCG (SEQ ID NO:9418), CGGCGCGAGGTTAGGTTTGTTTCGGTT (SEQ ID NO:9419), TCGGCGCGAGGTTAGGTTTGTTTCGGT (SEQ ID NO:9420), CGGCGCGAGGTTAGGTTTGTTTCGGTTT (SEQ ID NO:9421), CGGCGCGAGGTTAGGTTTGTTTCGGT (SEQ ID NO:9422), TCGGCGCGAGGTTAGGTTTGTTTCGG (SEQ ID NO:9423) |
| *Target999* | chr9:126778642-126778685 | GGTGGGGGGGTTTGGTTCGGATTTTCGG (SEQ ID NO:9424), GGTGAGGTGGGGGGGTTTGGTTCGGATT (SEQ ID NO:9425), GTGGGGGGGTTTGGTTCGGATTTTCGGT (SEQ ID NO:9426), AGGTGGGGGGGTTTGGTTCGGATTTTCG (SEQ ID NO:9427), GTGAGGTGGGGGGGTTTGGTTCGGATTT (SEQ ID NO:9428), CGGGTTTTGTAGATTTCGGGTAGATGTTGACGG (SEQ ID NO:9429), CGGGTTTTGTAGATTTCGGGTAGATGTTGACGGT (SEQ ID NO:9430), CGGGTTTTGTAGATTTCGGGTAGATGTTGACG (SEQ ID NO:9431), |

FIGURE 5 CONTINUED

TCGGGTTTTGTAGATTTCGGGTAGATGTTGACGG (SEQ ID NO:9432),
GGGTTTTGTAGATTTCGGGTAGATGTTGACGG (SEQ ID NO:9433)

| | | |
|---|---|---|
| Target1000 | chr9:127265555-127265560 | TCGTGCGTTTGAAGAAGTTTTGCGGGA (SEQ ID NO:9434), TGCGGGAGTTGAGAGTTAGCGAGGTTT (SEQ ID NO:9435), TTGCGGGAGTTGAGAGTTAGCGAGGTT (SEQ ID NO:9436), TTTGCGGGAGTTGAGAGTTAGCGAGGT (SEQ ID NO:9437), CGTGCGTTTGAAGAAGTTTTGCGGGAGT (SEQ ID NO:9438), CGTGTGAGAGTTGTAAGGTGAGCGGCG (SEQ ID NO:9439), ACGTGTGAGAGTTGTAAGGTGAGCGGC (SEQ ID NO:9440), CGTGTGCGGGGATAAGGTGTTCGGTTA (SEQ ID NO:9441), CGTGTGAGAGTTGTAAGGTGAGCGGCGA (SEQ ID NO:9442), GTGTGAGAGTTGTAAGGTGAGCGGCGA (SEQ ID NO:9443) |
| Target1001 | chr9:127265656-127265664 | CGGGGTATAGTTCGTTTAGGTTTTCGTCGT (SEQ ID NO:9444), CGGGGTATAGTTCGTTTAGGTTTTCGTCGTA (SEQ ID NO:9445), CGGGGTATAGTTCGTTTAGGTTTTCGTCGTAC (SEQ ID NO:9446), CGTGAGTAGTTCGTAGTGGTAGTCGGATATTTTG (SEQ ID NO:9447), AGTTCGTAGTGGTAGTCGGATATTTTGTTTTCGT (SEQ ID NO:9448), CGGTCGCGGGGATTTTAGGTTGTCGGT (SEQ ID NO:9449), GGTCGCGGGGATTTTAGGTTGTCGGTT (SEQ ID NO:9450), GCGGTCGCGGGGATTTTAGGTTGTCG (SEQ ID NO:9451), CGGTCGCGGGGATTTTAGGTTGTCGG (SEQ ID NO:9452), CGGACGTCGCGGGTATGGATTATTCGT (SEQ ID NO:9453) |
| Target1002 | chr9:127265764-127265817 | GTTTGCGGAGGGATAGCGGGTTAGGGA (SEQ ID NO:9454), TTTGCGGAGGGATAGCGGGTTAGGGAG (SEQ ID NO:9455), ATCGGTAGTTTGGGGTTTTCGCGGTCG (SEQ ID NO:9456), CGTTTGCGGAGGGATAGCGGGTTAGGG (SEQ ID NO:9457), GAGGGATAGCGGGTTAGGGAGGGTCGG (SEQ ID NO:9458), TCGGGCGCGGGGATTGTATCGGATTTA (SEQ ID NO:9459), GAGCGTGGGGTTTGGTAGGGGAAGGTC (SEQ ID NO:9460), GTCGGGCGCGGGGATTGTATCGGATTT (SEQ ID NO:9461), CGGGCGCGGGGATTGTATCGGATTTAT (SEQ ID NO:9462), AGCGTGGGGTTTGGTAGGGGAAGGTC (SEQ ID NO:9463) |
| Target1003 | chr9:127265835-127265843 | ATCGGTAGTTTGGGGTTTTCGCGGTCG (SEQ ID NO:9464), GATCGGTAGTTTGGGGTTTTCGCGGTCG (SEQ ID NO:9465), AGATCGGTAGTTTGGGGTTTTCGCGGT (SEQ ID NO:9466), TCGGTAGTTTGGGGTTTTCGCGGTCG (SEQ ID NO:9467), GGAGATCGGTAGTTTGGGGTTTTCGCGG (SEQ ID NO:9468), TCGGGCGCGGGGATTGTATCGGATTTA (SEQ ID NO:9469), GAGCGTGGGGTTTGGTAGGGGAAGGTC (SEQ ID NO:9470), GTCGGGCGCGGGGATTGTATCGGATTT (SEQ ID NO:9471), CGGGCGCGGGGATTGTATCGGATTTAT (SEQ ID NO:9472), GTTTTAGATCGGGCGCGACGGGGTTC (SEQ ID NO:9473) |
| Target1004 | chr9:127265928-127265933 | TAGCGTTTCGGGGTGGGTTCGGTGTAG (SEQ ID NO:9474), GTAGCGTTTCGGGGTGGGTTCGGTGTA (SEQ ID NO:9475), GGGTGGGTTCGGTGTAGTTTTCGCGTT (SEQ ID NO:9476), TCGGGGTGGGTTCGGTGTAGTTTTCGC (SEQ ID NO:9477), GGGGTGGGTTCGGTGTAGTTTTCGCGT (SEQ ID NO:9478), GTTTTAGATCGGGCGCGACGGGGTTC (SEQ ID NO:9479), GGTTTTAGATCGGGCGCGACGGGGTTC (SEQ ID NO:9480), GGTTTTAGATCGGGCGCGACGGGGTT (SEQ ID NO:9481), CGAGGGTTTTAGATCGGGCGCGACG (SEQ ID NO:9482), GAGGGTTTTAGATCGGGCGCGACGG (SEQ ID NO:9483) |
| Target1005 | chr9:132650532-132651124 | CGTTGGCGGGGGAGTTTATTGTGGAGT (SEQ ID NO:9484), AGTTGTTTCGGAAGGGTGGTGTGTGGT (SEQ ID NO:9485), GCGGGGGAGTTTATTGTGGAGTTGTGGG (SEQ ID NO:9486), GGCGGGGGAGTTTATTGTGGAGTTGTGG (SEQ ID NO:9487), TGGCGGGGGAGTTTATTGTGGAGTTGT (SEQ ID NO:9488), GGGGGGATTGTAAATCGTTTAGGGTTGCGG (SEQ ID NO:9489), GGGGGGATTGTAAATCGTTTAGGGTTGCGG (SEQ ID NO:9490), GGGGGGATTGTAAATCGTTTAGGGTTGCG (SEQ ID NO:9491), GGGGGGATTGTAAATCGTTTAGGGTTGCGGT (SEQ ID NO:9492), GGGGGGATTGTAAATCGTTTAGGGTTGCGGT (SEQ ID NO:9493) |
| Target1006 | chr9:133771616-133771649 | TCGGAGAGGATATGGGGTGGGTGGATA (SEQ ID NO:9494), TCGGAGAGGATATGGGGTGGGTGGAT (SEQ ID NO:9495), CGGAGAGGATATGGGGTGGGTGGATAT (SEQ ID NO:9496), TCGGAGAGGATATGGGGTGGGTGGATAT (SEQ ID NO:9497), TCGGAGAGGATATGGGGTGGGTGGA (SEQ ID NO:9498), TTTAGGGTATGCGGTGGGAGGGGTTGG (SEQ ID NO:9499), CGGTGGGAGGGGTTGGGGGGTTATAGGT (SEQ ID NO:9500), ATGCGGTGGGAGGGGTTGGGGGTTATA (SEQ ID NO:9501), TATGCGGTGGGAGGGGTTGGGGGTTAT (SEQ ID NO:9502), CGGTGGGAGGGGTTGGGGGTTATAGG (SEQ ID NO:9503) |
| Target1007 | chr9:135462376-135462397 | GGTTGGGTTCGGTTTTATCGTCGCGGT (SEQ ID NO:9504), AGGTTGGGTTCGGTTTTATCGTCGCGG (SEQ ID NO:9505), GGTTGGGTTCGGTTTTATCGTCGCGGT (SEQ ID NO:9506), AGGTTGGGTTCGGTTTTATCGTCGCGGTT (SEQ ID NO:9507), GTTGGGTTCGGTTTTATCGTCGCGGTT (SEQ ID NO:9508), CGAGAATTTTAGTTTTTGCGTCGCGTTCG (SEQ ID NO:9509), CGAAGTTGGCGAGAATTTTAGTTTTTGCGTCG (SEQ ID NO:9510), CGTTTTGTTCGCGTTTTTTGGAGGGATAAAC (SEQ ID NO:9511), GAAGTTGGCGAGAATTTTAGTTTTTGCGTCG (SEQ ID NO:9512), CGAAGTTGGCGAGAATTTTAGTTTTTGCGTC (SEQ ID NO:9513) |
| Target1008 | chr9:135462433-135462439 | GGTTGGGTTCGGTTTTATCGTCGCGGT (SEQ ID NO:9514), AGGTTGGGTTCGGTTTTATCGTCGCGG (SEQ ID NO:9515), GTTGGGTTCGGTTTTATCGTCGCGGTT (SEQ ID NO:9516), AGGTTGGGTTCGGTTTTATCGTCGCGGTT (SEQ ID NO:9517), GTTGGGTTCGGTTTTATCGTCGCGGTT (SEQ |

FIGURE 5 CONTINUED

Figure 5:
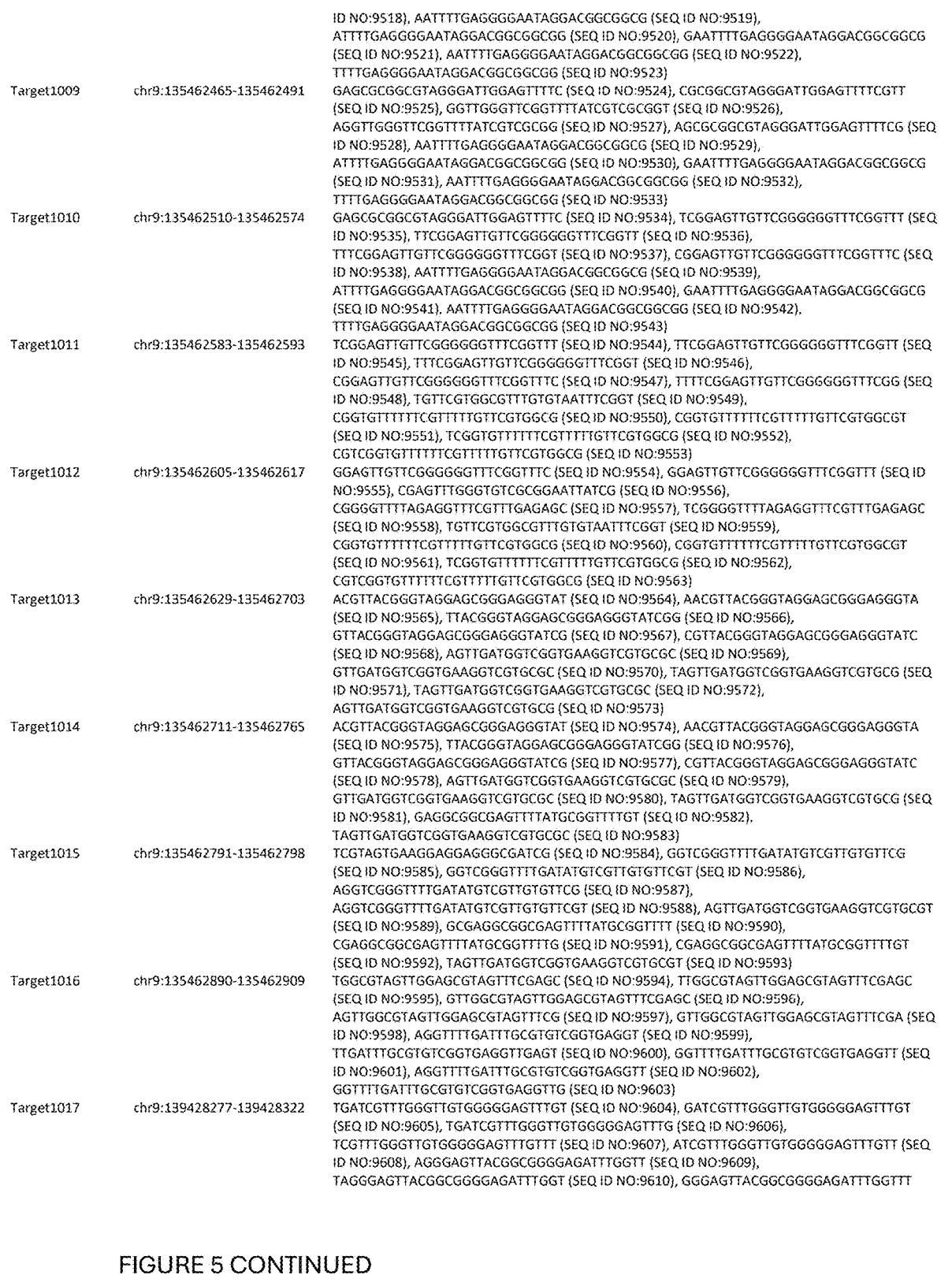

ID NO:9518), AATTTTGAGGGGAATAGGACGGCGGCG (SEQ ID NO:9519), ATTTTGAGGGGAATAGGACGGCGGCGG (SEQ ID NO:9520), GAATTTTGAGGGGAATAGGACGGCGGCG (SEQ ID NO:9521), AATTTTGAGGGGAATAGGACGGCGGCGG (SEQ ID NO:9522), TTTTGAGGGGAATAGGACGGCGGCGG (SEQ ID NO:9523)

Target1009        chr9:135462465-135462491        GAGCGCGGCGTAGGGGATTGGAGTTTTC (SEQ ID NO:9524), CGCGGCGTAGGGGATTGGAGTTTTCGTT (SEQ ID NO:9525), GGTTGGGTTCGGTTTTATCGTCGCGGT (SEQ ID NO:9526), AGGTTGGGTTCGGTTTTATCGTCGCGGT (SEQ ID NO:9527), AGCGCGGCGTAGGGGATTGGAGTTTTCG (SEQ ID NO:9528), AATTTTGAGGGGAATAGGACGGCGGCG (SEQ ID NO:9529), ATTTTGAGGGGAATAGGACGGCGGCGG (SEQ ID NO:9530), GAATTTTGAGGGGAATAGGACGGCGGCG (SEQ ID NO:9531), AATTTTGAGGGGAATAGGACGGCGGCGG (SEQ ID NO:9532), TTTTGAGGGGAATAGGACGGCGGCGG (SEQ ID NO:9533)

Target1010        chr9:135462510-135462574        GAGCGCGGCGTAGGGGATTGGAGTTTTC (SEQ ID NO:9534), TCGGAGTTGTTCGGGGGGGTTTCGGTTT (SEQ ID NO:9535), TTCGGAGTTGTTCGGGGGGGTTTCGGTT (SEQ ID NO:9536), TTTCGGAGTTGTTCGGGGGGGTTTCGGT (SEQ ID NO:9537), CGGAGTTGTTCGGGGGGGTTTCGGTTTC (SEQ ID NO:9538), AATTTTGAGGGGAATAGGACGGCGGCG (SEQ ID NO:9539), ATTTTGAGGGGAATAGGACGGCGGCGG (SEQ ID NO:9540), GAATTTTGAGGGGAATAGGACGGCGGCG (SEQ ID NO:9541), AATTTTGAGGGGAATAGGACGGCGGCGG (SEQ ID NO:9542), TTTTGAGGGGAATAGGACGGCGGCGG (SEQ ID NO:9543)

Target1011        chr9:135462583-135462593        TCGGAGTTGTTCGGGGGGGTTTCGGTTT (SEQ ID NO:9544), TTCGGAGTTGTTCGGGGGGGTTTCGGTT (SEQ ID NO:9545), TTTCGGAGTTGTTCGGGGGGGTTTCGGT (SEQ ID NO:9546), CGGAGTTGTTCGGGGGGGTTTCGGTTTC (SEQ ID NO:9547), TTTTCGGAGTTGTTCGGGGGGGTTTCGG (SEQ ID NO:9548), TGTTCGTGGCGTTTGTGTAATTTCGGT (SEQ ID NO:9549), CGGTGTTTTTTCGTTTTTGTTCGTGGCG (SEQ ID NO:9550), CGGTGTTTTTTCGTTTTTGTTCGTGGCGT (SEQ ID NO:9551), TCGGTGTTTTTTCGTTTTTGTTCGTGGCG (SEQ ID NO:9552), CGTCGGTGTTTTTTCGTTTTTGTTCGTGGCG (SEQ ID NO:9553)

Target1012        chr9:135462605-135462617        GGAGTTGTTCGGGGGGGTTTCGGTTTC (SEQ ID NO:9554), GGAGTTGTTCGGGGGGGTTTCGGTTT (SEQ ID NO:9555), CGAGTTTGGGTGTCGCGGAATTATCG (SEQ ID NO:9556), CGGGGGTTTTAGAGGTTTCGTTTGAGAGC (SEQ ID NO:9557), TCGGGGTTTTAGAGGTTTCGTTTGAGAGC (SEQ ID NO:9558), TGTTCGTGGCGTTTGTGTAATTTCGGT (SEQ ID NO:9559), CGGTGTTTTTTCGTTTTTGTTCGTGGCG (SEQ ID NO:9560), CGGTGTTTTTTCGTTTTTGTTCGTGGCGT (SEQ ID NO:9561), TCGGTGTTTTTTCGTTTTTGTTCGTGGCG (SEQ ID NO:9562), CGTCGGTGTTTTTTCGTTTTTGTTCGTGGCG (SEQ ID NO:9563)

Target1013        chr9:135462629-135462703        ACGTTACGGGTAGGAGCGGGAGGGTAT (SEQ ID NO:9564), AACGTTACGGGTAGGAGCGGGAGGGTA (SEQ ID NO:9565), TTACGGGTAGGAGCGGGAGGGTATCGG (SEQ ID NO:9566), GTTACGGGTAGGAGCGGGAGGGTATCGG (SEQ ID NO:9567), CGTTACGGGTAGGAGCGGGAGGGTATC (SEQ ID NO:9568), AGTTGATGGTCGGTGAAGGTCGTGCGC (SEQ ID NO:9569), GTTGATGGTCGGTGAAGGTCGTGCGC (SEQ ID NO:9570), TAGTTGATGGTCGGTGAAGGTCGTGCG (SEQ ID NO:9571), TAGTTGATGGTCGGTGAAGGTCGTGCGC (SEQ ID NO:9572), AGTTGATGGTCGGTGAAGGTCGTGCG (SEQ ID NO:9573)

Target1014        chr9:135462711-135462765        ACGTTACGGGTAGGAGCGGGAGGGTAT (SEQ ID NO:9574), AACGTTACGGGTAGGAGCGGGAGGGTA (SEQ ID NO:9575), TTACGGGTAGGAGCGGGAGGGTATCGG (SEQ ID NO:9576), GTTACGGGTAGGAGCGGGAGGGTATCG (SEQ ID NO:9577), CGTTACGGGTAGGAGCGGGAGGGTATC (SEQ ID NO:9578), AGTTGATGGTCGGTGAAGGTCGTGCGC (SEQ ID NO:9579), GTTGATGGTCGGTGAAGGTCGTGCGC (SEQ ID NO:9580), TAGTTGATGGTCGGTGAAGGTCGTGCG (SEQ ID NO:9581), GAGGCGGCGAGTTTTATGCGGTTTGT (SEQ ID NO:9582), TAGTTGATGGTCGGTGAAGGTCGTGCG (SEQ ID NO:9583)

Target1015        chr9:135462791-135462798        TCGTAGTGAAGGAGGAGGGCGATCG (SEQ ID NO:9584), GGTCGGGTTTTGATATGTCGTTGTGTTCG (SEQ ID NO:9585), GGTCGGGTTTTGATATGTCGTTGTGTTCGT (SEQ ID NO:9586), AGGTCGGGTTTTGATATGTCGTTGTGTTCG (SEQ ID NO:9587), AGGTCGGGTTTTGATATGTCGTTGTGTTCGT (SEQ ID NO:9588), AGTTGATGGTCGGTGAAGGTCGTGCGT (SEQ ID NO:9589), GCGAGGCGGCGAGTTTTATGCGGTTTT (SEQ ID NO:9590), CGAGGCGGCGAGTTTTATGCGGTTTTG (SEQ ID NO:9591), CGAGGCGGCGAGTTTTATGCGGTTTGT (SEQ ID NO:9592), TAGTTGATGGTCGGTGAAGGTCGTGCGT (SEQ ID NO:9593)

Target1016        chr9:135462890-135462909        TGGCGTAGTTGGAGCGTAGTTTCGAGC (SEQ ID NO:9594), TTGGCGTAGTTGGAGCGTAGTTTCGAGC (SEQ ID NO:9595), GTTGGCGTAGTTGGAGCGTAGTTTCGAGC (SEQ ID NO:9596), AGTTGGCGTAGTTGGAGCGTAGTTTCG (SEQ ID NO:9597), GTTGGCGTAGTTGGAGCGTAGTTTCGA (SEQ ID NO:9598), AGGTTTTGATTTGCGTGTCGGTGAGGT (SEQ ID NO:9599), TTGATTTGCGTGTCGGTGAGGTTGAGT (SEQ ID NO:9600), GGTTTTGATTTGCGTGTCGGTGAGGTT (SEQ ID NO:9601), AGGTTTTGATTTGCGTGTCGGTGAGGTT (SEQ ID NO:9602), GGTTTTGATTTGCGTGTCGGTGAGGTG (SEQ ID NO:9603)

Target1017        chr9:139428277-139428322        TGATCGTTTGGGTTGTGGGGGAGTTTGT (SEQ ID NO:9604), GATCGTTTGGGTTGTGGGGGAGTTTGT (SEQ ID NO:9605), TGATCGTTTGGGTTGTGGGGGAGTTTG (SEQ ID NO:9606), TCGTTTGGGTTGTGGGGGAGTTTGTT (SEQ ID NO:9607), ATCGTTTGGGTTGTGGGGGAGTTTGTT (SEQ ID NO:9608), AGGGAGTTACGGCGGGGAGATTTGGTT (SEQ ID NO:9609), TAGGGAGTTACGGCGGGGAGATTTGGT (SEQ ID NO:9610), GGGAGTTACGGCGGGGAGATTTGGTTT

FIGURE 5 CONTINUED (SEQ ID NO:9611), AGGGAGTTACGGCGGGGAGATTTGGTTT (SEQ ID NO:9612), AGGGAGTTACGGCGGGGAGATTTGGT (SEQ ID NO:9613)

Target1018  chr9:139428353-139428527  GGGCGGGTGTTTGTGGTTCGGGTTATG (SEQ ID NO:9614), TCGTCGTGGTTTTTTGGGCGGGTGTTT (SEQ ID NO:9615), TTCGTCGTGGTTTTTTGGGCGGGTGTT (SEQ ID NO:9616), TTTCGTCGTGGTTTTTTGGGCGGGTGT (SEQ ID NO:9617), TTTTTGGGCGGGTGTTTGTGGTTCGGG (SEQ ID NO:9618), AGGGAGTTACGGCGGGGAGATTTGGTT (SEQ ID NO:9619), TAGGGAGTTACGGCGGGGAGATTTGGT (SEQ ID NO:9620), GGGAGTTACGGCGGGGAGATTTGGTTT (SEQ ID NO:9621), AGGGAGTTACGGCGGGGAGATTTGGTTT (SEQ ID NO:9622), AGGGAGTTACGGCGGGGAGATTTGGT (SEQ ID NO:9623)

Target1019  chr10:555435-555454  TGGGTTGTGTGTGAGTTTTCGTTGCGG (SEQ ID NO:9624), TGGGTTGTGTGTGAGTTTTCGTTGCGGA (SEQ ID NO:9625), GGGTTGTGTGTGAGTTTTCGTTGCGGA (SEQ ID NO:9626), ATGGGTTGTGTGTGAGTTTTCGTTGCGG (SEQ ID NO:9627), GGGTTGTGTGTGAGTTTTCGTTGCGGAA (SEQ ID NO:9628)

Target1020  chr10:3514496-3514575  TGGGGATAGAGAGGGGGAAGGATGGTT (SEQ ID NO:9629), TTGGGGATAGAGAGGGGGAAGGATGGT (SEQ ID NO:9630), TGTTGGGGATAGAGAGGGGGAAGGATGGT (SEQ ID NO:9631), GTTGGGGATAGAGAGGGGGAAGGATGGT (SEQ ID NO:9632), TGTTGGGGATAGAGAGGGGGAAGGATGG (SEQ ID NO:9633)

Target1021  chr10:3514707-3514967  GGTCGGTAGGTTCGGGAAGTTTTTTCGT (SEQ ID NO:9634), GGTCGGTAGGTTCGGGAAGTTTTTTCG (SEQ ID NO:9635), AGGTCGGTAGGTTCGGGAAGTTTTTTCGT (SEQ ID NO:9636), AGGTCGGTAGGTTCGGGAAGTTTTTTCG (SEQ ID NO:9637), AAGGTCGGTAGGTTCGGGAAGTTTTTTCG (SEQ ID NO:9638), TGAATTTTACGTGGGATGGGTTTTGTTAGAGAGA (SEQ ID NO:9639), TTGAATTTTACGTGGGATGGGTTTTGTTAGAGAGA (SEQ ID NO:9640), TGAATTTTACGTGGGATGGGTTTTGTTAGAGAGAT (SEQ ID NO:9641), TTTGAATTTTACGTGGGATGGGTTTTGTTAGAGAGA (SEQ ID NO:9642), TGAATTTTACGTGGGATGGGTTTTGTTAGAGAGATT (SEQ ID NO:9643)

Target1022  chr10:6183284-6183576  CGTCGTATGGATTTGTAGAGGTAGTCGTTTTTGT (SEQ ID NO:9644), TCGTATGGATTTGTAGAGGTAGTCGTTTTTGTCG (SEQ ID NO:9645), TCGTCGTATGGATTTGTAGAGGTAGTCGTTTTTG (SEQ ID NO:9646), TCGTCGTATGGATTTGTAGAGGTAGTCGTTTTTGT (SEQ ID NO:9647), CGTCGTATGGATTTGTAGAGGTAGTCGTTTTTGTCG (SEQ ID NO:9648), AGGGCGGAGGGGGTTGGATTTGTTGAG (SEQ ID NO:9649), TAGGGCGGAGGGGGTTGGATTTGTTGA (SEQ ID NO:9650), GGGCGGAGGGGGTTGGATTTGTTGAGT (SEQ ID NO:9651), GGCGGAGGGGGTTGGATTTGTTGAGTT (SEQ ID NO:9652), TAGGGCGGAGGGGGTTGGATTTGTTGAG (SEQ ID NO:9653)

Target1023  chr10:6183594-6183800  TGGTTGATTTTGGTTGGTGGTGAGAGGA (SEQ ID NO:9654), TGTAGAGGTAGTCGTTTTTGTCGGGTGG (SEQ ID NO:9655), CGTTTTTGTCGGGTGGATTTGTTTTTCGCG (SEQ ID NO:9656), TGTAGAGGTAGTCGTTTTTGTCGGGTGGA (SEQ ID NO:9657), GTAGAGGTAGTCGTTTTTGTCGGGTGGA (SEQ ID NO:9658), TGGAGAGTTGGGAGAATTGGTTTTCGGT (SEQ ID NO:9659), TGGTGTTTGGAGAGTTGGGAGAATTGGT (SEQ ID NO:9660), TGGAGAGTTGGGAGAATTGGTTTTCGGTGT (SEQ ID NO:9661), GGAGAGTTGGGAGAATTGGTTTTCGGTGT (SEQ ID NO:9662), TGGAGAGTTGGGAGAATTGGTTTTCGGTG (SEQ ID NO:9663)

Target1024  chr10:7449679-7449756  GGTTTTTTAGCGTCGTTTCGGGATTTTCGG (SEQ ID NO:9664), CGGGCGGTCGATCGTTAGGGGTTAC (SEQ ID NO:9665), AGGTTTTTTAGCGTCGTTTCGGGATTTTCGG (SEQ ID NO:9666), TTTTTTAGCGTCGTTTCGGGATTTTCGGA (SEQ ID NO:9667), GGTTTTTTAGCGTCGTTTCGGGATTTTCGGA (SEQ ID NO:9668), CGTGGTTGATGGCGTTTGTGGTGTTCG (SEQ ID NO:9669), CGGTGTTCGTGGTTGATGGCGTTTGTG (SEQ ID NO:9670), GGTGTTCGTGGTTGATGGCGTTTGTGG (SEQ ID NO:9671), GGTGTTCGTGGTTGATGGCGTTTGTGGT (SEQ ID NO:9672), CGTGGTTGATGGCGTTTGTGGTGTTCGA (SEQ ID NO:9673)

Target1025  chr10:7449774-7449898  TGCGTTTCGAGTTTTTAGGTGTTAGAGCG (SEQ ID NO:9674), TTTTTTAGCGTCGTTTCGGGATTTTCGGA (SEQ ID NO:9675), GGTTTTTTAGCGTCGTTTCGGGATTTTCGGA (SEQ ID NO:9676), GGTGCGTTTCGAGTTTTTAGGTGTTAGAGCG (SEQ ID NO:9677), TGGTGCGTTTCGAGTTTTTAGGTGTTAGAGCG (SEQ ID NO:9678), TGGGGAGGAGGGAGGAGTCGAGATTGG (SEQ ID NO:9679), GGGAGGAGGGAGGAGTCGAGATTGGGT (SEQ ID NO:9680), GGTGGGGAGGAGGGAGGAGTCGAGATT (SEQ ID NO:9681), TTTTGGTGGGGAGGAGGGAGGAGTCGA (SEQ ID NO:9682), TTTGGTGGGGAGGAGGGAGGAGTCGAG (SEQ ID NO:9683)

Target1026  chr10:7450019-7450043  GGTGGTCGGTCGGGTTTTTGTTTAGTT (SEQ ID NO:9684), GGTCGGTCGGGTTTTTGTTTAGTTTCGGT (SEQ ID NO:9685), TGGTCGGTCGGGTTTTTGTTTAGTTTCGG (SEQ ID NO:9686), GGTCGGTCGGGTTTTTGTTTAGTTTCGG (SEQ ID NO:9687), TGGTCGGTCGGGTTTTTGTTTAGTTTCGGT (SEQ ID NO:9688), CGCGAGGTGGGGAGTAGTTTAAAATGGT (SEQ ID NO:9689), CGCGAGGTGGGGAGTAGTTTAAAATGGTT (SEQ ID NO:9690), CGCGAGGTGGGGAGTAGTTTAAAATGGTTT (SEQ ID NO:9691), TGGTTTTGTGTTGCGAAGTTGTAGTTTTAGTCG (SEQ ID NO:9692), ATGGTTTTGTGTTGCGAAGTTGTAGTTTTAGTCG (SEQ ID NO:9693)

FIGURE 5 CONTINUED

Target1027    chr10:7450049-7450202    GCGACGTTAGGAGGATAAGGGGAGGGG (SEQ ID NO:9694), GGCGACGTTAGGAGGATAAGGGGAGGG (SEQ ID NO:9695), TCGCGGGGTTTATGGGAAAGTCGGTTT (SEQ ID NO:9696), GCGACGTTAGGAGGATAAGGGGAGGGGT (SEQ ID NO:9697), CGACGTTAGGAGGATAAGGGGAGGGGT (SEQ ID NO:9698), TGGGTTTCGCGAGGTGGGGAGTAGTT (SEQ ID NO:9699), ATGGGTTTCGCGAGGTGGGGAGTAGTT (SEQ ID NO:9700), TATGGGTTTCGCGAGGTGGGGAGTAGT (SEQ ID NO:9701), ATGGGTTTCGCGAGGTGGGGAGTAGTT (SEQ ID NO:9702), TGGGTTTCGCGAGGTGGGGAGTAGTT (SEQ ID NO:9703)

Target1028    chr10:7454983-7454990    ATAGCGGGGTTTGTGGAAAGGGAGGGG (SEQ ID NO:9704), GGGTTTGTGGAAAGGGAGGGGTCGAGA (SEQ ID NO:9705), GGGGTTTGTGGAAAGGGAGGGGTCGAG (SEQ ID NO:9706), GGGTTTGTGGAAAGGGAGGGGTCGAGAG (SEQ ID NO:9707), GGGGTTTGTGGAAAGGGAGGGGTCGA (SEQ ID NO:9708), GCGCGGGTTAAGAGTGGGAGGTTTAGG (SEQ ID NO:9709), AGCGCGGGTTAAGAGTGGGAGGTTTAGG (SEQ ID NO:9710), CGCGGGTTAAGAGTGGGAGGTTTAGGGT (SEQ ID NO:9711), CGCGGGTTAAGAGTGGGAGGTTTAGGG (SEQ ID NO:9712), GTAGCGCGGGTTAAGAGTGGGAGGTTT (SEQ ID NO:9713)

Target1029    chr10:7455034-7455064    ATAGCGGGGTTTGTGGAAAGGGAGGGG (SEQ ID NO:9714), GGGTTTGTGGAAAGGGAGGGGTCGAGA (SEQ ID NO:9715), GGGGTTTGTGGAAAGGGAGGGGTCGAG (SEQ ID NO:9716), GGGTTTGTGGAAAGGGAGGGGTCGAGAG (SEQ ID NO:9717), GGGGTTTGTGGAAAGGGAGGGGTCGA (SEQ ID NO:9718), TGCGGGGTTAGGGTTATTGGGTAGGCG (SEQ ID NO:9719), GCGGGGTTAGGGTTATTGGGTAGGCGT (SEQ ID NO:9720), CGCGGGTTTGGGACGTAAATGGGAGGGA (SEQ ID NO:9721), GCGGTTTGGGACGTAAATGGGAGGGAG (SEQ ID NO:9722), GCGCGGGTTAAGAGTGGGAGGTTTAGG (SEQ ID NO:9723)

Target1030    chr10:7455069-7455179    ATAGCGGGGTTTGTGGAAAGGGAGGGG (SEQ ID NO:9724), GGGTTTGTGGAAAGGGAGGGGTCGAGA (SEQ ID NO:9725), GGGGTTTGTGGAAAGGGAGGGGTCGAG (SEQ ID NO:9726), GGGTTTGTGGAAAGGGAGGGGTCGAGAG (SEQ ID NO:9727), GGGGTTTGTGGAAAGGGAGGGGTCGA (SEQ ID NO:9728), TGCGGGGTTAGGGTTATTGGGTAGGCG (SEQ ID NO:9729), GCGGGGTTAGGGTTATTGGGTAGGCGT (SEQ ID NO:9730), CGCGGGTTTGGGACGTAAATGGGAGGGA (SEQ ID NO:9731), GCGGTTTGGGACGTAAATGGGAGGGAG (SEQ ID NO:9732), GCGCGGGTTAAGAGTGGGAGGTTTAGG (SEQ ID NO:9733)

Target1031    chr10:7455186-7455205    GCGTTGCGTTTATTTAGTGGTTTTGGTTTCG (SEQ ID NO:9734), GCGTTGCGTTTATTTAGTGGTTTTGGTTTCGT (SEQ ID NO:9735), GCGTTTATTTAGTGGTTTTGGTTTCGTAGGGC (SEQ ID NO:9736), TGCGTTTATTTAGTGGTTTTGGTTCGTAGGGC (SEQ ID NO:9737), TGCGTTTATTTAGTGGTTTTGGTTCGTAGGG (SEQ ID NO:9738), TCGGGAAGTTTTGCGTTGGTATTAGGGT (SEQ ID NO:9739), TTCGGGAAGTTTTGCGTTGGTATTAGGGT (SEQ ID NO:9740), CGGGAAGTTTTGCGTTGGTATTAGGGTAAGCG (SEQ ID NO:9741), TCGGGAAGTTTTGCGTTGGTATTAGGGTA (SEQ ID NO:9742), TTTCGGGAAGTTTTGCGTTGGTATTAGGGT (SEQ ID NO:9743)

Target1032    chr10:8094268-8094297    GGTGAGGAGGTTTTTCGGTGTAAGGGGC (SEQ ID NO:9744), TGAGGAGGTTTTTCGGTGTAAGGGCGT (SEQ ID NO:9745), GTGAGGAGGTTTTTCGGTGTAAGGGCGT (SEQ ID NO:9746), GTGAGGAGGTTTTTCGGTGTAAGGGCG (SEQ ID NO:9747), TGGTGAGGAGGTTTTTCGGTGTAAGGGCG (SEQ ID NO:9748)

Target1033    chr10:8094328-8094348    GGTGAGGAGGTTTTTCGGTGTAAGGGCG (SEQ ID NO:9749), TGAGGAGGTTTTTCGGTGTAAGGGCGT (SEQ ID NO:9750), GTGAGGAGGTTTTTCGGTGTAAGGGCGT (SEQ ID NO:9751), GTGAGGAGGTTTTTCGGTGTAAGGGCG (SEQ ID NO:9752), TGGTGAGGAGGTTTTTCGGTGTAAGGGCG (SEQ ID NO:9753)

Target1034    chr10:8094431-8094448    GCGGATAGGCGTTTTTGTATCGGAAGGT (SEQ ID NO:9754), GCGGATAGGCGTTTTTGTATCGGAAGG (SEQ ID NO:9755), GCGGATAGGCGTTTTTGTATCGGAAGGTT (SEQ ID NO:9756), GCGGATAGGCGTTTTTGTATCGGAAGGTTT (SEQ ID NO:9757), GCGGATAGGCGTTTTTGTATCGGAAGGTTTT (SEQ ID NO:9758), AGTTGTTATGGGTTTTGCGCGCGGAGA (SEQ ID NO:9759), AAGTTGTTATGGGTTTTGCGCGCGGAG (SEQ ID NO:9760), GTTGTTATGGGTTTTGCGCGCGGAGAT (SEQ ID NO:9761), AAGTTGTTATGGGTTTTGCGCGCGGAGA (SEQ ID NO:9762), AATCGAGGGGTGGATGCGTTACGTAGC (SEQ ID NO:9763)

Target1035    chr10:8094463-8094483    TTTTTTCGGTTTTGAGGTTTTCGCGCG (SEQ ID NO:9764), TTTTTCGGTTTTGAGGTTTTCGCGCG (SEQ ID NO:9765), TTTTCGGTTTTGAGGTTTTCGCGCG (SEQ ID NO:9766), AGTTGTTATGGGTTTTGCGCGCGGAGA (SEQ ID NO:9767), AAGTTGTTATGGGTTTTGCGCGCGGAG (SEQ ID NO:9768), GTTGTTATGGGTTTTGCGCGCGGAGAT (SEQ ID NO:9769), AAGTTGTTATGGGTTTTGCGCGCGGAGA (SEQ ID NO:9770), AATCGAGGGGTGGATGCGTTACGTAGC (SEQ ID NO:9771)

Target1036    chr10:8094513-8094540    ACGCGTGGTTGTGAGTTGGGTTTACGT (SEQ ID NO:9772), ACGCGTGGTTGTGAGTTGGGTTTACGTT (SEQ ID NO:9773), CGCGTGGTTGTGAGTTGGGTTTACGTT (SEQ ID NO:9774), TGGTTTTACGCGTGGTTGTGAGTTGGGT (SEQ ID NO:9775), GGTTTTACGCGTGGTTGTGAGTTGGGT (SEQ ID NO:9776), AATCGAGGGGTGGATGCGTTACGTAGC (SEQ ID NO:9777), ATCGAGGGGTGGATGCGTTACGTAGC (SEQ ID NO:9778), TAATCGAGGGGTGGATGCGTTACGTAGC (SEQ ID NO:9779), GTTAATCGAGGGGTGGATGCGTTACGT (SEQ ID NO:9780), TCGAGGGGTGGATGCGTTACGTAGC (SEQ ID NO:9781)

FIGURE 5 CONTINUED

Target1037    chr10:8529520-8529624    TGATAGTTTTCGGGAGGATTGTTTGGTTTTTGTT (SEQ ID NO:9782),
TTGATAGTTTTCGGGAGGATTGTTTGGTTTTTGT (SEQ ID NO:9783),
TGATAGTTTTCGGGAGGATTGTTTGGTTTTTGTTT (SEQ ID NO:9784),
TTGATAGTTTTCGGGAGGATTGTTTGGTTTTTGTT (SEQ ID NO:9785),
ATTGATAGTTTTCGGGAGGATTGTTTGGTTTTTGT (SEQ ID NO:9786)

Target1038    chr10:23480706-23480716    AGTTTTTAGTAGAATTTAGGTCGGAGTTTCGCGT (SEQ ID NO:9787),
CGTAGTGGGAGTGGGTTCGGATTATTTTTTAATG (SEQ ID NO:9788),
CGTAGTGGGAGTGGGTTCGGATTATTTTTTAATGA (SEQ ID NO:9789),
AAGTTTTTAGTAGAATTTAGGTCGGAGTTTCGCGT (SEQ ID NO:9790),
GAAGTTTTTAGTAGAATTTAGGTCGGAGTTTCGCG (SEQ ID NO:9791),
TCGCGGTAGTTTGGGTAATTTAAGGGTGT (SEQ ID NO:9792), AGGGTGTTGTTTTTAGGGATTAGGTGGGT
(SEQ ID NO:9793), GGGTGTTGTTTTTAGGGATTAGGTGGGTGT (SEQ ID NO:9794),
AGGGTGTTGTTTTTAGGGATTAGGTGGGTG (SEQ ID NO:9795),
AGGGTGTTGTTTTTAGGGATTAGGTGGGTGT (SEQ ID NO:9796)

Target1039    chr10:23480784-23480815    ATTTCGGATAAGGGGGTGGCGGAATGT (SEQ ID NO:9797), TTTCGGATAAGGGGGTGGCGGAATGTA
(SEQ ID NO:9798), TCGGATAAGGGGGTGGCGGAATGTATT (SEQ ID NO:9799),
TTCGGATAAGGGGGTGGCGGAATGTAT (SEQ ID NO:9800), TTTCGGATAAGGGGGTGGCGGAATGT (SEQ
ID NO:9801), TTTAGGGGTGCGCGTCGGTGGTTTAGA (SEQ ID NO:9802),
GTTTTTAGGGGTGCGCGTCGGTGGTTT (SEQ ID NO:9803), GAAGTTTTTAGGGGTGCGCGTCGGTGG (SEQ
ID NO:9804), AGAAGTTTTTAGGGGTGCGCGTCGGTG (SEQ ID NO:9805),
TTAGGGGTGCGCGTCGGTGGTTAGAC (SEQ ID NO:9806)

Target1040    chr10:23480820-23481032    GGCGCGCGGTTGTTTTAGTTTTTAGGGC (SEQ ID NO:9807), CGGCGCGCGGTTGTTTTAGTTTTTAGGG (SEQ
ID NO:9808), ATTTCGGATAAGGGGGTGGCGGAATGT (SEQ ID NO:9809),
CGGCGCGCGGTTGTTTTAGTTTTTAGGGC (SEQ ID NO:9810), TTTCGGATAAGGGGGTGGCGGAATGTA
(SEQ ID NO:9811), TTTAGGGGTGCGCGTCGGTGGTTTAGA (SEQ ID NO:9812),
GTTTTTAGGGGTGCGCGTCGGTGGTTT (SEQ ID NO:9813), GAAGTTTTTAGGGGTGCGCGTCGGTGG (SEQ
ID NO:9814), GAGTTTTTGGGGCGAGGAAAAGGCGGG (SEQ ID NO:9815),
GGAGTTTTTGGGGCGAGGAAAAGGCGG (SEQ ID NO:9816)

Target1041    chr10:23481051-23481062    AGGGAAGAGAGCGGTGCGAGGAGTTTC (SEQ ID NO:9817), GAGGGAAGAGAGCGGTGCGAGGAGTTT
(SEQ ID NO:9818), TAGAGGAGAGGGAAGAGAGCGGTGCGA (SEQ ID NO:9819),
GTAGAGGAGAGGGAAGAGAGCGGTGCG (SEQ ID NO:9820), AGAGGGAAGAGAGCGGTGCGAGGAGTT
(SEQ ID NO:9821), GAGTTTTTGGGGCGAGGAAAAGGCGGG (SEQ ID NO:9822),
GGAGTTTTTGGGGCGAGGAAAAGGCGG (SEQ ID NO:9823), GGGAGTTTTTGGGGCGAGGAAAAGGCG
(SEQ ID NO:9824), TGGGAGTTTTTGGGGCGAGGAAAAGGC (SEQ ID NO:9825),
AGTTTTTGGGGCGAGGAAAAGGCGGG (SEQ ID NO:9826)

Target1042    chr10:23481124-23481143    AGGGAAGAGAGCGGTGCGAGGAGTTTC (SEQ ID NO:9827), GAGGGAAGAGAGCGGTGCGAGGAGTTT
(SEQ ID NO:9828), TAGAGGAGAGGGAAGAGAGCGGTGCGA (SEQ ID NO:9829),
GTAGAGGAGAGGGAAGAGAGCGGTGCG (SEQ ID NO:9830), AGAGGGAAGAGAGCGGTGCGAGGAGTT
(SEQ ID NO:9831), TGGGGAGGGTTGTGGCGGATTTTTTGG (SEQ ID NO:9832),
GGGGAGGGTTGTGGCGGATTTTTTGGA (SEQ ID NO:9833), GGGGAGGGTTGTGGCGGATTTTTTGGAG
(SEQ ID NO:9834), TTGGGGAGGGTTGTGGCGGATTTTTTGG (SEQ ID NO:9835),
TGGGGAGGGTTGTGGCGGATTTTTTGGA (SEQ ID NO:9836)

Target1043    chr10:23481145-23481230    TGGTTGGCGCGATGGGTTTTTGGTACG (SEQ ID NO:9837), CGTTTTGATTGGTTGGCGCGATGGGTT (SEQ
ID NO:9838), TGATTGGTTGGCGCGATGGGTTTTTGGT (SEQ ID NO:9839),
GATTGGTTGGCGCGATGGGTTTTTGGT (SEQ ID NO:9840), TGATTGGTTGGCGCGATGGGTTTTTGG (SEQ
ID NO:9841), CGTTGGGGAGGGTTGTGGCGGATTTTT (SEQ ID NO:9842),
TGGGGAGGGTTGTGGCGGATTTTTTGG (SEQ ID NO:9843), GGGGAGGGTTGTGGCGGATTTTTTGGA
(SEQ ID NO:9844), CGTTGGGGAGGGTTGTGGCGGATTTTT (SEQ ID NO:9845),
GGGGAGGGTTGTGGCGGATTTTTTGGAG (SEQ ID NO:9846)

Target1044    chr10:28034313-28034373    CGTAAGGGGTTCGGGGGCGTGTGAATT (SEQ ID NO:9847), CGTAAGGGGTTCGGGGGCGTGTGAATTA
(SEQ ID NO:9848), GTAAGGGGTTCGGGGGCGTGTGAATTA (SEQ ID NO:9849),
CGTAAGGGGTTCGGGGGCGTGTGAAT (SEQ ID NO:9850), GTAAGGGGTTCGGGGGCGTGTGAATT (SEQ
ID NO:9851), AGTGATTTGAGAAGAGGCGCGGGTGGT (SEQ ID NO:9852),
TCGGCGTTGGGGGAGGGGGATATTTTT (SEQ ID NO:9853), GTCGGCGTTGGGGGAGGGGGATATTTT
(SEQ ID NO:9854), GTGATTTGAGAAGAGGCGCGGGTGGTC (SEQ ID NO:9855),
CGGCGTTGGGGGAGGGGGATATTTTTG (SEQ ID NO:9856)

Target1045    chr10:28034442-28034470    AGTAAAGGAGGCGCGGTTAGGTGGGTT (SEQ ID NO:9857), AAGTAAAGGAGGCGCGGTTAGGTGGGT
(SEQ ID NO:9858), AAAGGAGGCGCGGTTAGGTGGGTTTTT (SEQ ID NO:9859),
GTAAAGGAGGCGCGGTTAGGTGGGTTT (SEQ ID NO:9860), AGTAAAGGAGGCGCGGTTAGGTGGGTTT
(SEQ ID NO:9861), AGGTTTGGTGGAGAGGCGTTCGGGTAG (SEQ ID NO:9862),
AAGGTTTGGTGGAGAGGCGTTCGGGTA (SEQ ID NO:9863), TAAGGTTTGGTGGAGAGGCGTTCGGGT
(SEQ ID NO:9864), GGTTTTTGCGTTTTGGGCGTCGGTGTT (SEQ ID NO:9865),
TTGGTTTTTGCGTTTTGGGCGTCGGTG (SEQ ID NO:9866)

Target1046    chr10:28034494-28034506    AGTAAAGGAGGCGCGGTTAGGTGGGTT (SEQ ID NO:9867), AAGTAAAGGAGGCGCGGTTAGGTGGGT
(SEQ ID NO:9868), AAAGGAGGCGCGGTTAGGTGGGTTTTT (SEQ ID NO:9869),
GTAAAGGAGGCGCGGTTAGGTGGGTTT (SEQ ID NO:9870), AGTAAAGGAGGCGCGGTTAGGTGGGTTT

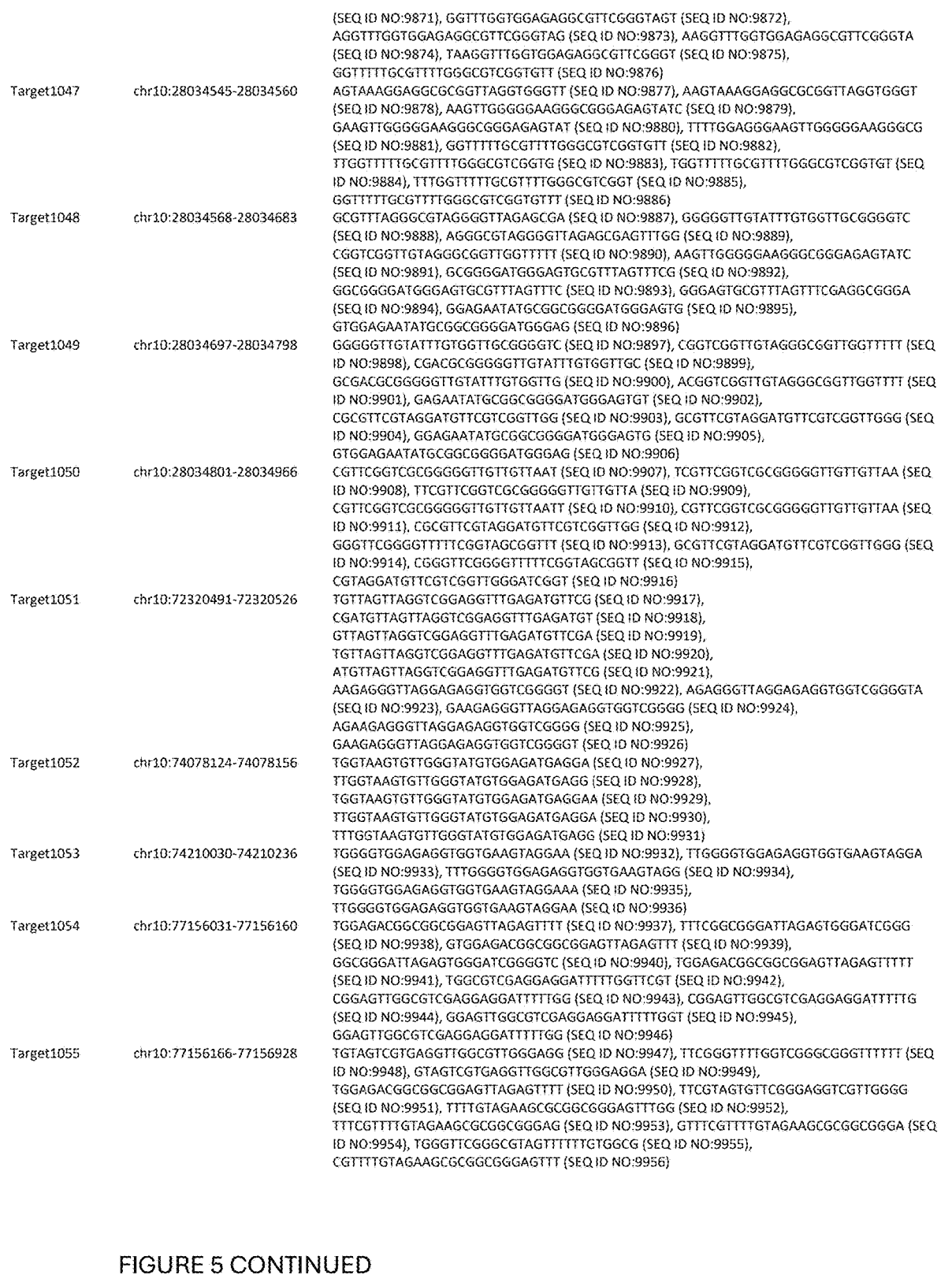

FIGURE 5 CONTINUED (SEQ ID NO:9871), GGTTTGGTGGAGAGGCGTTCGGGTAGT (SEQ ID NO:9872),
AGGTTTGGTGGAGAGGCGTTCGGGTAG (SEQ ID NO:9873), AAGGTTTGGTGGAGAGGCGTTCGGGTA
(SEQ ID NO:9874), TAAGGTTTGGTGGAGAGGCGTTCGGGT (SEQ ID NO:9875),
GGTTTTTGCGTTTTGGGCGTCGGTGTT (SEQ ID NO:9876)

| Target1047 | chr10:28034545-28034560 | AGTAAAGGAGGCGCGGTTAGGTGGGTT (SEQ ID NO:9877), AAGTAAAGGAGGCGCGGTTAGGTGGGT (SEQ ID NO:9878), AAGTTGGGGGAAGGGCGGGAGAGTATC (SEQ ID NO:9879), GAAGTTGGGGGAAGGGCGGGAGAGTAT (SEQ ID NO:9880), TTTTGGAGGGAAGTTGGGGGAAGGGCG (SEQ ID NO:9881), GGTTTTTGCGTTTTGGGCGTCGGTGTT (SEQ ID NO:9882), TTGGTTTTTGCGTTTTGGGCGTCGGTG (SEQ ID NO:9883), TGGTTTTTGCGTTTTGGGCGTCGGTGT (SEQ ID NO:9884), TTTGGTTTTTGCGTTTTGGGCGTCGGT (SEQ ID NO:9885), GGTTTTTGCGTTTTGGGCGTCGGTGTTT (SEQ ID NO:9886) |
|---|---|---|
| Target1048 | chr10:28034568-28034683 | GCGTTTAGGGCGTAGGGGTTAGAGCGA (SEQ ID NO:9887), GGGGGTTGTATTTGTGGTTGCGGGGTC (SEQ ID NO:9888), AGGGCGTAGGGGTTAGAGCGAGTTTGG (SEQ ID NO:9889), CGGTCGGTTGTAGGGCGGTTGGTTTTT (SEQ ID NO:9890), AAGTTGGGGGAAGGGCGGGAGAGTATC (SEQ ID NO:9891), GCGGGGATGGGAGTGCGTTTAGTTTCG (SEQ ID NO:9892), GGCGGGGATGGGAGTGCGTTTAGTTTC (SEQ ID NO:9893), GGGAGTGCGTTTAGTTTCGGAGGCGGGA (SEQ ID NO:9894), GGAGAATATGCGGCGGGGATGGGAGTG (SEQ ID NO:9895), GTGGAGAATATGCGGCGGGGATGGGAG (SEQ ID NO:9896) |
| Target1049 | chr10:28034697-28034798 | GGGGGTTGTATTTGTGGTTGCGGGGTC (SEQ ID NO:9897), CGGTCGGTTGTAGGGCGGTTGGTTTTT (SEQ ID NO:9898), CGACGCGGGGGTTGTATTTGTGGTTGC (SEQ ID NO:9899), GCGACGCGGGGGTTGTATTTGTGGTTG (SEQ ID NO:9900), ACGGTCGGTTGTAGGGCGGTTGGTTTT (SEQ ID NO:9901), GAGAATATGCGGCGGGGATGGGAGTGT (SEQ ID NO:9902), CGCGTTCGTAGGATGTTCGTCGGTTGG (SEQ ID NO:9903), GCGTTCGTAGGATGTTCGTCGGTTGGG (SEQ ID NO:9904), GGAGAATATGCGGCGGGGATGGGAGTG (SEQ ID NO:9905), GTGGAGAATATGCGGCGGGGATGGGAG (SEQ ID NO:9906) |
| Target1050 | chr10:28034801-28034966 | CGTTCGGTCGCGGGGGTTGTTGTTAAT (SEQ ID NO:9907), TCGTTCGGTCGCGGGGGTTGTTGTTAA (SEQ ID NO:9908), TTCGTTCGGTCGCGGGGGTTGTTGTTA (SEQ ID NO:9909), CGTTCGGTCGCGGGGGTTGTTGTTAATT (SEQ ID NO:9910), CGTTCGGTCGCGGGGGTTGTTGTTAA (SEQ ID NO:9911), CGCGTTCGTAGGATGTTCGTCGGTTGG (SEQ ID NO:9912), GGGTTCGGGGTTTTTCGGTAGCGGTTT (SEQ ID NO:9913), GCGTTCGTAGGATGTTCGTCGGTTGGG (SEQ ID NO:9914), CGGGTTCGGGGTTTTTCGGTAGCGGTT (SEQ ID NO:9915), CGTAGGATGTTCGTCGGTTGGGATCGGT (SEQ ID NO:9916) |
| Target1051 | chr10:72320491-72320526 | TGTTAGTTAGGTCGGAGGTTTGAGATGTTCG (SEQ ID NO:9917), CGATGTTAGTTAGGTCGGAGGTTTGAGATGT (SEQ ID NO:9918), GTTAGTTAGGTCGGAGGTTTGAGATGTTCGA (SEQ ID NO:9919), TGTTAGTTAGGTCGGAGGTTTGAGATGTTCGA (SEQ ID NO:9920), ATGTTAGTTAGGTCGGAGGTTTGAGATGTTCG (SEQ ID NO:9921), AAGAGGGTTAGGAGAGGTGGTCGGGGT (SEQ ID NO:9922), AGAGGGTTAGGAGAGGTGGTCGGGGTA (SEQ ID NO:9923), GAAGAGGGTTAGGAGAGGTGGTCGGGG (SEQ ID NO:9924), AGAAGAGGGTTAGGAGAGGTGGTCGGGG (SEQ ID NO:9925), GAAGAGGGTTAGGAGAGGTGGTCGGGGT (SEQ ID NO:9926) |
| Target1052 | chr10:74078124-74078156 | TGGTAAGTGTTGGGTATGTGGAGATGAGGA (SEQ ID NO:9927), TTGGTAAGTGTTGGGTATGTGGAGATGAGG (SEQ ID NO:9928), TGGTAAGTGTTGGGTATGTGGAGATGAGGAA (SEQ ID NO:9929), TTGGTAAGTGTTGGGTATGTGGAGATGAGGA (SEQ ID NO:9930), TTTGGTAAGTGTTGGGTATGTGGAGATGAGG (SEQ ID NO:9931) |
| Target1053 | chr10:74210030-74210236 | TGGGGTGGAGAGGTGGTGAAGTAGGAA (SEQ ID NO:9932), TTGGGGTGGAGAGGTGGTGAAGTAGGA (SEQ ID NO:9933), TTTGGGGTGGAGAGGTGGTGAAGTAGG (SEQ ID NO:9934), TGGGGTGGAGAGGTGGTGAAGTAGGAAA (SEQ ID NO:9935), TTGGGGTGGAGAGGTGGTGAAGTAGGAA (SEQ ID NO:9936) |
| Target1054 | chr10:77156031-77156160 | TGGAGACGGCGGCGGAGTTAGAGTTTT (SEQ ID NO:9937), TTTCGGCGGGATTAGAGTGGGATCGGG (SEQ ID NO:9938), GTGGAGACGGCGGCGGAGTTAGAGTTT (SEQ ID NO:9939), GGCGGGATTAGAGTGGGATCGGGGTC (SEQ ID NO:9940), TGGAGACGGCGGCGGAGTTAGAGTTTTT (SEQ ID NO:9941), TGGCGTCGAGGAGGATTTTTGGTTCGT (SEQ ID NO:9942), CGGAGTTGGCGTCGAGGAGGATTTTTGG (SEQ ID NO:9943), CGGAGTTGGCGTCGAGGAGGATTTTTG (SEQ ID NO:9944), GGAGTTGGCGTCGAGGAGGATTTTTGGT (SEQ ID NO:9945), GGAGTTGGCGTCGAGGAGGATTTTTGG (SEQ ID NO:9946) |
| Target1055 | chr10:77156166-77156928 | TGTAGTCGTGAGGTTGGCGTTGGGAGG (SEQ ID NO:9947), TTCGGGTTTTTGGTCGGGCGGGTTTTTT (SEQ ID NO:9948), GTAGTCGTGAGGTTGGCGTTGGGAGGA (SEQ ID NO:9949), TGGAGACGGCGGCGGAGTTAGAGTTTT (SEQ ID NO:9950), TTCGTAGTGTTCGGGGAGGTCGTTGGGG (SEQ ID NO:9951), TTTTGTAGAAGCGCGGCGGGAGTTTGG (SEQ ID NO:9952), TTTCGTTTTGTAGAAGCGCGGCGGGAG (SEQ ID NO:9953), GTTTCGTTTTGTAGAAGCGCGGCGGGA (SEQ ID NO:9954), TGGGTTCGGGCGTAGTTTTTTTGTGGCG (SEQ ID NO:9955), CGTTTTGTAGAAGCGCGGCGGGAGTTT (SEQ ID NO:9956) |

FIGURE 5 CONTINUED

| | | |
|---|---|---|
| Target1056 | chr10:88516504-88516592 | GAGGAGGTAGGAGCGAGGAGGGAGGAG (SEQ ID NO:9957), TGTCGGGTTTGGCGAAGGAGAAGGGAG (SEQ ID NO:9958), AGGAGGGGTTAAGGGCGGGTAGGAAGGT (SEQ ID NO:9959), AGGAGCGAGGAGGGAGGAGGGTTAAGG (SEQ ID NO:9960), TTGTCGGGTTTGGCGAAGGAGAAGGGA (SEQ ID NO:9961), GGGAACGTATTTTTTAGTTTTCGGCGCGG (SEQ ID NO:9962), AGGGAACGTATTTTTTAGTTTTCGGCGCGG (SEQ ID NO:9963), GGGAACGTATTTTTTAGTTTTCGGCGCGGA (SEQ ID NO:9964), GGAACGTATTTTTTAGTTTTCGGCGCGG (SEQ ID NO:9965), GGGAACGTATTTTTTAGTTTTCGGCGCG (SEQ ID NO:9966) |
| Target1057 | chr10:88516608-88516675 | GGGTAGGAAGGTTTAGGTTCGGCGCGT (SEQ ID NO:9967), CGGGTAGGAAGGTTTAGGTTCGGCGCG (SEQ ID NO:9968), AGGGTTGGAGGATGCGTTTTTTGGGGT (SEQ ID NO:9969), CGAGGGTTGGAGGATGCGTTTTTTGGGG (SEQ ID NO:9970), GGTAGGAAGGTTTAGGTTCGGCGCGTT (SEQ ID NO:9971), TCGGGTCGGGTAGTTTTTGGTTTCGGT (SEQ ID NO:9972), CGGGTCGGGTAGTTTTTGGTTTCGGTT (SEQ ID NO:9973), TCGGGTCGGGTAGTTTTTGGTTTCGGTT (SEQ ID NO:9974), CGGGTCGGGTAGTTTTTGGTTTCGGT (SEQ ID NO:9975), TCGGGTCGGGTAGTTTTTGGTTTCGG (SEQ ID NO:9976) |
| Target1058 | chr10:94451783-94451828 | GAGTTATTTGGGGAAAGAGGGTCGTGGT (SEQ ID NO:9977), CGAGAGTTATTTGGGGAAAGAGGGTCGTGG (SEQ ID NO:9978), CGAGAGTTATTTGGGGAAAGAGGGTCGTGGT (SEQ ID NO:9979), AGAGTTATTTGGGGAAAGAGGGTCGTGGT (SEQ ID NO:9980), CGAGAGTTATTTGGGGAAAGAGGGTCGT (SEQ ID NO:9981) |
| Target1059 | chr10:94451965-94451993 | TGTGTGTCGGTGGGAACGTGTTAGGTT (SEQ ID NO:9982), TTGTGTGTCGGTGGGAACGTGTTAGGT (SEQ ID NO:9983), GGGTATGTTTGTGTGTCGGTGGGAACGT (SEQ ID NO:9984), TGGGTATGTTTGTGTGTCGGTGGGAACG (SEQ ID NO:9985), TGGGTATGTTTGTGTGTCGGTGGGAACGT (SEQ ID NO:9986), GCGGGAAGAGCGGCGTTTATTTATTGT (SEQ ID NO:9987), GCGGGAAGAGCGGCGTTTATTTATTGTT (SEQ ID NO:9988), GCGGCGTTTATTTATTGTTTTGGAGCGGT (SEQ ID NO:9989), GCGGCGTTTATTTATTGTTTTGGAGCGG (SEQ ID NO:9990), AGCGGCGTTTATTTATTGTTTTGGAGCGG (SEQ ID NO:9991) |
| Target1060 | chr10:94452236-94452295 | AGGAAAGGCGGTTAGGTGAGATTTTTTAACGA (SEQ ID NO:9992), AAGGAAAGGCGGTTAGGTGAGATTTTTTAACG (SEQ ID NO:9993), AAGGAAAGGCGGTTAGGTGAGATTTTTTAACGA (SEQ ID NO:9994), AGGAAAGGCGGTTAGGTGAGATTTTTTAACGAT (SEQ ID NO:9995), AAAGGAAAGGCGGTTAGGTGAGATTTTTTAACG (SEQ ID NO:9996), GGGACGTGTTAGAGGGTAGGGTGGTTT (SEQ ID NO:9997), GGGACGTGTTAGAGGGTAGGGTGGTTTT (SEQ ID NO:9998), GGGACGTGTTAGAGGGTAGGGTGGTT (SEQ ID NO:9999), GGACGTGTTAGAGGGTAGGGTGGTTTT (SEQ ID NO:10000), GGGACGTGTTAGAGGGTAGGGTGGTTTTT (SEQ ID NO:10001) |
| Target1061 | chr10:94822093-94822882 | TTTGTAGGGGGCGTTGCGGTATGAGGT (SEQ ID NO:10002), GGTAATTAGCGGGTGGTTTTGGGCGGG (SEQ ID NO:10003), AATTAGCGGGTGGTTTTGGGCGGGTTC (SEQ ID NO:10004), TGGGTTAGGTCGGGGTTTCGGTGTTGG (SEQ ID NO:10005), CGTTTGTAGGGGGCGTTGCGGTATGAG (SEQ ID NO:10006), GAGGGCGTTTCGTTTGGGTTTGGGAGG (SEQ ID NO:10007), GGGCGTTTCGTTTGGGTTTGGGAGGTT (SEQ ID NO:10008), AGGTTTGGAGTCGGGGCGGTCGTATTT (SEQ ID NO:10009), AAGGTTTGGAGTCGGGGCGGTCGTATT (SEQ ID NO:10010), GAAGGTTTGGAGTCGGGGCGGTCGTAT (SEQ ID NO:10011) |
| Target1062 | chr10:94828119-94828197 | ACGGTTGCGGTGTATCGTAGTTTTTTCG (SEQ ID NO:10012), GACGGTTGCGGTGTATCGTAGTTTTTTCG (SEQ ID NO:10013), GGGTTGGAGCGTGATGTATAGTATTCGGG (SEQ ID NO:10014), AGACGGTTGCGGTGTATCGTAGTTTTTTCG (SEQ ID NO:10015), AGGGTTGGAGCGTGATGTATAGTATTCGGG (SEQ ID NO:10016), GAAGCGGTTGGAGGCGTTTCGGGAATT (SEQ ID NO:10017), AGCGGTTGGAGGCGTTTCGGGAATTTT (SEQ ID NO:10018), AAGCGGTTGGAGGCGTTTCGGGAATTT (SEQ ID NO:10019), GGGATGTAATGGAAGCGGTTGGAGGCG (SEQ ID NO:10020), CGGGATGTAATGGAAGCGGTTGGAGGC (SEQ ID NO:10021) |
| Target1063 | chr10:94828206-94828691 | GGTTTGGTCGGTGGTTATGGCGCGTAC (SEQ ID NO:10022), ATACGGTTTGGTCGGTGGTTATGGCGC (SEQ ID NO:10023), GGATTCGAGGAAGGAGGAGGGCGAGTT (SEQ ID NO:10024), CGGTGCGCGTAGTTGTTTCGGTTAGGA (SEQ ID NO:10025), CGGTTTGGTCGGTGGTTATGGCGCGTA (SEQ ID NO:10026), ATAATGGGGAGCGGTAGATGGGTGGCG (SEQ ID NO:10027), AGGCGGGTGTGGTTAGTTTTTAGCGCG (SEQ ID NO:10028), AGGCGTGAGGGGGTGGAAAAAGAGTCG (SEQ ID NO:10029), TGTTGAACGAGTGAAAGAGTGGCGCG (SEQ ID NO:10030), GGGATGTAATGGAAGCGGTTGGAGGCG (SEQ ID NO:10031) |
| Target1064 | chr10:99080800-99080816 | AATGGTGGTGGAAGGGTAGAGAGGCGC (SEQ ID NO:10032), GGGGAAGGTTGTACGATACGGGTGGGG (SEQ ID NO:10033), GGGGGAAGGTTGTACGATACGGGTGGG (SEQ ID NO:10034), GGGCGGGGAGTATTGAATGGTGGTGGA (SEQ ID NO:10035), GAAAGGAGGTGGGGGCGGGGAGTATTG (SEQ ID NO:10036), GTGATTTTGAATCGAGGAGAGGCGGGT (SEQ ID NO:10037), AGTGATTTTGAATCGAGGAGAGGCGGT (SEQ ID NO:10038), AGTGATTTTGAATCGAGGAGAGGCGGG (SEQ ID NO:10039), TGATTTTGAATCGAGGAGAGGCGGGTT (SEQ ID NO:10040), GTGATTTTGAATCGAGGAGAGGCGGGTT (SEQ ID NO:10041) |
| Target1065 | chr10:99080878-99081075 | CGTGTTGGGCGGTTGTGTTTCGGTAGG (SEQ ID NO:10042), ACGTGTTGGGCGGTTGTGTTTCGGTAG (SEQ ID NO:10043), GACGTGTTGGGCGGTTGTGTTTCGGTA (SEQ ID NO:10044), GTGTTGGGCGGTTGTGTTTCGGTAGGC (SEQ ID NO:10045), TGGGCGGTTGTGTTTCGGTAGGCGATT |

FIGURE 5 CONTINUED

|  |  |  |
|---|---|---|
|  |  | {SEQ ID NO:10046), CGTGAAAGTTCGGAGCGCGGTTAGGG (SEQ ID NO:10047), GTGAAAGTTCGGAGCGCGGTTAGGGG (SEQ ID NO:10048), CGTGAAAGTTCGGAGCGCGGTTAGGGG (SEQ ID NO:10049), TGAAAGTTCGGAGCGCGGTTAGGGG (SEQ ID NO:10050), CGTGAAAGTTCGGAGCGCGGTTAGG (SEQ ID NO:10051) |
| Target1066 | chr10:102587099-102587148 | TGGTCGTTCGAAGGTTTTGCGTCGTT (SEQ ID NO:10052), TTGGTCGTTCGAAGGTTTTGCGTCGTT (SEQ ID NO:10053), TTTGGTCGTTCGAAGGTTTTGCGTCGT (SEQ ID NO:10054), TGGTCGTTCGAAGGTTTTGCGTCGTTTT (SEQ ID NO:10055), TTGGTCGTTCGAAGGTTTTGCGTCGTTT (SEQ ID NO:10056), GGGATTCGGATTGGGAGATTTTGGTTGGG (SEQ ID NO:10057), GGGATTCGGATTGGGAGATTTTGGTTGGGT (SEQ ID NO:10058), CGGATTGGGAGATTTTGGTTGGGTAGTGG (SEQ ID NO:10059), GGATTCGGATTGGGAGATTTTGGTTGGGT (SEQ ID NO:10060), CGGATTGGGAGATTTTGGTTGGGTAGTGGA (SEQ ID NO:10061) |
| Target1067 | chr10:102587188-102587330 | CGTAGTCGGGCGTTATTAGATCGGGTT (SEQ ID NO:10062), CGTAGTCGGGCGTTATTAGATCGGGTTT (SEQ ID NO:10063), CGTAGTCGGGCGTTATTAGATCGGGT (SEQ ID NO:10064), TTTCGGATTTTTTGGAGGGTGCGTAGTC (SEQ ID NO:10065), CGTAGTCGGGCGTTATTAGATCGGGTTTT (SEQ ID NO:10066), GGCGGAGTTTCGGGGGGCGGTATTATA (SEQ ID NO:10067), TTTTTCGGGGTGGGGTTAGACGGGGAC (SEQ ID NO:10068), GGCGGAGTTTCGGGGGGCGGTATTATAA (SEQ ID NO:10069), TTTTCGGGGTGGGGTTAGACGGGGAC (SEQ ID NO:10070), TTTTTCGGGGTGGGGTTAGACGGGGA (SEQ ID NO:10071) |
| Target1068 | chr10:102587337-102587435 | CGGGGTTTCGTTTTTGTCGTTGTTGTCG (SEQ ID NO:10072), CGGGGTTTCGTTTTTGTCGTTGTTGTCGT (SEQ ID NO:10073), TCGGGGTTTCGTTTTTGTCGTTGTTGTCG (SEQ ID NO:10074), TCGGGGTTTCGTTTTTGTCGTTGTTGTCGT (SEQ ID NO:10075), TCGGGGTTTCGTTTTTGTCGTTGTTGT (SEQ ID NO:10076), TTTTTCGGGGTGGGGTTAGACGGGGAC (SEQ ID NO:10077), TTTTTTCGGGGTGGGGTTAGACGGGGA (SEQ ID NO:10078), TTCGAGGGGGGTGATGTGAAGGGTTGC (SEQ ID NO:10079), TTTTCGGGGTGGGGTTAGACGGGGAC (SEQ ID NO:10080), TTTTTTCGGGGTGGGGTTAGACGGGGAC (SEQ ID NO:10081) |
| Target1069 | chr10:102587465-102587493 | CGTTTGATTTTATTTCGGAGGGAGGGAGGA (SEQ ID NO:10082), TCGTTTGATTTTATTTCGGAGGGAGGGAGG (SEQ ID NO:10083), TCGTTTGATTTTATTTCGGAGGGAGGGAGGA (SEQ ID NO:10084), TTCGTTTGATTTTATTTCGGAGGGAGGGAGG (SEQ ID NO:10085), CGTTTGATTTTATTTCGGAGGGAGGGAGGAT (SEQ ID NO:10086), TTCGAGGGGGGTGATGTGAAGGGTTGC (SEQ ID NO:10087), TCGAGGGGGGTGATGTGAAGGGTTGC (SEQ ID NO:10088), TTTCGAGGGGGGTGATGTGAAGGGTTGC (SEQ ID NO:10089), TTTCGAGGGGGGTGATGTGAAGGGTTG (SEQ ID NO:10090), TTTTCGAGGGGGGTGATGTGAAGGGTT (SEQ ID NO:10091) |
| Target1070 | chr10:102587602-102587622 | CGTGGGCGGGATTTTTAGGTTCGGGTT (SEQ ID NO:10092), CGTGGGCGGGATTTTTAGGTTCGGGTTC (SEQ ID NO:10093), CGTGGGCGGGATTTTTAGGTTCGGGT (SEQ ID NO:10094), GTGGGCGGGATTTTTAGGTTCGGGTTC (SEQ ID NO:10095), GTGGGCGGGATTTTTAGGTTCGGGTT (SEQ ID NO:10096), GTTTCGGGGTTGGTTTGGTGGAGGTCG (SEQ ID NO:10097), GGTTTCGGGGTTGGTTTGGTGGAGGTC (SEQ ID NO:10098), AGTTCGGTAGGGTGGTTGGCGGGTTTC (SEQ ID NO:10099), GAGTTCGGTAGGGTGGTTGGCGGGTTT (SEQ ID NO:10100), TTTCGGGGTTGGTTTGGTGGAGGTCGG (SEQ ID NO:10101) |
| Target1071 | chr10:102587631-102587906 | TCGGGCGTTAGGAGGTTTCGTTGGAGG (SEQ ID NO:10102), GGCGTTAGGAGGTTTCGTTGGAGGGGT (SEQ ID NO:10103), GGCGTCGTGAGGGGGGATTCGGTTTAGT (SEQ ID NO:10104), CGTTCGGGCGTTAGGAGGTTTCGTTGG (SEQ ID NO:10105), AGGAGGTTTCGTTGGAGGGGTTGGGTT (SEQ ID NO:10106), AGTTCGGTAGGGTGGTTGGCGGGTTTC (SEQ ID NO:10107), GAGTTCGGTAGGGTGGTTGGCGGGTTT (SEQ ID NO:10108), TTTCGGGGTTGGTTTGGTGGAGGTCGG (SEQ ID NO:10109), AGTTCGGTAGGGTGGTTGGCGGGTTT (SEQ ID NO:10110), GTTCGGTAGGGTGGTTGGCGGGTTTC (SEQ ID NO:10111) |
| Target1072 | chr10:102588069-102588175 | GGGGGTGTGGGGGTTCGGTTTTAGGAA (SEQ ID NO:10112), ATGGGGGTGTGGGGGTTCGGTTTTAGG (SEQ ID NO:10113), CGGTTTTAGGAACGGGTTTTGGGGGCG (SEQ ID NO:10114), AAGATGGAATGGGGGTGTGGGGGTTCG (SEQ ID NO:10115), TAGGAACGGGTTTTGGGGGCGTTAGGT (SEQ ID NO:10116), GTTCGATCGGTGCGGGTTGTTGGGTTT (SEQ ID NO:10117), GCGAGTTAGGGAGGAGGATGTAGGGCG (SEQ ID NO:10118), TCGATCGGTGCGGGTTGTTGGGTTTTT (SEQ ID NO:10119), TTCGATCGGTGCGGGTTGTTGGGTTTT (SEQ ID NO:10120), GGGGTTGCGAGTTAGGGAGGAGGATGT (SEQ ID NO:10121) |
| Target1073 | chr10:102821357-102821367 | GTTCGCGTTTTGGTGGGGTAGTTGGGT (SEQ ID NO:10122), TTCGCGTTTTGGTGGGGTAGTTGGGTG (SEQ ID NO:10123), TGTTCGCGTTTTGGTGGGGTAGTTGGG (SEQ ID NO:10124), GGGGTAGTTGGGTGGGTAAGTTTGCGG (SEQ ID NO:10125), TCGCGTTTTGGTGGGGTAGTTGGGTGG (SEQ ID NO:10126), AAGGGGGAGGCGGTAGGAGTTTTGGTG (SEQ ID NO:10127), GGGGGAGGCGGTAGGAGTTTTGGTGTT (SEQ ID NO:10128), AGGGGGAGGCGGTAGGAGTTTTGGTGT (SEQ ID NO:10129), GGGGGAGGCGGTAGGAGTTTTGGTGT (SEQ ID NO:10130), AGGGGGAGGCGGTAGGAGTTTTGGTG (SEQ ID NO:10131) |
| Target1074 | chr10:102821421-102821428 | GGGGAGACGAAGGTGGTTGGTTTTGTT (SEQ ID NO:10132), GGAATTAGTTTTGGGTTGCGGGGAGACG (SEQ ID NO:10133), GGGGAGACGAAGGTGGTTGGTTTTGTTT (SEQ ID NO:10134), GAATTAGTTTTGGGTTGCGGGGAGACG (SEQ ID NO:10135), GGGGAGACGAAGGTGGTTGGTTTTGT |

FIGURE 5 CONTINUED (SEQ ID NO:10136), GGGAGTGGGGGTAGGAGTTTGGTTGGG (SEQ ID NO:10137),
GGGGGAGTGGGGGTAGGAGTTTGGTTGG (SEQ ID NO:10138), CGGGGGAGTGGGGGTAGGAGTTTGGTTG
(SEQ ID NO:10139), GGTTGGGAGAGAGGAAGGGGGTGAGGA (SEQ ID NO:10140),
AGGTTGGGAGAGAGGAAGGGGGTGAGG (SEQ ID NO:10141)

Target1075        chr10:102821552-102821579        GGGATTGTAAAATTAGATGGGATAGGGTTTAGTCGT (SEQ ID NO:10142)

Target1076        chr10:102821630-102821679        GAAATGATTCGGGAGGGTTTTATGCGGTT (SEQ ID NO:10143),
CGTATTGTGATTTTGGGTTAGGTTGGGGG (SEQ ID NO:10144),
CGTATTGTGATTTTGGGTTAGGTTGGGGGA (SEQ ID NO:10145),
TCGTATTGTGATTTTGGGTTAGGTTGGGGG (SEQ ID NO:10146),
TCGTATTGTGATTTTGGGTTAGGTTGGGGGA (SEQ ID NO:10147)

Target1077        chr10:102899883-102899935        TCGCGGAGAGTATATGTAGGTCGGAGT (SEQ ID NO:10148), TCGCGGAGAGTATATGTAGGTCGGAGTT
(SEQ ID NO:10149), ATCGCGGAGAGTATATGTAGGTCGGAGT (SEQ ID NO:10150),
TCGCGGAGAGTATATGTAGGTCGGAGTTT (SEQ ID NO:10151),
ATCGCGGAGAGTATATGTAGGTCGGAGTT (SEQ ID NO:10152), AGTTTCGGGAGTAGGCGAGCGGTATTC
(SEQ ID NO:10153), GAATAGTTTCGGGAGTAGGCGAGCGGT (SEQ ID NO:10154),
TAGTTTCGGGAGTAGGCGAGCGGTATT (SEQ ID NO:10155), AATAGTTTCGGGAGTAGGCGAGCGGTA
(SEQ ID NO:10156), ATAGTTTCGGGAGTAGGCGAGCGGTAT (SEQ ID NO:10157)

Target1078        chr10:102899949-102899961        TTTTAGCGTTGGGGTTTGGGGCGTTCG (SEQ ID NO:10158), TTTAGCGTTGGGGTTTGGGGCGTTCG (SEQ
ID NO:10159), ATTTTAGCGTTGGGGTTTGGGGCGTTCG (SEQ ID NO:10160),
ATTTTAGCGTTGGGGTTTGGGGCGTTC (SEQ ID NO:10161), TTTAGCGTTGGGGTTTGGGGCGTTCGG
(SEQ ID NO:10162), AGTTTCGGGAGTAGGCGAGCGGTATTC (SEQ ID NO:10163),
GAATAGTTTCGGGAGTAGGCGAGCGGT (SEQ ID NO:10164), TAGTTTCGGGAGTAGGCGAGCGGTATT
(SEQ ID NO:10165), AATAGTTTCGGGAGTAGGCGAGCGGTA (SEQ ID NO:10166),
ATAGTTTCGGGAGTAGGCGAGCGGTAT (SEQ ID NO:10167)

Target1079        chr10:102900103-102900169        ATTTTTGGGGACGTTGGGATTCGCGGC (SEQ ID NO:10168), GGTCGTCGGTTGTTCGGGTCGTGTATT
(SEQ ID NO:10169), GATTTTTGGGGACGTTGGGATTCGCGG (SEQ ID NO:10170),
TTTTTGGGGACGTTGGGATTCGCGGC (SEQ ID NO:10171), AGATTTTTGGGGACGTTGGGATTCGCGG
(SEQ ID NO:10172), CGGAGAGGCGGGAGTTTTGCGTGTTTC (SEQ ID NO:10173),
CGGAGAGGCGGGAGTTTTGCGTGTTT (SEQ ID NO:10174), GCGGAGAGGCGGGAGTTTTGCGTGTTT
(SEQ ID NO:10175), CGGAGAGGCGGGAGTTTTGCGTGTT (SEQ ID NO:10176),
GGAGAGGCGGGAGTTTTGCGTGTTTC (SEQ ID NO:10177)

Target1080        chr10:102983415-102983447        CGCGGTTTTAATAGAGTTGTCGGTTGGT (SEQ ID NO:10178), CGCGGTTTTAATAGAGTTGTCGGTTGGG
(SEQ ID NO:10179), TCGCGGTTTTAATAGAGTTGTCGGTTGGG (SEQ ID NO:10180),
TCGCGGTTTTAATAGAGTTGTCGGTTGGGT (SEQ ID NO:10181),
CGCGGTTTTAATAGAGTTGTCGGTTGGGTT (SEQ ID NO:10182), TCGGGTGGGTTTTCGGAGTTTAGTCGA
(SEQ ID NO:10183), TTCGGGTGGGTTTTCGGAGTTTAGTCG (SEQ ID NO:10184),
TTCGGGTGGGTTTTCGGAGTTTAGTCGA (SEQ ID NO:10185), AGGTTTCGGGTGGGTTTTCGGAGTTTA
(SEQ ID NO:10186), TAGGTTTCGGGTGGGTTTTCGGAGTTT (SEQ ID NO:10187)

Target1081        chr10:102983547-102983563        AGAGTTGTCGGTTGGGTTTCGGAAGTT (SEQ ID NO:10188), TAGAGTTGTCGGTTGGGTTTCGGAAGT
(SEQ ID NO:10189), GAGTTGTCGGTTGGGTTTCGGAAGTTT (SEQ ID NO:10190),
AGAGTTGTCGGTTGGGTTTCGGAAGTTT (SEQ ID NO:10191), TCGGTTGGGTTTCGGAAGTTTATTCGGA
(SEQ ID NO:10192), GAAGGATTAGAGTTGCGGCGGGGGGAA (SEQ ID NO:10193),
AAGGATTAGAGTTGCGGCGGGGGGAAG (SEQ ID NO:10194), AAGGAAGGATTAGAGTTGCGGCGGGGG
(SEQ ID NO:10195), GAAGGAAGGATTAGAGTTGCGGCGGGG (SEQ ID NO:10196),
GGAAGGAAGGATTAGAGTTGCGGCGGG (SEQ ID NO:10197)

Target1082        chr10:102983588-102983609        AGAGTAGAGGATATTGCGGAGAGGTTCGA (SEQ ID NO:10198),
AGAGTAGAGGATATTGCGGAGAGGTTCGAA (SEQ ID NO:10199),
AGAGTAGAGGATATTGCGGAGAGGTTCGAAT (SEQ ID NO:10200),
TAGAGTAGAGGATATTGCGGAGAGGTTCGAA (SEQ ID NO:10201),
TTAGAGTAGAGGATATTGCGGAGAGGTTCGA (SEQ ID NO:10202),
GAAGGATTAGAGTTGCGGCGGGGGGAA (SEQ ID NO:10203), AAGGATTAGAGTTGCGGCGGGGGGAAG
(SEQ ID NO:10204), AAGGAAGGATTAGAGTTGCGGCGGGGG (SEQ ID NO:10205),
GAAGGAAGGATTAGAGTTGCGGCGGGG (SEQ ID NO:10206), GGAAGGAAGGATTAGAGTTGCGGCGGG
(SEQ ID NO:10207)

Target1083        chr10:103043997-103044034        GGGGGAGGGGCGTTTGTTTGCGTATAG (SEQ ID NO:10208), CGGGGGAGGGGCGTTTGTTTGCGTATA
(SEQ ID NO:10209), GGGGGAGGGGCGTTTGTTTGCGTATAGT (SEQ ID NO:10210),
GGGGGAGGGGCGTTTGTTTGCGTATAGT (SEQ ID NO:10211), GGGGGAGGGGCGTTTGTTTGCGTATA
(SEQ ID NO:10212), GCGGTTTTTTCGTCGGGTTTTAGTTGCGC (SEQ ID NO:10213),
CGCGGTTTTTTCGTCGGGTTTTAGTTGCG (SEQ ID NO:10214), CGGTTTTTTCGTCGGGTTTTAGTTGCGC
(SEQ ID NO:10215), GCGGTTTTTTCGTCGGGTTTTAGTTGCG (SEQ ID NO:10216),
CGCGGTTTTTTCGTCGGGTTTTAGTTGC (SEQ ID NO:10217)

Target1084        chr10:103044083-103044140        GCGTAGTTGGAGTTCGGCGAGAGGGTC (SEQ ID NO:10218), TGAGGAGTTGGAGTCGAGTCGGGGATC
(SEQ ID NO:10219), GCGTAGTTGGAGTTCGGCGAGAGGGT (SEQ ID NO:10220),
TTGAGGAGTTGGAGTCGAGTCGGGGAT (SEQ ID NO:10221), ATTGAGGAGTTGGAGTCGAGTCGGGGA

FIGURE 5 CONTINUED (SEQ ID NO:10222), GGTTTTTTCGTCGGGTTTTAGTTGCGC (SEQ ID NO:10223), CGCGGTTTTTTCGTCGGGTTTTAGTTG (SEQ ID NO:10224)

| Target1085 | chr10:103044150-103044247 | GAGGGGTATTGCGCGGTTGGGTTTGTT (SEQ ID NO:10225), TATTGCGCGGTTGGGTTTGTTTCGGGG (SEQ ID NO:10226), GCGGTTGGGTTTGTTTCGGGGTTTCGT (SEQ ID NO:10227), AGGGGTATTGCGCGGTTGGGTTTGTTT (SEQ ID NO:10228), GCGTAGTTGGAGTTCGGCGAGAGGGTC (SEQ ID NO:10229), GGGTTGGAGGCGAGGTAGGTACGTTGG (SEQ ID NO:10230), CGGGTTGGAGGCGAGGTAGGTACGTTG (SEQ ID NO:10231), TTTCGGGTTGGAGGCGAGGTAGGTACG (SEQ ID NO:10232), GGTTGGAGGCGAGGTAGGTACGTTGGT (SEQ ID NO:10233), TCGGGTTGGAGGCGAGGTAGGTACGTT (SEQ ID NO:10234) |
| Target1086 | chr10:105344152-105344448 | TTATTCGGGATTGTAACGGTGCGCGCG (SEQ ID NO:10235), TATTCGGGATTGTAACGGTGCGCGCG (SEQ ID NO:10236), GTTATTCGGGATTGTAACGGTGCGCGC (SEQ ID NO:10237), GTTATTCGGGATTGTAACGGTGCGCGCG (SEQ ID NO:10238), GGGATTGTAACGGTGCGCGCGTAGG (SEQ ID NO:10239), TGTTACGTAGGGTTTTCGGGAGGCGGT (SEQ ID NO:10240), TGAGTTTTGCGGGATGGGGTAGTCGGC (SEQ ID NO:10241), GTGAGTTTTGCGGGATGGGGTAGTCGG (SEQ ID NO:10242), GTGTTACGTAGGGTTTTCGGGAGGCGG (SEQ ID NO:10243), AGTGTTACGTAGGGTTTTCGGGAGGCGG (SEQ ID NO:10244) |
| Target1087 | chr10:105344464-105344748 | GAGTAGACGGTGGCGCGCGTGGGAGTAC (SEQ ID NO:10245), GAGTAGACGGTGGCGCGCGTGGGAGTA (SEQ ID NO:10246), AGTAGACGGTGGCGCGCGTGGGAGTAC (SEQ ID NO:10247), GTAGACGGTGGCGCGCGTGGGAGTAC (SEQ ID NO:10248), CGAGTAGACGGTGGCGCGCGTGGGAGTA (SEQ ID NO:10249), ATGTCGTCGTTGTGTAGGGGTTCGGGT (SEQ ID NO:10250), TGTCGTCGTTGTGTAGGGGTTCGGGTA (SEQ ID NO:10251), GATGTCGTCGTTGTGTAGGGGTTCGGGT (SEQ ID NO:10252), GATGTCGTCGTTGTGTAGGGGTTCGGG (SEQ ID NO:10253), GGATGTCGTCGTTGTGTAGGGGTTCGG (SEQ ID NO:10254) |
| Target1088 | chr10:105344798-105344808 | GGTACGTTGCGGTCGGTCGATTTGTTT (SEQ ID NO:10255), GGTACGTTGCGGTCGGTCGATTTGTTTT (SEQ ID NO:10256), GGTACGTTGCGGTCGGTCGATTTGTT (SEQ ID NO:10257), ACGTTGCGGTCGGTCGATTTGTTTTTT (SEQ ID NO:10258), GTACGTTGCGGTCGGTCGATTTGTTTT (SEQ ID NO:10259), GCGGTCGCGTTATTGTGGTTGAGGTGT (SEQ ID NO:10260), ATGTCGTCGTTGTGTAGGGGTTCGGGT (SEQ ID NO:10261), TGTCGTCGTTGTGTAGGGGTTCGGGTA (SEQ ID NO:10262), GATGTCGTCGTTGTGTAGGGGTTCGGGT (SEQ ID NO:10263), GATGTCGTCGTTGTGTAGGGGTTCGGG (SEQ ID NO:10264) |
| Target1089 | chr10:108923824-108923845 | GGTTTGGTTGTGTGTTGAGTTTTTCGTTAGC (SEQ ID NO:10265), TGGTTTGGTTGTGTGTTGAGTTTTTCGTTAGC (SEQ ID NO:10266), ATGGTTTGGTTGTGTGTTGAGTTTTTCGTTAGC (SEQ ID NO:10267), AGTGGATTATGGTTTGGTTGTGTGTTGAGTTTT (SEQ ID NO:10268), GGATTATGGTTTGGTTGTGTGTTGAGTTTTTCGT (SEQ ID NO:10269), AGGAGTTTGGGATTCGGGAGCGGGATT (SEQ ID NO:10270), AGTAGGAGTTTGGGATTCGGGAGCGGG (SEQ ID NO:10271), GTAGGAGTTTGGGATTCGGGAGCGGGA (SEQ ID NO:10272), AGGAGAAGGTAGAACGGGGAGAGGGCG (SEQ ID NO:10273), GGAGTTTGGGATTCGGGAGCGGGATTC (SEQ ID NO:10274) |
| Target1090 | chr10:108923899-108923916 | AGCGGGTGGTTTTGTTCGGGTTTC (SEQ ID NO:10275), GCGGTTGTTGTACGTTTCGGTCGGAGG (SEQ ID NO:10276), GGCGGTTGTTGTACGTTTCGGTCGGAG (SEQ ID NO:10277), ATGGCGGTTGTTGTACGTTTCGGTCGG (SEQ ID NO:10278), AGGAGAAGGTAGAACGGGGAGAGGGCG (SEQ ID NO:10279), TGGCGGTTGTTGTACGTTTCGGTCGGA (SEQ ID NO:10280) |
| Target1091 | chr10:108923926-108923970 | AGCGGGTGGTTTTGTTCGGGTTTC (SEQ ID NO:10281), GCGGTTGTTGTACGTTTCGGTCGGAGG (SEQ ID NO:10282), GGCGGTTGTTGTACGTTTCGGTCGGAG (SEQ ID NO:10283), ATGGCGGTTGTTGTACGTTTCGGTCGG (SEQ ID NO:10284), TGGCGGTTGTTGTACGTTTCGGTCGGA (SEQ ID NO:10285), CGGTTGTTGTACGTTTCGGTCGGAGGA (SEQ ID NO:10286) |
| Target1092 | chr10:108924027-108924039 | GGTCGGAGCGTGTAGTAATCGTTATGGA (SEQ ID NO:10287), GGTCGGAGCGTGTAGTAATCGTTATGGAT (SEQ ID NO:10288), GGTCGGAGCGTGTAGTAATCGTTATGGATG (SEQ ID NO:10289), GGTCGGAGCGTGTAGTAATCGTTATGGATGT (SEQ ID NO:10290), GTCGGAGCGTGTAGTAATCGTTATGGATGT (SEQ ID NO:10291), GGGGCGGTTAGGTAGGGTTTTTGTTACGT (SEQ ID NO:10292), GGGGCGGTTAGGTAGGGTTTTTGTTACG (SEQ ID NO:10293), AGGGGCGGTTAGGTAGGGTTTTTGTTACG (SEQ ID NO:10294), AGGGGCGGTTAGGTAGGGTTTTTGTTACGT (SEQ ID NO:10295), GGGCGGTTAGGTAGGGTTTTTGTTACGT (SEQ ID NO:10296) |
| Target1093 | chr10:108924149-108924166 | GGGGTAGGGGCGTGGTAGGAGTTTTGT (SEQ ID NO:10297), AGGGGTAGGGGCGTGGTAGGAGTTTTG (SEQ ID NO:10298), GAGGGGTAGGGGCGTGGTAGGAGTTTT (SEQ ID NO:10299), CGAGGGGTAGGGGCGTGGTAGGAGTTT (SEQ ID NO:10300), GAGGGGTAGGGGCGTGGTAGGAGTTTTG (SEQ ID NO:10301), CGTCGGCGGCGGTTTTTAAGTTCGGTT (SEQ ID NO:10302), TCGGCGGCGGTTTTTAAGTTCGGTTGA (SEQ ID NO:10303), GCGGCGGTTTTTAAGTTCGGTTGAGCG (SEQ ID NO:10304), GGCGGCGGTTTTTAAGTTCGGTTGAGC (SEQ ID NO:10305), GTCGGCGGCGGTTTTTAAGTTCGGTTG (SEQ ID NO:10306) |

FIGURE 5 CONTINUED

| Target1094 | chr10:108924185-108924347 | GGGGTAGGGGCGTGGTAGGAGTTTTGT (SEQ ID NO:10307), AGGGGTAGGGGCGTGGTAGGAGTTTTG (SEQ ID NO:10308), GCGTTTAGTCGGGTTTGGGAGTCGTCG (SEQ ID NO:10309), GAGGGGTAGGGGCGTGGTAGGAGTTTT (SEQ ID NO:10310), CGAGGGGTAGGGGCGTGGTAGGAGTTT (SEQ ID NO:10311), CGCGGCGTAATTTGGATGGAGTTGGGG (SEQ ID NO:10312), CGTCGGCGGCGGTTTTTAAGTTCGGTT (SEQ ID NO:10313), GGATGGAGTTGGGGTTTTGAGCGTCGG (SEQ ID NO:10314), GCGGCGTAATTTGGATGGAGTTGGGGT (SEQ ID NO:10315), TCGGCGGCGGTTTTTAAGTTCGGTTGA (SEQ ID NO:10316) |
|---|---|---|
| Target1095 | chr10:110671872-110671904 | GTAGGAGTTCGGCGTAGGTGGTGGGGTT (SEQ ID NO:10317), AGGAGTTCGGCGTAGGTGGTGGGTTTA (SEQ ID NO:10318), TAGGAGTTCGGCGTAGGTGGTGGGTTT (SEQ ID NO:10319), GTAGGAGTTCGGCGTAGGTGGTGGGTTT (SEQ ID NO:10320), CGTAGGAGTTCGGCGTAGGTGGTGGG (SEQ ID NO:10321), TGGGAAAGGTTGGTAGATAGCGGCGTT (SEQ ID NO:10322), TTGGGAAAGGTTGGTAGATAGCGGCGT (SEQ ID NO:10323), GTTGGGAAAGGTTGGTAGATAGCGGCGT (SEQ ID NO:10324), GTTGGGAAAGGTTGGTAGATAGCGGCG (SEQ ID NO:10325), AGTTGGGAAAGGTTGGTAGATAGCGGCG (SEQ ID NO:10326) |
| Target1096 | chr10:110672060-110672089 | GCGAAGATAGTTTTAGGGTGGGCGGCG (SEQ ID NO:10327), CGAAGATAGTTTTAGGGTGGGCGGCGG (SEQ ID NO:10328), AGCGAAGATAGTTTTAGGGTGGGCGGC (SEQ ID NO:10329), CGAAGATAGTTTTAGGGTGGGCGGCGGT (SEQ ID NO:10330), AAGATAGTTTTAGGGTGGGCGGCGGTC (SEQ ID NO:10331), CGGTGGTTGTGGTTTTTGTTTTGTTAGCGG (SEQ ID NO:10332), CGGTGGTTGTGGTTTTTGTTTTGTTAGCGGT (SEQ ID NO:10333), TCGGTGGTTGTGGTTTTTGTTTTGTTAGCGG (SEQ ID NO:10334), TCGGTGGTTGTGGTTTTTGTTTTGTTAGCGGT (SEQ ID NO:10335), CGGTGGTTGTGGTTTTTGTTTTGTTAGCG (SEQ ID NO:10336) |
| Target1097 | chr10:110672251-110672267 | GGGGTTGCGGGTTGGTTGTTTGGGTAG (SEQ ID NO:10337), TAGTCGTTGTGGGGATTTCGGTTGCGC (SEQ ID NO:10338), GGGTTGCGGGTTGGTTGTTTGGGTAGT (SEQ ID NO:10339), AGTCGTTGTGGGGATTTCGGTTGCGC (SEQ ID NO:10340), GGGGGTTGCGGGTTGGTTGTTTGGGTA (SEQ ID NO:10341), AATGTGGGGTTGGGTGCGGGATTAGGT (SEQ ID NO:10342), GGCGGGTTAGTGGGGATAGTGGCGTAG (SEQ ID NO:10343), AGAGAAAATGTGGGGTTGGGTGCGGGA (SEQ ID NO:10344), ATGTGGGGTTGGGTGCGGGATTAGGTG (SEQ ID NO:10345), TTGGTAAATTCGGCGGGCGGGTTAGTG (SEQ ID NO:10346) |
| Target1098 | chr10:118892211-118892219 | ATGTGGGTGGTCGTGGTTGTAGGGACG (SEQ ID NO:10347), AGGGTAAGGAAAGAGGGTGTCGCGGTT (SEQ ID NO:10348), CGTAGGGTAAGGAAAGAGGGTGTCGCGG (SEQ ID NO:10349), GGGTAAGGAAAGAGGGTGTCGCGGTTC (SEQ ID NO:10350), TGTGGGTGGTCGTGGTTGTAGGGACG (SEQ ID NO:10351), AGTAGTTTCGGAGTTTAGATAGCGTTTTGTGTGA (SEQ ID NO:10352), AGTTTCGGAGTTTAGATAGCGTTTTGTGTGATTG (SEQ ID NO:10353), GTTTCGGAGTTTAGATAGCGTTTTGTGTGATTGA (SEQ ID NO:10354), AGTTTCGGAGTTTAGATAGCGTTTTGTGTGATTGA (SEQ ID NO:10355), CGGAGTTTAGATAGCGTTTTGTGTGATTGATAGGA (SEQ ID NO:10356) |
| Target1099 | chr10:118892390-118892424 | AGAGGAGGTTCGATTATTTAGCGGCGT (SEQ ID NO:10357), AGAGGAGGTTCGATTATTTAGCGGCGTT (SEQ ID NO:10358), TGCGTGTAGGAAGGGTTTTGTGAATTCG (SEQ ID NO:10359), AGAGGAGGTTCGATTATTTAGCGGCGTTT (SEQ ID NO:10360), TTGCGTGTAGGAAGGGTTTTGTGAATTCG (SEQ ID NO:10361), GGTTGTCGGCGGTAGTTTGCGTAGTC (SEQ ID NO:10362), TACGGTTTTTTAGGCGCGTAGTTTCGG (SEQ ID NO:10363), ACGGTTTTTTAGGCGCGTAGTTTCGG (SEQ ID NO:10364), GGTTGTCGGCGGTAGTTTGCGTAGT (SEQ ID NO:10365), TTACGGTTTTTTAGGCGCGTAGTTTCGG (SEQ ID NO:10366) |
| Target1100 | chr10:118892484-118892495 | TGAATTCGGGTGTTTGGGAGAGGAGGT (SEQ ID NO:10367), TGTGAATTCGGGTGTTTGGGAGAGGAGGT (SEQ ID NO:10368), GTGAATTCGGGTGTTTGGGAGAGGAGGT (SEQ ID NO:10369), TGTGAATTCGGGTGTTTGGGAGAGGAGG (SEQ ID NO:10370), GTGAATTCGGGTGTTTGGGAGAGGAGG (SEQ ID NO:10371), GGTTGTCGGCGGTAGTTTGCGTAGTC (SEQ ID NO:10372), GGTTGTCGGCGGTAGTTTGCGTAGT (SEQ ID NO:10373), GTTGTCGGCGGTAGTTTGCGTAGTC (SEQ ID NO:10374), GGTTGTCGGCGGTAGTTTGCGTAG (SEQ ID NO:10375), GAGTTTGTTCGGGGCGGTGGTC (SEQ ID NO:10376) |
| Target1101 | chr10:118892537-118892548 | TTTGGGAGGTCGTAGGGTGAAGCGTCG (SEQ ID NO:10377), CGTTTGGGAGGTCGTAGGGTGAAGCGT (SEQ ID NO:10378), ACGCGTTTGGGAGGTCGTAGGGTGAAG (SEQ ID NO:10379), GGAGGTCGTAGGGTGAAGCGTCGGTTG (SEQ ID NO:10380), GCGTCGGTTGCGTAGGTTATCGTCGGT (SEQ ID NO:10381), GAGTTTGTTCGGGGCGGTGGTC (SEQ ID NO:10382) |
| Target1102 | chr10:118892581-118892604 | TTTGGGAGGTCGTAGGGTGAAGCGTCG (SEQ ID NO:10383), CGTTTGGGAGGTCGTAGGGTGAAGCGT (SEQ ID NO:10384), ACGCGTTTGGGAGGTCGTAGGGTGAAG (SEQ ID NO:10385), GGAGGTCGTAGGGTGAAGCGTCGGTTG (SEQ ID NO:10386), GCGTCGGTTGCGTAGGTTATCGTCGGT (SEQ ID NO:10387), GAGTTTGTTCGGGGCGGTGGTT (SEQ ID NO:10388) |
| Target1103 | chr10:119292293-119292301 | TTTTTAGTTCGGGGTAGGGACGGGCGG (SEQ ID NO:10389), GCGAGTTGGGGTAGAGGATTTGCGGGA (SEQ ID NO:10390), GCGGTCGCGAGTTGGGGTAGAGGATT (SEQ ID NO:10391), GGTCGCGAGTTGGGGTAGAGGATTTGC (SEQ ID NO:10392), CGGTCGCGAGTTGGGGTAGAGGATTTG (SEQ ID NO:10393), TAGTTTGGGTGTTCGATGCGGAGGGGT (SEQ ID NO:10394), TTCGATGCGGAGGGGTTTGGTAGAGCG (SEQ ID NO:10395), GGGTGTTCGATGCGGAGGGGTTTGGTA (SEQ ID NO:10396), TTTGGGTGTTCGATGCGGAGGGGTTTG (SEQ ID NO:10397), GATGCGGAGGGGTTTGGTAGAGCGGAG (SEQ ID NO:10398) |

FIGURE 5 CONTINUED

Target1104    chr10:119295770-119295809    TTTGAGAGTGTGGTTTTTGGGACGTTAGC (SEQ ID NO:10399),
TTTTGAGAGTGTGGTTTTTGGGACGTTAGC (SEQ ID NO:10400),
AGTTTTTGAGAGTGTGGTTTTTGGGACGTT (SEQ ID NO:10401),
AAGTTTTTGAGAGTGTGGTTTTTGGGACGT (SEQ ID NO:10402),
TTTTTGAGAGTGTGGTTTTTGGGACGTTAGC (SEQ ID NO:10403),
TGTAAGGCGTTATTTGGGTTTGTTAGCGTT (SEQ ID NO:10404),
ATGTAAGGCGTTATTTGGGTTTGTTAGCGTT (SEQ ID NO:10405),
AATGTAAGGCGTTATTTGGGTTTGTTAGCGT (SEQ ID NO:10406),
AGCGTTTTTTGGTTTTTCGTGTTTGAGGT (SEQ ID NO:10407),
TGTAGCGTTTTTTGGTTTTTCGTGTTTGAGGT (SEQ ID NO:10408)

Target1105    chr10:119295840-119295872    AGTAGCGTTTTATATTGTCGGGCGAGGA (SEQ ID NO:10409), AAGTAGCGTTTTATATTGTCGGGCGAGGA
(SEQ ID NO:10410), AGTAGCGTTTTATATTGTCGGGCGAGGAT (SEQ ID NO:10411),
TTTGAGAGTGTGGTTTTTGGGACGTTAGC (SEQ ID NO:10412),
AGTAGCGTTTTATATTGTCGGGCGAGGATT (SEQ ID NO:10413),
AGCGTTTTTTGGTTTTTCGTGTTTGAGGTT (SEQ ID NO:10414),
TGTAGCGTTTTTTGGTTTTTCGTGTTTGAGGT (SEQ ID NO:10415),
AGCGTTTTTTGGTTTTTCGTGTTTGAGGTTT (SEQ ID NO:10416),
AGTTCGGTCGGTTTTTTAATTTGGAGTTTGGT (SEQ ID NO:10417),
GTAGCGTTTTTTGGTTTTTCGTGTTTGAGGTT (SEQ ID NO:10418)

Target1106    chr10:119295925-119295948    GCGTTGTAGAGGCGTGGAAGGTGCG (SEQ ID NO:10419), GCGTTGTAGAGGCGTGGAAGGTGC (SEQ ID
NO:10420), AGTAGCGTTTTATATTGTCGGGCGAGGA (SEQ ID NO:10421),
AGGTCGGTCGGGTTATTAGTGGTAGAGA (SEQ ID NO:10422), CGTTGTAGAGGCGTGGAAGGTGCG (SEQ
ID NO:10423), AGGGTGGGTGGGAGCGTGGTAAGTTTT (SEQ ID NO:10424),
GAGGGTGGGTGGGAGCGTGGTAAGTTT (SEQ ID NO:10425), GGGTGGGTGGGAGCGTGGTAAGTTTTT
(SEQ ID NO:10426), AGGGTGGGTGGGAGCGTGGTAAGTTTTT (SEQ ID NO:10427),
GAGGGTGGGTGGGAGCGTGGTAAGTT (SEQ ID NO:10428)

Target1107    chr10:119295992-119296096    TGTAGAGGCGTGGAAGGTGCGTTTCGT (SEQ ID NO:10429), AGAGGCGTGGAAGGTGCGTTTCGTTTC
(SEQ ID NO:10430), GGCGTGGAAGGTGCGTTTCGTTTCGTT (SEQ ID NO:10431),
CGTTGTAGAGGCGTGGAAGGTGCGTTT (SEQ ID NO:10432), GAGGCGTGGAAGGTGCGTTTCGTTTCG
(SEQ ID NO:10433), TTTTTCGGGATGGAGGGTGGGTGGGAG (SEQ ID NO:10434),
AGGGTGGGTGGGAGCGTGGTAAGTTTT (SEQ ID NO:10435), GAGGGTGGGTGGGAGCGTGGTAAGTTT
(SEQ ID NO:10436), TTTTTTCGGGATGGAGGGTGGGTGGGA (SEQ ID NO:10437),
GGGTGGGTGGGAGCGTGGTAAGTTTTT (SEQ ID NO:10438)

Target1108    chr10:119296118-119296131    TGGGGGCGATGGGAAGGATTTGTTACGT (SEQ ID NO:10439), GGGGGCGATGGGAAGGATTTGTTACGT
(SEQ ID NO:10440), TGGGGGCGATGGGAAGGATTTGTTACG (SEQ ID NO:10441),
GGGGGCGATGGGAAGGATTTGTTACGTT (SEQ ID NO:10442), TTGGGGGCGATGGGAAGGATTTGTTACG
(SEQ ID NO:10443), AGACGGTGGTGTAGGAGTTAGGGAAGA (SEQ ID NO:10444),
ACGGTGGTGTAGGAGTTAGGGAAGAAGT (SEQ ID NO:10445),
AGACGGTGGTGTAGGAGTTAGGGAAGAA (SEQ ID NO:10446),
GACGGTGGTGTAGGAGTTAGGGAAGAAGT (SEQ ID NO:10447),
GACGGTGGTGTAGGAGTTAGGGAAGAAG (SEQ ID NO:10448)

Target1109    chr10:119296170-119296211    CGGGTTGGCGTTCGAATTAGAGAGTGT (SEQ ID NO:10449), TCGGGTTGGCGTTCGAATTAGAGAGTGT
(SEQ ID NO:10450), TCGGGTTGGCGTTCGAATTAGAGAGTG (SEQ ID NO:10451),
CGGGTTGGCGTTCGAATTAGAGAGTGTA (SEQ ID NO:10452),
TCGGGTTGGCGTTCGAATTAGAGAGTGTA (SEQ ID NO:10453),
AGTTTAGGATCGAGTAAGGATTGGGAGGGA (SEQ ID NO:10454),
AAGTTTAGGATCGAGTAAGGATTGGGAGGGA (SEQ ID NO:10455),
CGAGTAAGGATTGGGAGGGATAGATAGACGT (SEQ ID NO:10456),
AGTTTAGGATCGAGTAAGGATTGGGAGGGAT (SEQ ID NO:10457),
TCGAGTAAGGATTGGGAGGGATAGATAGACG (SEQ ID NO:10458)

Target1110    chr10:119296327-119296362    TAGCGTGTGTGTGGTGAGGGAGTGACG (SEQ ID NO:10459), CGTGTGTGTGGTGAGGGAGTGACGAGT
(SEQ ID NO:10460), GCGTGTGTGTGGTGAGGGAGTGACGAG (SEQ ID NO:10461),
CGTGTGTGTGGTGAGGGAGTGACGAGTT (SEQ ID NO:10462), TCGAGATAGCGTGTGTGTGGTGAGGGA
(SEQ ID NO:10463), GCGGGTGGTTGTAGGGGCGTTGTTTTT (SEQ ID NO:10464),
GCGGGTGGTTGTAGGGGCGTTGTTTT (SEQ ID NO:10465), GCGGGTGGTTGTAGGGGCGTTGTTTTTT
(SEQ ID NO:10466), CGGGTGGTTGTAGGGGCGTTGTTTTTT (SEQ ID NO:10467),
GCGGGTGGTTGTAGGGGCGTTGTTT (SEQ ID NO:10468)

Target1111    chr10:119296414-119296468    TAGCGTGTGTGTGGTGAGGGAGTGACG (SEQ ID NO:10469), CGTGTGTGTGGTGAGGGAGTGACGAGT
(SEQ ID NO:10470), GGAGACGTAGAGGTTCGCGCGGATGTT (SEQ ID NO:10471),
AGGTTCGCGCGGATGTTTAGAGGAGGA (SEQ ID NO:10472), GCGTGTGTGTGGTGAGGGAGTGACGAG
(SEQ ID NO:10473), TTGGTTTTTGGGTTTCGCGGGTGGTTGT (SEQ ID NO:10474),
GCGGGTGGTTGTAGGGGCGTTGTTTTT (SEQ ID NO:10475), TTTTTGGGTTTCGCGGGTGGTTGTAGGG
(SEQ ID NO:10476), TGGTTTTTGGGTTTCGCGGGTGGTTGTA (SEQ ID NO:10477),
TTTGGGTTTCGCGGGTGGTTGTAGGGG (SEQ ID NO:10478)

FIGURE 5 CONTINUED

Target1112     chr10:119296552-119296567     AGGTTCGCGCGGATGTTTAGAGGAGGA (SEQ ID NO:10479), GAGGTTCGCGCGGATGTTTAGAGGAGG (SEQ ID NO:10480), GAGACGTAGAGGTTCGCGCGGATGTTT (SEQ ID NO:10481), AGAGGTTCGCGCGGATGTTTAGAGGAGG (SEQ ID NO:10482), GAGGTTCGCGCGGATGTTTAGAGGAGGA (SEQ ID NO:10483), TCGGTGATGTGGGGTCGTGGAATTCGT (SEQ ID NO:10484), CGGTGATGTGGGGTCGTGGAATTCGTT (SEQ ID NO:10485), TCGGTGATGTGGGGTCGTGGAATTCGTT (SEQ ID NO:10486), TTCGGTGATGTGGGGTCGTGGAATTCGT (SEQ ID NO:10487), TTCGGTGATGTGGGGTCGTGGAATTCG (SEQ ID NO:10488)

Target1113     chr10:123922876-123923563     GCGTTGGGGTTGTTCGGCGATGATGAT (SEQ ID NO:10489), GGTCGGGGTAGAGGGAGGGTTTTCGTT (SEQ ID NO:10490), AGGGGTCGGGGTAGAGGGAGGGTTTTC (SEQ ID NO:10491), GAGGGGTCGGGGTAGAGGGAGGGTTTT (SEQ ID NO:10492), TACGTCGGTTATATTCGGGCGCGCGTC (SEQ ID NO:10493), AGGGGAGTAGTTGCGGGTATTCGTGGC (SEQ ID NO:10494), CGGGGCGGTTCGGGCGGAGTATTTATA (SEQ ID NO:10495), GTTTTGTTCGGGGCGTGCGGGTATGAG (SEQ ID NO:10496), GGTTGGGGGTGGGGAGGCGAAGATTTT (SEQ ID NO:10497), GTTGGGGGTGGGGAGGCGAAGATTTTT (SEQ ID NO:10498)

Target1114     chr10:123923578-123923871     TTCGGGGAGGAGGAGAGAGGATGTTCGGG (SEQ ID NO:10499), CGGGGAGGAGGAGAGAGGATGTTCGGGTT (SEQ ID NO:10500), GGGGAGGAGGAGAGAGGATGTTCGGGTTT (SEQ ID NO:10501), TTTCGGGGAGGAGGAGAGAGGATGTTCGG (SEQ ID NO:10502), TCGGGGAGGAGGAGAGAGGATGTTCGGG (SEQ ID NO:10503), CGGGGGTGTAGAGGAAAGATGTTGACGG (SEQ ID NO:10504), CGGGGGTGTAGAGGAAAGATGTTGACGGT (SEQ ID NO:10505), TCGGGGGTGTAGAGGAAAGATGTTGACGG (SEQ ID NO:10506), TGTGTCGGGGGTGTAGAGGAAAGATGT (SEQ ID NO:10507), CGGGGGTGTAGAGGAAAGATGTTGACG (SEQ ID NO:10508)

Target1115     chr10:123923887-123924221     GCGTTTGTGGTTGGGTAGATGGCGTGG (SEQ ID NO:10509), TGCGTTTGTGGTTGGGTAGATGGCGTG (SEQ ID NO:10510), CGTTTGTGGTTGGGTAGATGGCGTGGT (SEQ ID NO:10511), TTGCGTTTGTGGTTGGGTAGATGGCGT (SEQ ID NO:10512), TTCGGGTAGTTGCGTTTGTGGTTGGGT (SEQ ID NO:10513), AGTGGGGGTAGGTGAGGTTGGGAGGTT (SEQ ID NO:10514), AAGTGGGGGTAGGTGAGGTTGGGAGGT (SEQ ID NO:10515), GTGGGGGTAGGTGAGGTTGGGAGGTTT (SEQ ID NO:10516), AAAGTGGGGGTAGGTGAGGTTGGGAGG (SEQ ID NO:10517), AGTGGGGGTAGGTGAGGTTGGGAGGT (SEQ ID NO:10518)

Target1116     chr10:124905635-124905831     GTTGCGACGTGGTTTAGGAGTTTGCGT (SEQ ID NO:10519), AGCGGGGTGGTTGGTATTGTTTTTCGA (SEQ ID NO:10520), GCGGGGTGGTTGGTATTGTTTTTCGAGT (SEQ ID NO:10521), GCGGGGTGGTTGGTATTGTTTTTCGAG (SEQ ID NO:10522), AGCGGGGTGGTTGGTATTGTTTTTCGAGT (SEQ ID NO:10523), TTCGGGAGGTTAGCGAGGGGTAGGTGT (SEQ ID NO:10524), GTTCGGGAGGTTAGCGAGGGGTAGGTG (SEQ ID NO:10525), TCGGGAGGTTAGCGAGGGGTAGGTGTC (SEQ ID NO:10526), TCGGGAGGTTAGCGAGGGGTAGGTGT (SEQ ID NO:10527), CGGGGAGGTTAGCGAGGGGTAGGTGTC (SEQ ID NO:10528)

Target1117     chr10:124905914-124905953     GTCGTTGAGTTTTGAAGAGGTTAATGCGGT (SEQ ID NO:10529), TCGTTGAGTTTTGAAGAGGTTAATGCGGTG (SEQ ID NO:10530), TGTCGTTGAGTTTTGAAGAGGTTAATGCGG (SEQ ID NO:10531), TGTCGTTGAGTTTTGAAGAGGTTAATGCGGT (SEQ ID NO:10532), CGTTGAGTTTTGAAGAGGTTAATGCGGTGAC (SEQ ID NO:10533), TTCGGGAGGTTAGCGAGGGGTAGGTGT (SEQ ID NO:10534), GTTCGGGAGGTTAGCGAGGGGTAGGTG (SEQ ID NO:10535), TCGGGAGGTTAGCGAGGGGTAGGTGTC (SEQ ID NO:10536), GGTTCGGGAGGTTAGCGAGGGGTAGGT (SEQ ID NO:10537), TCGGGAGGTTAGCGAGGGGTAGGTGT (SEQ ID NO:10538)

Target1118     chr10:124905957-124905981     TTTCGTTGGTTTTTCGGGTCGTTGCGC (SEQ ID NO:10539), TTTTCGTTGGTTTTTCGGGTCGTTGCGC (SEQ ID NO:10540), TTCGTTGGTTTTTCGGGTCGTTGCGC (SEQ ID NO:10541), TTTTCGTTGGTTTTTCGGGTCGTTGCG (SEQ ID NO:10542), TTTTTCGTTGGTTTTTCGGGTCGTTGCGC (SEQ ID NO:10543), GTAGTCGGGGTAGGGGTAGGCGAGGG (SEQ ID NO:10544), CGTAGTCGGGGTAGGGGTAGGCGAGG (SEQ ID NO:10545), TAGTCGGGGTAGGGGTAGGCGAGGG (SEQ ID NO:10546), GTAGTCGGGGTAGGGGTAGGCGAGGGG (SEQ ID NO:10547), CGTAGTCGGGGTAGGGGTAGGCGAGGG (SEQ ID NO:10548)

Target1119     chr10:124906003-124906042     CGTTTGTTTTTGTTTCGGTTGCGCGGTC (SEQ ID NO:10549), GTTTGTTTTTGTTTCGGTTGCGCGGT (SEQ ID NO:10550), GTTTGTTTTTGTTTCGGTTGCGCGGT (SEQ ID NO:10551), TTTGTTTTTGTTTCGGTTGCGCGGTC (SEQ ID NO:10552), TTGTTTTTGTTTCGGTTGCGCGGTC (SEQ ID NO:10553), TGGGTTAATTGATTAGGAGTCGGTCGCGT (SEQ ID NO:10554), GGGTTAATTGATTAGGAGTCGGTCGCGT (SEQ ID NO:10555), TGGGTTAATTGATTAGGAGTCGGTCGCG (SEQ ID NO:10556), ATGGGTTAATTGATTAGGAGTCGGTCGCG (SEQ ID NO:10557), ATGGGTTAATTGATTAGGAGTCGGTCGCGT (SEQ ID NO:10558)

Target1120     chr10:124906109-124906152     CGTTTGTTTTTGTTTCGGTTGCGCGGT (SEQ ID NO:10559), TCGTTTGTTTTTGTTTCGGTTGCGCGG (SEQ ID NO:10560), TCGTTTGTTTTTGTTTCGGTTGCGCGGT (SEQ ID NO:10561), CGTTTGTTTTTGTTTCGGTTGCGCGGTC (SEQ ID NO:10562), TCGTTTGTTTTTGTTTCGGTTGCGCGGTC (SEQ ID NO:10563), AGGGTGTTTTTTAAGTGTAGTTAAGGGTGAGTGG (SEQ ID NO:10564), GGGTGTTTTTTAAGTGTAGTTAAGGGTGAGTGGA (SEQ ID NO:10565), AGGGTGTTTTTTAAGTGTAGTTAAGGGTGAGTGGA (SEQ ID NO:10566),

FIGURE 5 CONTINUED

GGGTGTTTTTTAAGTGTAGTTAAGGGTGAGTGGAG (SEQ ID NO:10567),
AGGGTGTTTTTTAAGTGTAGTTAAGGGTGAGTGGAG (SEQ ID NO:10568)

| | | |
|---|---|---|
| Target1121 | chr10:124910456-124910790 | AGGGAATTGGGCGCGGTGAGGTAGTTT (SEQ ID NO:10569), GAGGGAATTGGGCGCGGTGAGGTAGTT (SEQ ID NO:10570), GAGAGGGAATTGGGCGCGGTGAGGTAG (SEQ ID NO:10571), GGGAATTGGGCGCGGTGAGGTAGTTTT (SEQ ID NO:10572), GGGAATTGGGCGCGGTGAGGTAGTTTTG (SEQ ID NO:10573), TTGGAGAGGAAGTGCGCGGTATAGGGT (SEQ ID NO:10574), TGGAGAGGAAGTGCGCGGTATAGGGTA (SEQ ID NO:10575), TTTGTTATCGGTCGGGTAGTTGGGCGT (SEQ ID NO:10576), TTTGGAGAGGAAGTGCGCGGTATAGGGT (SEQ ID NO:10577), TTTGGAGAGGAAGTGCGCGGTATAGGG (SEQ ID NO:10578) |
| Target1122 | chr10:124910846-124910976 | AGGGAATTGGGCGCGGTGAGGTAGTTT (SEQ ID NO:10579), GAGGGAATTGGGCGCGGTGAGGTAGTT (SEQ ID NO:10580), GAGAGGGAATTGGGCGCGGTGAGGTAG (SEQ ID NO:10581), GGGAATTGGGCGCGGTGAGGTAGTTTT (SEQ ID NO:10582), GGGAATTGGGCGCGGTGAGGTAGTTTTG (SEQ ID NO:10583), GCGGTCGTAGGTGTTAGGGCGAGGAAG (SEQ ID NO:10584), CGGTCGTAGGTGTTAGGGCGAGGAAGT (SEQ ID NO:10585), GCGGTCGTAGGTGTTAGGGCGAGGAA (SEQ ID NO:10586), CGGTCGTAGGTGTTAGGGCGAGGAAGTT (SEQ ID NO:10587), GCGGTCGCGTGTTAGTCGGTGATTTAGT (SEQ ID NO:10588) |
| Target1123 | chr10:124910989-124911104 | GGGGTTGGGAGGGCGTTGTATCGAGAG (SEQ ID NO:10589), CGTAGGGGTTGGGAGGGCGTTGTATCG (SEQ ID NO:10590), GTAGGGGTTGGGAGGGCGTTGTATCGA (SEQ ID NO:10591), TAGGGGTTGGGAGGGCGTTGTATCGAG (SEQ ID NO:10592), GCGTAGGGGTTGGGAGGGCGTTGTATC (SEQ ID NO:10593), AGGTCGGAGGAGTTCGTTTTAGGTGGT (SEQ ID NO:10594), GGTCGGAGGAGTTCGTTTTAGGTGGTGT (SEQ ID NO:10595), GGTCGGAGGAGTTCGTTTTAGGTGGTG (SEQ ID NO:10596), AGGTCGGAGGAGTTCGTTTTAGGTGGTGT (SEQ ID NO:10597), AGGTCGGAGGAGTTCGTTTTAGGTGGTG (SEQ ID NO:10598) |
| Target1124 | chr10:126135810-126135833 | TTTTTTATCGGGGGTGTAGGTGCGCGG (SEQ ID NO:10599), TTTTTATCGGGGGTGTAGGTGCGCGGG (SEQ ID NO:10600), TTTTTTATCGGGGGTGTAGGTGCGCGG (SEQ ID NO:10601), TTTTATCGGGGGTGTAGGTGCGCGGG (SEQ ID NO:10602), TTTTATCGGGGGTGTAGGTGCGCGGGT (SEQ ID NO:10603) |
| Target1125 | chr10:126135868-126135881 | AGATTTTTGATTTTTTGGTGGTTCGCGAGGA (SEQ ID NO:10604), CGGTAGATTTTTGATTTTTTGGTGGTTCGCG (SEQ ID NO:10605), ACGGTAGATTTTTGATTTTTTGGTGGTTCGCG (SEQ ID NO:10606), CGGTAGATTTTTGATTTTTTGGTGGTTCGCGA (SEQ ID NO:10607), ACGGTAGATTTTTGATTTTTTGGTGGTTCGCGA (SEQ ID NO:10608), TTTTTTATCGGGGGTGTAGGTGCGCGCG (SEQ ID NO:10609), TTTTTATCGGGGGTGTAGGTGCGCGGG (SEQ ID NO:10610), TTTTTTATCGGGGGTGTAGGTGCGCGG (SEQ ID NO:10611), TTTTATCGGGGGTGTAGGTGCGCGGG (SEQ ID NO:10612), TTTTATCGGGGGTGTAGGTGCGCGGGT (SEQ ID NO:10613) |
| Target1126 | chr10:126135895-126135908 | CGGCGGGTAGGGGTGCGTTGATATTCG (SEQ ID NO:10614), GCGGCGGGTAGGGGTGCGTTGATATTC (SEQ ID NO:10615), GGCGGGTAGGGGTGCGTTGATATTCG (SEQ ID NO:10616), CGGCGGGTAGGGGTGCGTTGATATTC (SEQ ID NO:10617), GCGGCGGGTAGGGGTGCGTTGATATT (SEQ ID NO:10618), TTTTTTATCGGGGGTGTAGGTGCGCGG (SEQ ID NO:10619), TTTTTATCGGGGGTGTAGGTGCGCGGG (SEQ ID NO:10620), TTTTTTATCGGGGGTGTAGGTGCGCGG (SEQ ID NO:10621), TTTTATCGGGGGTGTAGGTGCGCGGG (SEQ ID NO:10622), TTTTATCGGGGGTGTAGGTGCGCGGGT (SEQ ID NO:10623) |
| Target1127 | chr10:126135933-126135947 | CGGCGGGTAGGGGTGCGTTGATATTCG (SEQ ID NO:10624), GCGGCGGGTAGGGGTGCGTTGATATTC (SEQ ID NO:10625), GGCGGGTAGGGGTGCGTTGATATTCG (SEQ ID NO:10626), CGGCGGGTAGGGGTGCGTTGATATTC (SEQ ID NO:10627), GCGGCGGGTAGGGGTGCGTTGATATT (SEQ ID NO:10628), TCGCGGGATTTACGAGGGATTGGTATC (SEQ ID NO:10629), GGGAGTTTTTTCGCGTCGTTTTTTGGGT (SEQ ID NO:10630), GGGAGTTTTTTCGCGTCGTTTTTTGGG (SEQ ID NO:10631), GGGAGTTTTTTCGCGTCGTTTTTTGGGT (SEQ ID NO:10632), GGGAGTTTTTTCGCGTCGTTTTTTGGGTT (SEQ ID NO:10633) |
| Target1128 | chr10:126135960-126135972 | CGGCGGGTAGGGGTGCGTTGATATTCG (SEQ ID NO:10634), GCGGCGGGTAGGGGTGCGTTGATATTC (SEQ ID NO:10635), GGCGGGTAGGGGTGCGTTGATATTCG (SEQ ID NO:10636), CGGCGGGTAGGGGTGCGTTGATATTC (SEQ ID NO:10637), GCGGCGGGTAGGGGTGCGTTGATATT (SEQ ID NO:10638), GGGAGTTTTTTCGCGTCGTTTTTTGGGT (SEQ ID NO:10639), GGGAGTTTTTTCGCGTCGTTTTTTGGG (SEQ ID NO:10640), GGGAGTTTTTTCGCGTCGTTTTTTGGGTT (SEQ ID NO:10641), GGAGTTTTTTCGCGTCGTTTTTTGGGTT (SEQ ID NO:10642), GGGAGTTTTTTCGCGTCGTTTTTTGGGTT (SEQ ID NO:10643) |
| Target1129 | chr10:126135993-126136008 | CGGCGGGTAGGGGTGCGTTGATATTCG (SEQ ID NO:10644), GCGGCGGGTAGGGGTGCGTTGATATTC (SEQ ID NO:10645), TTCGCGAAAGAGGGGTTAGGGGGTTTC (SEQ ID NO:10646), GGCGGGTAGGGGTGCGTTGATATTCG (SEQ ID NO:10647), CGGCGGGTAGGGGTGCGTTGATATTC (SEQ ID NO:10648), GGGAGTTTTTTCGCGTCGTTTTTTGGGT (SEQ ID NO:10649), GGGAGTTTTTTCGCGTCGTTTTTTGGG (SEQ ID NO:10650), GGGAGTTTTTTCGCGTCGTTTTTTGGGTT (SEQ ID NO:10651), GGAGTTTTTTCGCGTCGTTTTTTGGGTT (SEQ ID NO:10652), GGGAGTTTTTTCGCGTCGTTTTTTGGGTTT (SEQ ID NO:10653) |

FIGURE 5 CONTINUED

Target1130     chr10:126136046-126136052     CGGGGCGTAGAAGGGGGTTAGGTAGGA (SEQ ID NO:10654), GGGGTTTCGGATTTATAGACGCGGGGC
(SEQ ID NO:10655), GCGGGGCGTAGAAGGGGGTTAGGTAG (SEQ ID NO:10656),
GGGGGTTTCGGATTTATAGACGCGGGG (SEQ ID NO:10657), AGGGGGTTTCGGATTTATAGACGCGGGG
(SEQ ID NO:10658)

Target1131     chr10:126136069-126136119     CGGGGCGTAGAAGGGGGTTAGGTAGGA (SEQ ID NO:10659), GGGGTTTCGGATTTATAGACGCGGGGC
(SEQ ID NO:10660), GCGGGGCGTAGAAGGGGGTTAGGTAG (SEQ ID NO:10661),
GGGGGTTTCGGATTTATAGACGCGGGG (SEQ ID NO:10662), AGGGGGTTTCGGATTTATAGACGCGGGG
(SEQ ID NO:10663), TAGGTGGGGGGTGGCGCGTTTTAGTTA (SEQ ID NO:10664),
GGCGGTTCGGGGGGGTAGTTTTGGTTTT (SEQ ID NO:10665), AGGTGGGGGGGTGGCGCGTTTTAGTTAG
(SEQ ID NO:10666), GTAGGTGGGGGGGTGGCGCGTTTTAGTT (SEQ ID NO:10667),
TAGGTGGGGGGGTGGCGCGTTTTAGTTAG (SEQ ID NO:10668)

Target1132     chr10:126136120-126136163     CGGGGCGTAGAAGGGGGTTAGGTAGGA (SEQ ID NO:10669), GGCGGACGGGAAGAGGATATTGGTCGC
(SEQ ID NO:10670), TGGTCGCGGAGTAGGAGGGGAAAGTTT (SEQ ID NO:10671),
TTGGTCGCGGAGTAGGAGGGGAAAGTT (SEQ ID NO:10672), ATTGGTCGCGGAGTAGGAGGGGAAAGT
(SEQ ID NO:10673), TAGGTGGGGGGTGGCGCGTTTTAGTTA (SEQ ID NO:10674),
GGCGGTTCGGGGGGGTAGTTTTGGTTTT (SEQ ID NO:10675), AGGTGGGGGGGTGGCGCGTTTTAGTTAG
(SEQ ID NO:10676), GTAGGTGGGGGGGTGGCGCGTTTTAGTT (SEQ ID NO:10677),
TAGGTGGGGGGGTGGCGCGTTTTAGTTAG (SEQ ID NO:10678)

Target1133     chr10:126136184-126136209     GGCGGACGGGAAGAGGATATTGGTCGC (SEQ ID NO:10679), TGGTCGCGGAGTAGGAGGGGAAAGTTT
(SEQ ID NO:10680), TTGGTCGCGGAGTAGGAGGGGAAAGTT (SEQ ID NO:10681),
ATTGGTCGCGGAGTAGGAGGGGAAAGT (SEQ ID NO:10682), TCGCGGAGTAGGAGGGGAAAGTTTGGA
(SEQ ID NO:10683), TAGGTGGGGGGTGGCGCGTTTTAGTTA (SEQ ID NO:10684),
AGGTGGGGGGGTGGCGCGTTTTAGTTAG (SEQ ID NO:10685), GTAGGTGGGGGGGTGGCGCGTTTTAGTT
(SEQ ID NO:10686), TAGGTGGGGGGGTGGCGCGTTTTAGTTAG (SEQ ID NO:10687),
GTAGGTGGGGGGGTGGCGCGTTTTAGTTA (SEQ ID NO:10688)

Target1134     chr10:126136211-126136229     TTTTTCGTCGTTTTTGGTTGGGGCGCG (SEQ ID NO:10689), GGCGGACGGGAAGAGGGATATTGGTCGC
(SEQ ID NO:10690), TGGTCGCGGAGTAGGAGGGGAAAGTTT (SEQ ID NO:10691),
TTGGTCGCGGAGTAGGAGGGGAAAGTT (SEQ ID NO:10692), ATTGGTCGCGGAGTAGGAGGGGAAAGT
(SEQ ID NO:10693), TAGGTGGGGGGTGGCGCGTTTTAGTTA (SEQ ID NO:10694),
AGGTGGGGGGGTGGCGCGTTTTAGTTAG (SEQ ID NO:10695), GTAGGTGGGGGGGTGGCGCGTTTTAGTT
(SEQ ID NO:10696), TAGGTGGGGGGGTGGCGCGTTTTAGTTAG (SEQ ID NO:10697),
GTAGGTGGGGGGGTGGCGCGTTTTAGTTA (SEQ ID NO:10698)

Target1135     chr10:126136244-126136256     TTCGTCGTTTTTGGTTGGGGCGCGTTA (SEQ ID NO:10699), TCGTCGTTTTTGGTTGGGGCGCGTTAT (SEQ
ID NO:10700), TTTTTCGTCGTTTTTGGTTGGGGCGCG (SEQ ID NO:10701),
TTTCGTCGTTTTTGGTTGGGGCGCGTT (SEQ ID NO:10702), TTTTCGTCGTTTTTGGTTGGGGCGCGT (SEQ
ID NO:10703), GCGTTATTTGTTAGTGTGCGAGCGTTTG (SEQ ID NO:10704),
GCGTTATTTGTTAGTGTGCGAGCGTTGA (SEQ ID NO:10705),
GCGTTATTTGTTAGTGTGCGAGCGTTGAA (SEQ ID NO:10706),
GCGTTATTTGTTAGTGTGCGAGCGTTTGAAT (SEQ ID NO:10707),
GCGTTATTTGTTAGTGTGCGAGCGTTGAATT (SEQ ID NO:10708)

Target1136     chr10:126136316-126136358     TTCGTCGTTTTTGGTTGGGGCGCGTTA (SEQ ID NO:10709), TCGTCGTTTTTGGTTGGGGCGCGTTAT (SEQ
ID NO:10710), TTTTTCGTCGTTTTTGGTTGGGGCGCG (SEQ ID NO:10711),
TTTCGTCGTTTTTGGTTGGGGCGCGTT (SEQ ID NO:10712), TTTTCGTCGTTTTTGGTTGGGGCGCGT (SEQ
ID NO:10713), CGTCGGCGTTTGGAGTTTAATTGCGTT (SEQ ID NO:10714),
CGTCGGCGTTTGGAGTTTAATTGCGT (SEQ ID NO:10715), CGTCGGCGTTTGGAGTTTAATTGCGTTA (SEQ
ID NO:10716), GCGTTATTTGTTAGTGTGCGAGCGTTTG (SEQ ID NO:10717),
CGTCGGCGTTTGGAGTTTAATTGCGTTAA (SEQ ID NO:10718)

Target1137     chr10:129534514-129534541     TTATAGCGCGGGGAGTAGGGGAGGTCG (SEQ ID NO:10719), TTTATAGCGCGGGGAGTAGGGGAGGTC
(SEQ ID NO:10720), GCGGGGAGTAGGGGAGGTCGAAAGTC (SEQ ID NO:10721),
TTTTATAGCGCGGGGAGTAGGGGAGGT (SEQ ID NO:10722), TATAGCGCGGGGAGTAGGGGAGGTCGA
(SEQ ID NO:10723), TGTCGTTCGGGGTTGTTGTAGTTCGGGT (SEQ ID NO:10724),
GTCGTTCGGGGTTGTTGTAGTTCGGGT (SEQ ID NO:10725), TGTCGTTCGGGGTTGTTGTAGTTCGGG
(SEQ ID NO:10726), TCGTTCGGGGTTGTTGTAGTTCGGGTT (SEQ ID NO:10727),
GTCGTTCGGGGTTGTTGTAGTTCGGGTT (SEQ ID NO:10728)

Target1138     chr10:129534613-129534710     AGTCGGGTAGTTTGGGGGGTCGGGATA (SEQ ID NO:10729), TTGGGGGGTCGGGATAATTCGGGTTGT
(SEQ ID NO:10730), TTATAGCGCGGGGAGTAGGGGAGGTCG (SEQ ID NO:10731),
AGTTTGGGGGGTCGGGATAATTCGGGT (SEQ ID NO:10732), GTCGGGTAGTTTGGGGGGTCGGGATAA
(SEQ ID NO:10733), GTCGGGGAGTTCGGGGGTTTCGTTAGGT (SEQ ID NO:10734),
AGTCGGGGAGTTCGGGGGTTTCGTTAGG (SEQ ID NO:10735), TCGGGGAGTTCGGGGGTTTCGTTAGGTT
(SEQ ID NO:10736), GTCGGGGAGTTCGGGGGTTTCGTTAGGTT (SEQ ID NO:10737),
AAGTCGGGGAGTTCGGGGGTTTCGTTAGG (SEQ ID NO:10738)

Target1139     chr10:129534807-129534867     TGGCGGGGTTTCGGATTTTTCGGTTTG (SEQ ID NO:10739), TTGGCGGGGTTTCGGATTTTTCGGTTT (SEQ
ID NO:10740), TTTGGCGGGGTTTCGGATTTTTCGGTT (SEQ ID NO:10741),
TTCGTTGTTTTTCGGGTTGAGGGGAGCG (SEQ ID NO:10742), TTGGCGGGGTTTCGGATTTTTCGGTTTG
(SEQ ID NO:10743), GCGGGGTTTGGGTTTGGATAGCGGTTTT (SEQ ID NO:10744),
GGGTTTGGATAGCGGTTTTTGGGGTCGT (SEQ ID NO:10745), TGGGTTTGGATAGCGGTTTTTGGGGTCG

FIGURE 5 CONTINUED (SEQ ID NO:10746), CGGGGTTGGGTTTGGATAGCGGTTTTGG (SEQ ID NO:10747),
GGGTTGGGTTTGGATAGCGGTTTTGGGG (SEQ ID NO:10748)

Target1140    chr10:129534960-129534983    CGTTGTTTTTCGGGTTGAGGGAGCGAGG (SEQ ID NO:10749), TCGTTGTTTTTCGGGTTGAGGGAGCGA
(SEQ ID NO:10750), TTGTTTTTCGGGTTGAGGGAGCGAGGA (SEQ ID NO:10751),
CGTTGTTTTTCGGGTTGAGGGAGCGAG (SEQ ID NO:10752), TGTTTTTCGGGTTGAGGGAGCGAGGAT
(SEQ ID NO:10753), GGGATTCGGGGTTAGGGATAGAGGGCG (SEQ ID NO:10754),
GGGATTCGGGGTTAGGGATAGAGGGCGA (SEQ ID NO:10755),
GGGGATTCGGGGTTAGGGATAGAGGGCGA (SEQ ID NO:10756), TCGTCGGGGTTTTTGGGTTATTCGGGA
(SEQ ID NO:10757), GGATTCGGGGTTAGGGATAGAGGGCGAT (SEQ ID NO:10758)

Target1141    chr10:129535075-129535091    GGGTAATTTAGGGGTTTCGGCGAGGCG (SEQ ID NO:10759), CGGGTAATTTAGGGGTTTCGGCGAGGC
(SEQ ID NO:10760), TAGGGGTTTCGGCGAGGCGAGTTTTTT (SEQ ID NO:10761),
TTAGGGGTTTCGGCGAGGCGAGTTTTT (SEQ ID NO:10762), TTTAGGGGTTTCGGCGAGGCGAGTTTT
(SEQ ID NO:10763), GGTTTGGGAGTTTCGTTTAATGCGCGGT (SEQ ID NO:10764),
TGGTTTGGGAGTTTCGTTTAATGCGCGG (SEQ ID NO:10765), TGGGTTTGGGAGTTTCGTTTAATGCGCGGT
(SEQ ID NO:10766), GGTTTGGGAGTTTCGTTTAATGCGCGG (SEQ ID NO:10767),
GTGGTTTGGGAGTTTCGTTTAATGCGCGG (SEQ ID NO:10768)

Target1142    chr10:130085065-130085094    CGTAGGGTGTAATTCGGACGCGTTTTC (SEQ ID NO:10769), TGTTATTTCGGGGAAGGTTACGTAGGGTGT
(SEQ ID NO:10770), GTTATTTCGGGGAAGGTTACGTAGGGTGT (SEQ ID NO:10771),
TGTTATTTCGGGGAAGGTTACGTAGGGTG (SEQ ID NO:10772),
TTGTTATTTCGGGGAAGGTTACGTAGGGTG (SEQ ID NO:10773),
ATGGGGTGGGCGTTAGTGTAGGTTGGG (SEQ ID NO:10774), GTGTAGGTTGGGGGGTGTGGTTGTTGCG
(SEQ ID NO:10775), TGGGCGTTAGTGTAGGTTGGGGGTGTG (SEQ ID NO:10776),
GGCGTTAGTGTAGGTTGGGGGTGTGGT (SEQ ID NO:10777), GTGGGCGTTAGTGTAGGTTGGGGGTGT
(SEQ ID NO:10778)

Target1143    chr10:130085140-130085149    CGTAGGGTGTAATTCGGACGCGTTTTC (SEQ ID NO:10779), TGTTATTTCGGGGAAGGTTACGTAGGGTGT
(SEQ ID NO:10780), GTTATTTCGGGGAAGGTTACGTAGGGTGT (SEQ ID NO:10781),
TGTTATTTCGGGGAAGGTTACGTAGGGTG (SEQ ID NO:10782),
TTGTTATTTCGGGGAAGGTTACGTAGGGTG (SEQ ID NO:10783), TAGGGAGGGCGTTTTTGGTCGGGTTGT
(SEQ ID NO:10784), GTAGGGAGGGCGTTTTTGGTCGGGTTG (SEQ ID NO:10785),
GGTAGGGAGGGCGTTTTTGGTCGGGTT (SEQ ID NO:10786), CGTTTTTGGTCGGGTTGTGCGTTGGTC
(SEQ ID NO:10787), GCGTTTTTGGTCGGGTTGTGCGTTGGT (SEQ ID NO:10788)

Target1144    chr10:130085154-130085179    CGTAGGGTGTAATTCGGACGCGTTTTC (SEQ ID NO:10789), GGGTAGGGAGCGCGCGTTTTTATCG (SEQ
ID NO:10790), TGTTATTTCGGGGAAGGTTACGTAGGGTGT (SEQ ID NO:10791),
GTTATTTCGGGGAAGGTTACGTAGGGTGT (SEQ ID NO:10792),
TGTTATTTCGGGGAAGGTTACGTAGGGTG (SEQ ID NO:10793), TAGGGAGGGCGTTTTTGGTCGGGTTGT
(SEQ ID NO:10794), GTAGGGAGGGCGTTTTTGGTCGGGTTG (SEQ ID NO:10795),
GATTAAAGGGTCGGCGGCGGTAGGGAG (SEQ ID NO:10796), GGTAGGGAGGGCGTTTTTGGTCGGGTT
(SEQ ID NO:10797), CGTTTTTGGTCGGGTTGTGCGTTGGTC (SEQ ID NO:10798)

Target1145    chr10:130085199-130085219    GGTAGGGAGCGCGCGTTTTTATCGGTT (SEQ ID NO:10799), GGGTAGGGAGCGCGCGTTTTTATCGGT
(SEQ ID NO:10800), GGGTAGGGAGCGCGCGTTTTTATCGG (SEQ ID NO:10801),
TAGGGAGCGCGCGTTTTTATCGGTTGA (SEQ ID NO:10802), GGTAGGGAGCGCGCGTTTTTATCGGTTG
(SEQ ID NO:10803), ATAGCGTTGGTTGTGGTTTGCGGGTCG (SEQ ID NO:10804),
TAGGGAGGGCGTTTTTGGTCGGGTTGT (SEQ ID NO:10805), GTAGGGAGGGCGTTTTTGGTCGGGTTG
(SEQ ID NO:10806), GATTAAAGGGTCGGCGGCGGTAGGGAG (SEQ ID NO:10807),
GGTAGGGAGGGCGTTTTTGGTCGGGTT (SEQ ID NO:10808)

Target1146    chr10:130085262-130085296    GGTAGGGAGCGCGCGTTTTTATCGGTT (SEQ ID NO:10809), GGGTAGGGAGCGCGCGTTTTTATCGGT
(SEQ ID NO:10810), GGGTAGGGAGCGCGCGTTTTTATCGG (SEQ ID NO:10811),
TAGGGAGCGCGCGTTTTTATCGGTTGA (SEQ ID NO:10812), GGTAGGGAGCGCGCGTTTTTATCGGTTG
(SEQ ID NO:10813), ATAGCGTTGGTTGTGGTTTGCGGGTCG (SEQ ID NO:10814),
TAGCGTTGGTTGTGGTTTGCGGGTCG (SEQ ID NO:10815), GTCGGTCGGTCGGGTTTTGATGTGCG (SEQ
ID NO:10816), TATAGCGTTGGTTGTGGTTTGCGGGTCG (SEQ ID NO:10817),
GCGGTTCGGGGATTCGTGCGTTTGAG (SEQ ID NO:10818)

Target1147    chr10:130085311-130085357    GTTAGCGTTGTGTTGGGTAGGTGGCGG (SEQ ID NO:10819), TTAGCGTTGTGTTGGGTAGGTGGCGGT
(SEQ ID NO:10820), TAGCGTTGTGTTGGGTAGGTGGCGGTA (SEQ ID NO:10821),
AGCGTTGTGTTGGGTAGGTGGCGGTAG (SEQ ID NO:10822), TAGCGTTGTGTTGGGTAGGTGGCGGTAG
(SEQ ID NO:10823), GTCGGTCGGTCGGGTTTTGATGTGCG (SEQ ID NO:10824),
GCGGTTCGGGGATTCGTGCGTTTGAG (SEQ ID NO:10825), GTCGGTCGGTCGGGTTTTGATGTGCGG (SEQ
ID NO:10826), GCGGTTCGGGGATTCGTGCGTTTGA (SEQ ID NO:10827),
TCGGTCGGTCGGGTTTTGATGTGCGG (SEQ ID NO:10828)

Target1148    chr10:130085373-130085381    GTTAGCGTTGTGTTGGGTAGGTGGCGG (SEQ ID NO:10829), TTAGCGTTGTGTTGGGTAGGTGGCGGT
(SEQ ID NO:10830), TAGCGTTGTGTTGGGTAGGTGGCGGTA (SEQ ID NO:10831),
AGCGTTGTGTTGGGTAGGTGGCGGTAG (SEQ ID NO:10832), AGTTAGCGTTGTGTTGGGTAGGTGGCG
(SEQ ID NO:10833), GTCGGTCGGTCGGGTTTTGATGTGCG (SEQ ID NO:10834),
GTCGGTCGGTCGGGTTTTGATGTGCGG (SEQ ID NO:10835), TCGGTCGGTCGGGTTTTGATGTGCGG (SEQ

FIGURE 5 CONTINUED

ID NO:10836), TCGGTCGGTCGGGTTTTGATGTGCG (SEQ ID NO:10837),
GTCGGTCGGGTTTTGATGTGCGGCGTG (SEQ ID NO:10838)

| | | |
|---|---|---|
| Target1149 | chr10:130732658-130732844 | GTGTTTTTTGGTTTTTGTTGACGTTGGTTGAGA (SEQ ID NO:10839), TGTGTTTTTTGGTTTTTGTTGACGTTGGTTGAGA (SEQ ID NO:10840), GGATTGTGTTTTTTGGTTTTTGTTGACGTTGGTT (SEQ ID NO:10841), TGGATTGTGTTTTTTGGTTTTTGTTGACGTTGGTT (SEQ ID NO:10842), TGTTTTTTGGTTTTTGTTGACGTTGGTTGAGAAA (SEQ ID NO:10843), GAGTGTATGTGGGTCGTGGAGGGGGAA (SEQ ID NO:10844), GGAGTGTATGTGGGTCGTGGAGGGGGA (SEQ ID NO:10845), AGGAGTGTATGTGGGTCGTGGAGGGGG (SEQ ID NO:10846), AGTGTATGTGGGTCGTGGAGGGGGAAA (SEQ ID NO:10847), GGAGTGTATGTGGGTCGTGGAGGGGG (SEQ ID NO:10848) |
| Target1150 | chr10:131213563-131213642 | AGGTTAACGTCGGGAAAAGTTCGGGGT (SEQ ID NO:10849), GGTTAACGTCGGGAAAAGTTCGGGGTT (SEQ ID NO:10850), AGGTTAACGTCGGGAAAAGTTCGGGGTT (SEQ ID NO:10851), AAGGTTAACGTCGGGAAAAGTTCGGGGT (SEQ ID NO:10852), AAGGTTAACGTCGGGAAAAGTTCGGGG (SEQ ID NO:10853), TTGGAGTGGAATTCGGGAGGTTTCGGA (SEQ ID NO:10854), TGGAGTGGAATTCGGGAGGTTTCGGAT (SEQ ID NO:10855), ATTGGAGTGGAATTCGGGAGGTTTCGG (SEQ ID NO:10856), TTGGAGTGGAATTCGGGAGGTTTCGGAT (SEQ ID NO:10857), ATTGGAGTGGAATTCGGGAGGTTTCGGA (SEQ ID NO:10858) |
| Target1151 | chr10:131223363-131223405 | TGGAAGGGTTGGGTTGTAGGAGGGGTT (SEQ ID NO:10859), TTGGAAGGGTTGGGTTGTAGGAGGGGT (SEQ ID NO:10860), TTGGAAGGGTTGGGTTGTAGGAGGGGTT (SEQ ID NO:10861), TTTGGAAGGGTTGGGTTGTAGGAGGGGT (SEQ ID NO:10862), TTTGGAAGGGTTGGGTTGTAGGAGGGG (SEQ ID NO:10863), CGAGGGCGTTGATAGGTAGAGGAAGTTTCG (SEQ ID NO:10864), AGGGCGTTGATAGGTAGAGGAAGTTTCG (SEQ ID NO:10865), CGAGGGCGTTGATAGGTAGAGGAAGTTT (SEQ ID NO:10866), GGGCGTTGATAGGTAGAGGAAGTTTCGA (SEQ ID NO:10867), AGGGCGTTGATAGGTAGAGGAAGTTTCGA (SEQ ID NO:10868) |
| Target1152 | chr10:131223459-131223546 | TCGAAGAGTTGGCGGAGAGAAGCGGTT (SEQ ID NO:10869), CGAAGAGTTGGCGGAGAGAAGCGGTTT (SEQ ID NO:10870), TCGAAGAGTTGGCGGAGAGAAGCGGTTT (SEQ ID NO:10871), TCGAAGAGTTGGCGGAGAGAAGCGGT (SEQ ID NO:10872), CGAAGAGTTGGCGGAGAGAAGCGGTTTT (SEQ ID NO:10873), TGGAGTGGTTGTTGTGGAGGTTTTCGG (SEQ ID NO:10874), TGGAGTGGTTGTTGTGGAGGTTTTCGGA (SEQ ID NO:10875), GGAGTGGTTGTTGTGGAGGTTTTCGGA (SEQ ID NO:10876), TGGAGTGGTTGTTGTGGAGGTTTTCGGAG (SEQ ID NO:10877), GGAGTGGTTGTTGTGGAGGTTTTCGGAG (SEQ ID NO:10878) |
| Target1153 | chr10:131756715-131756728 | AGCGCGCGTGTATGTGAGAATTGGATT (SEQ ID NO:10879), GCGCGCGTGTATGTGAGAATTGGATTGT (SEQ ID NO:10880), GCGCGCGTGTATGTGAGAATTGGATTG (SEQ ID NO:10881), AGCGCGCGTGTATGTGAGAATTGGATTGT (SEQ ID NO:10882), AGCGCGCGTGTATGTGAGAATTGGATTGT (SEQ ID NO:10883) |
| Target1154 | chr10:131756883-131756961 | AGGATGCGAGCGTTTGAGAAGGAAGTA (SEQ ID NO:10884), TAGGATGCGAGCGTTTGAGAAGGAAGT (SEQ ID NO:10885), GGATGCGAGCGTTTGAGAAGGAAGTAGT (SEQ ID NO:10886), AGGATGCGAGCGTTTGAGAAGGAAGTAGT (SEQ ID NO:10887), AGGATGCGAGCGTTTGAGAAGGAAGTAG (SEQ ID NO:10888), AGCGGATTAATATGTGGGTCGTGTCGT (SEQ ID NO:10889), TGTGGGTCGTGTCGTTGTAGTGTAGTT (SEQ ID NO:10890), GAGCGGATTAATATGTGGGTCGTGTCGT (SEQ ID NO:10891), AGAGCGGATTAATATGTGGGTCGTGTCGT (SEQ ID NO:10892), AGAGCGGATTAATATGTGGGTCGTGTCG (SEQ ID NO:10893) |
| Target1155 | chr10:131756982-131757005 | AGGCGTCGTTATTTCGTTTAGTTTCGGG (SEQ ID NO:10894), GGCGTCGTTATTTCGTTTAGTTTCGGGA (SEQ ID NO:10895), AGGCGTCGTTATTTCGTTTAGTTTCGGGA (SEQ ID NO:10896), CGTCGGGTCGCGGAGGAGTTCG (SEQ ID NO:10897), GGCGTCGTTATTTCGTTTAGTTTCGGGAAGGG (SEQ ID NO:10898) |
| Target1156 | chr10:131757011-131757071 | TTGGGGGGAAGGAGCGCGGGTTTTTTC (SEQ ID NO:10899), GTTGGGGGGAAGGAGCGCGGGTTTTTT (SEQ ID NO:10900), TTGGGGGGAAGGAGCGCGGGTTTTTTT (SEQ ID NO:10901), GGGGGGAAGGAGCGCGGGTTTTTTC (SEQ ID NO:10902), TGGGGGGAAGGAGCGCGGGTTTTTTC (SEQ ID NO:10903), GCGGGTTGTTTCGGCGTTAGTTGCGTT (SEQ ID NO:10904), CGGGTTGTTTCGGCGTTAGTTGCGTTT (SEQ ID NO:10905), GCGGGTTGTTTCGGCGTTAGTTGCGT (SEQ ID NO:10906), GCGGGTTGTTTCGGCGTTAGTTGCGTTT (SEQ ID NO:10907), CGGGTTGTTTCGGCGTTAGTTGCGTT (SEQ ID NO:10908) |
| Target1157 | chr10:131757107-131757192 | TTGGGGGGAAGGAGCGCGGGTTTTTTC (SEQ ID NO:10909), GTTGGGGGGAAGGAGCGCGGGTTTTTT (SEQ ID NO:10910), TTGGGGGGAAGGAGCGCGGGTTTTTT (SEQ ID NO:10911), GGGGGGAAGGAGCGCGGGTTTTTTC (SEQ ID NO:10912), TGGGGGGAAGGAGCGCGGGTTTTTTC (SEQ ID NO:10913), GCGGGTTGTTTCGGCGTTAGTTGCGTT (SEQ ID NO:10914), CGGGTTGTTTCGGCGTTAGTTGCGTTT (SEQ ID NO:10915), ACGAGATTATGTGTAGGTGAGCGGCGGG (SEQ ID NO:10916), CGAGATTATGTGTAGGTGAGCGGCGGG (SEQ ID NO:10917), ACGAGATTATGTGTAGGTGAGCGGCGG (SEQ ID NO:10918) |
| Target1158 | chr10:134977981-134978016 | TCGTGGGGTTTTCGTGGGTGTTGGGTA (SEQ ID NO:10919), GTAGATAGGTGCGTAGGAGGCGGCGTT (SEQ ID NO:10920), TAGATAGGTGCGTAGGAGGCGGCGTTG (SEQ ID NO:10921), TTGTCGTGGGGTTTTCGTGGGTGTTGG (SEQ ID NO:10922), CGTGGGGTTTTCGTGGGTGTTGGGTAG (SEQ ID NO:10923), GTTTAGTCGGGTTGCGGGGTTGTCGAG (SEQ ID NO:10924), |

FIGURE 5 CONTINUED

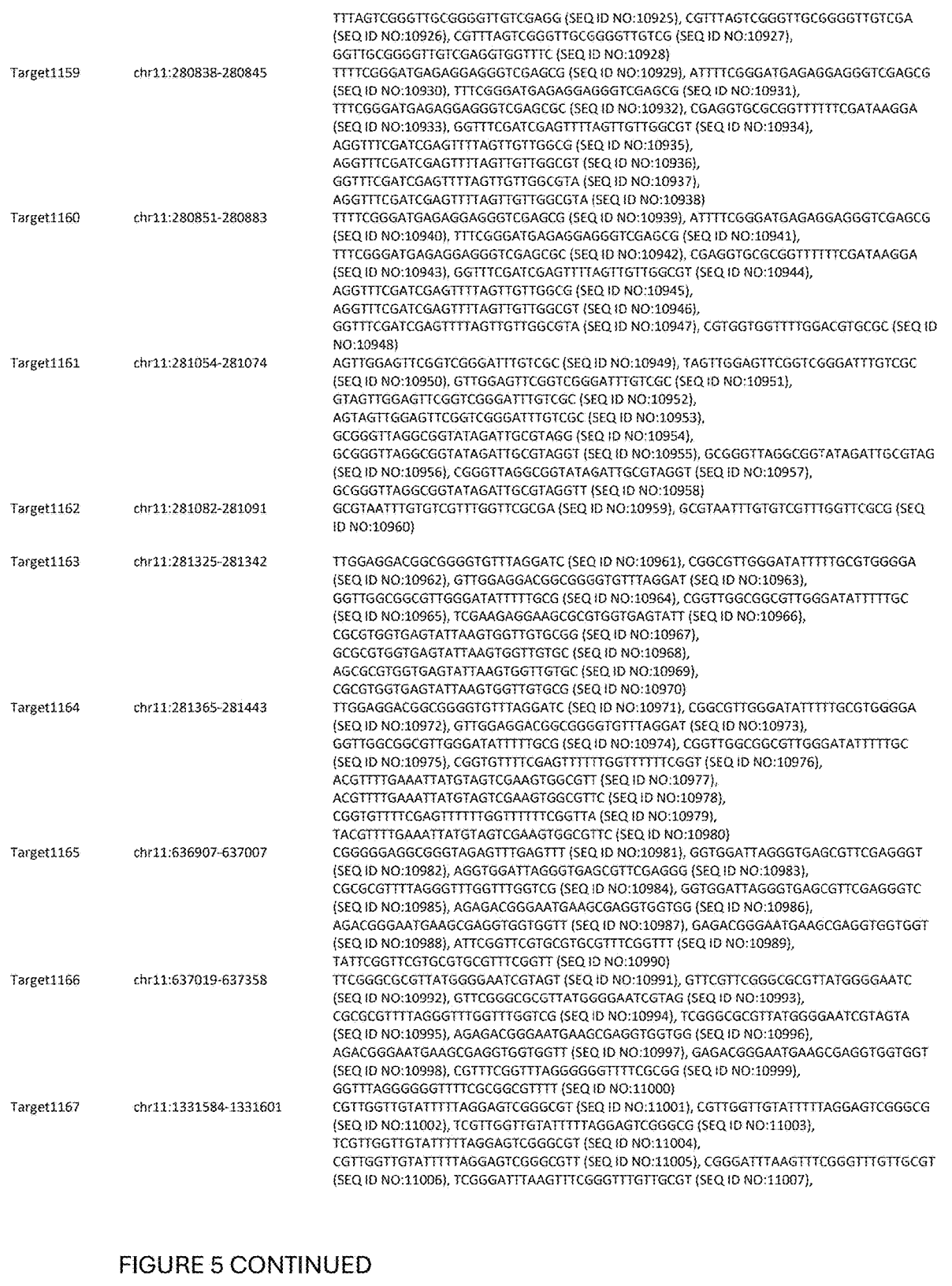

|  |  | TTTAGTCGGGTTGCGGGGTTGTCGAGG (SEQ ID NO:10925), CGTTTAGTCGGGTTGCGGGGTTGTCGA (SEQ ID NO:10926), CGTTTAGTCGGGTTGCGGGGTTGTCG (SEQ ID NO:10927), GGTTGCGGGGTTGTCGAGGTGGTTTC (SEQ ID NO:10928) |
|---|---|---|
| Target1159 | chr11:280838-280845 | TTTTCGGGATGAGAGGAGGGTCGAGCG (SEQ ID NO:10929), ATTTTCGGGATGAGAGGAGGGTCGAGCG (SEQ ID NO:10930), TTTCGGGATGAGAGGAGGGTCGAGCG (SEQ ID NO:10931), TTTCGGGATGAGAGGAGGGTCGAGCGC (SEQ ID NO:10932), CGAGGTGCGCGGTTTTTTCGATAAGGA (SEQ ID NO:10934), GGTTTCGATCGAGTTTTAGTTGTTGGCG (SEQ ID NO:10935), AGGTTTCGATCGAGTTTTAGTTGTTGGCG (SEQ ID NO:10936), AGGTTTCGATCGAGTTTTAGTTGTTGGCGT (SEQ ID NO:10936), GGTTTCGATCGAGTTTTAGTTGTTGGCGTA (SEQ ID NO:10937), AGGTTTCGATCGAGTTTTAGTTGTTGGCGTA (SEQ ID NO:10938) |
| Target1160 | chr11:280851-280883 | TTTTCGGGATGAGAGGAGGGTCGAGCG (SEQ ID NO:10939), ATTTTCGGGATGAGAGGAGGGTCGAGCG (SEQ ID NO:10940), TTTCGGGATGAGAGGAGGGTCGAGCG (SEQ ID NO:10941), TTTCGGGATGAGAGGAGGGTCGAGCGC (SEQ ID NO:10942), CGAGGTGCGCGGTTTTTTCGATAAGGA (SEQ ID NO:10943), GGTTTCGATCGAGTTTTAGTTGTTGGCGT (SEQ ID NO:10944), AGGTTTCGATCGAGTTTTAGTTGTTGGCG (SEQ ID NO:10945), AGGTTTCGATCGAGTTTTAGTTGTTGGCGT (SEQ ID NO:10946), GGTTTCGATCGAGTTTTAGTTGTTGGCGTA (SEQ ID NO:10947), CGTGGTGGTTTTGGACGTGCGC (SEQ ID NO:10948) |
| Target1161 | chr11:281054-281074 | AGTTGGAGTTCGGTCGGGATTTGTCGC (SEQ ID NO:10949), TAGTTGGAGTTCGGTCGGGATTTGTCGC (SEQ ID NO:10950), GTTGGAGTTCGGTCGGGATTTGTCGC (SEQ ID NO:10951), GTAGTTGGAGTTCGGTCGGGATTTGTCGC (SEQ ID NO:10952), AGTAGTTGGAGTTCGGTCGGGATTTGTCGC (SEQ ID NO:10953), GCGGGTTAGGCGGTATAGATTGCGTAGG (SEQ ID NO:10954), GCGGGTTAGGCGGTATAGATTGCGTAGGT (SEQ ID NO:10955), GCGGGTTAGGCGGTATAGATTGCGTAG (SEQ ID NO:10956), CGGGTTAGGCGGTATAGATTGCGTAGGT (SEQ ID NO:10957), GCGGGTTAGGCGGTATAGATTGCGTAGGTT (SEQ ID NO:10958) |
| Target1162 | chr11:281082-281091 | GCGTAATTTGTGTCGTTTGGTTCGCGA (SEQ ID NO:10959), GCGTAATTTGTGTCGTTTGGTTCGCG (SEQ ID NO:10960) |
| Target1163 | chr11:281325-281342 | TTGGAGGACGGCGGGGTGTTTAGGATC (SEQ ID NO:10961), CGGCGTTGGGATATTTTTGCGTGGGGA (SEQ ID NO:10962), GTTGGAGGACGGCGGGGTGTTTAGGAT (SEQ ID NO:10963), GGTTGGCGGCGTTGGGATATTTTTGCG (SEQ ID NO:10964), CGGTTGGCGGCGTTGGGATATTTTTGC (SEQ ID NO:10965), TCGAAGAGGAAGCGCGTGGTGAGTATT (SEQ ID NO:10966), CGCGTGGTGAGTATTAAGTGGTTGTGCGG (SEQ ID NO:10967), GCGCGTGGTGAGTATTAAGTGGTTGTGC (SEQ ID NO:10968), AGCGCGTGGTGAGTATTAAGTGGTTGTGC (SEQ ID NO:10969), CGCGTGGTGAGTATTAAGTGGTTGTGCG (SEQ ID NO:10970) |
| Target1164 | chr11:281365-281443 | TTGGAGGACGGCGGGGTGTTTAGGATC (SEQ ID NO:10971), CGGCGTTGGGATATTTTTGCGTGGGGA (SEQ ID NO:10972), GTTGGAGGACGGCGGGGTGTTTAGGAT (SEQ ID NO:10973), GGTTGGCGGCGTTGGGATATTTTTGCG (SEQ ID NO:10974), CGGTTGGCGGCGTTGGGATATTTTTGC (SEQ ID NO:10975), CGGTGTTTTCGAGTTTTTTGGTTTTTTCGGT (SEQ ID NO:10976), ACGTTTTGAAATTATGTAGTCGAAGTGGCGTT (SEQ ID NO:10977), ACGTTTTGAAATTATGTAGTCGAAGTGGCGTTC (SEQ ID NO:10978), CGGTGTTTTCGAGTTTTTTGGTTTTTTCGGTTA (SEQ ID NO:10979), TACGTTTTGAAATTATGTAGTCGAAGTGGCGTTC (SEQ ID NO:10980) |
| Target1165 | chr11:636907-637007 | CGGGGGGAGGCGGGTAGAGTTTGAGTTT (SEQ ID NO:10981), GGTGGATTAGGGTGAGCGTTCGAGGGT (SEQ ID NO:10982), AGGTGGATTAGGGTGAGCGTTCGAGGG (SEQ ID NO:10983), CGCGCGTTTTAGGGTTTGGTTTGGTCG (SEQ ID NO:10984), GGTGGATTAGGGTGAGCGTTCGAGGGTC (SEQ ID NO:10985), AGAGACGGGAATGAAGCGAGGTGGTGG (SEQ ID NO:10986), AGACGGGAATGAAGCGAGGTGGTGGTT (SEQ ID NO:10987), GAGACGGGAATGAAGCGAGGTGGTGGT (SEQ ID NO:10988), ATTCGGTTCGTGCGTGCGTTTCGGTTT (SEQ ID NO:10989), TATTCGGTTCGTGCGTGCGTTTCGGTT (SEQ ID NO:10990) |
| Target1166 | chr11:637019-637358 | TTCGGGCGCGTTATGGGGAATCGTAGT (SEQ ID NO:10991), GTTCGTTCGGGCGCGTTATGGGGAATC (SEQ ID NO:10992), GTTCGGGCGCGTTATGGGGAATCGTAG (SEQ ID NO:10993), CGCGCGTTTTAGGGTTTGGTTTGGTCG (SEQ ID NO:10994), TCGGGCGCGTTATGGGGAATCGTAGTA (SEQ ID NO:10995), AGAGACGGGAATGAAGCGAGGTGGTGG (SEQ ID NO:10996), AGACGGGAATGAAGCGAGGTGGTGGTT (SEQ ID NO:10997), GAGACGGGAATGAAGCGAGGTGGTGGT (SEQ ID NO:10998), CGTTTCGGTTTAGGGGGGTTTTCGCGG (SEQ ID NO:10999), GGTTTAGGGGGGTTTTCGCGGCGTTTT (SEQ ID NO:11000) |
| Target1167 | chr11:1331584-1331601 | CGTTGGTTGTATTTTTAGGAGTCGGGCGT (SEQ ID NO:11001), CGTTGGTTGTATTTTTAGGAGTCGGGCG (SEQ ID NO:11002), TCGTTGGTTGTATTTTTAGGAGTCGGGCG (SEQ ID NO:11003), TCGTTGGTTGTATTTTTAGGAGTCGGGCG (SEQ ID NO:11004), CGTTGGTTGTATTTTTAGGAGTCGGGCGTT (SEQ ID NO:11005), CGGGATTTAAGTTTCGGGTTTGTTGCGT (SEQ ID NO:11006), TCGGGATTTAAGTTTCGGGTTTGTTGCGT (SEQ ID NO:11007), |

FIGURE 5 CONTINUED

|  |  |  |
|---|---|---|
|  |  | TCGGGATTTAAGTTTCGGGTTTGTTGCG (SEQ ID NO:11008), ATCGGGATTTAAGTTTCGGGTTTGTTGCG (SEQ ID NO:11009), ATCGGGATTTAAGTTTCGGGTTTGTTGCGT (SEQ ID NO:11010) |
| Target1168 | chr11:1331624-1331657 | CGTTGGTTGTATTTTTAGGAGTCGGGCGT (SEQ ID NO:11011), CGTTGGTTGTATTTTTAGGAGTCGGGCG (SEQ ID NO:11012), TCGTTGGTTGTATTTTTAGGAGTCGGGCG (SEQ ID NO:11013), TCGTTGGTTGTATTTTTAGGAGTCGGGCGT (SEQ ID NO:11014), CGTTGGTTGTATTTTTAGGAGTCGGGCGTT (SEQ ID NO:11015) |
| Target1169 | chr11:1331696-1331858 | AGATGTTTGCGGAGGATAGGCGTTATGT (SEQ ID NO:11016), AGATGTTTGCGGAGGATAGGCGTTATGTA (SEQ ID NO:11017), TAGATGTTTGCGGAGGATAGGCGTTATGT (SEQ ID NO:11018), GCGGAGGATAGGCGTTATGTAAAGATTGGT (SEQ ID NO:11019), TGCGGAGGATAGGCGTTATGTAAAGATTGG (SEQ ID NO:11020), CGGGGGAGACGTGTTGTATTATTTGGGT (SEQ ID NO:11021), CGGGGGAGACGTGTTGTATTATTTGGGTT (SEQ ID NO:11022), CGGGGGAGACGTGTTGTATTATTTGGGTTCG (SEQ ID NO:11023), CGGGGGAGACGTGTTGTATTATTTGGGTTCGT (SEQ ID NO:11024), GGGGGAGACGTGTTGTATTATTTGGGTTCG (SEQ ID NO:11025) |
| Target1170 | chr11:1332089-1332115 | TGGTGTTTTGGATGGGGAGTGAAGAAAGT (SEQ ID NO:11026), ATGGTGTTTTGGATGGGGAGTGAAGAAAGT (SEQ ID NO:11027), TGGTGTTTTGGATGGGGAGTGAAGAAAGTA (SEQ ID NO:11028), TGGTGTTTTGGATGGGGAGTGAAGAAAGTAT (SEQ ID NO:11029), ATGGTGTTTTGGATGGGGAGTGAAGAAAGTA (SEQ ID NO:11030) |
| Target1171 | chr11:1682929-1682964 | AGAGGTGGGGATTTTGTTACGGTGGGT (SEQ ID NO:11031), GAGGTGGGGATTTTGTTACGGTGGGTT (SEQ ID NO:11032), AGAGGTGGGGATTTTGTTACGGTGGGTT (SEQ ID NO:11033), AGGTGGGGATTTTGTTACGGTGGGTTT (SEQ ID NO:11034), TAGAGGTGGGGATTTTGTTACGGTGGGT (SEQ ID NO:11035), TCGGGGAGGGGAGGGTTTTTTCGTTGA (SEQ ID NO:11036), TTCGGGGAGGGGAGGGTTTTTTCGTTG (SEQ ID NO:11037), TCGGGTGGGTGTAGGTTATTTCGGGGA (SEQ ID NO:11038), CGGGGAGGGGAGGGTTTTTTCGTTGAT (SEQ ID NO:11039), TTCGGGGAGGGGAGGGTTTTTTCGTTGA (SEQ ID NO:11040) |
| Target1172 | chr11:1683135-1683182 | GGATAGGTAGGGTGTTGCGTTCGTGGT (SEQ ID NO:11041), AGGATAGGTAGGGTGTTGCGTTCGTGGT (SEQ ID NO:11042), AGGATAGGTAGGGTGTTGCGTTCGTGG (SEQ ID NO:11043), GGATAGGTAGGGTGTTGCGTTCGTGGTT (SEQ ID NO:11044), AGGTAGGGTGTTGCGTTCGTGGTTTTT (SEQ ID NO:11045), GGGTTAGGTGTGGGCGAGGTTTGGGAT (SEQ ID NO:11046), ATAGTTCGGGGTTAGGTGTGGGCGAGG (SEQ ID NO:11047), TTCGGGGTTAGGTGTGGGCGAGGTTTG (SEQ ID NO:11048), GTTCGGGGTTAGGTGTGGGCGAGGTTT (SEQ ID NO:11049), TAGTTCGGGGTTAGGTGTGGGCGAGGT (SEQ ID NO:11050) |
| Target1173 | chr11:2114366-2114498 | CGGGGAGGAGGTTGTTTGGTAGGTTGG (SEQ ID NO:11051), TCGGGGAGGAGGTTGTTTGGTAGGTTGG (SEQ ID NO:11052), TTGGGGAGGTTGGGGAGGTTTTTGGTT (SEQ ID NO:11053), TTTGGGGAGGTTGGGGAGGTTTTTGGT (SEQ ID NO:11054), TCGGGGAGGAGGTTGTTTGGTAGGTTG (SEQ ID NO:11055), GGCGGCGGTTTTTATAGGGGAGGTTGGT (SEQ ID NO:11056), AGGCGGCGGTTTTTATAGGGGAGGTTGGT (SEQ ID NO:11057), AGGCGGCGGTTTTTATAGGGGAGGTTGG (SEQ ID NO:11058), AGGAGGGGTTAGGTGGGACGTGTTGTA (SEQ ID NO:11059), TAGGAGGGGTTAGGTGGGACGTGTTGT (SEQ ID NO:11060) |
| Target1174 | chr11:17497522-17497534 | GGGGGGATTTTAGTGGAGAGGTACGTACG (SEQ ID NO:11061), GGGGGGATTTTAGTGGAGAGGTACGTACGA (SEQ ID NO:11062), GGGGGATTTTAGTGGAGAGGTACGTACG (SEQ ID NO:11063), GGGGGATTTTAGTGGAGAGGTACGTACGA (SEQ ID NO:11064), GGGGGGATTTTAGTGGAGAGGTACGTACGAT (SEQ ID NO:11065), GGCGAGGAGAGGCGAGAGTTAGGGATT (SEQ ID NO:11066), GGCGAGGAGAGGCGAGAGTTAGGGATTT (SEQ ID NO:11067), GGCGAGGAGAGGCGAGAGTTAGGGAT (SEQ ID NO:11068), GCGAGGAGAGGCGAGAGTTAGGGATTGG (SEQ ID NO:11069), GGCGAGGAGAGGCGAGAGTTAGGGATTTG (SEQ ID NO:11070) |
| Target1175 | chr11:17497671-17497694 | AGGGCGCGGGTTTGGGATTGTTAGAGA (SEQ ID NO:11071), CGTTTAGGGCGCGGGTTTGGGATTGTT (SEQ ID NO:11072), TTCGTTTAGGGCGCGGGGTTTGGGATTG (SEQ ID NO:11073), AGATATATGTTCGGGTGGGGTGGCGGG (SEQ ID NO:11074), TGGGGTGGCGGGGGAAGGGAATTTAAG (SEQ ID NO:11075), AGTCGTAGTTGGGTTTAGGGAAGAGGGA (SEQ ID NO:11076), TCGTAGTTGGGTTTAGGGAAGAGGGAAGT (SEQ ID NO:11077), AGTCGTAGTTGGGTTTAGGGAAGAGGGAA (SEQ ID NO:11078), AGGGAAGAGGGAAGTTTGTGTTTTGGAGT (SEQ ID NO:11079), GTCGTAGTTGGGTTTAGGGAAGAGGGAAGT (SEQ ID NO:11080) |
| Target1176 | chr11:31819945-31820075 | AGGGGGGTTAGGGAGGGAGGGGGATTTT (SEQ ID NO:11081), AAGGGGGGTTAGGGAGGGAGGGGGATTT (SEQ ID NO:11082), AAAGGGGGGTTAGGGAGGGAGGGGGATT (SEQ ID NO:11083), GAAAGGGGGGTTAGGGAGGGAGGGGGAT (SEQ ID NO:11084), GTTGGGAAAGGGGGGTTAGGGAGGGAGG (SEQ ID NO:11085), TATAGAGTTGTCGGCGTGGGGGTAGCG (SEQ ID NO:11086), GTATAGAGTTGTCGGCGTGGGGGTAGCG (SEQ ID NO:11087), ATAGAGTTGTCGGCGTGGGGGTAGCG (SEQ ID NO:11088), CGAAGTATAGAGTTGTCGGCGTGGGGGT (SEQ ID NO:11089), CGAAGTATAGAGTTGTCGGCGTGGGGG (SEQ ID NO:11090) |

FIGURE 5 CONTINUED

| | | |
|---|---|---|
| Target1177 | chr11:31820087-31820149 | AGGGGGTTAGGGAGGGAGGGGGATTTT (SEQ ID NO:11091), AAGGGGGTTAGGGAGGGAGGGGGATTT (SEQ ID NO:11092), AAAGGGGGTTAGGGAGGGAGGGGGATT (SEQ ID NO:11093), GAAAGGGGGTTAGGGAGGGAGGGGGAT (SEQ ID NO:11094), GTTGGGAAAGGGGGTTAGGGAGGGAGG (SEQ ID NO:11095), TATAGAGTTGTCGGCGTGGGGGTAGCG (SEQ ID NO:11096), GTATAGAGTTGTCGGCGTGGGGGTAGCG (SEQ ID NO:11097), ATAGAGTTGTCGGCGTGGGGGTAGCG (SEQ ID NO:11098), CGAAGTATAGAGTTGTCGGCGTGGGGGT (SEQ ID NO:11099), CGAAGTATAGAGTTGTCGGCGTGGGGG (SEQ ID NO:11100) |
| Target1178 | chr11:31820160-31820485 | AGGGGCGACGGTTTTGTGTTTGAGGTG (SEQ ID NO:11101), GGGGCGACGGTTTTGTGTTTGAGGTGA (SEQ ID NO:11102), GGGGCGACGGTTTTGTGTTTGAGGTGAT (SEQ ID NO:11103), TAGGGGCGACGGTTTTGTGTTTGAGGT (SEQ ID NO:11104), AGGGGCGACGGTTTTGTGTTTGAGGTGA (SEQ ID NO:11105), CGTCGGTAGTTTGAGGGCGGGAAGTGA (SEQ ID NO:11106), TCGTCGGTAGTTTGAGGGCGGGAAGTG (SEQ ID NO:11107), GTCGTCGGTAGTTTGAGGGCGGGAAGT (SEQ ID NO:11108), GTGATGGTTGGGGTCGGAGGTGGAGTT (SEQ ID NO:11109), TTGTGATGGTTGGGGTCGGAGGTGGAG (SEQ ID NO:11110) |
| Target1179 | chr11:31820646-31820666 | TTTAGATTGTTGGGGGCGGAGGGGTGG (SEQ ID NO:11111), TTAGATTGTTGGGGGCGGAGGGGTGGA (SEQ ID NO:11112), TTAGATTGTTGGGGGCGGAGGGGTGG (SEQ ID NO:11113), TTTTAGATTGTTGGGGGCGGAGGGGTG (SEQ ID NO:11114), TTTTAGATTGTTGGGGGCGGAGGGGTGG (SEQ ID NO:11115) |
| Target1180 | chr11:31837359-31837370 | AGGCGGTAGTTAGGGATTAAAAGTCGGG (SEQ ID NO:11116), GGCGGTAGTTAGGGATTAAAAGTCGGGA (SEQ ID NO:11117), AGGCGGTAGTTAGGGATTAAAAGTCGGGA (SEQ ID NO:11118), GAGGCGGTAGTTAGGGATTAAAAGTCGGG (SEQ ID NO:11119), AGAGGCGGTAGTTAGGGATTAAAAGTCGGG (SEQ ID NO:11120), GTGAGATTGGGTTAGGAAGTGACGAAAAGC (SEQ ID NO:11121), TGTGAGATTGGGTTAGGAAGTGACGAAAAGC (SEQ ID NO:11122), TTGTGAGATTGGGTTAGGAAGTGACGAAAAGC (SEQ ID NO:11123), TTTGTGAGATTGGGTTAGGAAGTGACGAAAAGC (SEQ ID NO:11124), TTTTGTGAGATTGGGTTAGGAAGTGACGAAAAGC (SEQ ID NO:11125) |
| Target1181 | chr11:31837419-31837437 | AGAGGGTGATTTTTAAATTTGGTTAGCGGGGA (SEQ ID NO:11126), GAGGGTGATTTTTAAATTTGGTTAGCGGGGA (SEQ ID NO:11127), AGAGGGTGATTTTTAAATTTGGTTAGCGGGGAA (SEQ ID NO:11128), TAGAGGGTGATTTTTAAATTTGGTTAGCGGGGA (SEQ ID NO:11129), GAGGGTGATTTTTAAATTTGGTTAGCGGGGAAA (SEQ ID NO:11130), TGAGGAATTAGAGGTATCGGGTCGCGC (SEQ ID NO:11131), CGTGAGGAATTAGAGGTATCGGGTCGCGC (SEQ ID NO:11132), GTGAGGAATTAGAGGTATCGGGTCGCGC (SEQ ID NO:11133), CGTGAGGAATTAGAGGTATCGGGTCGCG (SEQ ID NO:11134), GGGTCGCGCGCGGGGTTGAGAATTTTTAAA (SEQ ID NO:11135) |
| Target1182 | chr11:31837478-31837489 | AGGGGTTGATAGGAATTGCGGGTTGGT (SEQ ID NO:11136), GAGGGGTTGATAGGAATTGCGGGTTGGT (SEQ ID NO:11137), GAGGGGTTGATAGGAATTGCGGGTTGG (SEQ ID NO:11138), GGGGTTGATAGGAATTGCGGGTTGGTT (SEQ ID NO:11139), AGAGGGGTTGATAGGAATTGCGGGTTGGT (SEQ ID NO:11140), TGAGGAATTAGAGGTATCGGGTCGCGC (SEQ ID NO:11141), CGTGAGGAATTAGAGGTATCGGGTCGCGC (SEQ ID NO:11142), GTGAGGAATTAGAGGTATCGGGTCGCGC (SEQ ID NO:11143), CGTGAGGAATTAGAGGTATCGGGTCGCG (SEQ ID NO:11144), GGGTCGCGCGGGGTTGAGAATTTTTAAA (SEQ ID NO:11145) |
| Target1183 | chr11:31837514-31837524 | AGGGGTTGATAGGAATTGCGGGTTGGT (SEQ ID NO:11146), GAGGGGTTGATAGGAATTGCGGGGTTGGT (SEQ ID NO:11147), GAGGGGTTGATAGGAATTGCGGGGTTGG (SEQ ID NO:11148), GGGGTTGATAGGAATTGCGGGTTGGTT (SEQ ID NO:11149), AGAGGGGTTGATAGGAATTGCGGGTTGGT (SEQ ID NO:11150), TCGGCGTTAGAGTCGGGTTTGAGGAGC (SEQ ID NO:11151), AGAGTCGGGTTTGAGGAGCGGGGTTTG (SEQ ID NO:11152), GTTAGAGTCGGGTTTGAGGAGCGGGGT (SEQ ID NO:11153), CGTTAGAGTCGGGTTTGAGGAGCGGGG (SEQ ID NO:11154), GCGTTAGAGTCGGGTTTGAGGAGCGGG (SEQ ID NO:11155) |
| Target1184 | chr11:31837640-31837651 | TTTAGGTTCGGTTTTGGCGTCGGGTGG (SEQ ID NO:11156), TTAGGTTCGGTTTTGGCGTCGGGTGGC (SEQ ID NO:11157), TTTTAGGTTCGGTTTTGGCGTCGGGTGG (SEQ ID NO:11158), TTAGGTTCGGTTTTGGCGTCGGGTGG (SEQ ID NO:11159), TTTTAGGTTCGGTTTTGGCGTCGGGTG (SEQ ID NO:11160), TTTTTTCGGGGTAGAAGGGGGTAGCGC (SEQ ID NO:11161), GTTTTTTCGGGGTAGAAGGGGGTAGCGC (SEQ ID NO:11162), CGTTTTTTCGGGGTAGAAGGGGGTAGCG (SEQ ID NO:11163), TTTTTCGGGGTAGAAGGGGGTAGCGC (SEQ ID NO:11164), GTTTTTTCGGGGTAGAAGGGGGTAGCG (SEQ ID NO:11165) |
| Target1185 | chr11:31837672-31837682 | TTTAGGTTCGGTTTTGGCGTCGGGTGG (SEQ ID NO:11166), TTAGGTTCGGTTTTGGCGTCGGGTGGC (SEQ ID NO:11167), TTTTAGGTTCGGTTTTGGCGTCGGGTGG (SEQ ID NO:11168), TTAGGTTCGGTTTTGGCGTCGGGTGG (SEQ ID NO:11169), GGCGTCGGGTGGCGTTTAGTTTTTGTA (SEQ ID NO:11170), TTTTTTCGGGGTAGAAGGGGGTAGCGC (SEQ ID NO:11171), GTTTTTTCGGGGTAGAAGGGGGTAGCGC (SEQ ID NO:11172), CGTTTTTTCGGGGTAGAAGGGGGTAGCG (SEQ ID NO:11173), TTTTTCGGGGTAGAAGGGGGTAGCGC (SEQ ID NO:11174), GTTTTTTCGGGGTAGAAGGGGGTAGCG (SEQ ID NO:11175) |

FIGURE 5 CONTINUED

| | | |
|---|---|---|
| Target1186 | chr11:31837723-31837728 | TTTAGGTTCGGTTTTGGCGTCGGGTGG (SEQ ID NO:11176), TTAGGTTCGGTTTTGGCGTCGGGTGGC (SEQ ID NO:11177), TTTTAGGTTCGGTTTTGGCGTCGGGTGG (SEQ ID NO:11178), TTAGGTTCGGTTTTGGCGTCGGGTGG (SEQ ID NO:11179), GGCGTCGGGTGGCGTTTAGTTTTTGTA (SEQ ID NO:11180), TTTTTTCGGGGTAGAAGGGGGTAGCGC (SEQ ID NO:11181), GTTTTTTCGGGGTAGAAGGGGGTAGCGC (SEQ ID NO:11182), CGTTTTTTCGGGGTAGAAGGGGGTAGCG (SEQ ID NO:11183), TTTTTCGGGGTAGAAGGGGGTAGCGC (SEQ ID NO:11184), GTTTTTTCGGGGTAGAAGGGGGTAGCG (SEQ ID NO:11185) |
| Target1187 | chr11:32462725-32462749 | TATTAGCGGTGGAAGACGAGGAAAGCG (SEQ ID NO:11186), ATTAGCGGTGGAAGACGAGGAAAGCG (SEQ ID NO:11187), TTATTAGCGGTGGAAGACGAGGAAAGCG (SEQ ID NO:11188), TTAGCGGTGGAAGACGAGGAAAGCG (SEQ ID NO:11189), TTTATTAGCGGTGGAAGACGAGGAAAGCG (SEQ ID NO:11190) |
| Target1188 | chr11:44326260-44326265 | CGGAGGATTTTGGTTTTTAAGATTAGTTGGGCG (SEQ ID NO:11191), CGGAGGATTTTGGTTTTTAAGATTAGTTGGGCGT (SEQ ID NO:11192), TCGGAGGATTTTGGTTTTTAAGATTAGTTGGGCG (SEQ ID NO:11193), TCGGAGGATTTTGGTTTTTAAGATTAGTTGGGCGT (SEQ ID NO:11194), GGAGGATTTTGGTTTTTAAGATTAGTTGGGCGT (SEQ ID NO:11195) |
| Target1189 | chr11:44326304-44326321 | GCGGTTGAGGGTAGGAAGGCGTTGAGA (SEQ ID NO:11196), TAAAGTTGCGCGCGGTTGAGGGTAGGA (SEQ ID NO:11197), ATAAAGTTGCGCGCGGTTGAGGGTAGG (SEQ ID NO:11198), AAAGTTGCGCGCGGTTGAGGGTAGGAA (SEQ ID NO:11199), GCGGTTGAGGGTAGGAAGGCGTTGAGAT (SEQ ID NO:11200), CGGAGGATTTTGGTTTTTAAGATTAGTTGGGCG (SEQ ID NO:11201), CGGAGGATTTTGGTTTTTAAGATTAGTTGGGCGT (SEQ ID NO:11202), TCGGAGGATTTTGGTTTTTAAGATTAGTTGGGCG (SEQ ID NO:11203), TCGGAGGATTTTGGTTTTTAAGATTAGTTGGGCGT (SEQ ID NO:11204), GGAGGATTTTGGTTTTTAAGATTAGTTGGGCGT (SEQ ID NO:11205) |
| Target1190 | chr11:58672874-58672973 | CGTAGACGCGGGTGTAGTTTGTTTTGC (SEQ ID NO:11206), TGTTGTTGTCGTTGGATTTCGTTTGGATGT (SEQ ID NO:11207), TTGTTGTTGTCGTTGGATTTCGTTTGGATGT (SEQ ID NO:11208), TTTGTTGTTGTCGTTGGATTTCGTTTGGATGT (SEQ ID NO:11209), TGTTGTTGTCGTTGGATTTCGTTTGGATGTAC (SEQ ID NO:11210), CGAGTGGGAGTAGCGCGTTGAGGAGAG (SEQ ID NO:11211), TCGGGTGGGTATGGGAGATGTTTGGCG (SEQ ID NO:11212), GGGTGGGTATGGGAGATGTTTGGCGGT (SEQ ID NO:11213), TGGAAGTTAAGGAGGGGTTGCGCGGTA (SEQ ID NO:11214), GAGTGGGAGTAGCGCGTTGAGGAGAGT (SEQ ID NO:11215) |
| Target1191 | chr11:58672974-58673012 | CGTCGATTTATTAGCGGTAGAAGGGTAGTAATGG (SEQ ID NO:11216), CGTCGATTTATTAGCGGTAGAAGGGTAGTAATGGT (SEQ ID NO:11217), TCGTCGATTTATTAGCGGTAGAAGGGTAGTAATGG (SEQ ID NO:11218), TCGTCGATTTATTAGCGGTAGAAGGGTAGTAATGGT (SEQ ID NO:11219), GTCGTCGATTTATTAGCGGTAGAAGGGTAGTAATGG (SEQ ID NO:11220), TCGGGTGGGTATGGGAGATGTTTGGCG (SEQ ID NO:11221), GGGTGGGTATGGGAGATGTTTGGCGGT (SEQ ID NO:11222), TGGAAGTTAAGGAGGGGTTGCGCGGTA (SEQ ID NO:11223), AGTGGAAGTTAAGGAGGGGTTGCGCGG (SEQ ID NO:11224), GTGGAAGTTAAGGAGGGGTTGCGCGGT (SEQ ID NO:11225) |
| Target1192 | chr11:58673048-58673091 | TGGTTTTTATTGGGAGATAGGGGACGTCG (SEQ ID NO:11226), TTGGTTTTTATTGGGAGATAGGGGACGTCG (SEQ ID NO:11227), TTTGGTTTTTATTGGGAGATAGGGGACGTCG (SEQ ID NO:11228), TTTTGGTTTTTATTGGGAGATAGGGGACGTCG (SEQ ID NO:11229), TTTTTGGTTTTTATTGGGAGATAGGGGACGTCG (SEQ ID NO:11230), TTTAGTGGAAGTTAAGGAGGGGTTGCGT (SEQ ID NO:11231), TTTTAGTGGAAGTTAAGGAGGGGTTGCGT (SEQ ID NO:11232), AGTGGAAGTTAAGGAGGGGTTGCGT (SEQ ID NO:11233), TTTTTAGTGGAAGTTAAGGAGGGGTTGCGT (SEQ ID NO:11234), TTTTTTAGTGGAAGTTAAGGAGGGGTTGCGT (SEQ ID NO:11235) |
| Target1193 | chr11:58673138-58673159 | TGGTACGCGGGAATTGGTTGTGGATCG (SEQ ID NO:11236), TTGGTACGCGGGAATTGGTTGTGGATCG (SEQ ID NO:11237), TTGGTACGCGGGAATTGGTTGTGGATC (SEQ ID NO:11238), TTTTGGTACGCGGGAATTGGTTGTGGA (SEQ ID NO:11239), TTTGGTACGCGGGAATTGGTTGTGGATCG (SEQ ID NO:11240), GGTCGAGGGGATTGCGCGTTTATTCGT (SEQ ID NO:11241), AGGTCGAGGGGATTGCGCGTTTATTCG (SEQ ID NO:11242), CGGTTAGGTCGAGGGGATTGCGCGTTT (SEQ ID NO:11243), GGTTAGGTCGAGGGGATTGCGCGTTTA (SEQ ID NO:11244), AGGTCGAGGGGATTGCGCGTTTATTCGT (SEQ ID NO:11245) |
| Target1194 | chr11:58673273-58673280 | GATAAATAGGGAGGGGTGGGCGGGTGGG (SEQ ID NO:11246), GGATAAATAGGGAGGGTGGGCGGGTGG (SEQ ID NO:11247), TGGATAAATAGGGAGGGTGGGCGGGTG (SEQ ID NO:11248), GGTGGGCGCGTAGTTTTTTCGGTTTG (SEQ ID NO:11249), GGGTGGGCGCGTAGTTTTTTCGGTTTG (SEQ ID NO:11250), GGAAAAGGGATGAGAGTGTACGTTTGGGC (SEQ ID NO:11251), AGGAAAAGGGATGAGAGTGTACGTTTGGGC (SEQ ID NO:11252), GAAAAGGGATGAGAGTGTACGTTTGGGC (SEQ ID NO:11253), GAGGAAAAGGGATGAGAGTGTACGTTTGGGC (SEQ ID NO:11254), AGGAAAAGGGATGAGAGTGTACGTTTGGG (SEQ ID NO:11255) |

FIGURE 5 CONTINUED

| | | |
|---|---|---|
| Target1195 | chr11:61537177-61537202 | GGGGAAGGTCGTGGGTGTAGTTTGGGT (SEQ ID NO:11256), TGGGGAAGGTCGTGGGTGTAGTTTGGG (SEQ ID NO:11257), TAAGTGGGTGGTTGGGGAAGGTCGTGG (SEQ ID NO:11258), GTGGTTGGGGAAGGTCGTGGGTGTAGT (SEQ ID NO:11259), GGTGGTTGGGGAAGGTCGTGGGTGTAG (SEQ ID NO:11260), TTCGGATTGCGGGGAGTTTGTTTTCGT (SEQ ID NO:11261), ATTCGGATTGCGGGGAGTTTGTTTTCGT (SEQ ID NO:11262), ATTCGGATTGCGGGGAGTTTGTTTTCG (SEQ ID NO:11263), TCGGATTGCGGGGAGTTTGTTTTCGT (SEQ ID NO:11264), AATTCGGATTGCGGGGAGTTTGTTTTCGT (SEQ ID NO:11265) |
| Target1196 | chr11:62211752-62211919 | TGGGGGGATTTGTTTTATGGGTTGGGA (SEQ ID NO:11266), TTGGGGGGATTTGTTTTATGGGTTGGGA (SEQ ID NO:11267), TGGGGGGATTTGTTTTATGGGTTGGGAT (SEQ ID NO:11268), TTTGGGGGGATTTGTTTTATGGGTTGGG (SEQ ID NO:11269), TTTGGGGGGATTTGTTTTATGGGTTGGGA (SEQ ID NO:11270), GGTCGGGTATTTATAGGGTCGGTGGTGT (SEQ ID NO:11271), GGTCGGGTATTTATAGGGTCGGTGGTG (SEQ ID NO:11272), AGGTCGGGTATTTATAGGGTCGGTGGTGT (SEQ ID NO:11273), TTTTTACGGCGCGGATATTTTGGAGGG (SEQ ID NO:11274), AGGTCGGGTATTTATAGGGTCGGTGGTG (SEQ ID NO:11275) |
| Target1197 | chr11:62211990-62212002 | AGGAGATTAGGTAGGGTTGGTTGATAGCGT (SEQ ID NO:11276), GGAGATTAGGTAGGGTTGGTTGATAGCGTG (SEQ ID NO:11277), GGAGATTAGGTAGGGTTGGTTGATAGCGTGT (SEQ ID NO:11278), AGGAGATTAGGTAGGGTTGGTTGATAGCGTG (SEQ ID NO:11279), AGGAGATTAGGTAGGGTTGGTTGATAGCGTGT (SEQ ID NO:11280), TTTTTACGGCGCGGATATTTTGGAGGG (SEQ ID NO:11281), GCGGATATTTTGGAGGGCGAGTAGTTGT (SEQ ID NO:11282), TTTTTTACGGCGCGGATATTTTGGAGGG (SEQ ID NO:11283), GCGGATATTTTGGAGGGCGAGTAGTTGTC (SEQ ID NO:11284), TTTTACGGCGCGGATATTTTGGAGGG (SEQ ID NO:11285) |
| Target1198 | chr11:62212028-62212034 | AGGAGATTAGGTAGGGTTGGTTGATAGCGT (SEQ ID NO:11286), GGAGATTAGGTAGGGTTGGTTGATAGCGTG (SEQ ID NO:11287), GGAGATTAGGTAGGGTTGGTTGATAGCGTGT (SEQ ID NO:11288), AGGAGATTAGGTAGGGTTGGTTGATAGCGTG (SEQ ID NO:11289), AGGAGATTAGGTAGGGTTGGTTGATAGCGTGT (SEQ ID NO:11290), TGGGAAAGGGGCGTTAGATGTGATTTTGT (SEQ ID NO:11291), TGGGAAAGGGGCGTTAGATGTGATTTTGTT (SEQ ID NO:11292), GGGAAAGGGGCGTTAGATGTGATTTTGTT (SEQ ID NO:11293), ATGGGAAAGGGGCGTTAGATGTGATTTTGT (SEQ ID NO:11294), GGGAAAGGGGCGTTAGATGTGATTTTGTTT (SEQ ID NO:11295) |
| Target1199 | chr11:62212114-62212196 | GGGGAAGCGGGGGTTTCGTTGGTTTT (SEQ ID NO:11296), TGGGGAAGCGGGGGTTTCGTTGGTTTT (SEQ ID NO:11297), GGGGAAGCGGGGGTTTCGTTGGTTTT (SEQ ID NO:11298), GGGGAAGCGGGGGTTTCGTTGGTTTTTT (SEQ ID NO:11299), GTGGGGAAGCGGGGGTTTCGTTGGTTT (SEQ ID NO:11300), GCGTGTTGTGTTTTATGGGAAAGGGGCG (SEQ ID NO:11301), GCGTGTTGTGTTTTATGGGAAAGGGGCGT (SEQ ID NO:11302), TGCGTGTTGTGTTTTATGGGAAAGGGGCG (SEQ ID NO:11303), TGCGTGTTGTGTTTTATGGGAAAGGGGC (SEQ ID NO:11304), GCGTGTTGTGTTTTATGGGAAAGGGGC (SEQ ID NO:11305) |
| Target1200 | chr11:63686935-63686949 | TTTTTTGTCGTTTCGGGGTTGCGGGGC (SEQ ID NO:11306), TTTTTTGTCGTTTCGGGGTTGCGGGGC (SEQ ID NO:11307), AGGATAAGGGGTTTCGGTCGGTTTGGT (SEQ ID NO:11308), TTTTTTGTCGTTTCGGGGTTGCGGGG (SEQ ID NO:11309), TTTTTGTCGTTTCGGGGTTGCGGGGCG (SEQ ID NO:11310), AGTGGAGTTAGGGAAAGGTGGGTGGGA (SEQ ID NO:11311), AAGTGGAGTTAGGGAAAGGTGGGTGGG (SEQ ID NO:11312), AAGTGGAGTTAGGGAAAGGTGGGTGGGA (SEQ ID NO:11313), GTGGAGTTAGGGAAAGGTGGGTGGGAT (SEQ ID NO:11314), AGTGGAGTTAGGGAAAGGTGGGTGGGAT (SEQ ID NO:11315) |
| Target1201 | chr11:63687154-63687161 | AGGGGAGGGAAGGAGAGGTAGTTCGGG (SEQ ID NO:11316), GGGAGGGAAGGAGAGGTAGTTCGGGGA (SEQ ID NO:11317), GTGTGGGAGGGGAGGGAAGGAGAGGTA (SEQ ID NO:11318), AGGGGTTAAGGAAGTTGGGTAGCGCGG (SEQ ID NO:11319), AATATGGGGGTGTGGGAGGGGAGGGAA (SEQ ID NO:11320), AGGTGAGGGTTTCGGGTTTTCGGTCGT (SEQ ID NO:11321), TGGCGGGGAGGGTATTTTCGGGAGTTT (SEQ ID NO:11322), ATGGCGGGGAGGGTATTTTCGGGAGTT (SEQ ID NO:11323), AATGGCGGGGAGGGTATTTTCGGGAGT (SEQ ID NO:11324), TCGGAGGTAGTTCGGGTAGGTGAGGGT (SEQ ID NO:11325) |
| Target1202 | chr11:63687205-63687213 | AGGGGTTAAGGAAGTTGGGTAGCGCGG (SEQ ID NO:11326), GGGGTTAAGGAAGTTGGGTAGCGCGGT (SEQ ID NO:11327), GGGTTAAGGAAGTTGGGTAGCGCGGTC (SEQ ID NO:11328), AAGGGGTTAAGGAAGTTGGGTAGCGCG (SEQ ID NO:11329), AAGGGGTTAAGGAAGTTGGGTAGCGCGG (SEQ ID NO:11330), TGGCGGGGAGGGTATTTTCGGGAGTTT (SEQ ID NO:11331), ATGGCGGGGAGGGTATTTTCGGGAGTT (SEQ ID NO:11332), AATGGCGGGGAGGGTATTTTCGGGAGT (SEQ ID NO:11333), TGGCGGGGAGGGTATTTTCGGGAGTTTT (SEQ ID NO:11334), GGCGGGGAGGGTATTTTCGGGAGTTTT (SEQ ID NO:11335) |

FIGURE 5 CONTINUED

Target1203    chr11:63687238-63687283    AGGGGTTAAGGAAGTTGGGTAGCGCGG (SEQ ID NO:11336), GGGGTTAAGGAAGTTGGGTAGCGCGGT
(SEQ ID NO:11337), GGGTTAAGGAAGTTGGGTAGCGCGGTC (SEQ ID NO:11338),
GCGAGTCGGAGGGTTTTCGGGAATGTT (SEQ ID NO:11339), AAGGGGTTAAGGAAGTTGGGTAGCGCG
(SEQ ID NO:11340), GCGGTTTGCGTTTTGGTTTGTAGTTTTCG (SEQ ID NO:11341),
GCGGTTTGCGTTTTGGTTTGTAGTTTTCGA (SEQ ID NO:11342),
TGTCGTTTTTAGTGGAAGGGTGAGTTCGA (SEQ ID NO:11343),
TCGTTTTTAGTGGAAGGGTGAGTTCGAGT (SEQ ID NO:11344),
CGTTGTCGTTTTTAGTGGAAGGGTGAGTTCG (SEQ ID NO:11345)

Target1204    chr11:63687288-63687319    GCGAGTCGGAGGGTTTTCGGGAATGTT (SEQ ID NO:11346), GCGAGTCGGAGGGTTTTCGGGAATGTTT
(SEQ ID NO:11347), GCGAGTCGGAGGGTTTTCGGGAATGT (SEQ ID NO:11348),
GCGAGTCGGAGGGTTTTCGGGAATGTTTT (SEQ ID NO:11349), CGAGTCGGAGGGTTTTCGGGAATGTTT
(SEQ ID NO:11350), TGGCGGAGGTTTGTGTAGGGGTTGTGT (SEQ ID NO:11351),
TTGGCGGAGGTTTGTGTAGGGGTTGTG (SEQ ID NO:11352), TTGGCGGAGGTTTGTGTAGGGGTTGTGT
(SEQ ID NO:11353), TTTGGCGGAGGTTTGTGTAGGGGTTGT (SEQ ID NO:11354),
TGGCGGAGGTTTGTGTAGGGGTTGTGTA (SEQ ID NO:11355)

Target1205    chr11:70211242-70211649    TGTTTTGGATGTGGTTGGTGTATTGGGGT (SEQ ID NO:11356),
TGTTTTGGATGTGGTTGGTGTATTGGGGTT (SEQ ID NO:11357),
TTGTTTTGGATGTGGTTGGTGTATTGGGGT (SEQ ID NO:11358),
GTTTTGGATGTGGTTGGTGTATTGGGGTT (SEQ ID NO:11359),
TTGTTTTGGATGTGGTTGGTGTATTGGGG (SEQ ID NO:11360), ACGCGTTGGGAGGAGTGTAGGTTGTGG
(SEQ ID NO:11361), GGAGGAGTGTAGGTTGTGGGGCGTGAT (SEQ ID NO:11362),
GTTGGGAGGAGTGTAGGTTGTGGGGCG (SEQ ID NO:11363), CGTTGGGAGGAGTGTAGGTTGTGGGGC
(SEQ ID NO:11364), GCGTTGGGAGGAGTGTAGGTTGTGGGG (SEQ ID NO:11365)

Target1206    chr11:76032999-76033014    GAGGGTTTGGGGGCGCGGTATTGAC (SEQ ID NO:11366), GAGGGTTTGGGGGCGCGGTATTGACG (SEQ
ID NO:11367), CGAGGGTTTGGGGGCGCGGTATTGAC (SEQ ID NO:11368),
GAGGGTTTGGGGGCGCGGTATTGACGG (SEQ ID NO:11369), CGAGGGTTTGGGGGCGCGGTATTGA
(SEQ ID NO:11370), GAGGTTCGGAGGGGGGTAGAAAACGTTT (SEQ ID NO:11371),
AGGTTCGGAGGGGGGTAGAAAACGTTTT (SEQ ID NO:11372), GAGGTTCGGAGGGGGGTAGAAAACGTTTT
(SEQ ID NO:11373), AGGTTCGGAGGGGGGTAGAAAACGTTTTT (SEQ ID NO:11374),
GAGGTTCGGAGGGGGTAGAAAACGTT (SEQ ID NO:11375)

Target1207    chr11:76033028-76033044    CGCGTAGAAAGGTGGGTCGGGGTTAGA (SEQ ID NO:11376), GCGCGTAGAAAGGTGGGTCGGGGTTAG
(SEQ ID NO:11377), CGCGTAGAAAGGTGGGTCGGGGTTAGAA (SEQ ID NO:11378),
GCGCGTAGAAAGGTGGGTCGGGGTTA (SEQ ID NO:11379), GCGTAGAAAGGTGGGTCGGGGTTAGAA
(SEQ ID NO:11380), CGAGTGCGCGGGGTTTTTCGTTCGTC (SEQ ID NO:11381),
CGAGTGCGCGGGGTTTTTCGTTCGT (SEQ ID NO:11382), GAGTGCGCGGGGTTTTTCGTTCGTC (SEQ ID
NO:11383), GAGGTTCGGAGGGGGGTAGAAAACGTTT (SEQ ID NO:11384),
CGAGTGCGCGGGGTTTTTCGTTCG (SEQ ID NO:11385)

Target1208    chr11:76033147-76033172    CGGGAATATTTGTGGGTTGTCGGCGGG (SEQ ID NO:11386), GGGAATATTTGTGGGTTGTCGGCGGGG
(SEQ ID NO:11387), TATTTGTGGGTTGTCGGCGGGGTAGGC (SEQ ID NO:11388),
GGAATATTTGTGGGTTGTCGGCGGGGT (SEQ ID NO:11389), TCGGGAATATTTGTGGGTTGTCGGCGG
(SEQ ID NO:11390), CGAGGTTGGGGGGTTCGGGTCGTTTTTC (SEQ ID NO:11391),
TTTTTCGGTTGCGGACGGGTCGAGGTT (SEQ ID NO:11392), TTTTTTCGGTTGCGGACGGGTCGAGGT
(SEQ ID NO:11393), TTTTTTTCGGTTGCGGACGGGTCGAGG (SEQ ID NO:11394),
TTTTCGGTTGCGGACGGGTCGAGGTTG (SEQ ID NO:11395)

Target1209    chr11:76033181-76033191    GAGGTTGTTCGGCGGGCGGGAAGTTTC (SEQ ID NO:11396), GGGAATATTTGTGGGTTGTCGGCGGGGTA
(SEQ ID NO:11397), GGAATATTTGTGGGTTGTCGGCGGGGTA (SEQ ID NO:11398),
AGGTTGTTCGGCGGGCGGGAAGTTTC (SEQ ID NO:11399), GAGGTTGTTCGGCGGGCGGGAAGTTT (SEQ
ID NO:11400), CGAGGTTGGGGGGTTCGGGTCGTTTTTC (SEQ ID NO:11401),
TTTTTCGGTTGCGGACGGGTCGAGGTT (SEQ ID NO:11402), TTTTTTCGGTTGCGGACGGGTCGAGGT
(SEQ ID NO:11403), TTTTTTTCGGTTGCGGACGGGTCGAGG (SEQ ID NO:11404),
TTTTCGGTTGCGGACGGGTCGAGGTTG (SEQ ID NO:11405)

Target1210    chr11:76033292-76033340    GGACGGAGAAGGGAGGGAGTTTGGGAG (SEQ ID NO:11406),
GGGACGGAGAAGGGAGGGAGTTTGGGA (SEQ ID NO:11407),
GGGAGTTTGGGAGAGACGTAGGTGTGGC (SEQ ID NO:11408), GGGACGGAGAAGGGAGGGAGTTTGGG
(SEQ ID NO:11409), ACGGAGAAGGGAGGGAGTTTGGGAGAG (SEQ ID NO:11410),
AGATTTCGAGGGTGTTACGTTTCGGTTGT (SEQ ID NO:11411),
GAGATTTCGAGGGTGTTACGTTTCGGTTG (SEQ ID NO:11412),
GAGATTTCGAGGGTGTTACGTTTCGGTTGT (SEQ ID NO:11413),
GATTTCGAGGGTGTTACGTTTCGGTTGTT (SEQ ID NO:11414),
AGATTTCGAGGGTGTTACGTTTCGGTTGTT (SEQ ID NO:11415)

Target1211    chr11:76033355-76033373    TAGGTGTGGCGTTCGTTTGTGTTGGCG (SEQ ID NO:11416), CGTTCGTTTGTGTTGGCGGGGTGGTAG
(SEQ ID NO:11417), GGACGGAGAAGGGAGGGAGTTTGGGAG (SEQ ID NO:11418),
GTTCGTTTGTGTTGGCGGGGTGGTAGT (SEQ ID NO:11419), TTCGTTTGTGTTGGCGGGGTGGTAGTC
(SEQ ID NO:11420), TGAAGGACGTTGTGAGTAGCGGGGGTT (SEQ ID NO:11421),
TTGAAGGACGTTGTGAGTAGCGGGGGT (SEQ ID NO:11422), GTTGAAGGACGTTGTGAGTAGCGGGGG

FIGURE 5 CONTINUED

{SEQ ID NO:11423}, TGTTGAAGGACGTTGTGAGTAGCGGGGG {SEQ ID NO:11424},
GTTGAAGGACGTTGTGAGTAGCGGGGGT {SEQ ID NO:11425}

| | | |
|---|---|---|
| Target1212 | chr11:76750769-76750781 | CGCGGGAGGAGAGGTTTTCGTAGGAGG {SEQ ID NO:11426}, TCGCGGGAGGAGAGGTTTTCGTAGGAG {SEQ ID NO:11427}, GGTTTTCGCGGGAGGAGAGGTTTTCGT {SEQ ID NO:11428}, GCGGGAGGAGAGGTTTTCGTAGGAGGA {SEQ ID NO:11429}, TTCGCGGGAGGAGAGGTTTTCGTAGGA {SEQ ID NO:11430}, GGAAGTTTTGGATGCGCGCGGGTAGTT {SEQ ID NO:11431}, ATCGTAGGAAGTTTTGGATGCGCGCGG {SEQ ID NO:11432}, GATGCGCGCGGGTAGTTGTTCGAAGTC {SEQ ID NO:11433}, AGTTTTGGATGCGCGCGGGTAGTTGTT {SEQ ID NO:11434}, AAGTTTTGGATGCGCGCGGGTAGTTGT {SEQ ID NO:11435} |
| Target1213 | chr11:76750805-76751075 | CGCGGGAGGAGAGGTTTTCGTAGGAGG {SEQ ID NO:11436}, TCGCGGGAGGAGAGGTTTTCGTAGGAG {SEQ ID NO:11437}, GGTTTTCGCGGGAGGAGAGGTTTTCGT {SEQ ID NO:11438}, GCGGGAGGAGAGGTTTTCGTAGGAGGA {SEQ ID NO:11439}, TTCGCGGGAGGAGAGGTTTTCGTAGGA {SEQ ID NO:11440}, GGAAGTTTTGGATGCGCGCGGGTAGTT {SEQ ID NO:11441}, ATCGTAGGAAGTTTTGGATGCGCGCGG {SEQ ID NO:11442}, GATGCGCGCGGGTAGTTGTTCGAAGTC {SEQ ID NO:11443}, AGTTTTGGATGCGCGCGGGTAGTTGTT {SEQ ID NO:11444}, AAGTTTTGGATGCGCGCGGGTAGTTGT {SEQ ID NO:11445} |
| Target1214 | chr11:94600469-94600953 | AGGTTTGGGAGTCGGAGGATTTGTTTGA {SEQ ID NO:11446}, TGGGAGTCGGAGGATTTGTTTGAAGGAA {SEQ ID NO:11447}, TTGGGAGTCGGAGGATTTGTTTGAAGGA {SEQ ID NO:11448}, GGTTTTGGAAGGAGGTGGAGGTGATAGT {SEQ ID NO:11449}, TGATAGGTTTTGGAAGGAGGTGGAGGTG {SEQ ID NO:11450}, TTTAGTTGGGGTGGGAGTTAAATGTTTTTGGG {SEQ ID NO:11451}, TGTAGGATGTTTTCGTAGGGAGTGATAGGTTGA {SEQ ID NO:11452}, TTTTAGTTGGGGTGGGAGTTAAATGTTTTTGGG {SEQ ID NO:11453}, GTTTGTAGGATGTTTTCGTAGGGAGTGATAGGT {SEQ ID NO:11454}, TTGTAGGATGTTTTCGTAGGGAGTGATAGGTTG {SEQ ID NO:11455} |
| Target1215 | chr11:125036180-125036207 | AGGTCGGAGTTGGGGGTTGGAGGAAC {SEQ ID NO:11456}, TGGGGAGGGGTAGTACGAGGGGGTTTTGT {SEQ ID NO:11457}, TTGGAGGAACGGGTGGCGTTTTTAGGA {SEQ ID NO:11458}, TGGAGGAACGGGTGGCGTTTTTAGGAT {SEQ ID NO:11459}, GTTGGAGGAACGGGTGGCGTTTTTAGG {SEQ ID NO:11460} |
| Target1216 | chr11:125036311-125036721 | ATTCGGTTTTTGGTGCGTTCGGGGGGAG {SEQ ID NO:11461}, TTTTTGGTGCGTTCGGGGGAGGAGGAA {SEQ ID NO:11462}, CGTTCGGGGGAGGAGGAAGTTTGGAGT {SEQ ID NO:11463}, AGTGGGTCGAGGAGTTTGGGTTGTGGT {SEQ ID NO:11464}, AATTCGGTTTTTGGTGCGTTCGGGGGA {SEQ ID NO:11465}, TTGTGGGTTTTTTAGTTCGGCGCGGGT {SEQ ID NO:11466}, TGTGGGTTTTTTAGTTCGGCGCGGGTA {SEQ ID NO:11467}, TTTGTGGGTTTTTTAGTTCGGCGCGGGT {SEQ ID NO:11468}, TTTGTGGGTTTTTTAGTTCGGCGCGGG {SEQ ID NO:11469}, TGTGGGTTTTTTAGTTCGGCGCGGGT {SEQ ID NO:11470} |
| Target1217 | chr11:128168780-128169479 | TGATGGGTGGGAAAAGATCGGTGAAGT {SEQ ID NO:11471}, TGGTTATTGGGGAATGGTTGGTTAGCGT {SEQ ID NO:11472}, TGAGAGAAGGGTAGGGAGGTGTTTACGT {SEQ ID NO:11473}, TTGATGGGTGGGAAAAGATCGGTGAAGT {SEQ ID NO:11474}, ATGGTTATTGGGGAATGGTTGGTTAGCGT {SEQ ID NO:11475}, TGGAGGTTGGGTTAAGAAGGTAGAGAAGAGT {SEQ ID NO:11476}, GGGATTGGATTATGATGTTGTTTGGAACGTGG {SEQ ID NO:11477}, ATGGAGGTTGGGTTAAGAAGGTAGAGAAGAGT {SEQ ID NO:11478}, AGGGATTGGATTATGATGTTGTTTGGAACGTGG {SEQ ID NO:11479}, GGGATTGGATTATGATGTTGTTTGGAACGTGGA {SEQ ID NO:11480} |
| Target1218 | chr11:129242486-129242689 | GTGGTCGAGTGGAAGCGGAGAGGAGTG {SEQ ID NO:11481}, GAGTGGAAGCGGAGAGGAGTGAGAGCG {SEQ ID NO:11482}, CGAGTGGAAGCGGAGAGGAGTGAGAGC {SEQ ID NO:11483}, GTGGAAGCGGAGAGGAGTGAGAGCGTT {SEQ ID NO:11484}, TGGAAGCGGAGAGGAGTGAGAGCGTTG {SEQ ID NO:11485}, CGGTTTCGTTTTGGTTGGTCGCGTCGT {SEQ ID NO:11486}, TGGTCGCGGTGTTGTTTTTCGGAAGGT {SEQ ID NO:11487}, GGTTTCGTTTTGGTTGGTCGCGTCGTT {SEQ ID NO:11488}, TGGTCGCGGTGTTGTTTTTCGGAAGGTT {SEQ ID NO:11489}, TTGGTCGCGGTGTTGTTTTTCGGAAGGT {SEQ ID NO:11490} |
| Target1219 | chr11:129242959-129243195 | GGAGTTAGTGGCGGTGGAAGGAAGGGG {SEQ ID NO:11491}, GGCGTTGCGGGTGAGATCGTTCGTAAG {SEQ ID NO:11492}, GGGCGTCGGGTTTTGGTGTTGTCGTTT {SEQ ID NO:11493}, AGTGGCGGTGGAAGGAAGGGGAAGAAT {SEQ ID NO:11494}, AGGAGTTAGTGGCGGTGGAAGGAAGGG {SEQ ID NO:11495}, TAATGTCGGGCGGGGAGTTTTAGGCGT {SEQ ID NO:11496}, GTCGAGTCGGGGTTGGGTTTTAGGGGT {SEQ ID NO:11497}, GTTACGACGGAGGGGGTTTTTTCGGGC {SEQ ID NO:11498}, CGGGGTAATGTCGGGCGGGGAGTTTTA {SEQ ID NO:11499}, ACGAGGCGGGTTTGGAGTTGGGGATTA {SEQ ID NO:11500} |
| Target1220 | chr11:129243209-129243493 | AGTAGGGGGCGCGTTTGGGGTTAGTTT {SEQ ID NO:11501}, AAGTAGGGGGCGCGTTTGGGGTTAGTT {SEQ ID NO:11502}, GGGGGCGCGTTTGGGGTTAGTTTAG {SEQ ID NO:11503}, GTAGGGGGCGCGTTTGGGGTTAGTTTG {SEQ ID NO:11504}, GGCGTTGCGGGTGAGATCGTTCGTAAG {SEQ ID NO:11505}, TTCGCGGCGGGATTTTGAGGTTGGTTC {SEQ ID NO:11506}, CGGGGGTTTTGTCGTCGGATTTTGGGG {SEQ ID NO:11507}, GTCGAGTCGGGGTTGGGTTTTAGGGGT |

FIGURE 5 CONTINUED (SEQ ID NO:11508), GTTACGACGGAGGGGGTTTTTCGGGC (SEQ ID NO:11509), TTTCGCGGCGGGATTTTGAGGTTGGTT (SEQ ID NO:11510)

Target1221    chr11:133994800-133994973    GGGGATCGGGTATTGAAGTTCGGCGGT (SEQ ID NO:11511), GGATCGGGTATTGAAGTTCGGCGGTGG (SEQ ID NO:11512), GGGATCGGGTATTGAAGTTCGGCGGTG (SEQ ID NO:11513), CGGGTATTGAAGTTCGGCGGTGGTAGG (SEQ ID NO:11514), CGGGTATTGAAGTTCGGCGGTGGTAGGA (SEQ ID NO:11515), GGCGGTCGTGTATTTCGGGAGGCGATA (SEQ ID NO:11516), TTCGGGAGCGGTTGGAGTAGTAGTGGC (SEQ ID NO:11517), GGCGGTCGTGTATTTCGGGAGGCGATAT (SEQ ID NO:11518), GTTCGGGAGCGGTTGGAGTAGTAGTGGC (SEQ ID NO:11519), TCGGGAGCGGTTGGAGTAGTAGTGGCG (SEQ ID NO:11520)

Target1222    chr11:133994988-133995005    AGTCGTCGTTGTTTTGTGGTGTCGTTT (SEQ ID NO:11521), TGTAGTCGTCGTTGTTTTGTGGTGTCGT (SEQ ID NO:11522), GTAGTCGTCGTTGTTTTGTGGTGTCGT (SEQ ID NO:11523), TGTAGTCGTCGTTGTTTTGTGGTGTCG (SEQ ID NO:11524), AGTCGTCGTTGTTTTGTGGTGTCGTTTT (SEQ ID NO:11525), AGAGAGAGAAGAGGGGGCGGGAGTTGT (SEQ ID NO:11526), TGAGAGAGAAGAGGGGGCGGGAGTT (SEQ ID NO:11527), TTCGGGAGCGGTTGGAGTAGTAGTGGC (SEQ ID NO:11528), GAGGGGGCGGGAGTTGTTTTTGGTTGT (SEQ ID NO:11529), AGAGGGGGCGGGAGTTGTTTTTGGTTG (SEQ ID NO:11530)

Target1223    chr11:133995029-133995090    TGTTTTTGTAGTCGTCGTTGTTTTGTGGTGT (SEQ ID NO:11531), TGTTTTTGTAGTCGTCGTTGTTTTGTGGTGTC (SEQ ID NO:11532), TTGTTTTTGTAGTCGTCGTTGTTTTGTGGTGT (SEQ ID NO:11533), TGTTGTTTTTGTAGTCGTCGTTGTTTTGTGGT (SEQ ID NO:11534), GATATTCGTTCGGTGGCGGCGG (SEQ ID NO:11535), AGAGAGAGAAGAGGGGGCGGGAGTTGT (SEQ ID NO:11536), TGAGAGAGAAGAGGGGGCGGGAGTT (SEQ ID NO:11537), TTGAGAGAGAGAAGAGGGGGCGGGAGT (SEQ ID NO:11538), AGTTGAGAGAGAGAAGAGGGGGCGGGA (SEQ ID NO:11539), GAGGGGGCGGGAGTTGTTTTTGGTTGT (SEQ ID NO:11540)

Target1224    chr12:2282206-2282237    AGAGTTGGTGAGGAGTTGGGAGGGGGA (SEQ ID NO:11541), GAGTTGGTGAGGAGTTGGGAGGGGGAT (SEQ ID NO:11542), AGAGTTGGTGAGGAGTTGGGAGGGGGAT (SEQ ID NO:11543), AGTTGGTGAGGAGTTGGGAGGGGGATT (SEQ ID NO:11544), TAGAGTTGGTGAGGAGTTGGGAGGGGG (SEQ ID NO:11545), GGGTAGTGAAGTGGATTTGGGTTAGGGT (SEQ ID NO:11546), AGGGTAGTGAAGTGGATTTGGGTTAGGGT (SEQ ID NO:11547), GGGTAGTGAAGTGGATTTGGGTTAGGGTT (SEQ ID NO:11548), AGGGTAGTGAAGTGGATTTGGGTTAGGGTT (SEQ ID NO:11549), TAGGGTAGTGAAGTGGATTTGGGTTAGGGT (SEQ ID NO:11550)

Target1225    chr12:6184230-6184282    TGAGGGAAGTTAGGGGGCGTTAGGGGA (SEQ ID NO:11551), GAGGGAAGTTAGGGGGCGTTAGGGGAG (SEQ ID NO:11552), AGGGAAGTTAGGGGGCGTTAGGGGAGG (SEQ ID NO:11553), TTGAGGGAAGTTAGGGGGCGTTAGGGG (SEQ ID NO:11554), TTGAGGGAAGTTAGGGGGCGTTAGGGGA (SEQ ID NO:11555)

Target1226    chr12:6184402-6184468    TTGGTTGGTTGGGTGTGGTAAAGTCGT (SEQ ID NO:11556), TGGTTGGTTGGGTGTGGTAAAGTCGTA (SEQ ID NO:11557), ATTGGTTGGTTGGGTGTGGTAAAGTCGT (SEQ ID NO:11558), TGGTTGGTTGGGTGTGGTAAAGTCGT (SEQ ID NO:11559), TTGGTTGGTTGGGTGTGGTAAAGTCGTA (SEQ ID NO:11560), AGGAGGGAATGGTGTTGTACGGTTGGA (SEQ ID NO:11561), GGGTGGTGTTTTTTAGGGTGTTTCGGGGT (SEQ ID NO:11562), TGGGTGGTGTTTTTTAGGGTGTTTCGGGG (SEQ ID NO:11563), GGGTGGTGTTTTTTTAGGGTGTTTCGGGG (SEQ ID NO:11564), AGGGAATGGTGTTGTACGGTTGGATCG (SEQ ID NO:11565)

Target1227    chr12:6184505-6184562    TTTCGGTAGGGTAGGACGGGGTAGGGG (SEQ ID NO:11566), GGGTAGGGACGGGGTAGGGGGTCGATTT (SEQ ID NO:11567), TAGGGTAGGACGGGGTAGGGGGTCGAT (SEQ ID NO:11568), TTCGGTAGGGTAGGACGGGGTAGGGG (SEQ ID NO:11569), GGGTAGGGACGGGGTAGGGGGTCGATTTA (SEQ ID NO:11570), GTGTTGGGGGGGTTGGAGTGCGTTTGTT (SEQ ID NO:11571), TGTGTGAGTGTGTTGGGGGGGTTGGAGT (SEQ ID NO:11572), GTGTGTTGGGGGGGTTGGAGTGCGTTTG (SEQ ID NO:11573), TGGGGGGGTTGGAGTGCGTTTGTTTTGT (SEQ ID NO:11574), TGTTGGGGGGTTGGAGTGCGTTTGTT (SEQ ID NO:11575)

Target1228    chr12:6184734-6184753    CGGGGGTTTATTAGAGGGTGGTAGCGGG (SEQ ID NO:11576), CGGGGGTTTATTAGAGGGTGGTAGCGGG (SEQ ID NO:11577), TCGGGGGTTTATTAGAGGGTGGTAGCGGG (SEQ ID NO:11578), TCGGGGGTTTATTAGAGGGTGGTAGCGGGT (SEQ ID NO:11579), GGGGTTTATTAGAGGGTGGTAGCGGGT (SEQ ID NO:11580), TGGTGTTAGTTTGTTTTAGGTGTTGAGGGAGT (SEQ ID NO:11581), TGGTGTTAGTTTGTTTTAGGTGTTGAGGGAGTT (SEQ ID NO:11582), TTGGTGTTAGTTTGTTTTAGGTGTTGAGGGAGT (SEQ ID NO:11583), GTTTGTTTTAGGTGTTGAGGGAGTTGTTTTGGT (SEQ ID NO:11584), AGTTTGTTTTAGGTGTTGAGGGAGTTGTTTTGG (SEQ ID NO:11585)

Target1229    chr12:6664109-6665508    AGATGGTGTCGGGTATGAAGCGGGTCG (SEQ ID NO:11586), GATGGTGTCGGGTATGAAGCGGGTCGA (SEQ ID NO:11587), ATAGCCGGTCGGTCGGGCGTTTAGTTGT (SEQ ID NO:11588), TTGTAGATAGCGGTCGGTCGGCGTT (SEQ ID NO:11589), GGGGCGGGTCGAGGGGAAGTTAATGAT (SEQ ID NO:11590), TGTCGTGGGTGTATTCGGATGGGGTGG (SEQ ID NO:11591), GGTCGCGAGTTGGTGTGGGTTTCGAAG (SEQ ID NO:11592), GGGCGTTCGGTCGGTCGTTGTTTGTAG (SEQ ID NO:11593), TCGGGGGAGGAGATTTGTTTTCGGCGT (SEQ ID NO:11594), GAGGGTAAGTAGGGTCGGCGGGGTTTG (SEQ ID NO:11595)

FIGURE 5 CONTINUED

Target1230    chr12:6665529-6665547    TCGTTTGGATTTTAGTCGGGGTGGCGT (SEQ ID NO:11596), CGTTTGGATTTTAGTCGGGGTGGCGTA (SEQ ID NO:11597), TCGTTTGGATTTTAGTCGGGGTGGCGTA (SEQ ID NO:11598), CGTTTGGATTTTAGTCGGGGTGGCGT (SEQ ID NO:11599), TCGTTTGGATTTTAGTCGGGGTGGCG (SEQ ID NO:11600), CGGGTGTGGTGGCGGGTGTTTGTAATT (SEQ ID NO:11601), ATTAGTCGGGTGTGGTGGCGGGTGTTT (SEQ ID NO:11602), AATTAGTCGGGTGTGGTGGCGGGTGTT (SEQ ID NO:11603), TCGGGTGTGGTGGCGGGTGTTTGTAAT (SEQ ID NO:11604), TTAGTCGGGTGTGGTGGCGGGTGTTTG (SEQ ID NO:11605)

Target1231    chr12:6756182-6756196    TGGGTTGCGGTAGGTGTTAGAGGTAGG (SEQ ID NO:11606), TGGGTTGCGGTAGGTGTTAGAGGTAGGA (SEQ ID NO:11607), GGGTTGCGGTAGGTGTTAGAGGTAGGA (SEQ ID NO:11608), AGTCGAATTTTGGGTTGCGGTAGGTGT (SEQ ID NO:11609), AGAGAGAGGGTTGTTTGGAGTGGAGGT (SEQ ID NO:11610), CGGAGCGGGTTTTGGGGTTCGGTTTTT (SEQ ID NO:11611), TTGGTTTCGGAGCGGGTTTTGGGGTTC (SEQ ID NO:11612), TTTGGTTTCGGAGCGGGTTTTGGGGTT (SEQ ID NO:11613), TTTTGGTTTCGGAGCGGGTTTTGGGGT (SEQ ID NO:11614), GTTTTGGTTTCGGAGCGGGTTTTGGGG (SEQ ID NO:11615)

Target1232    chr12:6756211-6756231    CGGGCGAACGGATGATGGAAGGATCGA (SEQ ID NO:11616), AGCGGGCGAACGGATGATGGAAGGATC (SEQ ID NO:11617), GAGCGGGCGAACGGATGATGGAAGGAT (SEQ ID NO:11618), AGCGGGCGAACGGATGATGGAAGGAT (SEQ ID NO:11619), GCGGGCGAACGGATGATGGAAGGATCG (SEQ ID NO:11620), TTGGTTTCGGAGCGGGTTTTGGGGTTT (SEQ ID NO:11621), TTTGGTTTCGGAGCGGGTTTTGGGGTT (SEQ ID NO:11622), TTTTGGTTTCGGAGCGGGTTTTGGGGT (SEQ ID NO:11623), GTTTTGGTTTCGGAGCGGGTTTTGGGG (SEQ ID NO:11624), TGTTTTGGTTTCGGAGCGGGTTTTGGGG (SEQ ID NO:11625)

Target1233    chr12:6756300-6756378    CGGGCGAACGGATGATGGAAGGATCGA (SEQ ID NO:11626), AGCGGGCGAACGGATGATGGAAGGATC (SEQ ID NO:11627), GAGCGGGCGAACGGATGATGGAAGGAT (SEQ ID NO:11628), CGGGCGGGGGGAGATGGGAGTATTTTA (SEQ ID NO:11629), CGGGCGGGGGGAGATGGGAGTATTTT (SEQ ID NO:11630), ATGGTGGTCGCGTTGGGTCGGTTTTTT (SEQ ID NO:11631), TGGTGGTCGCGTTGGGTCGGTTTTTTA (SEQ ID NO:11632), TATGGTGGTCGCGTTGGGTCGGTTTTT (SEQ ID NO:11633), TTATGGTGGTCGCGTTGGGTCGGTTTT (SEQ ID NO:11634), TTTATGGTGGTCGCGTTGGGTCGGTTT (SEQ ID NO:11635)

Target1234    chr12:6756385-6756679    CGGGCGGGGGGAGATGGGAGTATTTTA (SEQ ID NO:11636), TCGGGAGGGAGAGGATTAGTTCGGGGA (SEQ ID NO:11637), CGGGAGGGAGAGGATTAGTTCGGGGAG (SEQ ID NO:11638), CGGGCGGGGGGAGATGGGAGTATTTT (SEQ ID NO:11639), GATAGAGGTAAAGGTTCGGTCGCGGGC (SEQ ID NO:11640), TGCGGTTTGGTTCGTTAGAGGCGGTTT (SEQ ID NO:11641), TTGCGGTTTGGTTCGTTAGAGGCGGTT (SEQ ID NO:11642), TTTGCGGTTTGGTTCGTTAGAGGCGGT (SEQ ID NO:11643), GCGGTTTGGTTCGTTAGAGGCGGTTTG (SEQ ID NO:11644), GCGGTTTGGTTCGTTAGAGGCGGTTTGT (SEQ ID NO:11645)

Target1235    chr12:7072338-7072466    GCGGAGAAGGAAGGAGGAAGAGCGGAG (SEQ ID NO:11646), AGTTTGCGTTGGTTGTTCGGTAGGCGG (SEQ ID NO:11647), CGGAGGTTAGGGCGGGGTTTTAGGTCGT (SEQ ID NO:11648), GTTTGCGTTGGTTGTTCGGTAGGCGGA (SEQ ID NO:11649), TTGGCGTTGGGAGGGAAGGGGTTAAGG (SEQ ID NO:11650), GAGAGTGGGTGTTGGGGAGACGAAGGG (SEQ ID NO:11651), TGGGTGTTGGGGAGACGAAGGGGTTTT (SEQ ID NO:11652), GTGGGTGTTGGGGAGACGAAGGGGTTT (SEQ ID NO:11653), AGAGAGTGGGTGTTGGGGAGACGAAGG (SEQ ID NO:11654), AGTGGGTGTTGGGGAGACGAAGGGGTT (SEQ ID NO:11655)

Target1236    chr12:7072582-7072643    GGAAAGGTTGTCGGGGGTAGGGGAAGG (SEQ ID NO:11656), GGGAAAGGTTGTCGGGGGTAGGGGAAG (SEQ ID NO:11657), GTTGTCGGGGGTAGGGGAAGGTGGTTT (SEQ ID NO:11658), TGGGGGTAGGTGGGTTCGGTGATAGGT (SEQ ID NO:11659), GGGGGGATGAGGGTGGGTAAATCGGTG (SEQ ID NO:11660), TGGGGATATTTTTTGGTGAGTTTTGTTGTTCGT (SEQ ID NO:11661), TGGGGATATTTTTTGGTGAGTTTTGTTGTTCGTT (SEQ ID NO:11662), TTGGGGATATTTTTTGGTGAGTTTTGTTGTTCGT (SEQ ID NO:11663), TTGGGGATATTTTTTGGTGAGTTTTGTTGTTCGTT (SEQ ID NO:11664), TTTGGGGATATTTTTTGGTGAGTTTTGTTGTTCGT (SEQ ID NO:11665)

Target1237    chr12:7072705-7072848    GGAAAGGTTGTCGGGGGTAGGGGAAGG (SEQ ID NO:11666), GGGAAAGGTTGTCGGGGGTAGGGGAAG (SEQ ID NO:11667), GTTGTCGGGGGTAGGGGAAGGTGGTTT (SEQ ID NO:11668), GTGTGGTTGGTGGCGGGTAGTAGGGTT (SEQ ID NO:11669), GGGTAGGGGAAGGTGGTTTAGAGGCGG (SEQ ID NO:11670), TGGGGATTTGAGGCGATGGATGTTGTT (SEQ ID NO:11671), TTGGGGATTTGAGGCGATGGATGTTGT (SEQ ID NO:11672), TGGGGATTTGAGGCGATGGATGTTGTTG (SEQ ID NO:11673), GGGGATTTGAGGCGATGGATGTTGTTG (SEQ ID NO:11674), TGGGGATTTGAGGCGATGGATGTTGTTGA (SEQ ID NO:11675)

Target1238    chr12:25055421-25055858    AGGGATGCGGGGAAGGGAAGACGTTTC (SEQ ID NO:11676), GTAGGGATGCGGGGAAGGGAAGACGTT (SEQ ID NO:11677), TCGTTGGAGGCGGAATGGAGGGTAAGG (SEQ ID NO:11678), AGATTTCGGGTAGGGATGCGGGGAAGG (SEQ ID NO:11679), GATTTCGGGTAGGGATGCGGGGAAGGG (SEQ ID NO:11680), GGATTCGTTTTGAGGGAGGAGGCGGGA (SEQ ID NO:11681), GTTTCGGTAGTTCGCGGGTTTGGTCGG (SEQ ID NO:11682), GGTTTCGGTAGTTCGCGGGTTTGGTCG (SEQ ID NO:11683), CGTTTTGAGGGAGGAGGCGGGAGTTGA (SEQ ID NO:11684), TCGTTTTGAGGGAGGAGGCGGGAGTTG (SEQ ID NO:11685)

FIGURE 5 CONTINUED

| | | |
|---|---|---|
| Target1239 | chr12:25055863-25055874 | TCGTTGGAGGCGGAATGGAGGGTAAGG (SEQ ID NO:11686), GCGGAATGGAGGGTAAGGCGAAGGAGG (SEQ ID NO:11687), GGCGGAATGGAGGGTAAGGCGAAGGAG (SEQ ID NO:11688), GAGGCGGAATGGAGGGTAAGGCGAAGG (SEQ ID NO:11689), GGAGGCGGAATGGAGGGTAAGGCGAAG (SEQ ID NO:11690), TGGTTAGTTCGTTTCGTTTCGTTGCGGT (SEQ ID NO:11691), GGTTAGTTCGTTTCGTTTCGTTGCGGT (SEQ ID NO:11692), TGGTTAGTTCGTTTCGTTTCGTTGCGG (SEQ ID NO:11693), CGTTTGTTTTCGTTTTTAGTCGCGCGT (SEQ ID NO:11694), TCGTTTGTTTTCGTTTTTAGTCGCGCGT (SEQ ID NO:11695) |
| Target1240 | chr12:25055885-25056352 | ATTTGGCGGGTAAGGGTCGTAGCGGAG (SEQ ID NO:11696), GATTTGGGGTCGCGCGTTAGGGTTAGG (SEQ ID NO:11697), TATTTGGCGGGTAAGGGTCGTAGCGGA (SEQ ID NO:11698), TCGAGGTATTTGGCGGGTAAGGGTCGT (SEQ ID NO:11699), GCGGGGTTGTAGAGAGCGGTAGTGGTA (SEQ ID NO:11700), CGTTTGGTTTTGGCGCGCGGTTTTAGG (SEQ ID NO:11701), AAGGGATGTTGGAGGGGTTGCGTCGTA (SEQ ID NO:11702), TAAGGGATGTTGGAGGGGTTGCGTCGT (SEQ ID NO:11703), AGGGATGTTGGAGGGGTTGCGTCGTAT (SEQ ID NO:11704), GTTTGGTTTTGGCGCGCGGTTTTAGGT (SEQ ID NO:11705) |
| Target1241 | chr12:25056390-25056447 | TTTGTTTTCGAGAGTTTGCGGGCGGGG (SEQ ID NO:11706), TTGCGGGCGGGGATTGATATTTGTGCG (SEQ ID NO:11707), GTTTTCGAGAGTTTGCGGGCGGGGATT (SEQ ID NO:11708), GCGGGCGGGGATTGATATTTGTGCGTT (SEQ ID NO:11709), TTTTCGAGAGTTTGCGGGCGGGGATTG (SEQ ID NO:11710), TCGGTTTGGGTAGGTGGCGTAGGGAAA (SEQ ID NO:11711), TTCGGTTTGGGTAGGTGGCGTAGGGAA (SEQ ID NO:11712), ATTCGGTTTGGGTAGGTGGCGTAGGGA (SEQ ID NO:11713), CGGTTTGGGTAGGTGGCGTAGGGAAAT (SEQ ID NO:11714), AATTCGGTTTGGGTAGGTGGCGTAGGG (SEQ ID NO:11715) |
| Target1242 | chr12:33592228-33592320 | AGGAAGGAGCGAGGTAGGAAAGCGTGG (SEQ ID NO:11716), GGAGTTTGTAGTTTAGCGCGCGGGGTT (SEQ ID NO:11717), TTCGGAGTTTGTAGTTTAGCGCGCGGG (SEQ ID NO:11718), GGAAGGAGCGAGGTAGGAAAGCGTGGC (SEQ ID NO:11719), TCGGAGTTTGTAGTTTAGCGCGCGGGG (SEQ ID NO:11720), CGCGCGTTAGGTTGTAAGTTTCGGGGT (SEQ ID NO:11721), TCGCGCGTTAGGTTGTAAGTTTCGGGG (SEQ ID NO:11722), CGGGATAGGGGTAGTTAGGGCGGAAGT (SEQ ID NO:11723), TCGCGCGTTAGGTTGTAAGTTTCGGGGT (SEQ ID NO:11724), CGCGCGTTAGGTTGTAAGTTTCGGGGTT (SEQ ID NO:11725) |
| Target1243 | chr12:33592379-33592401 | TGTTTTCGTTTTGGTTGTTTTTGTTTCGAGGGA (SEQ ID NO:11726), GTTTTCGTTTTGGTTGTTTTTGTTTCGAGGGA (SEQ ID NO:11727), TGTTTTCGTTTTGGTTGTTTTTGTTTCGAGGGA (SEQ ID NO:11728), GCGGAGTTTTTTCGGTTATTTGTGTTGTTTTCG (SEQ ID NO:11729), GCGGAGTTTTTTCGGTTATTTGTGTTGTTTTCGT (SEQ ID NO:11730), AGAGGTACGGGAAGAGGAAAAGACGGT (SEQ ID NO:11731), GAGGTACGGGAAGAGGAAAAGACGGTT (SEQ ID NO:11732), AGAGGTACGGGAAGAGGAAAAGACGGTT (SEQ ID NO:11733), TAGAGGTACGGGAAGAGGAAAAGACGGT (SEQ ID NO:11734), ACGGGAAGAGGAAAAGACGGTTAATTGGG (SEQ ID NO:11735) |
| Target1244 | chr12:33592516-33592595 | GCGGTGATTTTGGTTGGAGATTGCGTCG (SEQ ID NO:11736), GCGGTGATTTTGGTTGGAGATTGCGTCGT (SEQ ID NO:11737), TGGTTGGAGATTGCGTCGTTGAGAGTCG (SEQ ID NO:11738), GGTTGGAGATTGCGTCGTTGAGAGTCG (SEQ ID NO:11739), GCGGTGATTTTGGTTGGAGATTGCGTC (SEQ ID NO:11740), GCGGGCGGATTATGGTTTAGGGCGTTA (SEQ ID NO:11741), GCGGGCGGATTATGGTTTAGGGCGTT (SEQ ID NO:11742), GCGGGCGGATTATGGTTTAGGGCGTTAG (SEQ ID NO:11743), GCGGGCGGATTATGGTTTAGGGCGTTAGA (SEQ ID NO:11744), CGGGCGGATTATGGTTTAGGGCGTTAG (SEQ ID NO:11745) |
| Target1245 | chr12:33592629-33592675 | GGTTGGAGATTGCGTCGTTGAGAGTCGG (SEQ ID NO:11746), TTGGAGATTGCGTCGTTGAGAGTCGGT (SEQ ID NO:11747), GCGGTGATTTTGGTTGGAGATTGCGTCG (SEQ ID NO:11748), GCGGTGATTTTGGTTGGAGATTGCGTCGT (SEQ ID NO:11749), GTTGGAGATTGCGTCGTTGAGAGTCGGT (SEQ ID NO:11750), CGGTAGTCGTAGTTTTTTCGCGCGTTT (SEQ ID NO:11751), CGGTAGTCGTAGTTTTTTCGCGCGTTTT (SEQ ID NO:11752), CGGTAGTCGTAGTTTTTTCGCGCGTT (SEQ ID NO:11753), CGGTAGTCGTAGTTTTTTCGCGCGTTTTT (SEQ ID NO:11754), GGCGGGAGAGTTGGCGTAAATTTCG (SEQ ID NO:11755) |
| Target1246 | chr12:33592683-33592728 | GGTTGGAGATTGCGTCGTTGAGAGTCGG (SEQ ID NO:11756), TTGGAGATTGCGTCGTTGAGAGTCGGT (SEQ ID NO:11757), GTTGGAGATTGCGTCGTTGAGAGTCGGT (SEQ ID NO:11758), TGGTTGGAGATTGCGTCGTTGAGAGTCG (SEQ ID NO:11759), TGGTTGGAGATTGCGTCGTTGAGAGTCGG (SEQ ID NO:11760), TATTAGTGCGTTGGGGGAGAGGAGGGGG (SEQ ID NO:11761), ATTAGTGCGTTGGGGGAGAGGAGGGGGG (SEQ ID NO:11762), GCGTGTTTGCGAGTCGAGGGTTTGTTT (SEQ ID NO:11763), TATTAGTGCGTTGGGGGAGAGGAGGGGGG (SEQ ID NO:11764), ATTAGTGCGTTGGGGGAGAGGAGGGGGG (SEQ ID NO:11765) |
| Target1247 | chr12:33592774-33592804 | AGTGTTGAGGGGAGGGGGGAGTCGTAA (SEQ ID NO:11766), GAGTGTTGAGGGGAGGGGGGAGTCGTA (SEQ ID NO:11767), TATGGAGTGTTGAGGGGAGGGGGGAGT (SEQ ID NO:11768), GGTATGGAGTGTTGAGGGGAGGGGGGA (SEQ ID NO:11769), TCGGTATGGAGTGTTGAGGGGAGGGGG (SEQ ID NO:11770), TATTAGTGCGTTGGGGAGAGGAGGGGGG (SEQ ID NO:11771), ATTAGTGCGTTGGGGAGAGGAGGGGGG (SEQ ID NO:11772), GCGTGTTTGCGAGTCGAGGGTTTGTTT (SEQ ID NO:11773), TATTAGTGCGTTGGGGAGAGGAGGGGGG (SEQ ID NO:11774), ATTAGTGCGTTGGGGAGAGGAGGGGG (SEQ ID NO:11775) |

FIGURE 5 CONTINUED

Target1248　　chr12:33592831-33592892　　AGTGTTGAGGGGAGGGGGGAGTCGTAA (SEQ ID NO:11776), GAGTGTTGAGGGGAGGGGGGAGTCGTA (SEQ ID NO:11777), TATGGAGTGTTGAGGGGAGGGGGGAGT (SEQ ID NO:11778), GGTATGGAGTGTTGAGGGGAGGGGGGA (SEQ ID NO:11779), ATTGGTGTTTTTGGCGGGTGTTTGGCG (SEQ ID NO:11780), GTAGGGGCGTCGGGTCGTTCGTTTTT (SEQ ID NO:11781), GGTAGGGGCGTCGGGTCGTTCGTTTTT (SEQ ID NO:11782), GTAGGGGCGTCGGGTCGTTCGTTTTTT (SEQ ID NO:11783), GGTAGGGGCGTCGGGTCGTTCGTTTT (SEQ ID NO:11784), GGTAGGGGCGTCGGGTCGTTCGTTTTTT (SEQ ID NO:11785)

Target1249　　chr12:33592905-33592916　　ATTGGTGTTTTTGGCGGGTGTTTGGCG (SEQ ID NO:11786), TTGGTGTTTTTGGCGGGTGTTTGGCGG (SEQ ID NO:11787), TTGGTGTTTTTGGCGGGTGTTTGGCG (SEQ ID NO:11788), AGCGTATTGGTGTTTTTGGCGGGTGTT (SEQ ID NO:11789), ATTGGTGTTTTTGGCGGGTGTTTGGCGG (SEQ ID NO:11790), GTAGGGGCGTCGGGTCGTTCGTTTTTT (SEQ ID NO:11791), GGTAGGGGCGTCGGGTCGTTCGTTTTT (SEQ ID NO:11792), GTAGGGGCGTCGGGTCGTTCGTTTTTT (SEQ ID NO:11793), GGTAGGGGCGTCGGGTCGTTCGTTTT (SEQ ID NO:11794), GGTAGGGGCGTCGGGTCGTTCGTTTTTT (SEQ ID NO:11795)

Target1250　　chr12:43945543-43945566　　CGGTTGATTGGTTCGGGAGTTTCGGGA (SEQ ID NO:11796), TCGGTTGATTGGTTCGGGAGTTTCGGG (SEQ ID NO:11797), TCGGTTGATTGGTTCGGGAGTTTCGGGA (SEQ ID NO:11798), TTTTGGGAGTGCGATGCGTTTTAGGCG (SEQ ID NO:11799), TGTGGTTTTGGGAGTGCGATGCGTTTT (SEQ ID NO:11800), ACGTTTTTAGCGGTTAAGTGGGGGCGC (SEQ ID NO:11801), TCGAGTGGGATATGTAGGTCGCGGGGA (SEQ ID NO:11802), GTTTTTAGCGGTTAAGTGGGGGCGCGG (SEQ ID NO:11803), TTCGAGTGGGATATGTAGGTCGCGGGG (SEQ ID NO:11804), CGTTTTTAGCGGTTAAGTGGGGGCGCG (SEQ ID NO:11805)

Target1251　　chr12:43945592-43945623　　CGGTTGATTGGTTCGGGAGTTTCGGGA (SEQ ID NO:11806), TCGGTTGATTGGTTCGGGAGTTTCGGG (SEQ ID NO:11807), TCGGTTGATTGGTTCGGGAGTTTCGGGA (SEQ ID NO:11808), CGGTTGATTGGTTCGGGAGTTTCGGGAG (SEQ ID NO:11809), TTCGGTTGATTGGTTCGGGAGTTTCGGG (SEQ ID NO:11810), GCGAGACGTTTTTAGCGGTTAAGTGGGGG (SEQ ID NO:11811), GCGAGACGTTTTTAGCGGTTAAGTGGG (SEQ ID NO:11812), CGAGACGTTTTTAGCGGTTAAGTGGGGG (SEQ ID NO:11813), CGAGACGTTTTTAGCGGTTAAGTGGGGGT (SEQ ID NO:11814), GCGAGACGTTTTTAGCGGTTAAGTGGG (SEQ ID NO:11815)

Target1252　　chr12:43945748-43945800　　TCGGGGAGGTTTATTAGAGTCGTCGGT (SEQ ID NO:11816), TTTTGGGGATTTCGATCGGGGAGGTTT (SEQ ID NO:11817), ATTTTGGGGATTTCGATCGGGGAGGTT (SEQ ID NO:11818), TTTGGGGATTTCGATCGGGGAGGTTTA (SEQ ID NO:11819), CGATCGGGGAGGTTTATTAGAGTCGTCGG (SEQ ID NO:11820), GAGCGGAGATAGGCGGTGTGGTTGGAT (SEQ ID NO:11821), TGGTTGTCGGCGGTTTTGGTGGGTTTT (SEQ ID NO:11822), TTGGTTGTCGGCGGTTTTGGTGGGTTT (SEQ ID NO:11823), TTTGGTTGTCGGCGGTTTTGGTGGGTT (SEQ ID NO:11824), AGCGGAGATAGGCGGTGTGGTTGGATT (SEQ ID NO:11825)

Target1253　　chr12:43945818-43945926　　CGCGGGTTTTGGGTCGGTTGGTTTAGT (SEQ ID NO:11826), GGAATAGTAGCGCGGGTTTTGGGTCGG (SEQ ID NO:11827), GGGAATAGTAGCGCGGGTTTTGGGTCG (SEQ ID NO:11828), GCGCGGGTTTTGGGTCGGTTGGTTTAG (SEQ ID NO:11829), TAGTAGCGCGGGTTTTGGGTCGGTTGG (SEQ ID NO:11830), GAGCGGAGATAGGCGGTGTGGTTGGAT (SEQ ID NO:11831), AGCGGAGATAGGCGGTGTGGTTGGATT (SEQ ID NO:11832), GGCGTAGGAAGGGGGGTGAGGTTGTAG (SEQ ID NO:11833), GGAAGGGGGGTGAGGTTGTAGTGCGAT (SEQ ID NO:11834), AGGAAGGGGGGTGAGGTTGTAGTGCGA (SEQ ID NO:11835)

Target1254　　chr12:43945952-43945959　　CGCGGGTTTTGGGTCGGTTGGTTTAGT (SEQ ID NO:11836), GGAATAGTAGCGCGGGTTTTGGGTCGG (SEQ ID NO:11837), GGGAATAGTAGCGCGGGTTTTGGGTCG (SEQ ID NO:11838), GCGCGGGTTTTGGGTCGGTTGGTTTAG (SEQ ID NO:11839), TAGTAGCGCGGGTTTTGGGTCGGTTGG (SEQ ID NO:11840), TCGTCGGTTCGGGGTGGTTATATTGGT (SEQ ID NO:11841), TAGAGAGTTTTTGAGGGTAGCGCGGGT (SEQ ID NO:11842), GTAGAGAGTTTTTGAGGGTAGCGCGGGT (SEQ ID NO:11843), GTAGAGAGTTTTTGAGGGTAGCGCGGG (SEQ ID NO:11844), AGAGAGTTTTTGAGGGTAGCGCGGGT (SEQ ID NO:11845)

Target1255　　chr12:43945993-43945999　　TCGTTTGTTTTCGTTCGTTGAGTCGTTGT (SEQ ID NO:11846), TCGTTTGTTTTCGTTCGTTGAGTCGTTGTT (SEQ ID NO:11847), ATCGTTTGTTTTCGTTCGTTGAGTCGTTGT (SEQ ID NO:11848), CGTTTGTTTTCGTTCGTTGAGTCGTTGTT (SEQ ID NO:11849), TCGTTTGTTTTCGTTCGTTGAGTCGTTGTTT (SEQ ID NO:11850), TGGTCGGGAATAGTTTATAGGGGCGGGT (SEQ ID NO:11851), TCGTCGGTTCGGGGTGGTTATATTGGT (SEQ ID NO:11852), GGTCGGGAATAGTTTATAGGGGCGGGT (SEQ ID NO:11853), TGGTCGGGAATAGTTTATAGGGGCGGG (SEQ ID NO:11854), TTCGTCGGTTCGGGGTGGTTATATTGGT (SEQ ID NO:11855)

Target1256　　chr12:43946045-43946058　　AGTTCGGCGCGGGGAAGTAATTCGATT (SEQ ID NO:11856), TGTTTAGGTTTAGTTCGGCGCGGGGAA (SEQ ID NO:11857), TTGTTTAGGTTTAGTTCGGCGCGGGGA (SEQ ID NO:11858), TTTAGGTTTAGTTCGGCGCGGGGAAGT (SEQ ID NO:11859), TAGTTCGGCGCGGGGAAGTAATTCGAT (SEQ ID NO:11860), TTTGCGGTTGAGTGGAGAAGGGGAGGGG (SEQ ID NO:11861), CGGTTGAGTGGAGAAGGGGAGGGGGTTG (SEQ ID NO:11862), GGTTGAGTGGAGAAGGGAGGGGGTTGC (SEQ ID NO:11863), GTTGAGTGGAGAAGGGGAGGGGGTTGCG (SEQ ID NO:11864), TTGAGTGGAGAAGGGGAGGGGGTTGCG (SEQ ID NO:11865)

FIGURE 5 CONTINUED

Target1257 chr12:43946060-43946134 AGTTCGGCGCGGGGAAGTAATTCGATT (SEQ ID NO:11866), TGTTTAGGTTTAGTTCGGCGCGGGGAA
(SEQ ID NO:11867), TTGTTTAGGTTTAGTTCGGCGCGGGGA (SEQ ID NO:11868),
TTTAGGTTTAGTTCGGCGCGGGGAAGT (SEQ ID NO:11869), GCGTCGCGGAGAGTTCGTTTTTATGGG
(SEQ ID NO:11870), TTTGCGGTTGAGTGGAGAAGGGAGGGG (SEQ ID NO:11871),
CGGTTGAGTGGAGAAGGGAGGGGGTTG (SEQ ID NO:11872), GGTTGAGTGGAGAAGGGAGGGGGTTGC
(SEQ ID NO:11873), GTTGAGTGGAGAAGGGAGGGGGTTGCG (SEQ ID NO:11874),
TTGAGTGGAGAAGGGAGGGGGTTGCG (SEQ ID NO:11875)

Target1258 chr12:54427638-54427666 TTGAAGGGTGAGGAGCGCGGGGTTTTA (SEQ ID NO:11876), GAAGGGTGAGGAGCGCGGGGTTTTAGA
(SEQ ID NO:11877), AAGGGTGAGGAGCGCGGGGTTTTAGAG (SEQ ID NO:11878),
AGAGGGATTTGAAGGGTGAGGAGCGCG (SEQ ID NO:11879), TGAAGGGTGAGGAGCGCGGGGTTTTAG
(SEQ ID NO:11880), GGAGTCGCGGGGGGGATTTTCGTTTTGG (SEQ ID NO:11881),
GGGAGTCGCGGGGGGATTTTCGTTTTG (SEQ ID NO:11882), GTTTCGTAGGGGAGGGAGGGAGGGAGT
(SEQ ID NO:11883), TTTCGTAGGGGAGGGAGGGAGGGAGTC (SEQ ID NO:11884),
AGGGAGTCGCGGGGGGGATTTTCGTTTT (SEQ ID NO:11885)

Target1259 chr12:54427688-54427701 TTGAAGGGTGAGGAGCGCGGGGTTTTA (SEQ ID NO:11886), GAAGGGTGAGGAGCGCGGGGTTTTAGA
(SEQ ID NO:11887), AAGGGTGAGGAGCGCGGGGTTTTAGAG (SEQ ID NO:11888),
AGAGGGATTTGAAGGGTGAGGAGCGCG (SEQ ID NO:11889), TGAAGGGTGAGGAGCGCGGGGTTTTAG
(SEQ ID NO:11890), GGGTTGGGGGGGAAGAGGGAGATTTAGGT (SEQ ID NO:11891),
TGGGGGGGAAGAGGGAGATTTAGGTTCGG (SEQ ID NO:11892),
GGGTTGGGGGGGAAGAGGGAGATTTAGG (SEQ ID NO:11893), GGGGGGAAGAGGGAGATTTAGGTTCGG
(SEQ ID NO:11894), TGGGGGGGAAGAGGGAGATTTAGGTTCGGA (SEQ ID NO:11895)

Target1260 chr12:54427706-54427732 TTGAAGGGTGAGGAGCGCGGGGTTTTA (SEQ ID NO:11896), GAAGGGTGAGGAGCGCGGGGTTTTAGA
(SEQ ID NO:11897), AAGGGTGAGGAGCGCGGGGTTTTAGAG (SEQ ID NO:11898),
AGAGGGATTTGAAGGGTGAGGAGCGCG (SEQ ID NO:11899), TGAAGGGTGAGGAGCGCGGGGTTTTAG
(SEQ ID NO:11900), TTTTGTAGTCGGAGGGGTTGAGGGGGG (SEQ ID NO:11901),
GGGGGGTTGGGGGGGAAGAGGGAGATTTA (SEQ ID NO:11902), GGGGGGGTTGGGGGGGAAGAGGGAGATTT
(SEQ ID NO:11903), GGGGGTTGGGGGGGAAGAGGGAGATTT (SEQ ID NO:11904),
ATTTTGTAGTCGGAGGGGTTGAGGGGGG (SEQ ID NO:11905)

Target1261 chr12:54428065-54428083 TTTTTCGGTCGCGGGTGGGGGTTTGG (SEQ ID NO:11906), TTTTCGGTCGCGGGTGGGGGTTTG (SEQ ID
NO:11907), TTTTTCGGTCGCGGGTGGGGGTTTGGG (SEQ ID NO:11908),
TGTTTTAGAGACGGACGGTAAGCGGTT (SEQ ID NO:11909), TTTTCGGTCGCGGGTGGGGGTTTGG (SEQ
ID NO:11910), CGGCGAGTGAGGTAGCGGTTAAAGTGG (SEQ ID NO:11911),
CGGCGAGTGAGGTAGCGGTTAAAGTGGA (SEQ ID NO:11912), GGCGAGTGAGGTAGCGGTTAAAGTGGA
(SEQ ID NO:11913), CGGCGAGTGAGGTAGCGGTTAAAGTGAA (SEQ ID NO:11914),
GGCGAGTGAGGTAGCGGTTAAAGTGGAA (SEQ ID NO:11915)

Target1262 chr12:54428139-54428224 TGTTTTAGAGACGGACGGTAAGCGGTT (SEQ ID NO:11916), ATGTTTTAGAGACGGACGGTAAGCGGT
(SEQ ID NO:11917), GGGGTGGGGTTTATGTTTTAGAGACGGACGG (SEQ ID NO:11918),
TGTTTTAGAGACGGACGGTAAGCGGTTT (SEQ ID NO:11919),
GGGTGGGGTTTATGTTTTAGAGACGGACGG (SEQ ID NO:11920),
GGAAAGGCGAAAAGGAAAGGCGTAGGG (SEQ ID NO:11921),
GGAAAGGCGAAAAGGAAAGGCGTAGGGA (SEQ ID NO:11922), ATAGGAATCGGTTAGGGGCGCGTTTTG
(SEQ ID NO:11923), GAAAGGCGAAAAGGAAAGGCGTAGGGA (SEQ ID NO:11924),
GGCGAAAAGGAAAGGCGTAGGGATAGG (SEQ ID NO:11925)

Target1263 chr12:54428283-54428342 TTAGAGGTAGCGGGGGAGGTTCGTAGA (SEQ ID NO:11926), TTTTTTAGAGGTAGCGGGGGAGGTTCGT
(SEQ ID NO:11927), AGGTTTTTTAGAGGTAGCGGGGGAGGT (SEQ ID NO:11928),
TTTAGAGGTAGCGGGGGAGGTTCGTAG (SEQ ID NO:11929), TTTAGAGGTAGCGGGGGAGGTTCGTAGA
(SEQ ID NO:11930), TTCGCGGGAATTTTGGGTCGGTAGGGA (SEQ ID NO:11931),
TCGCGGGAATTTTGGGTCGGTAGGGAT (SEQ ID NO:11932), GCGGGAATTTTGGGTCGGTAGGGATGC
(SEQ ID NO:11933), CGGGAATTTTGGGTCGGTAGGGATGCG (SEQ ID NO:11934),
CGCGGGAATTTTGGGTCGGTAGGGATG (SEQ ID NO:11935)

Target1264 chr12:54428361-54428554 TCGGGTCGGGGGTAGGTGTTGGAGTAT (SEQ ID NO:11936), TTCGGGTCGGGGGTAGGTGTTGGAGTA
(SEQ ID NO:11937), ATTTCGGGTCGGGGGTAGGTGTTGGAG (SEQ ID NO:11938),
CGGGTCGGGGGTAGGTGTTGGAGTATT (SEQ ID NO:11939), TTTCGGGTCGGGGGTAGGTGTTGGAGT
(SEQ ID NO:11940), TTCGCGGGAATTTTGGGTCGGTAGGGA (SEQ ID NO:11941),
TCGCGGGAATTTTGGGTCGGTAGGGAT (SEQ ID NO:11942), GAGTTGAGGGGAGATGGGGTAGCGTCG
(SEQ ID NO:11943), CGAGTTGAGGGGAGATGGGGTAGCGTC (SEQ ID NO:11944),
GTCGAGTTGAGGGGAGATGGGGTAGCG (SEQ ID NO:11945)

Target1265 chr12:54428556-54428593 GGAGGGTTGCGGCGTATAGGTTGGC (SEQ ID NO:11946), GCGGGGTTGTCGGCGTTGTTTTATTTT (SEQ
ID NO:11947), GCGGGGTTGTCGGCGTTGTTTTATTT (SEQ ID NO:11948),
GCGGGGTTGTCGGCGTTGTTTTATTT (SEQ ID NO:11949), GCGGGGTTGTCGGCGTTGTTTTATTTTT
(SEQ ID NO:11950), CGAGGTTAGAGGGTTCGGCGAGGGGTTT (SEQ ID NO:11951),
AGGAGAGGGCGAGGTTAGAGGGTTCGG (SEQ ID NO:11952), TAGAGGGTTCGGCGAGGGTTTTGTGGC
(SEQ ID NO:11953), AAGGAGAGGGCGAGGTTAGAGGGTTCG (SEQ ID NO:11954),
CGAGGTTAGAGGGTTCGGCGAGGGTTTT (SEQ ID NO:11955)

FIGURE 5 CONTINUED

Target1266    chr12:54428600-54428619    GGAGGGTTGCGGCGTATAGGTTGGC (SEQ ID NO:11956), GAGGGTTGCGGCGTATAGGTTGGC (SEQ ID
NO:11957), GGAGGGTTGCGGCGTATAGGTTGG (SEQ ID NO:11958),
AGTTTCGTAGGATTTTTTCGGAGGGTTGC (SEQ ID NO:11959), AGGGTTGCGGCGTATAGGTTGGC (SEQ
ID NO:11960), CGAGGGTTAGAGGGTTCGGCGAGGGTTT (SEQ ID NO:11961),
AGGAGAGGGCGAGGTTAGAGGGTTCGG (SEQ ID NO:11962), TAGAGGGTTCGGCGAGGGTTTTGTGGC
(SEQ ID NO:11963), AAGGAGAGGGCGAGGTTAGAGGGTTCG (SEQ ID NO:11964),
CGAGGTTAGAGGGTTCGGCGAGGGTTTT (SEQ ID NO:11965)

Target1267    chr12:54441100-54441186    CGGGGTCGTTGTAGAGTCGGTTTTTCG (SEQ ID NO:11966), CGGGGGAGGAGAAAAGTATAGGATCGCGG
(SEQ ID NO:11967), CGGGGGAGGAGAAAAGTATAGGATCGCG (SEQ ID NO:11968),
GGGGGAGGAGAAAAGTATAGGATCGCGG (SEQ ID NO:11969),
TCGGGGGAGGAGAAAAGTATAGGATCGCG (SEQ ID NO:11970), GCGGCGCGGGATTTTTAGGTTGTGGTT
(SEQ ID NO:11971), CGGCGCGGGATTTTTAGGTTGTGGTTT (SEQ ID NO:11972),
GCGGCGCGGGATTTTTAGGTTGTGGT (SEQ ID NO:11973), GCGGCGCGGGATTTTTAGGTTGTGGTTT
(SEQ ID NO:11974), CGGCGCGGGATTTTTAGGTTGTGGTTTT (SEQ ID NO:11975)

Target1268    chr12:54441200-54441393    TAGTCGGAGGTAGAGGCGTTTCGAGGC (SEQ ID NO:11976), AGTCGGAGGTAGAGGCGTTTCGAGGC
(SEQ ID NO:11977), ATAGTCGGAGGTAGAGGCGTTTCGAGGC (SEQ ID NO:11978),
CGGGGTCGTTGTAGAGTCGGTTTTTCG (SEQ ID NO:11979), GTTCGTTTCGGATTTAGGTCGCGAGGT
(SEQ ID NO:11980), GCGTTTTGGTTTTGGCGGGCGAGTTAC (SEQ ID NO:11981),
GCGTTTTGGTTTTGGCGGGCGAGTTA (SEQ ID NO:11982), GCGTTTTGGTTTTGGCGGGCGAGTT (SEQ ID
NO:11983), CGTTTTGGTTTTGGCGGGCGAGTTAC (SEQ ID NO:11984),
GCGTTTTGGTTTTGGCGGGCGAGT (SEQ ID NO:11985)

Target1269    chr12:54441420-54441497    CGGAGGAGGCGGTTAAGGTGTAGGTCG (SEQ ID NO:11986), GGGTTCGGAGGAGGCGGTTAAGGTGTA
(SEQ ID NO:11987), GGAGGCGGTTAAGGTGTAGGTCGAGGT (SEQ ID NO:11988),
TAGTCGGAGGTAGAGGCGTTTCGAGGC (SEQ ID NO:11989), GCGGTTAAGGTGTAGGTCGAGGTTGGC
(SEQ ID NO:11990), GCGTTTTGGTTTTGGCGGGCGAGTTAC (SEQ ID NO:11991),
GCGTTTTGGTTTTGGCGGGCGAGTTA (SEQ ID NO:11992), GCGTTTTGGTTTTGGCGGGCGAGTT (SEQ ID
NO:11993), AGTTTTTTCGCGCGTTTTGGTTTTGGC (SEQ ID NO:11994),
CGTTTTGGTTTTGGCGGGCGAGTTAC (SEQ ID NO:11995)

Target1270    chr12:54441529-54441644    CGGAGGAGGCGGTTAAGGTGTAGGTCG (SEQ ID NO:11996), GGGTTCGGAGGAGGCGGTTAAGGTGTA
(SEQ ID NO:11997), GGAGGCGGTTAAGGTGTAGGTCGAGGT (SEQ ID NO:11998),
GTTCGTTAGGATTAGAGCGCGCGGAGG (SEQ ID NO:11999), GCGGTTAAGGTGTAGGTCGAGGTTGGC
(SEQ ID NO:12000), CGTGGTATTAGTGGGATTTGGGGAGCGG (SEQ ID NO:12001),
CGTGGTATTAGTGGGATTTGGGGAGCGGT (SEQ ID NO:12002),
TCGTGGTATTAGTGGGATTTGGGGAGCGG (SEQ ID NO:12003), TGGTATTAGTGGGATTTGGGGAGCGGT
(SEQ ID NO:12004), CGTGGTATTAGTGGGATTTGGGGAGCG (SEQ ID NO:12005)

Target1271    chr12:58013414-58013637    GCGTGGCGTTTGTTGTTGGTTCGGTTG (SEQ ID NO:12006), TAGGGGCGTGGCGTTTGTTGTTGGTTC
(SEQ ID NO:12007), GTTTTTCGGGTTGTGGAGGTTGCGGGT (SEQ ID NO:12008),
GATAGGGGCGTGGCGTTTGTTGTTGGT (SEQ ID NO:12009), GGATAGGGGCGTGGCGTTTGTTGTTGG
(SEQ ID NO:12010), GGGGTAGTTAGTGTAGCGCGGGTAGTCG (SEQ ID NO:12011),
GGGTAGTTAGTGTAGCGCGGGTAGTCG (SEQ ID NO:12012), GGGTAGTTAGTGTAGCGCGGGTAGTCGA
(SEQ ID NO:12013), CGCGGGTAGTCGAGGTTAGTAGTAGGCGT (SEQ ID NO:12014),
GGGGTAGTTAGTGTAGCGCGGGTAGTC (SEQ ID NO:12015)

Target1272    chr12:58013651-58013714    GCGTGGCGTTTGTTGTTGGTTCGGTTG (SEQ ID NO:12016), TAGGGGCGTGGCGTTTGTTGTTGGTTC
(SEQ ID NO:12017), GATAGGGGCGTGGCGTTTGTTGTTGGT (SEQ ID NO:12018),
GGATAGGGGCGTGGCGTTTGTTGTTGG (SEQ ID NO:12019), GGGATAGGGGCGTGGCGTTTGTTGTTG
(SEQ ID NO:12020), AGAGTTTGTGTTTTCGATAGGTTGTTGTTAGGGT (SEQ ID NO:12021),
GAGTTTGTGTTTTCGATAGGTTGTTGTTAGGGTT (SEQ ID NO:12022),
AGAGTTTGTGTTTTCGATAGGTTGTTGTTAGGGTT (SEQ ID NO:12023),
TAGAGTTTGTGTTTTCGATAGGTTGTTGTTAGGGT (SEQ ID NO:12024),
GAGTTTGTGTTTTCGATAGGTTGTTGTTAGGGTTT (SEQ ID NO:12025)

Target1273    chr12:58130751-58131225    ATTCGGAGTTGGTGGGAGGGTTAGCGG (SEQ ID NO:12026), GGGTTCGGGAAGGGGTTCGGAGTTAGG
(SEQ ID NO:12027), GGGGTTCGGGAAGGGGTTCGGAGTTAG (SEQ ID NO:12028),
GGTTGGATTCGGAGTTGGTGGGAGGGT (SEQ ID NO:12029), TGGTTGGATTCGGAGTTGGTGGGAGGG
(SEQ ID NO:12030), TAGCGGGTTTAGGGAGTTGTTGGGCGT (SEQ ID NO:12031),
CGGGTTTAGGGAGTTGTTGGGCGTCGA (SEQ ID NO:12032), GTAGCGGGTTTAGGGAGTTGTTGGGCG
(SEQ ID NO:12033), TTCGATTTTTGGTGGGGTCGGGGTTGG (SEQ ID NO:12034),
ATTTTTGGTGGGGTCGGGGTTGGGGTT (SEQ ID NO:12035)

Target1274    chr12:58131312-58132106    GGGGTTTCGGAGGGACGGTTTAGAGGG (SEQ ID NO:12036), GGGGGTTTCGGAGGGACGGTTTAGAGG
(SEQ ID NO:12037), GAGTCGGGGATAGGGTTGGGGGTTTCG (SEQ ID NO:12038),
AGTTCGGGTTGTTGAGTAGGGGGCGTC (SEQ ID NO:12039), GGTGGGGGCGTTTTTAGGTTTGGGGTC
(SEQ ID NO:12040), GGGGAGGGGGCGTTTTATGTGATGGGA (SEQ ID NO:12041),
AGGGGGCGTTTTATGTGATGGGAGGGG (SEQ ID NO:12042), AGGGCGCGGGTAGTCGTTTGTTATGGT
(SEQ ID NO:12043), GCGGAGGAGTCGGGTAAGAAGCGGTAC (SEQ ID NO:12044),
TTTTCGGGTTTTATGAGTCGGGGCGCG (SEQ ID NO:12045)

FIGURE 5 CONTINUED

| | | |
|---|---|---|
| Target1275 | chr12:63544123-63544297 | GGCGCGCGGGTTGTTGTAGAGTTTTGA (SEQ ID NO:12046), CGGCGCGCGGGTTGTTGTAGAGTTTTG (SEQ ID NO:12047), CGCGCGGGTTGTTGTAGAGTTTTGAGC (SEQ ID NO:12048), GCGCGCGGGTTGTTGTAGAGTTTTGAG (SEQ ID NO:12049), GGCGCGCGGGTTGTTGTAGAGTTTTGAG (SEQ ID NO:12050), CGATTGGTTGTGTCGCGTGGTGAAGTA (SEQ ID NO:12051), AGGTGTTCGGTATGTTTGCGTCGGTT (SEQ ID NO:12052), TGTAGGTGTTCGGTATGTTTGCGTCGGT (SEQ ID NO:12053), GTAGGTGTTCGGTATGTTTGCGTCGGT (SEQ ID NO:12054), TGTAGGTGTTCGGTATGTTTGCGTCGG (SEQ ID NO:12055) |
| Target1276 | chr12:63544328-63544500 | AGGTCGGTTAGGTTGAGGTGTCGGATG (SEQ ID NO:12056), GGTCGGTTAGGTTGAGGTGTCGGATGA (SEQ ID NO:12057), CGGTTAGGTCGGTTAGGTTGAGGTGTCGG (SEQ ID NO:12058), AGGTCGGTTAGGTTGAGGTGTCGGATGA (SEQ ID NO:12059), CGGTTAGGTCGGTTAGGTTGAGGTGTCG (SEQ ID NO:12060), TGGAGATCGTCGTGTTGGCGGTGATTT (SEQ ID NO:12061), TTGGAGATCGTCGTGTTGGCGGTGATT (SEQ ID NO:12062), AATTGGAGATCGTCGTGTTGGCGGTGA (SEQ ID NO:12063), ATTGGAGATCGTCGTGTTGGCGGTGAT (SEQ ID NO:12064), AAATTGGAGATCGTCGTGTTGGCGGTG (SEQ ID NO:12065) |
| Target1277 | chr12:63544511-63544529 | CGGCGATTTTTAGTTTGGTTAGTTTTTCGTTGCG (SEQ ID NO:12066), CGGCGATTTTTAGTTTGGTTAGTTTTTCGTTGCGT (SEQ ID NO:12067), ACGGCGATTTTTAGTTTGGTTAGTTTTTCGTTGCG (SEQ ID NO:12068), GGCGATTTTTAGTTTGGTTAGTTTTTCGTTGCG (SEQ ID NO:12069), CGGCGATTTTTAGTTTGGTTAGTTTTTCGTTGC (SEQ ID NO:12070), TGGTGGTTTTTGGTTATCGGCGTTGGT (SEQ ID NO:12071), ATGGTGGTTTTTGGTTATCGGCGTTGGT (SEQ ID NO:12072), ATGGTGGTTTTTGGTTATCGGCGTTGG (SEQ ID NO:12073), CGGCGTTGGTAATATAAGTCGGGAGGTCG (SEQ ID NO:12074), CGGCGTTGGTAATATAAGTCGGGAGGT (SEQ ID NO:12075) |
| Target1278 | chr12:63544544-63544591 | CGGTTTGTGTTGTTAGCGTCGGTGGTT (SEQ ID NO:12076), CGGTTTGTGTTGTTAGCGTCGGTGGT (SEQ ID NO:12077), TGTGTTGTTAGCGTCGGTGGTTAGAGGT (SEQ ID NO:12078), GTGTTGTTAGCGTCGGTGGTTAGAGGT (SEQ ID NO:12079), TGTGTTGTTAGCGTCGGTGGTTAGAGG (SEQ ID NO:12080), TTTTTCGAGACGGGGAGGGAGCGGTTC (SEQ ID NO:12081), AAGTTTTTCGAGACGGGGAGGGAGCGG (SEQ ID NO:12082), GTTTTTCGAGACGGGGAGGGAGCGGTT (SEQ ID NO:12083), TTTTTCGAGACGGGGAGGGAGCGGTT (SEQ ID NO:12084), TAAGTTTTTCGAGACGGGGAGGGAGCGG (SEQ ID NO:12085) |
| Target1279 | chr12:63544648-63544687 | CGGTTTGTGTTGTTAGCGTCGGTGGTT (SEQ ID NO:12086), CGGTTTGTGTTGTTAGCGTCGGTGGT (SEQ ID NO:12087), TGTGTTGTTAGCGTCGGTGGTTAGAGGT (SEQ ID NO:12088), GTGTTGTTAGCGTCGGTGGTTAGAGGT (SEQ ID NO:12089), TGTGTTGTTAGCGTCGGTGGTTAGAGG (SEQ ID NO:12090), TTTTTCGAGACGGGGAGGGAGCGGTTC (SEQ ID NO:12091), AAGTTTTTCGAGACGGGGAGGGAGCGG (SEQ ID NO:12092), GTTTTTCGAGACGGGGAGGGAGCGGTT (SEQ ID NO:12093), TTTTTCGAGACGGGGAGGGAGCGGTT (SEQ ID NO:12094), TAAGTTTTTCGAGACGGGGAGGGAGCGG (SEQ ID NO:12095) |
| Target1280 | chr12:63544708-63544789 | CGCGTTCGTAGTTTGTCGGGTTTTGCG (SEQ ID NO:12096), GCGTTCGTAGTTTGTCGGGTTTTGCGA (SEQ ID NO:12097), GCGTTCGTAGTTTGTCGGGTTTTGCGAT (SEQ ID NO:12098), TTGGGTTTTTCGTTCGAAGCGTAGGGT (SEQ ID NO:12099), GCGTTCGTAGTTTGTCGGGTTTTGCG (SEQ ID NO:12100), TGAGAGTTGTTTAGTGGGTAGGCGGGA (SEQ ID NO:12101), TGAGAGTTGTTTAGTGGGTAGGCGGGAC (SEQ ID NO:12102), GAGAGTTGTTTAGTGGGTAGGCGGGAC (SEQ ID NO:12103), TTGAGAGTTGTTTAGTGGGTAGGCGGG (SEQ ID NO:12104), TTGAGAGTTGTTTAGTGGGTAGGCGGGA (SEQ ID NO:12105) |
| Target1281 | chr12:63544889-63544967 | GAGGTCGGGAAGGTGAGTTTCGAGTTT (SEQ ID NO:12106), AGGTCGGGAAGGTGAGTTTCGAGTTTT (SEQ ID NO:12107), AGGTCGGGAAGGTGAGTTTCGAGTTTC (SEQ ID NO:12108), GAGGTCGGGAAGGTGAGTTTCGAGTTTT (SEQ ID NO:12109), GAGGTCGGGAAGGTGAGTTTCGAGTT (SEQ ID NO:12110), TTTTCGGTAATAGGGCGGGAGGGAGCG (SEQ ID NO:12111), TTTCGGTAATAGGGCGGGAGGGAGCG (SEQ ID NO:12112), TTTTTCGGTAATAGGGCGGGAGGGAGCG (SEQ ID NO:12113), TTTTTCGGTAATAGGGCGGGAGGGAGC (SEQ ID NO:12114), GTTTTTCGGTAATAGGGCGGGAGGGAGC (SEQ ID NO:12115) |
| Target1282 | chr12:66122895-66122975 | CGGTAGGAGGTATTTTCGGGGAGCGGT (SEQ ID NO:12116), TCGGTAGGAGGTATTTTCGGGGAGCGG (SEQ ID NO:12117), CGGTAGGAGGTATTTTCGGGGAGCGGTT (SEQ ID NO:12118), TCGGTAGGAGGTATTTTCGGGGAGCGGT (SEQ ID NO:12119), TTCGGTAGGAGGTATTTTCGGGGAGCGG (SEQ ID NO:12120), ATCGGGGATTGAGGAAGGAGGAGTGCG (SEQ ID NO:12121), CGTTTTTAGGGTAGCGCGGGGAGTTCG (SEQ ID NO:12122), GGGATTGAGGAAGGAGGAGTGCGGGAT (SEQ ID NO:12123), GAGGTCGTTTTGGAGATGGCGTCGGTT (SEQ ID NO:12124), GGGGATTGAGGAAGGAGGAGTGCGGGA (SEQ ID NO:12125) |
| Target1283 | chr12:66123010-66123091 | CGGTAGGAGGTATTTTCGGGGAGCGGT (SEQ ID NO:12126), TCGGTAGGAGGTATTTTCGGGGAGCGG (SEQ ID NO:12127), CGGTAGGAGGTATTTTCGGGGAGCGGTT (SEQ ID NO:12128), TCGGTAGGAGGTATTTTCGGGGAGCGGT (SEQ ID NO:12129), TTCGGTAGGAGGTATTTTCGGGGAGCGG (SEQ ID NO:12130), TTCGTCGTTTGGAGCGGGAAAGTTGCG (SEQ ID NO:12131), GTTTTCGAGGTTTGGGCGCGTAGGAGG (SEQ ID NO:12132), TTTTCGAGGTTTGGGCGCGTAGGAGGT (SEQ ID NO:12133), GTTCGGGGTTTTCGTCGTTTGGAGCGG (SEQ ID NO:12134), GGTTCGGGGTTTTCGTCGTTTGGAGCG (SEQ ID NO:12135) |

FIGURE 5 CONTINUED

Target1284    chr12:66123110-66123128    GTTTTAGGCGGCGGGGGATTTCGAGTCG (SEQ ID NO:12136), CGTTTTAGGCGGCGGGGGATTTCGAGTC (SEQ ID NO:12137), TCGTTTTAGGCGGCGGGGGATTTCGAGT (SEQ ID NO:12138), TTCGTTTTAGGCGGCGGGGGATTTCGAG (SEQ ID NO:12139), TTTCGTTTTAGGCGGCGGGGGATTTCGA (SEQ ID NO:12140), GTTTTCGAGGTTTGGGCGCGTAGGAGG (SEQ ID NO:12141), TTTTCGAGGTTTGGGCGCGTAGGAGGT (SEQ ID NO:12142), TTTCGAGGTTTGGGCGCGTAGGAGGTA (SEQ ID NO:12143), TTCGAGGTTTGGGCGCGTAGGAGGTAT (SEQ ID NO:12144), CGAGGTTTGGGCGCGTAGGAGGTATAGG (SEQ ID NO:12145)

Target1285    chr12:66123168-66123214    GTTTTAGGCGGCGGGGGATTTCGAGTCG (SEQ ID NO:12146), CGTTTTAGGCGGCGGGGGATTTCGAGTC (SEQ ID NO:12147), CGGCGGGGGATTTCGAGTCGGAGTTTTG (SEQ ID NO:12148), TCGTTTTAGGCGGCGGGGGATTTCGAGT (SEQ ID NO:12149), GGCGGGGGATTTCGAGTCGGAGTTTTGG (SEQ ID NO:12150), GTAGAGCGGGGCGTTAAGGGTTGTTCG (SEQ ID NO:12151), CGAGTTTTTATGTCGGCGGGCGTAGAG (SEQ ID NO:12152), TAGAGCGGGGCGTTAAGGGTTGTTCG (SEQ ID NO:12153), GTTTAGGCGGAGGGTCGAAACGTTACG (SEQ ID NO:12154), CGTTAAGGGTTGTTCGCGGGGTGTATT (SEQ ID NO:12155)

Target1286    chr12:66123273-66123286    GCGGGTAGTTTTTGGCGTTTCGTTTTGC (SEQ ID NO:12156), TGGTGGATTAGAGGTGTATTTCGCGGGT (SEQ ID NO:12157), GGTGGATTAGAGGTGTATTTCGCGGGT (SEQ ID NO:12158), TGGTGGATTAGAGGTGTATTTCGCGGG (SEQ ID NO:12159), CGGGTAGTTTTTGGCGTTTCGTTTTGC (SEQ ID NO:12160), CGAGTTTTTATGTCGGCGGGCGTAGAG (SEQ ID NO:12161), GTTTAGGCGGAGGGTCGAAACGTTACG (SEQ ID NO:12162), CGAGTTTTTATGTCGGCGGGCGTAGA (SEQ ID NO:12163), TTTAGGCGGAGGGTCGAAACGTTACG (SEQ ID NO:12164), GAGTTTTTATGTCGGCGGGCGTAGAG (SEQ ID NO:12165)

Target1287    chr12:66123289-66123381    TCGGTATGAGGATTCGTGCGTGGCGTT (SEQ ID NO:12166), CGGTATGAGGATTCGTGCGTGGCGTTT (SEQ ID NO:12167), TGAGGATTCGTGCGTGGCGTTTCGATT (SEQ ID NO:12168), GTCGGTATGAGGATTCGTGCGTGGCGT (SEQ ID NO:12169), ATGAGGATTCGTGCGTGGCGTTTCGAT (SEQ ID NO:12170), TTTGCGGGTGGGTGGAGGTTGTAGGTT (SEQ ID NO:12171), TGTTTGCGGGTGGGTGGAGGTTGTAGG (SEQ ID NO:12172), GTTTGCGGGTGGGTGGAGGTTGTAGGT (SEQ ID NO:12173), TTGCGGGTGGGTGGAGGTTGTAGGTTA (SEQ ID NO:12174), TGCGGGTGGGTGGAGGTTGTAGGTTAT (SEQ ID NO:12175)

Target1288    chr12:66275403-66276260    GGGGAGGGAGGGAGGGAGGGAGAAAGAG (SEQ ID NO:12176), GAGGGAGGGAGGGAGGGAGGGAGAAAG (SEQ ID NO:12177), TCGGGTTGCGTTGTTAGGGTTGCGTTT (SEQ ID NO:12178), TTCGGGTTGCGTTGTTAGGGTTGCGTT (SEQ ID NO:12179), TTTCGGGTTGCGTTGTTAGGGTTGCGT (SEQ ID NO:12180), TTTGCGGTAGTTTTTTAGGGCGGGCGG (SEQ ID NO:12181), CGGTAGTTTTTTAGGGCGGGCGGGTTG (SEQ ID NO:12182), GGTAGTTTTTTAGGGCGGGCGGGTTGT (SEQ ID NO:12183), GTTTGCGGTAGTTTTTTAGGGCGGGCG (SEQ ID NO:12184), TTGCGGTAGTTTTTTAGGGCGGGCGG (SEQ ID NO:12185)

Target1289    chr12:66897000-66897016    TGGTTTTTAATAGGGTTTTAGAAATTGGGCGAGTG (SEQ ID NO:12186), GGTTTTTAATAGGGTTTTAGAAATTGGGCGAGTGA (SEQ ID NO:12187), TGGTTTTTAATAGGGTTTTAGAAATTGGGCGAGTGA (SEQ ID NO:12188), TTGGTTTTTAATAGGGTTTTAGAAATTGGGCGAGTG (SEQ ID NO:12189), GGTTTTTAATAGGGTTTTAGAAATTGGGCGAGTGAA (SEQ ID NO:12190), TGGGAAGTGAGTATGTGTAGTGTGTTTAGGAAGT (SEQ ID NO:12191), TGTTTGGGAAGTGAGTATGTGTAGTGTGTTTAGG (SEQ ID NO:12192), GTTTGGGAAGTGAGTATGTGTAGTGTGTTTAGGA (SEQ ID NO:12193), TGTTTGGGAAGTGAGTATGTGTAGTGTGTTTAGGA (SEQ ID NO:12194), GGGAAGTGAGTATGTGTAGTGTGTTTAGGAAGTT (SEQ ID NO:12195)

Target1290    chr12:70051601-70051609    TTGGTTGAATGTTTTGGGACGGCGTTC (SEQ ID NO:12196), ATTGGTTGAATGTTTTGGGACGGCGTT (SEQ ID NO:12197), AATTGGTTGAATGTTTTGGGACGGCGT (SEQ ID NO:12198), ATTGGTTGAATGTTTTGGGACGGCGTTC (SEQ ID NO:12199), TGGTTGAATGTTTTGGGACGGCGTTC (SEQ ID NO:12200), GTGGAGGGTGGGTTAGAAGGTTATTTGGT (SEQ ID NO:12201), AGTGGAGGGTGGGTTAGAAGGTTATTTGGT (SEQ ID NO:12202), AGTGGAGGGTGGGTTAGAAGGTTATTTGG (SEQ ID NO:12203), TGGAGGGTGGGTTAGAAGGTTATTTGGTAGT (SEQ ID NO:12204), AGTGGAGGGTGGGTTAGAAGGTTATTTGGTA (SEQ ID NO:12205)

Target1291    chr12:81312705-81313105    CGTTAAGGAATGTATGTCGGTAGTTGTTGAGATGT (SEQ ID NO:12206), TCGTTAAGGAATGTATGTCGGTAGTTGTTGAGATG (SEQ ID NO:12207), TCGTTAAGGAATGTATGTCGGTAGTTGTTGAGATGT (SEQ ID NO:12208), ATCGTTAAGGAATGTATGTCGGTAGTTGTTGAGATG (SEQ ID NO:12209), CGTTAAGGAATGTATGTCGGTAGTTGTTGAGATGTA (SEQ ID NO:12210)

Target1292    chr12:104193695-104193807    AGGAGGGGTGGAGGAGTAGGTGTTTT (SEQ ID NO:12211), TAGGAGGGGTGGAGGAGTAGGTGTTTT (SEQ ID NO:12212), GGAGGGGTGGAGGAGTAGGTGTTTTT (SEQ ID NO:12213), AGGAGGGGTGGAGGAGTAGGTGTTTTT (SEQ ID NO:12214), ATAGGAGGGGTGGAGGAGTAGGTGTTT (SEQ ID NO:12215)

Target1293    chr12:104193912-104193975    GGGGATGGAGACGGGAGGAAAGAGGT (SEQ ID NO:12216), TGGGTGATGGAGACGGGAGGAAAGAGG (SEQ ID NO:12217), TGGGTGATGGAGACGGGAGGAAAGAGGT (SEQ ID NO:12218), TGTGGGTGATGGAGACGGGAGGAAAGA (SEQ ID NO:12219), GTGGGTGATGGAGACGGGAGGAAAGAGG (SEQ ID NO:12220)

FIGURE 5 CONTINUED

Figure 5:
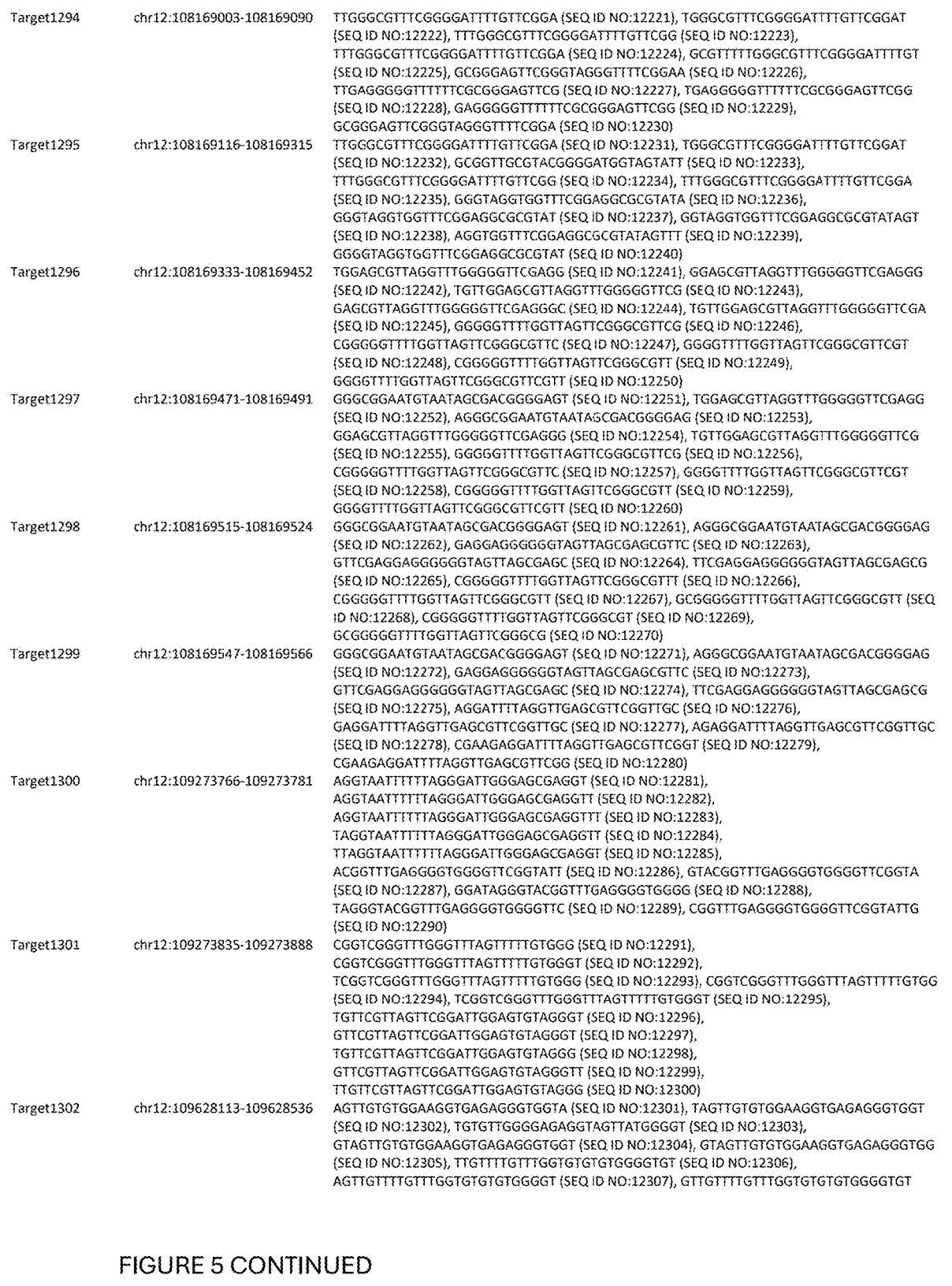

Target1294   chr12:108169003-108169090   TTGGGCGTTCGGGGATTTTGTTCGGA (SEQ ID NO:12221), TGGGCGTTTCGGGGATTTTGTTCGGAT
                                          (SEQ ID NO:12222), TTTGGGCGTTTCGGGGATTTTGTTCGG (SEQ ID NO:12223),
                                          TTTGGGCGTTTCGGGGATTTTGTTCGGA (SEQ ID NO:12224), GCGTTTTTGGGCGTTTCGGGGATTTTGT
                                          (SEQ ID NO:12225), GCGGGGAGTTCGGGTAGGGTTTCGGAA (SEQ ID NO:12226),
                                          TTGAGGGGGTTTTTTCGCGGGAGTTCG (SEQ ID NO:12227), TGAGGGGGTTTTTTCGCGGGAGTTCGG
                                          (SEQ ID NO:12228), GAGGGGGTTTTTTCGCGGGAGTTCGG (SEQ ID NO:12229),
                                          GCGGGAGTTCGGGTAGGGTTTCGGA (SEQ ID NO:12230)
Target1295   chr12:108169116-108169315   TTGGGCGTTCGGGGATTTTGTTCGGA (SEQ ID NO:12231), TGGGCGTTTCGGGGATTTTGTTCGGAT
                                          (SEQ ID NO:12232), GCGGTTGCGTACGGGGATGGTAGTATT (SEQ ID NO:12233),
                                          TTTGGGCGTTTCGGGGATTTTGTTCGG (SEQ ID NO:12234), TTTGGGCGTTTCGGGGATTTTGTTCGGA
                                          (SEQ ID NO:12235), GGGTAGGTGGTTTCGGAGGCGCGTATA (SEQ ID NO:12236),
                                          GGGTAGGTGGTTTCGGAGGCGCGTAT (SEQ ID NO:12237), GGTAGGTGGTTTCGGAGGCGCGTATAGT
                                          (SEQ ID NO:12238), AGGTGGTTTCGGAGGCGCGTATAGTTT (SEQ ID NO:12239),
                                          GGGGTAGGTGGTTTCGGAGGCGCGTAT (SEQ ID NO:12240)
Target1296   chr12:108169333-108169452   TGGAGCGTTAGGTTTGGGGGTTCGAGG (SEQ ID NO:12241), GGAGCGTTAGGTTTGGGGGTTCGAGGG
                                          (SEQ ID NO:12242), TGTTGGAGCGTTAGGTTTGGGGGTTCG (SEQ ID NO:12243),
                                          GAGCGTTAGGTTTGGGGGTTCGAGGGC (SEQ ID NO:12244), TGTTGGAGCGTTAGGTTTGGGGGTTCGA
                                          (SEQ ID NO:12245), GGGGGTTTTGGTTAGTTCGGGCGTTCG (SEQ ID NO:12246),
                                          CGGGGGGTTTTGGTTAGTTCGGGCGTTC (SEQ ID NO:12247), GGGGTTTTGGTTAGTTCGGGCGTTCGT
                                          (SEQ ID NO:12248), CGGGGGGTTTTGGTTAGTTCGGGCGTT (SEQ ID NO:12249),
                                          GGGGTTTTGGTTAGTTCGGGCGTTCGTT (SEQ ID NO:12250)
Target1297   chr12:108169471-108169491   GGGCGGAATGTAATAGCGACGGGGAGT (SEQ ID NO:12251), TGGAGCGTTAGGTTTGGGGGTTCGAGG
                                          (SEQ ID NO:12252), AGGGCGGAATGTAATAGCGACGGGGAG (SEQ ID NO:12253),
                                          GGAGCGTTAGGTTTGGGGGTTCGAGGG (SEQ ID NO:12254), TGTTGGAGCGTTAGGTTTGGGGGTTCG
                                          (SEQ ID NO:12255), GGGGGTTTTGGTTAGTTCGGGCGTTCG (SEQ ID NO:12256),
                                          CGGGGGGTTTTGGTTAGTTCGGGCGTTC (SEQ ID NO:12257), GGGGTTTTGGTTAGTTCGGGCGTTCGT
                                          (SEQ ID NO:12258), CGGGGGGTTTTGGTTAGTTCGGGCGTT (SEQ ID NO:12259),
                                          GGGGTTTTGGTTAGTTCGGGCGTTCGTT (SEQ ID NO:12260)
Target1298   chr12:108169515-108169524   GGGCGGAATGTAATAGCGACGGGGAGT (SEQ ID NO:12261), AGGGCGGAATGTAATAGCGACGGGGAG
                                          (SEQ ID NO:12262), GAGGAGGGGGGTAGTTAGCGAGCGTTC (SEQ ID NO:12263),
                                          GTTCGAGGAGGGGGGTAGTTAGCGAGC (SEQ ID NO:12264), TTCGAGGAGGGGGGTAGTTAGCGAGCG
                                          (SEQ ID NO:12265), CGGGGGGTTTTGGTTAGTTCGGGCGTTT (SEQ ID NO:12266),
                                          CGGGGGGTTTTGGTTAGTTCGGGCGTT (SEQ ID NO:12267), GCGGGGGGTTTTGGTTAGTTCGGGCGTT (SEQ
                                          ID NO:12268), CGGGGGGTTTTGGTTAGTTCGGGCGT (SEQ ID NO:12269),
                                          GCGGGGGTTTTGGTTAGTTCGGGCG (SEQ ID NO:12270)
Target1299   chr12:108169547-108169566   GGGCGGAATGTAATAGCGACGGGGAGT (SEQ ID NO:12271), AGGGCGGAATGTAATAGCGACGGGGAG
                                          (SEQ ID NO:12272), GAGGAGGGGGGTAGTTAGCGAGCGTTC (SEQ ID NO:12273),
                                          GTTCGAGGAGGGGGGTAGTTAGCGAGC (SEQ ID NO:12274), TTCGAGGAGGGGGGTAGTTAGCGAGCG
                                          (SEQ ID NO:12275), AGGATTTTAGGTTGAGCGTTCGGTTGC (SEQ ID NO:12276),
                                          GAGGATTTTAGGTTGAGCGTTCGGTTGC (SEQ ID NO:12277), AGAGGATTTTAGGTTGAGCGTTCGGTTGC
                                          (SEQ ID NO:12278), CGAAGAGGATTTTAGGTTGAGCGTTCGGT (SEQ ID NO:12279),
                                          CGAAGAGGATTTTAGGTTGAGCGTTCGG (SEQ ID NO:12280)
Target1300   chr12:109273766-109273781   AGGTAATTTTTTAGGGATTGGGAGCGAGGT (SEQ ID NO:12281),
                                          AGGTAATTTTTTAGGGATTGGGAGCGAGGTT (SEQ ID NO:12282),
                                          AGGTAATTTTTTAGGGATTGGGAGCGAGGTTT (SEQ ID NO:12283),
                                          TAGGTAATTTTTTAGGGATTGGGAGCGAGGTT (SEQ ID NO:12284),
                                          TTAGGTAATTTTTTAGGGATTGGGAGCGAGGT (SEQ ID NO:12285),
                                          ACGGTTTGAGGGGTGGGGTTCGGTATT (SEQ ID NO:12286), GTACGGTTTGAGGGGTGGGGTTCGGTA
                                          (SEQ ID NO:12287), GGATAGGGTACGGTTTGAGGGGTGGGG (SEQ ID NO:12288),
                                          TAGGGTACGGTTTGAGGGGTGGGGTTC (SEQ ID NO:12289), CGGTTTGAGGGGTGGGGTTCGGTATTG
                                          (SEQ ID NO:12290)
Target1301   chr12:109273835-109273888   CGGTCGGGTTTGGGTTTAGTTTTTTGTGGG (SEQ ID NO:12291),
                                          CGGTCGGGTTTGGGTTTAGTTTTTTGTGGGT (SEQ ID NO:12292),
                                          TCGGTCGGGTTTGGGTTTAGTTTTTTGTGGG (SEQ ID NO:12293), CGGTCGGGTTTGGGTTTAGTTTTTTGTGG
                                          (SEQ ID NO:12294), TCGGTCGGGTTTGGGTTTAGTTTTTTGTGGGT (SEQ ID NO:12295),
                                          TGTTCGTTAGTTCGGATTGGAGTGTAGGGT (SEQ ID NO:12296),
                                          GTTCGTTAGTTCGGATTGGAGTGTAGGG (SEQ ID NO:12297),
                                          TGTTCGTTAGTTCGGATTGGAGTGTAGGG (SEQ ID NO:12298),
                                          GTTCGTTAGTTCGGATTGGAGTGTAGGGTT (SEQ ID NO:12299),
                                          TTGTTCGTTAGTTCGGATTGGAGTGTAGGG (SEQ ID NO:12300)
Target1302   chr12:109628113-109628536   AGTTGTGTGGAAGGTGAGAGGGTGGTA (SEQ ID NO:12301), TAGTTGTGTGGAAGGTGAGAGGGTGGT
                                          (SEQ ID NO:12302), TGTGTTGGGGAGAGGTAGTTATGGGGT (SEQ ID NO:12303),
                                          GTAGTTGTGTGGAAGGTGAGAGGGTGGT (SEQ ID NO:12304), GTAGTTGTGTGGAAGGTGAGAGGGTGG
                                          (SEQ ID NO:12305), TTGTTTTGTTTGGTGTGTGTGGGGTGT (SEQ ID NO:12306),
                                          AGTTGTTTTGTTTGGTGTGTGTGGGGT (SEQ ID NO:12307), GTTGTTTTGTTTGGTGTGTGTGTGGGGTGT

FIGURE 5 CONTINUED (SEQ ID NO:12308), AGTTGTTTTGTTTGGTGTGTGTGGGGTGT (SEQ ID NO:12309), AGTTGTTTTGTTTGGTGTGTGTGGGGTG (SEQ ID NO:12310)

| | | |
|---|---|---|
| Target1303 | chr12:113901279-113901325 | GTTGGAGTCGGTCGGGGATTGCGTTTG (SEQ ID NO:12311), AGGAAGTTGGAGTCGGTCGGGGATTGC (SEQ ID NO:12312), AGTTGGAGTCGGTCGGGGATTGCGTTT (SEQ ID NO:12313), AAGTTGGAGTCGGTCGGGGATTGCGTT (SEQ ID NO:12314), GAAGTTGGAGTCGGTCGGGGATTGCGT (SEQ ID NO:12315) |
| Target1304 | chr12:113901337-113901352 | GTTGGAGTCGGTCGGGGATTGCGTTTG (SEQ ID NO:12316), AGGAAGTTGGAGTCGGTCGGGGATTGC (SEQ ID NO:12317), AGTTGGAGTCGGTCGGGGATTGCGTTT (SEQ ID NO:12318), AAGTTGGAGTCGGTCGGGGATTGCGTT (SEQ ID NO:12319), GAAGTTGGAGTCGGTCGGGGATTGCGT (SEQ ID NO:12320) |
| Target1305 | chr12:113901393-113901409 | GTTGGAGTCGGTCGGGGATTGCGTTTG (SEQ ID NO:12321), GTTTTGGTAGTTTGCGGAGGGGGAGCG (SEQ ID NO:12322), CGTTTTGGTAGTTTGCGGAGGGGGAGC (SEQ ID NO:12323), AGTTGGAGTCGGTCGGGGATTGCGTTT (SEQ ID NO:12324), AAGTTGGAGTCGGTCGGGGATTGCGTT (SEQ ID NO:12325) |
| Target1306 | chr12:113901467-113901478 | GTTTTGGTAGTTTGCGGAGGGGGAGCG (SEQ ID NO:12326), CGTTTTGGTAGTTTGCGGAGGGGGAGC (SEQ ID NO:12327), GGAAGGAGATAGGGCGCGGTGAGAGAA (SEQ ID NO:12328), TTTTGGTAGTTTGCGGAGGGGGAGCGG (SEQ ID NO:12329), AGTCGTTTTGGTAGTTTGCGGAGGGGG (SEQ ID NO:12330) |
| Target1307 | chr12:113901793-113901814 | GGGTCGGTGAGAGATATAGAGATGCGGG (SEQ ID NO:12331), AGGGTCGGTGAGAGATATAGAGATGCGGG (SEQ ID NO:12332), GGGTCGGTGAGAGATATAGAGATGCGGGA (SEQ ID NO:12333), AGGGTCGGTGAGAGATATAGAGATGCGGGA (SEQ ID NO:12334), AGGGTCGGTGAGAGATATAGAGATGCGGG (SEQ ID NO:12335) |
| Target1308 | chr12:113901855-113901867 | CGGTAGAGGGGTAGAGAGAAAGGCGGA (SEQ ID NO:12336), TCGGTAGAGGGGTAGAGAGAAAGGCGG (SEQ ID NO:12337), TCGGTAGAGGGGTAGAGAGAAAGGCGGA (SEQ ID NO:12338), CGGTAGAGGGGTAGAGAGAAAGGCGGAA (SEQ ID NO:12339), ATCGGTAGAGGGGTAGAGAGAAAGGCGG (SEQ ID NO:12340), TGTTTCGGGTTTTCGGGTTTTAGTCGC (SEQ ID NO:12341), ATGTTTCGGGTTTTCGGGTTTTAGTCGC (SEQ ID NO:12342), GATGTTTCGGGTTTTCGGGTTTTAGTCGC (SEQ ID NO:12343) |
| Target1309 | chr12:113901937-113901976 | GATATCGGAGGGTCGCGGAGGAGTCGA (SEQ ID NO:12344), AGATATCGGAGGGTCGCGGAGGAGTCG (SEQ ID NO:12345), CGTAGAGAGAGGAAAGACGGTCGCGGT (SEQ ID NO:12346), GAGATATCGGAGGGTCGCGGAGGAGTC (SEQ ID NO:12347), ATATCGGAGGGTCGCGGAGGAGTCGA (SEQ ID NO:12348) |
| Target1310 | chr12:113902019-113902036 | CGTAGAGAGAGGAAAGACGGTCGCGGT (SEQ ID NO:12349), GCGGTAGCGAGGGAGTTAGGAGTGAGT (SEQ ID NO:12350), CGTAGAGAGAGGAAAGACGGTCGCGGTT (SEQ ID NO:12351), GCGGTAGCGAGGGAGTTAGGAGTGAGTT (SEQ ID NO:12352), GTAGAGAGAGGAAAGACGGTCGCGGTT (SEQ ID NO:12353), TCGCGTTTTGTTTTGTTCGTTGGTTTGTT (SEQ ID NO:12354), TTCGCGTTTTGTTTTGTTCGTTGGTTTGT (SEQ ID NO:12355), TGTTTTGTTCGTTGGTTTGTTTTTTGTCGGTT (SEQ ID NO:12356), TTGTTTTGTTCGTTGGTTTGTTTTTTGTTCGGT (SEQ ID NO:12357), TTGTTTTGTTCGTTGGTTTGTTTTTTGTTCGGTT (SEQ ID NO:12358) |
| Target1311 | chr12:113902128-113902145 | GCGGAGGTTGATAGGTTCGGGGAGAGG (SEQ ID NO:12359), GGTTCGGGGAGAGGAATCGGGTAGGGA (SEQ ID NO:12360), AGGTTCGGGGAGAGGAATCGGGTAGGG (SEQ ID NO:12361), TAGGTTCGGGGAGAGGAATCGGGTAGGG (SEQ ID NO:12362), GTTCGGGGAGAGGAATCGGGTAGGGAT (SEQ ID NO:12363), GGGCGTAGGGATCGAGTTTAGGGCGTT (SEQ ID NO:12364), AGGGCGTAGGGATCGAGTTTAGGGCGT (SEQ ID NO:12365), TAGGGCGTAGGGATCGAGTTTAGGGCG (SEQ ID NO:12366), GGGCGTAGGGATCGAGTTTAGGGCGT (SEQ ID NO:12367), AGGGCGTTAAGGTCGTTTCGTTCGGTT (SEQ ID NO:12368) |
| Target1312 | chr12:113917518-113917544 | CGGTGCGTAGGGTTGGGGGAGTATAGGT (SEQ ID NO:12369), CGGTGCGTAGGGTTGGGGGAGTATAGGTT (SEQ ID NO:12370), GGTGCGTAGGGTTGGGGGAGTATAGGTT (SEQ ID NO:12371), CGGTGCGTAGGGTTGGGGGAGTATAGGTTT (SEQ ID NO:12372), CGGTGCGTAGGGTTGGGGGAGTATAGG (SEQ ID NO:12373) |
| Target1313 | chr12:113917702-113917732 | TGCGGGTTTTGGGGCGAGGTTTAGTTG (SEQ ID NO:12374), GCGGGTTTTGGGGCGAGGTTTAGTTGG (SEQ ID NO:12375), GGCGAGGCGTTGTTTGGGGATAGATCG (SEQ ID NO:12376), TGGGGCGAGGTTTAGTTGGTTTGGGGG (SEQ ID NO:12377), GGGGCGAGGTTTAGTTGGTTTGGGGGT (SEQ ID NO:12378), TGTTTGGGGTGGGTGTTGGAGGGTAGG (SEQ ID NO:12379), GGTGTTTGGGGTGGGTGTTGGAGGGTA (SEQ ID NO:12380), TTGGGGTGGGTGTTGGAGGGTAGGAGA (SEQ ID NO:12381), GTTTGGGGTGGGTGTTGGAGGGTAGGA (SEQ ID NO:12382), TACGGTGTTTGGGGTGGGTGTTGGAGG (SEQ ID NO:12383) |
| Target1314 | chr12:113917733-113917750 | GGCGAGGCGTTGTTTGGGGATAGATCG (SEQ ID NO:12384), AGGCGAGGCGTTGTTTGGGGATAGATCG (SEQ ID NO:12385), AGGCGAGGCGTTGTTTGGGGATAGATC (SEQ ID NO:12386), AGGCGAGGCGTTGTTTGGGGATAGAT (SEQ ID NO:12387), GCGAGGCGTTGTTTGGGGATAGATCG (SEQ ID NO:12388), TGTTTGGGGTGGGTGTTGGAGGGTAGG (SEQ ID NO:12389), GGTGTTTGGGGTGGGTGTTGGAGGGTA (SEQ ID NO:12390), TTGGGGTGGGTGTTGGAGGGTAGGAGA |

FIGURE 5 CONTINUED (SEQ ID NO:12391), GTTTGGGGTGGGTGTTGGAGGGTAGGA (SEQ ID NO:12392),
TACGGTGTTTGGGGTGGGTGTTGGAGG (SEQ ID NO:12393)

Target1315     chr12:114075881-114076058     TCGGTCGTTCGTATTTGGGCGCGTAGA (SEQ ID NO:12394), GTCGGTCGTTCGTATTTGGGCGCGTAG
(SEQ ID NO:12395), CGGTCGTTCGTATTTGGGCGCGTAGAG (SEQ ID NO:12396),
GTCGTTCGTATTGTTCGGGTCGGCGTT (SEQ ID NO:12397), GGTCGTTCGTATTTGGGCGCGTAGAGG
(SEQ ID NO:12398), GTGATAATGGCGGGGTGACGGGGGTTA (SEQ ID NO:12399),
TGATAATGGCGGGGTGACGGGGGTTAA (SEQ ID NO:12400), AATGGCGGGGTGACGGGGGTTAATTCG
(SEQ ID NO:12401), TGAGGGCGGTTATTGTGCGTTGTGTGA (SEQ ID NO:12402),
GCGTTTTTGAGGGCGGTTATTGTGCGT (SEQ ID NO:12403)

Target1316     chr12:114833945-114833953     GATCGAGTGGAGGTAGTTGGGGGAGGC (SEQ ID NO:12404), CGATCGAGTGGAGGTAGTTGGGGGAGG
(SEQ ID NO:12405), AGTGGAGGTAGTTGGGGGAGGCGAGTC (SEQ ID NO:12406),
GAGTGGAGGTAGTTGGGGGAGGCGAGT (SEQ ID NO:12407), ATCGAGTGGAGGTAGTTGGGGGAGGCG
(SEQ ID NO:12408), TTATCGGTCGGGGAGGCGGTCGGGTTA (SEQ ID NO:12409),
TATCGGTCGGGGAGGCGGTCGGGTTAC (SEQ ID NO:12410), TATCGGTCGGGGAGGCGGTCGGGTTA
(SEQ ID NO:12411), GTTATCGGTCGGGGAGGCGGTCGGGTT (SEQ ID NO:12412),
TTATCGGTCGGGGAGGCGGTCGGGTTAC (SEQ ID NO:12413)

Target1317     chr12:114833956-114833974     GATCGAGTGGAGGTAGTTGGGGGAGGC (SEQ ID NO:12414), CGATCGAGTGGAGGTAGTTGGGGGAGG
(SEQ ID NO:12415), AGTGGAGGTAGTTGGGGGAGGCGAGTC (SEQ ID NO:12416),
GAGTGGAGGTAGTTGGGGGAGGCGAGT (SEQ ID NO:12417), ATCGAGTGGAGGTAGTTGGGGGAGGCG
(SEQ ID NO:12418), TTATCGGTCGGGGAGGCGGTCGGGTTA (SEQ ID NO:12419),
TATCGGTCGGGGAGGCGGTCGGGTTAC (SEQ ID NO:12420), TATCGGTCGGGGAGGCGGTCGGGTTA
(SEQ ID NO:12421), GTTATCGGTCGGGGAGGCGGTCGGGTT (SEQ ID NO:12422),
TTATCGGTCGGGGAGGCGGTCGGGTTAC (SEQ ID NO:12423)

Target1318     chr12:114833991-114834066     GATCGAGTGGAGGTAGTTGGGGGAGGC (SEQ ID NO:12424), CGATCGAGTGGAGGTAGTTGGGGGAGG
(SEQ ID NO:12425), AGTGGAGGTAGTTGGGGGAGGCGAGTC (SEQ ID NO:12426),
GAGTGGAGGTAGTTGGGGGAGGCGAGT (SEQ ID NO:12427), ATCGAGTGGAGGTAGTTGGGGGAGGCG
(SEQ ID NO:12428), CGGTTAGCGGGGTTTCGTTGCGTTTTT (SEQ ID NO:12429),
CGGTTAGCGGGGTTTCGTTGCGTTTTT (SEQ ID NO:12430), CGGTTAGCGGGGTTTCGTTGCGTTTT (SEQ
ID NO:12431), TTATCGGTCGGGGAGGCGGTCGGGTTA (SEQ ID NO:12432),
GGTTAGCGGGGTTTCGTTGCGTTTTTT (SEQ ID NO:12433)

Target1319     chr12:114834075-114834139     GGGTCGCGCGTTTTTAATTTTCGGTCG (SEQ ID NO:12434), GGGTCGCGCGTTTTTAATTTTCGGTCGT
(SEQ ID NO:12435), GGTCGCGCGTTTTTAATTTTCGGTCGT (SEQ ID NO:12436),
GGGTCGCGCGTTTTTAATTTTCGGTCGTC (SEQ ID NO:12437), GGTCGCGCGTTTTTAATTTTCGGTCGTC
(SEQ ID NO:12438), CGGTTAGCGGGGTTTCGTTGCGTTTTT (SEQ ID NO:12439),
CGGTTAGCGGGGTTTCGTTGCGTTTTT (SEQ ID NO:12440), CGGTTAGCGGGGTTTCGTTGCGTTTTT (SEQ
ID NO:12441), GGTTAGCGGGGTTTCGTTGCGTTTTTT (SEQ ID NO:12442),
GTCGGTCGGGGATTGTGGCGGTTAG (SEQ ID NO:12443)

Target1320     chr12:114834201-114834210     GTTTTCGGTCGGCGGGGTTATCGGTTC (SEQ ID NO:12444), TCGGCGGGGTTATCGGTTCGGTTTAGT
(SEQ ID NO:12445), TAGTTTTCGGTCGGCGGGGTTATCGGT (SEQ ID NO:12446),
AGTTTTCGGTCGGCGGGGTTATCGGTT (SEQ ID NO:12447), GGTCGGCGGGGTTATCGGTTCGGTTTA
(SEQ ID NO:12448), AGTTGGGGAGAGGGGTTCGGAGTTGTT (SEQ ID NO:12449),
TAGTTGGGGAGAGGGGTTCGGAGTTGT (SEQ ID NO:12450), GTTGGGGAGAGGGGTTCGGAGTTGTTT
(SEQ ID NO:12451), AGTTGGGGAGAGGGGTTCGGAGTTGTTT (SEQ ID NO:12452),
AGTTGGGGAGAGGGGTTCGGAGTTGT (SEQ ID NO:12453)

Target1321     chr12:114840863-114840896     GCGTTTAGTGCGTTTTGGGTTTTGGGCG (SEQ ID NO:12454), GCGTTTAGTGCGTTTTGGGTTTTGGGC
(SEQ ID NO:12455), AGTGCGTTTTGGGTTTTGGGCGTAGAG (SEQ ID NO:12456),
CGTTTAGTGCGTTTTGGGTTTTGGGCGT (SEQ ID NO:12457), CGTTTAGTGCGTTTTGGGTTTTGGGCG
(SEQ ID NO:12458), TGGCGCGTTATTATCGGTCGTTGGGAG (SEQ ID NO:12459),
GGTTGGCGCGTTATTATCGGTCGTTGGG (SEQ ID NO:12460), TTGGCGCGTTATTATCGGTCGTTGGGA
(SEQ ID NO:12461), GTTGGCGCGTTATTATCGGTCGTTGGG (SEQ ID NO:12462),
GGTTGGCGCGTTATTATCGGTCGTTGG (SEQ ID NO:12463)

Target1322     chr12:114840967-114841026     TAGCGGTCGGTGATGGCGCGTTAGTTA (SEQ ID NO:12464), GTTTTTAGCGGTCGGTGATGGCGCGTT
(SEQ ID NO:12465), TTTTAGCGGTCGGTGATGGCGCGTTAG (SEQ ID NO:12466),
TTAGCGGTCGGTGATGGCGCGTTAGTT (SEQ ID NO:12467), TTTAGCGGTCGGTGATGGCGCGTTAGT
(SEQ ID NO:12468), TGTTTTGCGGTCGGGGTTTGGTTGGTT (SEQ ID NO:12469),
TTGTTTTGCGGTCGGGGTTTGGTTGGT (SEQ ID NO:12470), TTTTGCGGTCGGGGTTTGGTTGGTTGG (SEQ
ID NO:12471), CGGGGTTTGGTTGGTTGGCGCGTTATT (SEQ ID NO:12472),
GTTTTGCGGTCGGGGTTTGGTTGGTTG (SEQ ID NO:12473)

Target1323     chr12:114841029-114841071     TAGCGGTCGGTGATGGCGCGTTAGTTA (SEQ ID NO:12474), GTTTTTAGCGGTCGGTGATGGCGCGTT
(SEQ ID NO:12475), TTTTAGCGGTCGGTGATGGCGCGTTAG (SEQ ID NO:12476),
TTAGCGGTCGGTGATGGCGCGTTAGTT (SEQ ID NO:12477), TTTAGCGGTCGGTGATGGCGCGTTAGT
(SEQ ID NO:12478), AAGGGGTTAGGTTAGCGGTCGATTTAGGTC (SEQ ID NO:12479),
AATAAGGGGTTAGGTTAGCGGTCGATTTAGGTC (SEQ ID NO:12480),
TTTAATAAGGGGTTAGGTTAGCGGTCGATTTAGGTC (SEQ ID NO:12481),
TTTTAATAAGGGGTTAGGTTAGCGGTCGATTTAGGTC (SEQ ID NO:12482)

FIGURE 5 CONTINUED

Target1324    chr12:114841155-114841170    GTAGGAGGAGGTAGGAGGAGGCGGGAG (SEQ ID NO:12483),
                                           GAGGTAGGAGGAGGTAGGAGGAGGCGG (SEQ ID NO:12484),
                                           GGAGGTAGGAGGAGGTAGGAGGAGGCG (SEQ ID NO:12485),
                                           GCGGAGGAGGTAGGAGGAGGTAGGAGG (SEQ ID NO:12486),
                                           CGCGGAGGAGGTAGGAGGAGGTAGGAG (SEQ ID NO:12487),
                                           TCGGTCGTTTGGGGTTAGTTAATAATGGTTTAGA (SEQ ID NO:12488),
                                           TTCGGTCGTTTGGGGTTAGTTAATAATGGTTTAGA (SEQ ID NO:12489),
                                           TCGGTCGTTTGGGGTTAGTTAATAATGGTTTAGAT (SEQ ID NO:12490),
                                           TTCGGTCGTTTGGGGTTAGTTAATAATGGTTTAGAT (SEQ ID NO:12491),
                                           ATTCGGTCGTTTGGGGTTAGTTAATAATGGTTTAGA (SEQ ID NO:12492)

Target1325    chr12:114886355-114886374    TGGTTGTGGGTGGATGGATGAAGAAGGT (SEQ ID NO:12493), GGTTGTGGGTGGATGGATGAAGAAGGT
                                           (SEQ ID NO:12494), TGGTTGTGGGTGGATGGATGAAGAAGG (SEQ ID NO:12495),
                                           TGGTTGTGGGTGGATGGATGAAGAAGGTT (SEQ ID NO:12496),
                                           TTGGTTGTGGGTGGATGGATGAAGAAGGT (SEQ ID NO:12497), TTGATGGAGTAGTTCGCGTCGTGGTGC
                                           (SEQ ID NO:12498), TTTGATGGAGTAGTTCGCGTCGTGGTGC (SEQ ID NO:12499),
                                           TGATGGAGTAGTTCGCGTCGTGGTGC (SEQ ID NO:12500), GGAAACGCGGTTGGAGGTTAGTGGATGT
                                           (SEQ ID NO:12501), GGAAACGCGGTTGGAGGTTAGTGGATG (SEQ ID NO:12502)

Target1326    chr12:114886408-114886417    TGGTTGTGGGTGGATGGATGAAGAAGGT (SEQ ID NO:12503), GGTTGTGGGTGGATGGATGAAGAAGGT
                                           (SEQ ID NO:12504), TGGTTGTGGGTGGATGGATGAAGAAGG (SEQ ID NO:12505),
                                           TGGTTGTGGGTGGATGGATGAAGAAGGTT (SEQ ID NO:12506),
                                           TTGGTTGTGGGTGGATGGATGAAGAAGGT (SEQ ID NO:12507), CGGGTTTATTTTGGGGGCGTTTAGTGT
                                           (SEQ ID NO:12508), TCGGGTTTATTTTGGGGGCGTTTAGTGT (SEQ ID NO:12509),
                                           TCGGGTTTATTTTGGGGGCGTTTAGTG (SEQ ID NO:12510), CGGGTTTATTTTGGGGGCGTTTAGTGTT
                                           (SEQ ID NO:12511), TCGGGTTTATTTTGGGGGCGTTTAGTGTT (SEQ ID NO:12512)

Target1327    chr12:114886449-114886466    TTTATTTGGAGTTTAAGTTTTGGCGCGCG (SEQ ID NO:12513),
                                           TTTTATTTGGAGTTTAAGTTTTGGCGCGCG (SEQ ID NO:12514),
                                           CGGTTGTAGTATTGGGCGTTTTTAGAGTGG (SEQ ID NO:12515),
                                           CGGTTGTAGTATTGGGCGTTTTTAGAGTGGA (SEQ ID NO:12516),
                                           TCGGTTGTAGTATTGGGCGTTTTTAGAGTGG (SEQ ID NO:12517),
                                           GCGGTCGTTGGTAGGTAGTCGGATCGG (SEQ ID NO:12518), CGGTCGTTGGTAGGTAGTCGGATCGGG
                                           (SEQ ID NO:12519), AGCGGTCGTTGGTAGGTAGTCGGATCG (SEQ ID NO:12520),
                                           TTGAGCGGTCGTTGGTAGGTAGTCGGA (SEQ ID NO:12521), GGTCGTTGGTAGGTAGTCGGATCGGGA
                                           (SEQ ID NO:12522)

Target1328    chr12:114886504-114886517    GCGGCGAGTTAGGGTATTTCGGATCGG (SEQ ID NO:12523), AGCGGCGAGTTAGGGTATTTCGGATCGG
                                           (SEQ ID NO:12524), GCGGCGAGTTAGGGTATTTCGGATCGGT (SEQ ID NO:12525),
                                           AGCGGCGAGTTAGGGTATTTCGGATCG (SEQ ID NO:12526), TAAGTTATCGGCGCGGTTTAGGAGGGG
                                           (SEQ ID NO:12527), AGGCGGAATGTAGGTCGGTGTGTGAGG (SEQ ID NO:12528),
                                           GGAGGCGGAATGTAGGTCGGTGTGTGA (SEQ ID NO:12529), GGCGGAATGTAGGTCGGTGTGTGAGGT
                                           (SEQ ID NO:12530), GCGGTCGTTGGTAGGTAGTCGGATCGG (SEQ ID NO:12531),
                                           CGGTCGTTGGTAGGTAGTCGGATCGGG (SEQ ID NO:12532)

Target1329    chr12:114886523-114886562    GCGGCGAGTTAGGGTATTTCGGATCGG (SEQ ID NO:12533), AGCGGCGAGTTAGGGTATTTCGGATCGG
                                           (SEQ ID NO:12534), GCGGCGAGTTAGGGTATTTCGGATCGGT (SEQ ID NO:12535),
                                           AGCGGCGAGTTAGGGTATTTCGGATCG (SEQ ID NO:12536), TAAGTTATCGGCGCGGTTTAGGAGGGG
                                           (SEQ ID NO:12537), AGGCGGAATGTAGGTCGGTGTGTGAGG (SEQ ID NO:12538),
                                           GGAGGCGGAATGTAGGTCGGTGTGTGA (SEQ ID NO:12539), GGCGGAATGTAGGTCGGTGTGTGAGGT
                                           (SEQ ID NO:12540), GATGGGGGTTGGGGAGGCGGAATGTAG (SEQ ID NO:12541),
                                           TTCGTGGTAAGGATGGGGGTTGGGGAG (SEQ ID NO:12542)

Target1330    chr12:115103612-115104184    ATAAGAGGGTTGGTCGGGGAGGGGGAT (SEQ ID NO:12543), TCGCGGGAGAGGGAAATTTCGGCGTTA
                                           (SEQ ID NO:12544), CGGATTGCGTTCGGTTTTGGCGTTTGG (SEQ ID NO:12545),
                                           GGTTGGTCGGGGAGGGGGATGTTGAAA (SEQ ID NO:12546), GGACGCGGGGGAGGATTTGAGGTTAGT
                                           (SEQ ID NO:12547), TTCGGGGATTGTAGGTGGAGACGTCGT (SEQ ID NO:12548),
                                           GTTCGGGGATTGTAGGTGGAGACGTCGT (SEQ ID NO:12549), GTTCGGGGATTGTAGGTGGAGACGTCG
                                           (SEQ ID NO:12550), GAGGGAAATCGCGGGGGGAGAGGAAATT (SEQ ID NO:12551),
                                           CGGGGATTGTAGGTGGAGACGTCGTAGG (SEQ ID NO:12552)

Target1331    chr12:122473392-122473522    GGGTTGGGTAGGGTTCGGCGGTTTTTG (SEQ ID NO:12553), AGGGTTGGGTAGGGTTCGGCGGTTTTT
                                           (SEQ ID NO:12554), AGGGGTAGGAGGGTTGGGTAGGGTTCG (SEQ ID NO:12555),
                                           GGTTGGGTAGGGTTCGGCGGTTTTTGT (SEQ ID NO:12556), GAGGGTTGGGTAGGGTTCGGCGGTTTT
                                           (SEQ ID NO:12557), TGCGGGGTTTTTGTTTTTGGGTGAGGA (SEQ ID NO:12558),
                                           TGCGGGGTTTTTGTTTTTGGGTGAGGAG (SEQ ID NO:12559), GCGGGGTTTTTGTTTTTGGGTGAGGAG
                                           (SEQ ID NO:12560), TTGCGGGGTTTTTGTTTTTGGGTGAGG (SEQ ID NO:12561),
                                           TGCGGGGTTTTTGTTTTTGGGTGAGGAGA (SEQ ID NO:12562)

Target1332    chr12:124941570-124941724    ACGTCGTTTGGGTAGCGTTTGGTAATAGA (SEQ ID NO:12563),
                                           ACGTCGTTTGGGTAGCGTTTGGTAATAGAT (SEQ ID NO:12564),
                                           CGTCGTTTGGGTAGCGTTTGGTAATAGATG (SEQ ID NO:12565),
                                           ACGTCGTTTGGGTAGCGTTTGGTAATAGATG (SEQ ID NO:12566),
                                           CGTCGTTTGGGTAGCGTTTGGTAATAGATGA (SEQ ID NO:12567),

FIGURE 5 CONTINUED

|  |  |  |
|---|---|---|
|  |  | TAGGGTTAGGGGTTTAGGGGGAGGGCGG (SEQ ID NO:12568), GGGTGGTTGGAGAGGTGGGTAGGGAGG (SEQ ID NO:12569), GGGGTGGTTGGAGAGGTGGGTAGGGAG (SEQ ID NO:12570), GTGGTTGGAGAGGTGGGTAGGGAGGC (SEQ ID NO:12571), ATAGGGTTAGGGGTTTAGGGGGAGGGCG (SEQ ID NO:12572) |
| Target1333 | chr12:124941781-124941952 | GGGGGAGGGAGGTTCGGGGGTTTTTTGT (SEQ ID NO:12573), TTTAGTACGGGGGAGGGAGGTTCGGGG (SEQ ID NO:12574), TTTTAGTACGGGGGAGGGAGGTTCGGG (SEQ ID NO:12575), TACGGGGGAGGGAGGTTCGGGGTTTTT (SEQ ID NO:12576), CGGGGGAGGGAGGTTCGGGGTTTTTTG (SEQ ID NO:12577), GGGAGGGTTTGTAGGGGGTTTCGGGTT (SEQ ID NO:12578), TGGTTTGTTGGGGTCGTTGTGGGGGTA (SEQ ID NO:12579), GTTGGTTTGTTGGGGTCGTTGTGGGGG (SEQ ID NO:12580), GGTTGGTTTGTTGGGGTCGTTGTGGGG (SEQ ID NO:12581), TTTAGCGTGGGGAGGGTTTGTAGGGGG (SEQ ID NO:12582) |
| Target1334 | chr12:124941977-124942177 | GGAGGGAGGGAGGGTGAGATAGAGGCGT (SEQ ID NO:12583), CGAGGGAAGGAGGAGGAGGAGGAGGAG (SEQ ID NO:12584), AGGAGGAGGGAGGGTGAGATAGAGGCG (SEQ ID NO:12585), GAAGGAGGAGGAGGAGGAGGAGGGAGG (SEQ ID NO:12586), GGAAGGAGGAGGAGGAGGAGGAGGGAG (SEQ ID NO:12587), TTTAGTTGTGAGTGGGGAGGAGGCGGG (SEQ ID NO:12588), TTGGTAGTGTCGGTTGGGTTGGTGGGG (SEQ ID NO:12589), GGTAGTGTCGGTTGGGTTGGTGGGGAG (SEQ ID NO:12590), AGGGTTGGTAGTGTCGGTTGGGTTGGT (SEQ ID NO:12591), AGGCGGGGGAGGTTTCGGGGTAGTTTAG (SEQ ID NO:12592) |
| Target1335 | chr12:132258427-132258452 | CGGTTTCGGGATTTGGGGTTTAGGGCG (SEQ ID NO:12593), GGTTTCGGGATTTGGGGTTTAGGGCG (SEQ ID NO:12594), CGGTTTCGGGATTTGGGGTTTAGGC (SEQ ID NO:12595), GGATAGTATAGTTAGGAGGAGAGTGGCGGT (SEQ ID NO:12596), AGGATAGTATAGTTAGGAGGAGAGTGGCGGT (SEQ ID NO:12597), GGGTTTTTGGTTTTCGTGGGTTTTTATTATTTTGGT (SEQ ID NO:12598), TGGGTTTTTGGTTTTCGTGGGTTTTTATTATTTTGG (SEQ ID NO:12599), TTTTAAGGTTTCGTTTGAGTTTTAGGTTTCGGAGT (SEQ ID NO:12600), TTTTTAAGGTTTCGTTTGAGTTTTAGGTTTCGGAGT (SEQ ID NO:12601) |
| Target1336 | chr12:132258560-132258668 | TGGGGTTTAGGCGAGGTTTTGAGGAGT (SEQ ID NO:12602), TGGGGTTTAGGCGAGGTTTTGAGGAGTT (SEQ ID NO:12603), TTGGGGTTTAGGCGAGGTTTTGAGGAGT (SEQ ID NO:12604), GGGGTTTAGGCGAGGTTTTGAGGAGTT (SEQ ID NO:12605), TTGGGGTTTAGGCGAGGTTTTGAGGAG (SEQ ID NO:12606), GCGGAAATGCGGTTTTTATTTTGTCGGTT (SEQ ID NO:12607), GCGGAAATGCGGTTTTTATTTTGTCGGTTT (SEQ ID NO:12608), GCGGAAATGCGGTTTTTATTTTGTCGGTTTT (SEQ ID NO:12609), GCGGAAATGCGGTTTTTATTTTGTCGGTTTTT (SEQ ID NO:12610), GCGGAAATGCGGTTTTTATTTTGTCGGTTTTTCG (SEQ ID NO:12611) |
| Target1337 | chr12:133481384-133481393 | CGGTTTGGGGATGATTTGAGGTCGCGT (SEQ ID NO:12612), TCGGTTTGGGGATGATTTGAGGTCGCG (SEQ ID NO:12613), TCGGTTTGGGGATGATTTGAGGTCGCGT (SEQ ID NO:12614), CGGTTTGGGGATGATTTGAGGTCGCGTT (SEQ ID NO:12615), TTCGGTTTGGGGATGATTTGAGGTCGCG (SEQ ID NO:12616) |
| Target1338 | chr12:133481463-133481558 | GGGCGCGTTTTGTCGGTTATTAGGGGT (SEQ ID NO:12617), TGGGCGCGTTTTGTCGGTTATTAGGGG (SEQ ID NO:12618), TGGGCGCGTTTTGTCGGTTATTAGGGGT (SEQ ID NO:12619), TTGGGCGCGTTTTGTCGGTTATTAGGGG (SEQ ID NO:12620), GGGTTGGGCGCGTTTTGTCGGTTATTA (SEQ ID NO:12621), TGCGTTGTTTTTGGTGGTCGGTAGGGC (SEQ ID NO:12622), GTTTTTGGTGGTCGGTAGGGCGCGTTT (SEQ ID NO:12623), GTTGTTTTTGGTGGTCGGTAGGGCGCG (SEQ ID NO:12624), CGTTGTTTTTGGTGGTCGGTAGGGCGC (SEQ ID NO:12625), GCGTTGTTTTTGGTGGTCGGTAGGGCG (SEQ ID NO:12626) |
| Target1339 | chr12:133481570-133481590 | GGGCGCGTTTTGTCGGTTATTAGGGGT (SEQ ID NO:12627), TGGGCGCGTTTTGTCGGTTATTAGGGG (SEQ ID NO:12628), TGGGCGCGTTTTGTCGGTTATTAGGGGT (SEQ ID NO:12629), TTGGGCGCGTTTTGTCGGTTATTAGGGG (SEQ ID NO:12630), GGGTTGGGCGCGTTTTGTCGGTTATTA (SEQ ID NO:12631) |
| Target1340 | chr13:21520242-21520564 | GGATGGAGAAACGGTGGAGAGACGGGG (SEQ ID NO:12632), GGGATGGAGAAACGGTGGAGAGACGGG (SEQ ID NO:12633), GGGGATGGAGAAACGGTGGAGAGACGG (SEQ ID NO:12634), GGGGGATGGAGAAACGGTGGAGAGACG (SEQ ID NO:12635), TTTCGGGGGGGATGGAGAAACGGTGGAG (SEQ ID NO:12636), CGGGGGCGTATTAGTTTTTTAGGCGTCGGG (SEQ ID NO:12637), TCGTTAATTGCGGGGGATTTCGTTCGT (SEQ ID NO:12638), ATTAGGAGATTTCGGTGCGGCGAGTTC (SEQ ID NO:12639), CGGGGGCGTATTAGTTTTTTAGGCGTCGG (SEQ ID NO:12640), GGGGCGTATTAGTTTTTTAGGCGTCGGG (SEQ ID NO:12641) |
| Target1341 | chr13:25320032-25320080 | TGTAGCGGGCGGTTTGTAGGGTGAGTT (SEQ ID NO:12642), TTGTAGCGGGCGGTTTGTAGGGTGAGT (SEQ ID NO:12643), AGCGGGCGGTTTGTAGGGTGAGTTACG (SEQ ID NO:12644), GTTGTAGCGGGCGGTTTGTAGGGTGAG (SEQ ID NO:12645), CGTTGTAGCGGGCGGTTTGTAGGGTGA (SEQ ID NO:12646), GTAGTTCGTGGTTGCGCGGGAAAGTCG (SEQ ID NO:12647), GTGGCGGTAGTGTAGTTCGTGGTTGCG (SEQ ID NO:12648), CGTGGCGGTAGTGTAGTTCGTGGTTGC (SEQ ID NO:12649), GCGTGGCGGTAGTGTAGTTCGTGGTTG (SEQ ID NO:12650), GTGTAGTTCGTGGTTGCGCGGGAAAGT (SEQ ID NO:12651) |

FIGURE 5 CONTINUED

| Target1342 | chr13:25320106-25320227 | TGTAGCGGGCGGTTTGTAGGGTGAGTT (SEQ ID NO:12652), TTGTAGCGGGCGGTTTGTAGGGTGAGT (SEQ ID NO:12653), AGCGGGCGGTTTGTAGGGTGAGTTACG (SEQ ID NO:12654), GTTGTAGCGGGCGGTTTGTAGGGTGAG (SEQ ID NO:12655), TGTTCGTGGGTTATTTCGGCGCGTAGG (SEQ ID NO:12656), GTTGGAGTTTTTGTCGGCGTGGCGGTA (SEQ ID NO:12657), GTAGTTCGTGGTTGCGCGGGAAAGTCG (SEQ ID NO:12658), GGAGTTTTTGTCGGCGTGGCGGTAGTG (SEQ ID NO:12659), GGCGTAGGAAGGGGAGGTTTCGGGAAG (SEQ ID NO:12660), GCGTAGGAAGGGGAGGTTTCGGGAAGT (SEQ ID NO:12661) |
| Target1343 | chr13:25320247-25320389 | AGGTTTCGGTTCGTAGTTTCGCGCGTT (SEQ ID NO:12662), TAGGTTTCGGTTCGTAGTTTCGCGCGT (SEQ ID NO:12663), GGTTTCGGTTCGTAGTTTCGCGCGTTT (SEQ ID NO:12664), AGGTTTCGGTTCGTAGTTTCGCGCGTTT (SEQ ID NO:12665), AGGTTTCGGTTCGTAGTTTCGCGCGT (SEQ ID NO:12666), GGCGTAGGAAGGGGAGGTTTCGGGAAG (SEQ ID NO:12667), GCGTAGGAAGGGGAGGTTTCGGGAAGT (SEQ ID NO:12668), GGTGGTGGCGTAGGAAGGGGAGGTTTC (SEQ ID NO:12669), GTGGTGGCGTAGGAAGGGGAGGTTTCG (SEQ ID NO:12670), GCGGGTCGGGGTTTGGTTTCGGTTTTC (SEQ ID NO:12671) |
| Target1344 | chr13:25320541-25320560 | GGGTGCGTAGGGAGAATGGGTTGTGGT (SEQ ID NO:12672), GAGGTGTGGGGGTGCGTAGGGAGAATG (SEQ ID NO:12673), TTAGAGAGGTTTGGCGAGGTGTGGGGG (SEQ ID NO:12674), TGCGTAGGGAGAATGGGTTGTGGTCGT (SEQ ID NO:12675), GGGGTGCGTAGGGAGAATGGGTTGTGG (SEQ ID NO:12676), TCGTCGGTTTTTTAAGGAGAACGCGGT (SEQ ID NO:12677), CGTCGGTTTTTTAAGGAGAACGCGGTG (SEQ ID NO:12678), CGTCGGTTTTTTAAGGAGAACGCGGTGA (SEQ ID NO:12679), TCGTCGGTTTTTTAAGGAGAACGCGGTG (SEQ ID NO:12680), TCGTCGGTTTTTTAAGGAGAACGCGGTGA (SEQ ID NO:12681) |
| Target1345 | chr13:25320608-25320617 | TGGTGCGTGTTGGTTTTGTGGAGATGG (SEQ ID NO:12682), TGGTGCGTGTTGGTTTTGTGGAGATGGA (SEQ ID NO:12683), GGTGCGTGTTGGTTTTGTGGAGATGGA (SEQ ID NO:12684), ATGGTGCGTGTTGGTTTTGTGGAGATGG (SEQ ID NO:12685), TGGTGCGTGTTGGTTTTGTGGAGATGGAT (SEQ ID NO:12686), TCGTCGGTTTTTTAAGGAGAACGCGGT (SEQ ID NO:12687), CGTCGGTTTTTTAAGGAGAACGCGGTG (SEQ ID NO:12688), CGTCGGTTTTTTAAGGAGAACGCGGTGA (SEQ ID NO:12689), TCGTCGGTTTTTTAAGGAGAACGCGGTG (SEQ ID NO:12690), TCGTCGGTTTTTTAAGGAGAACGCGGTGA (SEQ ID NO:12691) |
| Target1346 | chr13:25320665-25320698 | CGAAGGTGGTGGGGATTGTCGTGAGGA (SEQ ID NO:12692), TTGGCGAAGGTGGTGGGGATTGTCGTG (SEQ ID NO:12693), GTTGGCGAAGGTGGTGGGGATTGTCGT (SEQ ID NO:12694), GCGAAGGTGGTGGGGATTGTCGTGAGG (SEQ ID NO:12695), GGCGAAGGTGGTGGGGATTGTCGTGAG (SEQ ID NO:12696), GCGGGTGGAGCGTAGTTTTTTGGGAGA (SEQ ID NO:12697), GCGGGTGGAGCGTAGTTTTTTGGGAGAG (SEQ ID NO:12698), CGGGTGGAGCGTAGTTTTTTGGGAGAGT (SEQ ID NO:12699), CGGGTGGAGCGTAGTTTTTTGGGAGAG (SEQ ID NO:12700), GCGGGTGGAGCGTAGTTTTTTGGGAGAGT (SEQ ID NO:12701) |
| Target1347 | chr13:25320780-25320804 | GCGCGGTAGTGGTTTCGAGTTTTGGGT (SEQ ID NO:12702), CGCGCGGTAGTGGTTTCGAGTTTTGGG (SEQ ID NO:12703), GCGCGCGGTAGTGGTTTCGAGTTTTGG (SEQ ID NO:12704), GGCGCGCGGTAGTGGTTTCGAGTTTTG (SEQ ID NO:12705), GCGCGGTAGTGGTTTCGAGTTTTGGGTT (SEQ ID NO:12706), CGTGGTAGGGGCGTTTAGGGGTTTAGGT (SEQ ID NO:12707), CGTGGTAGGGGCGTTTAGGGGTTTAGG (SEQ ID NO:12708), TGAAGAGGTTTAGTGTTGGGACGGGGG (SEQ ID NO:12709), GTGGTAGGGGCGTTTAGGGGTTTAGGT (SEQ ID NO:12710), TGAAGAGGTTTAGTGTTGGGACGGGGGA (SEQ ID NO:12711) |
| Target1348 | chr13:51417461-51417509 | TGGGTTAGGGTGTAGGGTTCGCGGTTT (SEQ ID NO:12712), TTGGGTTAGGGTGTAGGGTTCGCGGTT (SEQ ID NO:12713), TTTGGGTTAGGGTGTAGGGTTCGCGGT (SEQ ID NO:12714), TCGGGGGAAGGGTAGTAATTCGGCGTT (SEQ ID NO:12715), TTCGGGGGAAGGGTAGTAATTCGGCGT (SEQ ID NO:12716), GAGGAGGAGGTAGTGCGAGGCGTTGAG (SEQ ID NO:12717), AGAGGAGGAGGTAGTGCGAGGCGTTGA (SEQ ID NO:12718), GTTGAGGGGGGCGTCGAGTTGTTGTTT (SEQ ID NO:12719), TAGAGGAGGAGGTAGTGCGAGGCGTTG (SEQ ID NO:12720), TGAGGGGGGCGTCGAGTTGTTGTTTTT (SEQ ID NO:12721) |
| Target1349 | chr13:51417538-51417648 | TGGGTTAGGGTGTAGGGTTCGCGGTTT (SEQ ID NO:12722), TTGGGTTAGGGTGTAGGGTTCGCGGTT (SEQ ID NO:12723), TTTGGGTTAGGGTGTAGGGTTCGCGGT (SEQ ID NO:12724), TCGGGGGAAGGGTAGTAATTCGGCGTT (SEQ ID NO:12725), TTCGGGGGAAGGGTAGTAATTCGGCGT (SEQ ID NO:12726), TAGGAGTGGGGTTGGGGGGACGGTTTA (SEQ ID NO:12727), TGTAGTAGGAGTGGGGTTGGGGGGACG (SEQ ID NO:12728), TGTTGTAGTAGGAGTGGGGTTGGGGGG (SEQ ID NO:12729), GTAGTAGGAGTGGGGTTGGGGGGACGG (SEQ ID NO:12730), TGTTGTAGTAGGAGTGGGGTTGGGGGGA (SEQ ID NO:12731) |
| Target1350 | chr13:51417661-51417687 | CGTGGTTTGGGTTTCGCGGGTTTTCG (SEQ ID NO:12732), GCGGGTTTTCGGGGGCGATTGGATC (SEQ ID NO:12733), GCGGGTTTTCGGGGGCGATTGGAT (SEQ ID NO:12734), GGTTTGAGCGACGGGTTGGAGCGG (SEQ ID NO:12735), GGGTTTGAGCGACGGGTTGGAGCG (SEQ ID NO:12736), TAGGAGTGGGGTTGGGGGGACGGTTTA (SEQ ID NO:12737), TGTAGTAGGAGTGGGGTTGGGGGGACG (SEQ ID NO:12738), TGTTGTAGTAGGAGTGGGGTTGGGGGG (SEQ ID NO:12739), GTAGTAGGAGTGGGGTTGGGGGGACGG (SEQ ID NO:12740), TGTTGTAGTAGGAGTGGGGTTGGGGGGA (SEQ ID NO:12741) |
| Target1351 | chr13:51417768-51417796 | CGTGGTTTGGGTTTCGCGGGTTTTCGG (SEQ ID NO:12742), CGTGGTTTGGGTTTCGCGGGTTTTCG (SEQ ID NO:12743), GTGGTTTGGGTTTCGCGGGTTTTCGG (SEQ ID NO:12744), GCGGGTTTTCGGGGGCGATTGGATC (SEQ ID NO:12745), GCGGGTTTTCGGGGGCGATTGGAT (SEQ ID |

FIGURE 5 CONTINUED

NO:12746), GAGCGCGTCGGGTCGTTAGC (SEQ ID NO:12747),
TCGATTATATACGTTGTGAGATTTAGAGGTCGAGGA (SEQ ID NO:12748),
GTCGATTATATACGTTGTGAGATTTAGAGGTCGAGG (SEQ ID NO:12749),
GGTCGATTATATACGTTGTGAGATTTAGAGGTCGAG (SEQ ID NO:12750)

| Target1352 | chr13:51417803-51417813 | TGGAGGTTATTAAGGGCGTAGGGTTGGT (SEQ ID NO:12751), GGAGGTTATTAAGGGCGTAGGGTTGGT (SEQ ID NO:12752), TGGAGGTTATTAAGGGCGTAGGGTTGG (SEQ ID NO:12753), TGGTGGTTGATGGAGGTTATTAAGGGCGT (SEQ ID NO:12754), GGTGGTTGATGGAGGTTATTAAGGGCGT (SEQ ID NO:12755), TTTAGAGTCGGGGGCGGGGTC (SEQ ID NO:12756), GGGGTCGATTATATACGTTGTGAGATTTAGAGGTCG (SEQ ID NO:12757), GGGTCGATTATATACGTTGTGAGATTTAGAGGTCG (SEQ ID NO:12758), GGGGTCGATTATATACGTTGTGAGATTTAGAGGTC (SEQ ID NO:12759), GGGTCGATTATATACGTTGTGAGATTTAGAGGTCGA (SEQ ID NO:12760) |
| Target1353 | chr13:51417831-51417847 | GCGTGTAGGTGGAGTAGTAGCGAGGGA (SEQ ID NO:12761), TGTAGGTGGAGTAGTAGCGAGGGAGGC (SEQ ID NO:12762), GCGTGTAGGTGGAGTAGTAGCGAGGGAG (SEQ ID NO:12763), GTGTAGGTGGAGTAGTAGCGAGGGAGGC (SEQ ID NO:12764), CGTGTAGGTGGAGTAGTAGCGAGGGAGG (SEQ ID NO:12765), AGGCGAAGGTAGAGGTTAGTACGGGTT (SEQ ID NO:12766), TAGGCGAAGGTAGAGGTTAGTACGGGT (SEQ ID NO:12767), AGGCGAAGGTAGAGGTTAGTACGGGT (SEQ ID NO:12768), AGGCGAAGGTAGAGGTTAGTACGGGTTA (SEQ ID NO:12769), TAGGCGAAGGTAGAGGTTAGTACGGGTT (SEQ ID NO:12770) |
| Target1354 | chr13:51417855-51417881 | CGGGGGCGTTGGGGTCGTTAAGGTTAT (SEQ ID NO:12771), CGGGGGCGTTGGGGTCGTTAAGGTTATA (SEQ ID NO:12772), GCGTGTAGGTGGAGTAGTAGCGAGGGA (SEQ ID NO:12773), CGGGGGCGTTGGGGTCGTTAAGGTTA (SEQ ID NO:12774), TGTAGGTGGAGTAGTAGCGAGGGAGGC (SEQ ID NO:12775), AGGCGAAGGTAGAGGTTAGTACGGGTT (SEQ ID NO:12776), TAGGCGAAGGTAGAGGTTAGTACGGGT (SEQ ID NO:12777), AGGCGAAGGTAGAGGTTAGTACGGGT (SEQ ID NO:12778), AGGCGAAGGTAGAGGTTAGTACGGGTTA (SEQ ID NO:12779), TAGGCGAAGGTAGAGGTTAGTACGGGTT (SEQ ID NO:12780) |
| Target1355 | chr13:53313143-53313336 | TAGTCGCGCGGGGTTGGAGGGTTTTAT (SEQ ID NO:12781), GGGGGAGTTTACGTTGGGTTCGAGGGGT (SEQ ID NO:12782), AGGGGAGTTTACGTTGGGTTCGAGGGG (SEQ ID NO:12783), GTAGTCGCGCGGGGTTGGAGGGTTTTA (SEQ ID NO:12784), TTTTGAGTAGTCGCGCGGGGTTGGAGG (SEQ ID NO:12785), GCGCGGTTGTTTAAGGTGGGAGTCGTG (SEQ ID NO:12786), GTTGGGGGTCGTAGGTGTTGGCGGTAT (SEQ ID NO:12787), CGCGGTTGTTTAAGGTGGGAGTCGTGG (SEQ ID NO:12788), TTTTTGGGGGTTATCGCGTGGGGTTCG (SEQ ID NO:12789), GGGGTATTCGTAGGAGTTCGGGCGAGT (SEQ ID NO:12790) |
| Target1356 | chr13:53313337-53313459 | TAGTCGCGCGGGGTTGGAGGGTTTTAT (SEQ ID NO:12791), AGTTTTTAGGGAGTGGGGAGTCGGGCG (SEQ ID NO:12792), AGTGGGGAGTCGGGCGGGAAATAGTTC (SEQ ID NO:12793), GAGTGGGGAGTCGGGCGGGAAATAGTT (SEQ ID NO:12794), GTAGTCGCGCGGGGTTGGAGGGTTTTA (SEQ ID NO:12795), GTTGGGGGTCGTAGGTGTTGGCGGTAT (SEQ ID NO:12796), CGGTAGAGGGTGTAGGTTTTGGGGCGA (SEQ ID NO:12797), TCGGTAGAGGGTGTAGGTTTTGGGGCG (SEQ ID NO:12798), GGCGAAGGTTTTGTGTTGCGGGGTTTG (SEQ ID NO:12799), TTTTTGGGGGTTATCGCGTGGGGTTCG (SEQ ID NO:12800) |
| Target1357 | chr13:53313529-53313622 | GTAGTCGGGCGTGGAAGTGGGATGAGT (SEQ ID NO:12801), TGTAGTCGGGCGTGGAAGTGGGATGAG (SEQ ID NO:12802), TTGTAGTCGGGCGTGGAAGTGGGATGA (SEQ ID NO:12803), AGTCGGGCGTGGAAGTGGGATGAGTAA (SEQ ID NO:12804), CGAGGGTTTTTTGTAGTCGGGCGTGGA (SEQ ID NO:12805), GTTATCGAATGGGTGTGTTGGCGGGGG (SEQ ID NO:12806), CGAATGGGTGTGTTGGCGGGGGGATAA (SEQ ID NO:12807), TTATCGAATGGGTGTGTTGGCGGGGGG (SEQ ID NO:12808), TGTTATCGAATGGGTGTGTTGGCGGGG (SEQ ID NO:12809), GAATGGGTGTGTTGGCGGGGGGATAAA (SEQ ID NO:12810) |
| Target1358 | chr13:53421357-53421510 | GAAGGGTGAGGTTGTCGGCGCGTTTG (SEQ ID NO:12811), GAAGGGTGAGGTTGTCGGCGCGTTTGG (SEQ ID NO:12812), GAAGGGTGAGGTTGTCGGCGCGTTT (SEQ ID NO:12813), CGAAGGGTGAGGTTGTCGGCGCGTTTG (SEQ ID NO:12814), GTAGCGGCGAAGGGTGAGGTTGTCGG (SEQ ID NO:12815), GTCGTTGTATTCGGGGGAGCGGACGTT (SEQ ID NO:12816), TCGTTGTATTCGGGGGAGCGGACGTTA (SEQ ID NO:12817), GTCGTCGTTGTATTCGGGGGAGCGGAC (SEQ ID NO:12818), CGTTGTATTCGGGGGAGCGGACGTTAG (SEQ ID NO:12819), CGTTGTATTCGGGGGAGCGGACGTTAGT (SEQ ID NO:12820) |
| Target1359 | chr13:53421578-53421587 | TGATTTTGTAGGTGGTAGCGCGGGGTT (SEQ ID NO:12821), GAAGGGTGAGGTTGTCGGCGCGTTTG (SEQ ID NO:12822), CGATGATTTTGTAGGTGGTAGCGCGGGG (SEQ ID NO:12823), ATGATTTTGTAGGTGGTAGCGCGGGGT (SEQ ID NO:12824), GAAGGGTGAGGTTGTCGGCGCGTTTGG (SEQ ID NO:12825) |
| Target1360 | chr13:53421602-53421670 | GGGTTCGGTTAGGGTGAGGCGGTTTGA (SEQ ID NO:12826), CGGGTTCGGTTAGGGTGAGGCGGTTTG (SEQ ID NO:12827), GGTTCGGTTAGGGTGAGGCGGTTTGAT (SEQ ID NO:12828), TTCGGTTAGGGTGAGGCGGTTTGATCG (SEQ ID NO:12829), GGGTTCGGTTAGGGTGAGGCGGTTTGAT (SEQ ID NO:12830), CGTGGTGTTCGTATTTGGCGTTCGTAT (SEQ ID NO:12831), CGTGGTGTTCGTATTTGGCGTTCGTATT (SEQ ID NO:12832), CGTGGTGTTCGTATTTGGCGTTCGTA (SEQ ID NO:12833), CGTGGTGTTCGTATTTGGCGTTCGTATTT (SEQ ID NO:12834), CGTGGTGTTCGTATTTGGCGTTCGT (SEQ ID NO:12835) |

FIGURE 5 CONTINUED

| Target1361 | chr13:53421688-53421694 | GGGTTCGGTTAGGGTGAGGCGGTTTGA (SEQ ID NO:12836), CGGGTTCGGTTAGGGTGAGGCGGTTTG (SEQ ID NO:12837), GGTTCGGTTAGGGTGAGGCGGTTTGAT (SEQ ID NO:12838), TTCGGTTAGGGTGAGGCGGTTTGATCG (SEQ ID NO:12839), GGGTTCGGTTAGGGTGAGGCGGTTTGAT (SEQ ID NO:12840), CGTGGTGTTCGTATTTGGCGTTCGTAT (SEQ ID NO:12841), CGCGTTCGTGGGTTTTTTGTTTTTCGA (SEQ ID NO:12842), CGTGGTGTTCGTATTTGGCGTTCGTATT (SEQ ID NO:12843), CGCGTTCGTGGGTTTTTTGTTTTTCGAT (SEQ ID NO:12844), CGTGGTGTTCGTATTTGGCGTTCGTA (SEQ ID NO:12845) |
| Target1362 | chr13:53421731-53421738 | CGGGGTGCGGGCGTTAAATGCGAATAT (SEQ ID NO:12846), GGGTTCGGTTAGGGTGAGGCGGTTTGA (SEQ ID NO:12847), CGGGGTGCGGGCGTTAAATGCGAATA (SEQ ID NO:12848), CGGGGTGCGGGCGTTAAATGCGAATATT (SEQ ID NO:12849), CGGGTTCGGTTAGGGTGAGGCGGTTTG (SEQ ID NO:12850), GTGGTCGAAGTGGAGTTGGCGGAAGA (SEQ ID NO:12851), CGCGTTCGTGGGTTTTTTGTTTTTCGA (SEQ ID NO:12852), TGGTCGAAGTGGAGTTGGCGGAAGA (SEQ ID NO:12853), GTGGTCGAAGTGGAGTTGGCGGAAG (SEQ ID NO:12854), CGCGTTCGTGGGTTTTTTGTTTTTCGAT (SEQ ID NO:12855) |
| Target1363 | chr13:100608123-100608186 | GTCGGGGTAAGGACGTAGGGGC (SEQ ID NO:12856), GCGTTTTTTATGTTGGAAGGATTTTTAGTTTGGAGC (SEQ ID NO:12857), CGTTTTTTATGTTGGAAGGATTTTTAGTTTGGAGCG (SEQ ID NO:12858), TTTTATGTTGGAAGGATTTTTAGTTTGGAGCGGAAA (SEQ ID NO:12859), TTTTTATGTTGGAAGGATTTTTAGTTTGGAGCGGAA (SEQ ID NO:12860), GCGGTTAGTCGGGTTAGAAACGTGGGC (SEQ ID NO:12861), TGCGGTTAGTCGGGTTAGAAACGTGGG (SEQ ID NO:12862), TGCGGTTAGTCGGGTTAGAAACGTGGGC (SEQ ID NO:12863), TTGCGGTTAGTCGGGTTAGAAACGTGGG (SEQ ID NO:12864), TTGCGGTTAGTCGGGTTAGAAACGTGGGC (SEQ ID NO:12865) |
| Target1364 | chr13:100608216-100608228 | GTCGGGGTAAGGACGTAGGGGC (SEQ ID NO:12866), ACGTTTTTGGTTCGGTTAGTCGTAATTTTTTGGA (SEQ ID NO:12867), ACGTTTTTGGTTCGGTTAGTCGTAATTTTTTGGAT (SEQ ID NO:12868), TGGTTCGGTTAGTCGTAATTTTTTGGATGTAAACG (SEQ ID NO:12869), CGTTTTTGGTTCGGTTAGTCGTAATTTTTTGGATG (SEQ ID NO:12870), AGGAGCGGGGAGTTGTTGAAAGTCGGG (SEQ ID NO:12871), GGAGCGGGGAGTTGTTGAAAGTCGGGT (SEQ ID NO:12872), GAGGAGCGGGGAGTTGTTGAAAGTCGG (SEQ ID NO:12873), GAGCGGGGAGTTGTTGAAAGTCGGGTT (SEQ ID NO:12874), GGAGCGGGGAGTTGTTGAAAGTCGGG (SEQ ID NO:12875) |
| Target1365 | chr13:100608251-100608317 | CGTTGCGGCGTGTGGGGAAAGATGATT (SEQ ID NO:12876), CGTTGCGGCGTGTGGGGAAAGATGAT (SEQ ID NO:12877), CGTTGCGGCGTGTGGGGAAAGATGATTA (SEQ ID NO:12878), GCGTTGCGGCGTGTGGGGAAAGATGAT (SEQ ID NO:12879), CGTTGCGGCGTGTGGGGAAAGATGA (SEQ ID NO:12880), AGGAGCGGGGAGTTGTTGAAAGTCGGG (SEQ ID NO:12881), TGGGGGGGTTGTAGTTTCGGGCGTAGTT (SEQ ID NO:12882), TTGGGGGGTTGTAGTTTCGGGCGTAGT (SEQ ID NO:12883), GGAGCGGGGAGTTGTTGAAAGTCGGGT (SEQ ID NO:12884), GAGGAGCGGGGAGTTGTTGAAAGTCGG (SEQ ID NO:12885) |
| Target1366 | chr13:100608341-100608371 | CGTTGCGGCGTGTGGGGAAAGATGATT (SEQ ID NO:12886), CGTTGCGGCGTGTGGGGAAAGATGAT (SEQ ID NO:12887), CGTTGCGGCGTGTGGGGAAAGATGATTA (SEQ ID NO:12888), GCGTTGCGGCGTGTGGGGAAAGATGAT (SEQ ID NO:12889), CGTTGCGGCGTGTGGGGAAAGATGA (SEQ ID NO:12890), CGTGCGCGGAGGTAGTTTTTTGGGTGT (SEQ ID NO:12891), AGAGGGGAGTGGGAGTAGGAGGTGTCG (SEQ ID NO:12892), CGGAGAGGGGAGTGGGAGTAGGAGGTG (SEQ ID NO:12893), AGTGGGAGTAGGAGGTGTCGGTTTGGC (SEQ ID NO:12894), TGGGGGGGTTGTAGTTTCGGGCGTAGTT (SEQ ID NO:12895) |
| Target1367 | chr13:100608449-100608462 | TCGTAGTGGAGTTGCGTTCGGGGTTGT (SEQ ID NO:12896), TGTGGGTCGTAGTGGAGTTGCGTTCGG (SEQ ID NO:12897), GGTCGTAGTGGAGTTGCGTTCGGGGTT (SEQ ID NO:12898), GTCGTAGTGGAGTTGCGTTCGGGGTTG (SEQ ID NO:12899), GTGGGTCGTAGTGGAGTTGCGTTCGGG (SEQ ID NO:12900), GGAGTAGGAGGTGTCGGTTTGGCGTGT (SEQ ID NO:12901), TTGTTTACGGTTGGGCGAGAGGGGAG (SEQ ID NO:12902), AGAGGGGAGTGGGAGTAGGAGGTGTCG (SEQ ID NO:12903), CGGAGAGGGGAGTGGGAGTAGGAGGTG (SEQ ID NO:12904), GTTGTTTACGGTTGGGCGGAGAGGGGA (SEQ ID NO:12905) |
| Target1368 | chr13:100641337-100641413 | TGCGTTGCGGGTAGTTGTTCGTAGGGA (SEQ ID NO:12906), GCGTTGCGTTGCGGGTAGTTGTTCGTA (SEQ ID NO:12907), GCGTTGCGGGTAGTTGTTCGTAGGGAG (SEQ ID NO:12908), TTGCGTTGCGGGTAGTTGTTCGTAGGG (SEQ ID NO:12909), CGTTGCGTTGCGGGTAGTTGTTCGTAGG (SEQ ID NO:12910), TGGATGGAGGTGAGCGCGAAGGAAGTC (SEQ ID NO:12911), GTGGATGGAGGTGAGCGCGAAGGAAGT (SEQ ID NO:12912), TTTAGGTGGTGGATGGAGGTGAGCGCG (SEQ ID NO:12913), GGTGGATGGAGGTGAGCGCGAAGGAAG (SEQ ID NO:12914), TAGGTGGTGGATGGAGGTGAGCGCGAA (SEQ ID NO:12915) |
| Target1369 | chr13:100641490-100641497 | TGTCGCGGTTGGAGTACGGTTTTTGTT (SEQ ID NO:12916), TTGTCGCGGTTGGAGTACGGTTTTTGT (SEQ ID NO:12917), TTGTCGCGGTTGGAGTACGGTTTTTGTT (SEQ ID NO:12918), TTTGTCGCGGTTGGAGTACGGTTTTTGT (SEQ ID NO:12919), TTTGTCGCGGTTGGAGTACGGTTTTTG (SEQ ID NO:12920), TGACGGGTTTTTCGAGGGGGTTTTAGT (SEQ ID NO:12921), ACGGGTTTTTCGAGGGGGTTTTAGTGT (SEQ ID NO:12922), TGACGGGTTTTTCGAGGGGGTTTTAGTT (SEQ ID NO:12923), ATGACGGGTTTTTCGAGGGGGTTTTAGT (SEQ ID NO:12924), GACGGGTTTTTCGAGGGGGTTTTAGTGT (SEQ ID NO:12925) |

FIGURE 5 CONTINUED

Target1370    chr13:100641499-100641606    TGTCGCGGTTGGAGTACGGTTTTTGTT (SEQ ID NO:12926), TTGTCGCGGTTGGAGTACGGTTTTTGT (SEQ ID NO:12927), TTGTCGCGGTTGGAGTACGGTTTTTGTT (SEQ ID NO:12928), TGTCGCGGTTGGAGTACGGTTTTTGT (SEQ ID NO:12929), CGCGGTTGGAGTACGGTTTTTGTTAGTCG (SEQ ID NO:12930), TGACGGGTTTTTCGAGGGGGTTTTAGT (SEQ ID NO:12931), TCGACGCGGTTTTTGATTTTGGAGTGA (SEQ ID NO:12932), ACGGGTTTTTCGAGGGGGTTTTAGTTGT (SEQ ID NO:12933), TGACGGGTTTTTCGAGGGGGTTTTAGTT (SEQ ID NO:12934), ATGACGGGTTTTTCGAGGGGGTTTTAGT (SEQ ID NO:12935)

Target1371    chr13:100641681-100641743    CGCGTCGGTTTTTGTTTGGGGTATGGGT (SEQ ID NO:12936), TCGCGTCGGTTTTTGTTTGGGGTATGGG (SEQ ID NO:12937), AGAGGTCGCGTCGGTTTTGTTTGGGGT (SEQ ID NO:12938), GAGGTCGCGTCGGTTTTGTTTGGGGTA (SEQ ID NO:12939), TAGAGGTCGCGTCGGTTTTGTTTGGGG (SEQ ID NO:12940), TAGGGGGTGGGGAAGAGGAAGAGCGAA (SEQ ID NO:12941), TTAGGGGGTGGGGAAGAGGAAGAGCGA (SEQ ID NO:12942), GTTAGGTATGGGCGTGCGGGTTTTGGG (SEQ ID NO:12943), TTAGGTATGGGCGTGCGGGTTTTGGGA (SEQ ID NO:12944), GTTAGGGGGTGGGGAAGAGGAAGAGCG (SEQ ID NO:12945)

Target1372    chr13:100649601-100649626    ATTTTCGCGCGGATGGTTTAGGAGGCG (SEQ ID NO:12946), TTTTCGCGCGGATGGTTTAGGAGGGGC (SEQ ID NO:12947), GATTTTCGCGCGGATGGTTTAGGAGGGG (SEQ ID NO:12948), TTTTCGCGCGGATGGTTTAGGAGGGG (SEQ ID NO:12949), AGGGGAGTATTAGAGGGTCGCGCGAGGTT (SEQ ID NO:12950), CGGTGGGGATCGCGTCGGTATAGGATA (SEQ ID NO:12951), CGTCGGTATAGGATAACGCGGTGGAGGG (SEQ ID NO:12952), CGGTGGGGATCGCGTCGGTATAGGAT (SEQ ID NO:12953), GCGGTGGGGATCGCGTCGGTATAGGAT (SEQ ID NO:12954), TCGGTATAGGATAACGCGGTGGAGGGA (SEQ ID NO:12955)

Target1373    chr13:100649671-100649702    GAGTTAAGGTGGGCGGGGGTAGGTGTT (SEQ ID NO:12956), TTGAGTTAAGGTGGGCGGGGGTAGGTG (SEQ ID NO:12957), AGTTAAGGTGGGCGGGGGTAGGTGTTT (SEQ ID NO:12958), TGAGTTAAGGTGGGCGGGGGTAGGTGT (SEQ ID NO:12959), ATTTTCGCGCGGATGGTTTAGGAGGGG (SEQ ID NO:12960), GGATTCGGTGGGAGGAAGGAGTGCGAA (SEQ ID NO:12961), GGGAATCGTGAAGTCGGGTTTGCGGAT (SEQ ID NO:12962), CGGGAATCGTGAAGTCGGGTTTGCGGA (SEQ ID NO:12963), CGGTGGGGATCGCGTCGGTATAGGATA (SEQ ID NO:12964), CGGGAATCGTGAAGTCGGGTTTGCGG (SEQ ID NO:12965)

Target1374    chr13:100649715-100649726    GAGTTAAGGTGGGCGGGGGTAGGTGTT (SEQ ID NO:12966), TTGAGTTAAGGTGGGCGGGGGTAGGTG (SEQ ID NO:12967), AGTTAAGGTGGGCGGGGGTAGGTGTTT (SEQ ID NO:12968), TGAGTTAAGGTGGGCGGGGGTAGGTGT (SEQ ID NO:12969), ATTTTCGCGCGGATGGTTTAGGAGGGG (SEQ ID NO:12970), GGATTCGGTGGGAGGAAGGAGTGCGAA (SEQ ID NO:12971), GGGAATCGTGAAGTCGGGTTTGCGGAT (SEQ ID NO:12972), CGGGAATCGTGAAGTCGGGTTTGCGGA (SEQ ID NO:12973), CGGGAATCGTGAAGTCGGGTTTGCGG (SEQ ID NO:12974), GGATTCGGTGGGAGGAAGGAGTGCGA (SEQ ID NO:12975)

Target1375    chr13:100649777-100649801    TATGTCGGCGCGGTTTTTATCGTTCGA (SEQ ID NO:12976), ATGTCGGCGCGGTTTTTATCGTTCGA (SEQ ID NO:12977), TTATGTCGGCGCGGTTTTTATCGTTCG (SEQ ID NO:12978), TTATGTCGGCGCGGTTTTTATCGTTCGA (SEQ ID NO:12979), TCGGCGCGGTTTTTATCGTTCGATTTA (SEQ ID NO:12980), TGTGGTTTTGCGGGAGTGAGTTGAGGG (SEQ ID NO:12981), TGTGGTTTTGCGGGAGTGAGTTGAGGGA (SEQ ID NO:12982), GTGGTTTTGCGGGAGTGAGTTGAGGGA (SEQ ID NO:12983), TGGTTTTGCGGGAGTGAGTTGAGGGAGT (SEQ ID NO:12984), GGTTTTGCGGGAGTGAGTTGAGGGAGT (SEQ ID NO:12985)

Target1376    chr13:100649912-100649918    TTTTCGGGTTTTCGGGTATGTGAGGGA (SEQ ID NO:12986), TCGGGTTTTCGGGTATGTGAGGGATTT (SEQ ID NO:12987), TTCGGGTTTTCGGGTATGTGAGGGATT (SEQ ID NO:12988), TTTCGGGTTTTCGGGTATGTGAGGGAT (SEQ ID NO:12989), CGGGTTTTCGGGTATGTGAGGGATTTG (SEQ ID NO:12990), GTCGATCGATGTGGGGAAGGGGAAGGG (SEQ ID NO:12991), GGTCGATCGATGTGGGGAAGGGGAAGG (SEQ ID NO:12992), CGGTCGATCGATGTGGGGAAGGGGAAG (SEQ ID NO:12993), ATCGATGTGGGGAAGGGGAAGGGGTTC (SEQ ID NO:12994), GATCGATGTGGGGAAGGGGAAGGGGTT (SEQ ID NO:12995)

Target1377    chr13:100649941-100649966    CGGTCGGTCGAGGGAGTTTAGAGTCG (SEQ ID NO:12996), GGTCGGTCGAGGGAGTTTAGAGTCG (SEQ ID NO:12997), CGGTCGGTCGAGGGAGTTTAGAGTC (SEQ ID NO:12998), GTGGGAAGTCGACGATGTTTGAGGCG (SEQ ID NO:12999), TGGGAAGTCGACGATGTTTGAGGCG (SEQ ID NO:13000), GTGGGAAGTCGACGATGTTTGAGGC (SEQ ID NO:13001), CGATGTTTGAGGCGTTTTGTTTTCGGTTT (SEQ ID NO:13002), TCGTAGGAAAGGATTAGGAGAGGTCGTTGT (SEQ ID NO:13003)

Target1378    chr13:109148125-109148632    TCGGGAGGGTGTTTCGGGTCGGATTTG (SEQ ID NO:13004), GTCGGGAGGGTGTTTCGGGTCGGATTT (SEQ ID NO:13005), GGGCGTGGAGAGGAGGTTTGTCGGTTT (SEQ ID NO:13006), GGGTCGGATTTGCGGCGTTGGGTTTTT (SEQ ID NO:13007), GGCGTGGAGAGGAGGTTTGTCGGTTTT (SEQ ID NO:13008), GCGGGTGAGAGGGGTCGGTAGTTGTTT (SEQ ID NO:13009), GCGTTTGGGAGCGGTTGTGTAGGTGAT (SEQ ID NO:13010), TCGTGCGGGAATTTTGGGTGGGGATTT (SEQ ID NO:13011), ATCGTGCGGGAATTTTGGGTGGGGATT (SEQ ID NO:13012), GCGGGTGAGAGGGGTCGGTAGTTGTT (SEQ ID NO:13013)

Target1379    chr13:111178104-111178204    GGGGGGACGAGTTTTTAGGAAGTAGTTGTGG (SEQ ID NO:13014), AGAGTTTTTAGTAGGGAGGGTCGAGTCGA (SEQ ID NO:13015), AGGTGAGAGTTTTTAGTAGGGAGGGTCGA (SEQ ID NO:13016), GGGGGGACGAGTTTTTAGGAAGTAGTTGTGGG (SEQ ID NO:13017),

FIGURE 5 CONTINUED

| | | |
|---|---|---|
| | | GGGGGGACGAGTTTTTAGGAAGTAGTTGTGG (SEQ ID NO:13018), TCGAGAGGTAGGTGGGGGTTAAGGTGT (SEQ ID NO:13019), TTCGAGAGGTAGGTGGGGGTTAAGGTGT (SEQ ID NO:13020), TTGAGAGGTAGGTGGGGGTTAAGGTG (SEQ ID NO:13021), CGAGAGGTAGGTGGGGGTTAAGGTGTA (SEQ ID NO:13022), TTTCGAGAGGTAGGTGGGGGTTAAGGT (SEQ ID NO:13023) |
| Target1380 | chr13:111178351-111178399 | TGGTAGGAAGGGGTTTTATAGACGTTTTTGGT (SEQ ID NO:13024), TGGTAGGAAGGGGTTTTATAGACGTTTTTGGTG (SEQ ID NO:13025), GGTAGGAAGGGGTTTTATAGACGTTTTTGGTGA (SEQ ID NO:13026), AGGAAGGGGTTTTATAGACGTTTTTGGTGATGT (SEQ ID NO:13027), TGGTAGGAAGGGGTTTTATAGACGTTTTTGGTGA (SEQ ID NO:13028), AGGGAGGAGGGGATGAGTTGGTTTGTA (SEQ ID NO:13029), TAGGGAGGAGGGGATGAGTTGGTTTGT (SEQ ID NO:13030), GGGGAGGAGGGGATGAGTTGGTTTGTAGT (SEQ ID NO:13031), GGGAGGAGGGGATGAGTTGGTTTGTAG (SEQ ID NO:13032), AGGGAGGAGGGGATGAGTTGGTTTGTAGT (SEQ ID NO:13033) |
| Target1381 | chr13:112547564-112547607 | GCGTTTCGTGTGATTTCGTGTCGTTGT (SEQ ID NO:13034), GCGTTTCGTGTGATTTCGTGTCGTTGTT (SEQ ID NO:13035), GCGTTTCGTGTGATTTCGTGTCGTTGTTT (SEQ ID NO:13036), GCGTTTCGTGTGATTTCGTGTCGTTG (SEQ ID NO:13037), TCGCGTTTTTGTTGTTTGGGAGAAAGC (SEQ ID NO:13038), GAGAAACGGATATTTTTGGTTGTTACGAGGGTC (SEQ ID NO:13039) |
| Target1382 | chr13:112547626-112547671 | GCGTTTCGTGTGATTTCGTGTCGTTGT (SEQ ID NO:13040), GCGTTTCGTGTGATTTCGTGTCGTTGTT (SEQ ID NO:13041), CGCGTTCGGGAGGGGATTATATTTTTGCG (SEQ ID NO:13042), CGCGTTCGGGAGGGGATTATATTTTTGCGT (SEQ ID NO:13043), GCGTTCGGGAGGGGATTATATTTTTGCGT (SEQ ID NO:13044), CGATGGGATAGGTTGTGTTGCGTTTCG (SEQ ID NO:13045), TGGGATAGGTTGTGTTGCGTTTCGAGA (SEQ ID NO:13046), CGATGGGATAGGTTGTGTTGCGTTTCGA (SEQ ID NO:13047), TCGATGGGATAGGTTGTGTTGCGTTTCG (SEQ ID NO:13048), TCGATGGGATAGGTTGTGTTGCGTTTCGA (SEQ ID NO:13049) |
| Target1383 | chr13:112547730-112547774 | TGCGTTGTTGGCGGAAGTGATTTGTTT (SEQ ID NO:13050), CGCGTTCGGGAGGGGATTATATTTTTGCG (SEQ ID NO:13051), CGCGTTCGGGAGGGGATTATATTTTTGCGT (SEQ ID NO:13052), TGCGTTGTTGGCGGAAGTGATTTGTTTT (SEQ ID NO:13053), GCGTTGTTGGCGGAAGTGATTTGTTTT (SEQ ID NO:13054), AGGTTTTTGGTTTGTTTGTTTTTCGTTACGGGA (SEQ ID NO:13055), GGTTTTTGGTTTGTTTGTTTTTCGTTACGGGA (SEQ ID NO:13056), AGGTTTTTGGTTTGTTTGTTTTTCGTTACGGGA (SEQ ID NO:13057), GGTTTTTGGTTTGTTTGTTTTTCGTTACGGGAG (SEQ ID NO:13058), GAGGTTTTTGGTTTGTTTGTTTTTCGTTACGGG (SEQ ID NO:13059) |
| Target1384 | chr13:112717140-112717159 | AGTTCGGGTTAGGGCGTAGATGATGGA (SEQ ID NO:13060), GTTCGGGTTAGGGCGTAGATGATGGAT (SEQ ID NO:13061), AGTTCGGGTTAGGGCGTAGATGATGGAT (SEQ ID NO:13062), TAGTTCGGGTTAGGGCGTAGATGATGGA (SEQ ID NO:13063), GTTCGGGTTAGGGCGTAGATGATGGATT (SEQ ID NO:13064), AGGTTTTGTTCGAGGGTTTGGAGCGCG (SEQ ID NO:13065), GGTTTTGTTCGAGGGTTTGGAGCGCGC (SEQ ID NO:13066), GAGGTTTTGTTCGAGGGTTTGGAGCGCG (SEQ ID NO:13067), GAGGTTTTGTTCGAGGGTTTGGAGCGC (SEQ ID NO:13068), GTTTTGTTCGAGGGTTTGGAGCGCGC (SEQ ID NO:13069) |
| Target1385 | chr13:112717207-112717256 | GGAGAGTTTCGGTGTTTTCGCGAGGGC (SEQ ID NO:13070), GCGGAGAGTTTCGGTGTTTTCGCGAGG (SEQ ID NO:13071), TTGGTTGTTAGAGCGAGTGAGGGGCGT (SEQ ID NO:13072), CGGAGAGTTTCGGTGTTTTCGCGAGGG (SEQ ID NO:13073), TGGTTGTTAGAGCGAGTGAGGGGCGTA (SEQ ID NO:13074), CGCGCGGAGTTATGAGGGGTAAAGAGGT (SEQ ID NO:13075), CGCGCGGAGTTATGAGGGGTAAAGAGG (SEQ ID NO:13076), TCGCGCGGAGTTATGAGGGGTAAAGAGG (SEQ ID NO:13078), GCGCGCGGAGTTATGAGGGGTAAAGAGG (SEQ ID NO:13077), TCGCGCGGAGTTATGAGGGGTAAAGAG (SEQ ID NO:13079) |
| Target1386 | chr13:112717281-112717303 | GGAGAGTTTCGGTGTTTTCGCGAGGGC (SEQ ID NO:13080), GCGGAGAGTTTCGGTGTTTTCGCGAGG (SEQ ID NO:13081), TTGGTTGTTAGAGCGAGTGAGGGGCGT (SEQ ID NO:13082), CGGAGAGTTTCGGTGTTTTCGCGAGGG (SEQ ID NO:13083), TGGTTGTTAGAGCGAGTGAGGGGCGTA (SEQ ID NO:13084), GGCGGGGCGGAGAAGGTTCGGTTTTTT (SEQ ID NO:13085), CGCGCGGAGTTATGAGGGGTAAAGAGGT (SEQ ID NO:13086), CGCGCGGAGTTATGAGGGGTAAAGAGG (SEQ ID NO:13087), TCGCGCGGAGTTATGAGGGGTAAAGAGG (SEQ ID NO:13088), GGGCGGGGCGGAGAAGGTTCGGTTTTTT (SEQ ID NO:13089) |
| Target1387 | chr13:112717310-112717324 | GGAGAGTTTCGGTGTTTTCGCGAGGGC (SEQ ID NO:13090), GCGGAGAGTTTCGGTGTTTTCGCGAGG (SEQ ID NO:13091), CGGAGAGTTTCGGTGTTTTCGCGAGGG (SEQ ID NO:13092), TGTTAGAGCGAGTGAGGGGCGTAGAGG (SEQ ID NO:13093), TTGTTAGAGCGAGTGAGGGGCGTAGAGG (SEQ ID NO:13094), GGCGGGGCGGAGAAGGTTCGGTTTTTT (SEQ ID NO:13095), CGCGCGGAGTTATGAGGGGTAAAGAGGT (SEQ ID NO:13096), CGCGCGGAGTTATGAGGGGTAAAGAGG (SEQ ID NO:13097), GGGCGGGGGTGTTGGGGATATCGTAG (SEQ ID NO:13098), TCGCGCGGAGTTATGAGGGGTAAAGAGG (SEQ ID NO:13099) |
| Target1388 | chr13:112717328-112717421 | GGAGAGTTTCGGTGTTTTCGCGAGGGC (SEQ ID NO:13100), GCGGAGAGTTTCGGTGTTTTCGCGAGG (SEQ ID NO:13101), CGGAGAGTTTCGGTGTTTTCGCGAGGG (SEQ ID NO:13102), TGTTTTTTATGGTTTCGCGGGAGGA (SEQ ID NO:13103), GCGGAGAGTTTCGGTGTTTTCGCGAG (SEQ ID NO:13104), GGCGGGGCGGAGAAGGTTCGGTTTTTT (SEQ ID NO:13105), CGCGCGGAGTTATGAGGGGTAAAGAGGT (SEQ ID NO:13106), CGCGCGGAGTTATGAGGGGTAAAGAGG |

FIGURE 5 CONTINUED

{SEQ ID NO:13107), GGGCGGGGGGTGTTGGGGGATATCGTAG {SEQ ID NO:13108},
TCGCGCGGAGTTATGAGGGGTAAAGAGG {SEQ ID NO:13109)

| | | |
|---|---|---|
| Target1389 | chr13:112758613-112758653 | GGGGTTCGGGGATTTTGGGGGTCGAG {SEQ ID NO:13110), GTTCGGGGATTTTGGGGGTCGAGCG {SEQ ID NO:13111), GGGTTCGGGGATTTTGGGGGTCGAGC {SEQ ID NO:13112}, GGTTCGGGGATTTTGGGGGTCGAGC {SEQ ID NO:13113), GGTTCGGGGATTTTGGGGGTCGAGCG {SEQ ID NO:13114}, CGGCGGTGTTTTCGTTCGGGTTGGTTT {SEQ ID NO:13115), GCGGTGTTTTCGTTCGGGTTGGTTTCG {SEQ ID NO:13116}, GGCGGTGTTTTCGTTCGGGTTGGTTTC {SEQ ID NO:13117}, GCGGTGTTTTCGTTCGGGTTGGTTTCGT {SEQ ID NO:13118}, CGGCGGTGTTTTCGTTCGGGTTGGTT {SEQ ID NO:13119) |
| Target1390 | chr13:112758676-112758712 | GGGGATTTTGGGGGTCGAGCGAGGTTA {SEQ ID NO:13120), GTTCGGGGATTTTGGGGGTCGAGCGAG {SEQ ID NO:13121), GGGATTTTGGGGGTCGAGCGAGGTTAGT {SEQ ID NO:13122), GGGATTTTGGGGGTCGAGCGAGGTTAG {SEQ ID NO:13123), GGGGATTTTGGGGGTCGAGCGAGGTTAG {SEQ ID NO:13124}, GCGTTTTGAGTTTCGGTTTGGTCGTAGC {SEQ ID NO:13125), AGCGTTTTGAGTTTCGGTTTGGTCGTAGC {SEQ ID NO:13126}, AGCGTTTTGAGTTTCGGTTTGGTCGTAG {SEQ ID NO:13127), AGCGTTTTGAGTTTCGGTTTGGTCGT {SEQ ID NO:13128}, CGTGTTTTTATTAGGGTTGATATCGGTTCGTCGG {SEQ ID NO:13129} |
| Target1391 | chr13:112758718-112758745 | GGGGATTTTGGGGGTCGAGCGAGGTTA {SEQ ID NO:13130), TCGGCGATAGGGGGGAATTTCGTTGGG {SEQ ID NO:13131), GTCGGCGATAGGGGGGAATTTCGTTGG {SEQ ID NO:13132), GTTCGGGGATTTTGGGGGTCGAGCGAG {SEQ ID NO:13133}, GGGATTTTGGGGGTCGAGCGAGGTTAGT {SEQ ID NO:13134), GCGTTTTGAGTTTCGGTTTGGTCGTAGT {SEQ ID NO:13135), AGCGTTTTGAGTTTCGGTTTGGTCGTAGT {SEQ ID NO:13136), AGCGTTTTGAGTTTCGGTTTGGTCGTAG {SEQ ID NO:13137), AGCGTTTTGAGTTTCGGTTTGGTCGT {SEQ ID NO:13138}, CGTGTTTTTATTAGGGTTGATATCGGTTCGTCGG {SEQ ID NO:13139} |
| Target1392 | chr13:112758756-112758882 | GGGGATTTTGGGGGTCGAGCGAGGTTA {SEQ ID NO:13140), TAGGTCGGGGTTTAGGGCGTTGGGTTG {SEQ ID NO:13141), GTTAGGTCGGGGTTTAGGGCGTTGGGT {SEQ ID NO:13142), GGGTTTAGGGCGTTGGGTTGTGCGTTT {SEQ ID NO:13143}, TCGGCGATAGGGGGGAATTTCGTTGGG {SEQ ID NO:13144), TGGGAAAGGTGGGTTGGGGAGAAAGGG {SEQ ID NO:13145), AAGGTGGGTTGGGGAGAAAGGGCGTAG {SEQ ID NO:13146), GGTGGGTTGGGGAGAAAGGGCGTAGAG {SEQ ID NO:13147), AAAGGTGGGTTGGGGAGAAAGGGCGTA {SEQ ID NO:13148}, GAAAGGTGGGTTGGGGAGAAAGGGCGT {SEQ ID NO:13149) |
| Target1393 | chr13:112758986-112759113 | GTGGAGTGGGGACGGCGGGGTATAG {SEQ ID NO:13150), GAGTGGGGACGGCGGGGTATAGGAC {SEQ ID NO:13151), TGGGAGTGGGGACGGCGGGGTATAGGAC {SEQ ID NO:13152), GTGGAGTGGGGACGGCGGGGTATAGGA {SEQ ID NO:13153), GGAGTGGGGACGGCGGGGTATAGGAC {SEQ ID NO:13154}, CGGGGTCGTTTTTTGCGGGGTC {SEQ ID NO:13155), CGGGGTCGTTTTTTGCGGGGT {SEQ ID NO:13156), GGCGTTCGTAGTATTAAGTTGTTGGTTTTTGAGT {SEQ ID NO:13157), TGGCGTTCGTAGTATTAAGTTGTTGGTTTTTGAG {SEQ ID NO:13158), TGGCGTTCGTAGTATTAAGTTGTTGGTTTTTGAGT {SEQ ID NO:13159) |
| Target1394 | chr13:113436226-113436480 | TGTCGGGTTAAACGTCGTTATATTGTTGGGT {SEQ ID NO:13160), GTGTCGGGTTAAACGTCGTTATATTGTTGGGT {SEQ ID NO:13161), GTGTCGGGTTAAACGTCGTTATATTGTTGGGT {SEQ ID NO:13162), TGTGTCGGGTTAAACGTCGTTATATTGTTGGG {SEQ ID NO:13163), TGTGTCGGGTTAAACGTCGTTATATTGTTGGGT {SEQ ID NO:13164), GTGGGTTTTGTTTGGTAAGTGCGCGGT {SEQ ID NO:13165), AGTGGGTTTTGTTTGGTAAGTGCGCGGT {SEQ ID NO:13166}, AGTGGGTTTTGTTTGGTAAGTGCGCGG {SEQ ID NO:13167), TGGGTTTTGTTTGGTAAGTGCGCGGT {SEQ ID NO:13168}, GTGGGTTTTGTTTGGTAAGTGCGCGGTT {SEQ ID NO:13169} |
| Target1395 | chr13:113436564-113436678 | GTTGTTGGTTGGAAGCGGTCGGGAAGC {SEQ ID NO:13170), TGTTGTTGGTTGGAAGCGGTCGGGAAG {SEQ ID NO:13171), TTGTTGTTGGTTGGAAGCGGTCGGGAA {SEQ ID NO:13172), TTTGTTGTTGGTTGGAAGCGGTCGGGA {SEQ ID NO:13173), TTGTTGGTTGGAAGCGGTCGGGAAGC {SEQ ID NO:13174), TGGAGTCGTGTGGTATTGTTTATGTTATAGCGA {SEQ ID NO:13175), GGAGTCGTGTGGTATTGTTTATGTTATAGCGAGT {SEQ ID NO:13176), TGGAGTCGTGTGGTATTGTTTATGTTATAGCGAG {SEQ ID NO:13177), TGGAGTCGTGTGGTATTGTTTATGTTATAGCGAGT {SEQ ID NO:13178), TTGGAGTCGTGTGGTATTGTTTATGTTATAGCGA {SEQ ID NO:13179} |
| Target1396 | chr14:21093540-21093618 | GTGTGGTCGAGCGGTTTAAGGCGTTGG {SEQ ID NO:13180), TGTGGTCGAGCGGTTTAAGGCGTTGGA {SEQ ID NO:13181), AGTGTGGTCGAGCGGTTTAAGGCGTTG {SEQ ID NO:13182), CGTGTGTGGTAGTGTGGTCGAGTCGAGCGG {SEQ ID NO:13183}, AACGTGTGTGGTAGTGTGGTCGAGCGG {SEQ ID NO:13184), ACGTATTATTGGTAGTGGTGGGATTCGAATTTACG {SEQ ID NO:13185), TGTTGTGTTAAAACGTATTATTGGTAGTGGTGGGA {SEQ ID NO:13186), TGTTAAAACGTATTATTGGTAGTGGTGGGATTCGA {SEQ ID NO:13187), GTGTTAAAACGTATTATTGGTAGTGGTGGGATTCG {SEQ ID NO:13188), TGTGTTAAAACGTATTATTGGTAGTGGTGGGATTCG {SEQ ID NO:13189) |
| Target1397 | chr14:21093736-21093819 | CGGTTAGGTAGGGAGGTTTTTTCGTTCGC {SEQ ID NO:13190), TCGGTTAGGTAGGGAGGTTTTTTCGTTCGC {SEQ ID NO:13191), GGTTAGGTAGGGAGGTTTTTTCGTTCGC {SEQ ID NO:13192), TCGGTTAGGTAGGGAGGTTTTTTCGTTCG |

FIGURE 5 CONTINUED (SEQ ID NO:13193), TTCGGTTAGGTAGGGAGGTTTTTTCGTTCGC (SEQ ID NO:13194), GTTAGTATAACGGATAAAGTAGGAGATCGCGAGC (SEQ ID NO:13195), AGTTAGTATAACGGATAAAGTAGGAGATCGCGAGC (SEQ ID NO:13196), GCGGGAATTTAAATGGTGTAGTGTAAAAATTGGGG (SEQ ID NO:13197), GCGGGAATTTAAATGGTGTAGTGTAAAAATTGGGGT (SEQ ID NO:13198), TGCGGGAATTTAAATGGTGTAGTGTAAAAATTGGGG (SEQ ID NO:13199)

| Target1398 | chr14:21093995-21094036 | CGCGGTCGGTATTGTTTTAGGAGTTGTAGT (SEQ ID NO:13200), CGCGGTCGGTATTGTTTTAGGAGTTGTAGTT (SEQ ID NO:13201), CGCGGTCGGTATTGTTTTAGGAGTTGTAGTTT (SEQ ID NO:13202), CGCGGTCGGTATTGTTTTAGGAGTTGTAGTTTT (SEQ ID NO:13203), CGCGGTCGGTATTGTTTTAGGAGTTGTAGTTTTG (SEQ ID NO:13204), AGGGTTTAGGTAGGATATTTCGCGAGTATAGAGT (SEQ ID NO:13205), AGGGTTTAGGTAGGATATTTCGCGAGTATAGAGTT (SEQ ID NO:13206), GGGTTTAGGTAGGATATTTCGCGAGTATAGAGTTG (SEQ ID NO:13207), GGGTTTAGGTAGGATATTTCGCGAGTATAGAGTTGT (SEQ ID NO:13208), AGGGTTTAGGTAGGATATTTCGCGAGTATAGAGTTG (SEQ ID NO:13209) |
| --- | --- | --- |
| Target1399 | chr14:33401997-33402061 | CGGGAAGGAGGGAGTTAGGATTTCGGT (SEQ ID NO:13210), TCGGGAAGGAGGGAGTTAGGATTTCGGT (SEQ ID NO:13211), TCGGGAAGGAGGGAGTTAGGATTTCGG (SEQ ID NO:13212), CGGGAAGGAGGGAGTTAGGATTTCGGTT (SEQ ID NO:13213), TCGGGAAGGAGGGAGTTAGGATTTCGGTT (SEQ ID NO:13214), CGGTAGTCGTTGGGAAATAGAGGGAGGG (SEQ ID NO:13215), AGTCGTTGGGAAATAGAGGGAGGGAGT (SEQ ID NO:13216), CGGTAGTCGTTGGGAAATAGAGGGAGGGA (SEQ ID NO:13217), CGGTAGTCGTTGGGAAATAGAGGGAGG (SEQ ID NO:13218), CGGTAGTCGTTGGGAAATAGAGGGAGGGAG (SEQ ID NO:13219) |
| Target1400 | chr14:33402106-33402304 | TAGTTGCGTCGTGGGTTCGGTTAGCGA (SEQ ID NO:13220), TCGTGGGTTCGGTTAGCGAGAGTTGGG (SEQ ID NO:13221), GTGGGTTCGGTTAGCGAGAGTTGGGGT (SEQ ID NO:13222), GTAGTTGCGTCGTGGGTTCGGTTAGCG (SEQ ID NO:13223), CGTAGTTGCGTCGTGGGTTCGGTTAGC (SEQ ID NO:13224), GGGATTTAGAGGGGTAGGGCGGATTGGT (SEQ ID NO:13225), GGGATTTAGAGGGGTAGGGCGGATTGG (SEQ ID NO:13226), GGATTTAGAGGGGTAGGGCGGATTGGT (SEQ ID NO:13227), GAGGGGTAGGGCGGATTGGTTAGAAGT (SEQ ID NO:13228), AGAGGGGTAGGGCGGATTGGTTAGAAGT (SEQ ID NO:13229) |
| Target1401 | chr14:33402328-33402369 | CGGGTTTGCGGTAAGGGTAGGCGTTTG (SEQ ID NO:13230), TATTAGGGTGGGAGGGGGACGTTCGGGT (SEQ ID NO:13231), GGGTTTGCGGTAAGGGTAGGCGTTTGG (SEQ ID NO:13232), TCGGGTTTGCGGTAAGGGTAGGCGTTT (SEQ ID NO:13233), TTCGGGTTTGCGGTAAGGGTAGGCGTT (SEQ ID NO:13234), TTCGTCGGGATTTAGAGGGGTAGGGCG (SEQ ID NO:13235), CGTCGGGATTTAGAGGGGTAGGGCGGA (SEQ ID NO:13236), TCGTCGGGATTTAGAGGGGTAGGGCGG (SEQ ID NO:13237), GTCGGGATTTAGAGGGGTAGGGCGGAT (SEQ ID NO:13238), CGTCGGGATTTAGAGGGGTAGGGCGG (SEQ ID NO:13239) |
| Target1402 | chr14:33402429-33402617 | CGGGTTTGCGGTAAGGGTAGGCGTTTG (SEQ ID NO:13240), GGGTTTGCGGTAAGGGTAGGCGTTTGG (SEQ ID NO:13241), CGGCGGGTCGGTTGCGTTTTAGGTTTA (SEQ ID NO:13242), TTCGGGTTTGCGGTAAGGGTAGGCGTT (SEQ ID NO:13243), GGGACGTTAGGTTGGGCGGTTTGTGTT (SEQ ID NO:13244), GCGGTCGCGTCGTTTTAGTTTTCGGTT (SEQ ID NO:13245), GCGGTCGCGTCGTTTTAGTTTTCGGT (SEQ ID NO:13246), TGCGCGTTAAGGTTTGGGTTTCGTAGT (SEQ ID NO:13247), GCGGTCGCGTCGTTTTAGTTTTCGGTTA (SEQ ID NO:13248), TTTTGCGCGTTAAGGTTTGGGTTTCGT (SEQ ID NO:13249) |
| Target1403 | chr14:37126751-37126823 | TCGGGTGATCGGAAATAGGTAGGCGGA (SEQ ID NO:13250), CGGGTGATCGGAAATAGGTAGGCGGAG (SEQ ID NO:13251), CGGGTGATCGGAAATAGGTAGGCGGAGA (SEQ ID NO:13252), TCGGGTGATCGGAAATAGGTAGGCGGAG (SEQ ID NO:13253), TCGGGTGATCGGAAATAGGTAGGCGGAGA (SEQ ID NO:13254), AGAATGGTAGCGGGTTGGGTCGGGTTC (SEQ ID NO:13255), TAGAATGGTAGCGGGTTGGGTCGGGTT (SEQ ID NO:13256), TTAGAATGGTAGCGGGTTGGGTCGGGT (SEQ ID NO:13257), TGCGAGAGTAGGGGAGGGGTTTGTTGT (SEQ ID NO:13258), GTTAGAATGGTAGCGGGTTGGGTCGGGT (SEQ ID NO:13259) |
| Target1404 | chr14:37126862-37126949 | TCGTAGGGTTTCGGTCGTGTCGTTGTC (SEQ ID NO:13260), TTCGTAGGGTTTCGGTCGTGTCGTTGT (SEQ ID NO:13261), TTCGTAGGGTTTCGGTCGTGTCGTTGTC (SEQ ID NO:13262), TTTCGTAGGGTTTCGGTCGTGTCGTTGT (SEQ ID NO:13263), TTTCGTAGGGTTTCGGTCGTGTCGTTG (SEQ ID NO:13264), AGAATGGTAGCGGGTTGGGTCGGGTTC (SEQ ID NO:13265), TAGAATGGTAGCGGGTTGGGTCGGGTT (SEQ ID NO:13266), TTAGAATGGTAGCGGGTTGGGTCGGGT (SEQ ID NO:13267), GTTAGAATGGTAGCGGGTTGGGTCGGGT (SEQ ID NO:13268), AGAATGGTAGCGGGTTGGGTCGGGTT (SEQ ID NO:13269) |
| Target1405 | chr14:37127048-37127102 | TGATGAGAAGGTGGAGAGGTTGTCGGGT (SEQ ID NO:13270), GATGAGAAGGTGGAGAGGTTGTCGGGT (SEQ ID NO:13271), TGATGAGAAGGTGGAGAGGTTGTCGGG (SEQ ID NO:13272), ATGAGAAGGTGGAGAGGTTGTCGGGTT (SEQ ID NO:13273), TGAGAAGGTGGAGAGGTTGTCGGGTTA (SEQ ID NO:13274), CGGGAGGGGATGGCGGTTAAAAGGAGT (SEQ ID NO:13275), GTTGCGGGAGGGGATGGCGGTTAAAAG (SEQ ID NO:13276), TGCGGTTTGGATTTGGAGGGGATTGCGG |

FIGURE 5 CONTINUED (SEQ ID NO:13277), TGGTGGGAGAGGAGGATAGGAGGCGTT (SEQ ID NO:13278),
TTGGTGGGAGAGGAGGATAGGAGGCGT (SEQ ID NO:13279)

| | | |
|---|---|---|
| Target1406 | chr14:37127247-37127271 | TTGTAGGGGTTAGCGGTTTAGGGCGGA (SEQ ID NO:13280), TGTAGGGGTTAGCGGTTTAGGGCGGAT (SEQ ID NO:13281), TTTGTAGGGGTTAGCGGTTTAGGGCGG (SEQ ID NO:13282), TTTGTAGGGGTTAGCGGTTTAGGGCGGA (SEQ ID NO:13283), AGGGGTTAGCGGTTTAGGGCGGATTTT (SEQ ID NO:13284), GCGTTTAGGGCGAGGGAGGGTTT (SEQ ID NO:13285), TCGTTTTGTAGGGTAAGCGGTTAGTTGAGT (SEQ ID NO:13286), TTCGTTTTGTAGGGTAAGCGGTTAGTTGAGT (SEQ ID NO:13287), GCGTTTAGGGCGAGGGAGGGGTT (SEQ ID NO:13288), TCGTTTTGTAGGGTAAGCGGTTAGTTGAGTT (SEQ ID NO:13289) |
| Target1407 | chr14:38724381-38724436 | GCGGGCGTTTGGTGGGTATTTCGGTTT (SEQ ID NO:13290), GGTACGGGGTTGGTTGTAGTGGTCGGC (SEQ ID NO:13291), GTACGGGGTTGGTTGTAGTGGTCGGCG (SEQ ID NO:13292), GCGGGCGTTTGGTGGGTATTTCGGTT (SEQ ID NO:13293), GCGGGCGTTTGGTGGGTATTTCGGTTTT (SEQ ID NO:13294), GGCGTTCGTTGGGATAAATTTTCGGGCG (SEQ ID NO:13295), CGGCGTTCGTTGGGATAAATTTTCGGGC (SEQ ID NO:13296), GGCGTTCGTTGGGATAAATTTTCGGGCGA (SEQ ID NO:13297), GCGTTCGTTGGGATAAATTTTCGGGCG (SEQ ID NO:13298), GCGTTCGTTGGGATAAATTTTCGGGCGA (SEQ ID NO:13299) |
| Target1408 | chr14:38724473-38724766 | TTTCGGGGCGCGGCGTAGGATATAAGA (SEQ ID NO:13300), GGTTTCGGGGCGCGGCGTAGGATATAA (SEQ ID NO:13301), TCGGGGCGCGGCGTAGGATATAAGATT (SEQ ID NO:13302), TTCGGGGCGCGGCGTAGGATATAAGAT (SEQ ID NO:13303), GTTGTGTAGTTGGAAGGGCGCGCGATA (SEQ ID NO:13304), TCGAGGTGAGTGCGTTTTGTCGGGGAT (SEQ ID NO:13305), ATCGAGGTGAGTGCGTTTTGTCGGGGA (SEQ ID NO:13306), GATCGAGGTGAGTGCGTTTTGTCGGGG (SEQ ID NO:13307), GGATCGAGGTGAGTGCGTTTTGTCGGG (SEQ ID NO:13308), GGGATCGAGGTGAGTGCGTTTTGTCGG (SEQ ID NO:13309) |
| Target1409 | chr14:38724780-38724874 | TTTCGGGGCGCGGCGTAGGATATAAGA (SEQ ID NO:13310), GGTTTCGGGGCGCGGCGTAGGATATAA (SEQ ID NO:13311), TCGGGGCGCGGCGTAGGATATAAGATT (SEQ ID NO:13312), TTCGGGGCGCGGCGTAGGATATAAGAT (SEQ ID NO:13313), GTTTCGGGGCGCGGCGTAGGATATAAG (SEQ ID NO:13314), TTGCGGGTAGGTTTAGGGTTCGGAGGG (SEQ ID NO:13315), CGGGTAGGTTTAGGGTTCGGAGGGGGT (SEQ ID NO:13316), GGGTAGGTTTAGGGTTCGGAGGGGGTT (SEQ ID NO:13317), GCGGGTAGGTTTAGGGTTCGGAGGGG (SEQ ID NO:13318), TGCGGGTAGGTTTAGGGTTCGGAGGGG (SEQ ID NO:13319) |
| Target1410 | chr14:38724929-38725127 | GGTTTTGGGTTTGTTCGTAGGAGCGCG (SEQ ID NO:13320), GGGTTTTGGGTTTGTTCGTAGGAGCGCG (SEQ ID NO:13321), CGGGTTTTGGGTTTGTTCGTAGGAGCGC (SEQ ID NO:13322), GGGTTTTGGGTTTGTTCGTAGGAGCGC (SEQ ID NO:13323), CGGGTTTTGGGTTTGTTCGTAGGAGCG (SEQ ID NO:13324), GCGGTAGGCGGTCGAGGAGGTTTGTAT (SEQ ID NO:13325), TTGCGGGTAGGTTTAGGGTTCGGAGGG (SEQ ID NO:13326), TTTGGTAGGCGTTTTGGTTCGGGTCGG (SEQ ID NO:13327), CGAGGTGGGGCGTTTAGTATCGTGCGT (SEQ ID NO:13328), GCGGGGTTTTAGAGAATGAGGTCGGCG (SEQ ID NO:13329) |
| Target1411 | chr14:38725145-38725190 | GTACGGTCGGTAGTGGGGTGTTCGTCG (SEQ ID NO:13330), TACGGTCGGTAGTGGGGTGTTCGTCGTC (SEQ ID NO:13331), ACGGTCGGTAGTGGGGTGTTCGTCGTC (SEQ ID NO:13332), CGGTCGGTAGTGGGGTGTTCGTCGTC (SEQ ID NO:13333), CGGTCGGTAGTGGGGTGTTCGTCGT (SEQ ID NO:13334), GTTGGGGAGTAGTTTTGCGTGCGGGGTT (SEQ ID NO:13335), AAGTTGGGAGTAGTTTTGCGTGCGGGG (SEQ ID NO:13336), TTTGGTAGGCGTTTTGGTTCGGGTCGG (SEQ ID NO:13337), AGTTGGGAGTAGTTTTGCGTGCGGGGT (SEQ ID NO:13338), GCGGGGTTTTAGAGAATGAGGTCGGCG (SEQ ID NO:13339) |
| Target1412 | chr14:51338713-51338816 | GTTTGTTTGATCGCGCGGAGGAGGAGG (SEQ ID NO:13340), TTTGTTTGATCGCGCGGAGGAGGAGGG (SEQ ID NO:13341), AGTTTGTTTGATCGCGCGGAGGAGGAG (SEQ ID NO:13342), AGTTTGTTTGATCGCGCGGAGGAGGAGG (SEQ ID NO:13343), TAGTTTGTTTGATCGCGCGGAGGAGGA (SEQ ID NO:13344), TTAGGTAGGTTGGTACGGCGGGGGAGA (SEQ ID NO:13345), ATGCGGTCGTTTGGTAGTTTTGCGCGT (SEQ ID NO:13346), GTTAGGTAGGTTGGTACGGCGGGGGAG (SEQ ID NO:13347), TGCGGTCGTTTGGTAGTTTTGCGCGTT (SEQ ID NO:13348), TTCGCGCGGAGGTAGGTTGGTACGG (SEQ ID NO:13349) |
| Target1413 | chr14:51338844-51338959 | GTTTGTTTGATCGCGCGGAGGAGGAGG (SEQ ID NO:13350), TTCGGATTGTAGTTTTCGCGGCGGTGG (SEQ ID NO:13351), TTTGTTTGATCGCGCGGAGGAGGAGGG (SEQ ID NO:13352), AGTTTGTTTGATCGCGCGGAGGAGGAG (SEQ ID NO:13353), TTTCGGATTGTAGTTTTCGCGGCGGTGG (SEQ ID NO:13354), CGGTTAGGGGTGGATCGGGCGGTATTT (SEQ ID NO:13355), ATGCGGTCGTTTGGTAGTTTTGCGCGT (SEQ ID NO:13356), TGCGGTCGTTTGGTAGTTTTGCGCGTT (SEQ ID NO:13357), GATGCGGTCGTTTGGTAGTTTTGCGCG (SEQ ID NO:13358), GCGGTCGTTTGGTAGTTTTGCGCGTTT (SEQ ID NO:13359) |
| Target1414 | chr14:51338995-51339010 | CGTGGTCGTTTGGTGGGATATGGTCGA (SEQ ID NO:13360), CGTGGTCGTTTGGTGGGATATGGTCGAT (SEQ ID NO:13361), GCGTAGGATTGTTAGGCGGTCGTATCGT (SEQ ID NO:13362), GGTCGTTTGGTGGGATATGGTCGATCGT (SEQ ID NO:13363), TGGTCGTTTGGTGGGATATGGTCGATCG (SEQ ID NO:13364), CGGTTAGGGGTGGATCGGGCGGTATTT (SEQ ID NO:13365), TCGGTTAGGGGTGGATCGGGCGGTATT (SEQ ID NO:13366), TTCGGTTAGGGGTGGATCGGGCGGTAT (SEQ ID NO:13367), CGGTTAGGGGTGGATCGGGCGGTATT (SEQ ID NO:13368), GGGTTCGGGTTAGTAGAGGGGATTGCGG (SEQ ID NO:13369) |

FIGURE 5 CONTINUED

| | | |
|---|---|---|
| Target1415 | chr14:51339024-51339049 | CGTGGTCGTTTGGTGGGATATGGTCGA (SEQ ID NO:13370), CGTGGTCGTTTGGTGGGATATGGTCGAT (SEQ ID NO:13371), GGTCGTTTGGTGGGATATGGTCGATCGT (SEQ ID NO:13372), TGGTCGTTTGGTGGGATATGGTCGATCG (SEQ ID NO:13373), TGGTCGTTTGGTGGGATATGGTCGATCGT (SEQ ID NO:13374), GGGTTCGGGTTAGTAGAGGGGATTGCGG (SEQ ID NO:13375), TTCGCGTAGTTTGAGTCGTCGGGGGTTT (SEQ ID NO:13376), TTTCGCGTAGTTTGAGTCGTCGGGGGTT (SEQ ID NO:13377), TTTTCGCGTAGTTTGAGTCGTCGGGGT (SEQ ID NO:13378), GGTTCGGGTTAGTAGAGGGGATTGCGGT (SEQ ID NO:13379) |
| Target1416 | chr14:51339072-51339085 | TTTCGACGGTTTAGGTTGCGCGGGGAT (SEQ ID NO:13380), GTTTAGGTTGCGCGGGGATGGGGTAGG (SEQ ID NO:13381), GGTTTAGGTTGCGCGGGGATGGGGTAG (SEQ ID NO:13382), TTCGACGGTTTAGGTTGCGCGGGGATG (SEQ ID NO:13383), GTTTCGACGGTTTAGGTTGCGCGGGGA (SEQ ID NO:13384), GGGTTCGGGTTAGTAGAGGGGATTGCGG (SEQ ID NO:13385), GGTTCGGGTTAGTAGAGGGGATTGCGGT (SEQ ID NO:13386), TGGGTTCGGGTTAGTAGAGGGGATTGCG (SEQ ID NO:13387), GGTTCGGGTTAGTAGAGGGGATTGCGG (SEQ ID NO:13388), GGGTTCGGGTTAGTAGAGGGGATTGCG (SEQ ID NO:13389) |
| Target1417 | chr14:52781541-52781816 | GCGTTTCGGGGGTTTGGTCGTGTTGTT (SEQ ID NO:13390), GCGTTTCGGGGGTTTGGTCGTGTTGT (SEQ ID NO:13391), GCGTTTCGGGGGTTTGGTCGTGTTGTTT (SEQ ID NO:13392), CGTTTCGGGGGTTTGGTCGTGTTGTTT (SEQ ID NO:13393), CGTTTCGGGGGTTTGGTCGTGTTGTTTG (SEQ ID NO:13394), CGCGGCGTTGGTAGAAGTAGGGGTGTT (SEQ ID NO:13395), GCGGCGTTGGTAGAAGTAGGGGTGTTC (SEQ ID NO:13396), AGGGGTGTTCGATCGAGAGGTAGCGTT (SEQ ID NO:13397), CGGCGTTGGTAGAAGTAGGGGTGTTCG (SEQ ID NO:13398), AGGTAAGCGGTTCGTTCGTGTCGGATG (SEQ ID NO:13399) |
| Target1418 | chr14:52781834-52781937 | GCGTTTCGGGGGTTTGGTCGTGTTGT (SEQ ID NO:13400), GCGTTTCGGGGGTTTGGTCGTGTTGTTT (SEQ ID NO:13401), CGTTTCGGGGGTTTGGTCGTGTTGTTT (SEQ ID NO:13402), CGTTTCGGGGGTTTGGTCGTGTTGTTTGT (SEQ ID NO:13403), TTCGGGGGTTTGGTCGTGTTGTTTGTT (SEQ ID NO:13404), GGCGGTGTATGCGGATGAGGTTGAGAA (SEQ ID NO:13405), GGCGGTGTATGCGGATGAGGTTGAGAAT (SEQ ID NO:13406), GGCGGTGTATGCGGATGAGGTTGAGA (SEQ ID NO:13407), AGGGAAGGTTCGTAGCGGTTTTTTCGG (SEQ ID NO:13408), GGCGGTGTATGCGGATGAGGTTGAGAATG (SEQ ID NO:13409) |
| Target1419 | chr14:52781945-52781969 | AGGGAAGGTTCGTAGCGGTTTTTTCGG (SEQ ID NO:13410), TAGGGAAGGTTCGTAGCGGTTTTTTCGG (SEQ ID NO:13411), CGGGGTCGTTTCGGTTATTGTTTAGGG (SEQ ID NO:13412), CGGGGTCGTTTCGGTTATTGTTTAGGGA (SEQ ID NO:13413), GGGAAGGTTCGTAGCGGTTTTTTCGG (SEQ ID NO:13414) |
| Target1420 | chr14:52782008-52782046 | GGGGTTCGTAGGAGAGGGGAAAGGGTG (SEQ ID NO:13415), AGGGGAAAGGGGTGTTTATGGCGGAGGA (SEQ ID NO:13416), TTTTTGGGTAGTGGTCGGGGCGGTTTC (SEQ ID NO:13417), CGGGGTTCGTAGGAGAGGGGAAAGGGT (SEQ ID NO:13418), TTTTTTGGGTAGTGGTCGGGGCGGTTT (SEQ ID NO:13419), AGTCGGGTTGTGGAAACGTAGGGGAGTG (SEQ ID NO:13420), GTCGGGTTGTGGAAACGTAGGGGAGTGA (SEQ ID NO:13421), AGTCGGGTTGTGGAAACGTAGGGGAGTGA (SEQ ID NO:13422), GAGTCGGGTTGTGGAAACGTAGGGGAGT (SEQ ID NO:13423), AGAGTCGGGTTGTGGAAACGTAGGGGAGT (SEQ ID NO:13424) |
| Target1421 | chr14:52782125-52782173 | GGGGTTCGTAGGAGAGGGGAAAGGGTG (SEQ ID NO:13425), AGGGGAAAGGGGTGTTTATGGCGGAGGA (SEQ ID NO:13426), AAGGGTGTTTATGGCGGAGGAGACGGA (SEQ ID NO:13427), CGGGGTTCGTAGGAGAGGGGAAAGGGT (SEQ ID NO:13428), AGGGTGTTTATGGCGGAGGAGACGGAT (SEQ ID NO:13429), TTTGTAGGGCGGTGGAAAGGGTGGAGG (SEQ ID NO:13430), GTGGAAAGGGTGGAGGCGTTAGGGGAG (SEQ ID NO:13431), GGAAAGGGTGGAGGCGTTAGGGGAGAG (SEQ ID NO:13432), AGTTTGTAGGGCGGTGGAAAGGGTGGA (SEQ ID NO:13433), TGGAAAGGGTGGAGGCGTTAGGGGAGA (SEQ ID NO:13434) |
| Target1422 | chr14:55243177-55243271 | TGATGTTTTAGTAGTTAGGTAGGGTTCGGCG (SEQ ID NO:13435), TTGATGTTTTAGTAGTTAGGTAGGGTTCGGCG (SEQ ID NO:13436), GTTGATGTTTTAGTAGTTAGGTAGGGTTCGGCG (SEQ ID NO:13437), TGTTGATGTTTTAGTAGTTAGGTAGGGTTCGGCG (SEQ ID NO:13438), TGTTGGCGGTTTTGTTTTTTATTTTAGTGGGGT (SEQ ID NO:13439), AGTGTGTACGGGTAGCGAGCGGGTTTT (SEQ ID NO:13440), AAGTGTGTACGGGTAGCGAGCGGGTTT (SEQ ID NO:13441), GAAGTGTGTACGGGTAGCGAGCGGGTT (SEQ ID NO:13442), TGTGGGGAAGTGTGTACGGGTAGCGAG (SEQ ID NO:13443), GTGGGGAAGTGTGTACGGGTAGCGAGC (SEQ ID NO:13444) |
| Target1423 | chr14:56705456-56705503 | AGTTAGGTGAGTGGTAGATTTCGGGTTTACG (SEQ ID NO:13445), AAGTTAGGTGAGTGGTAGATTTCGGGTTTACG (SEQ ID NO:13446), AAAGTTAGGTGAGTGGTAGATTTCGGGTTTACG (SEQ ID NO:13447), AAAAGTTAGGTGAGTGGTAGATTTCGGGTTTACG (SEQ ID NO:13448), TAAAAGTTAGGTGAGTGGTAGATTTCGGGTTTACG (SEQ ID NO:13449), TGTTCGTGGGTTCGGAATTTGTTATTTATTTGGT (SEQ ID NO:13450), TGTTCGTGGGTTCGGAATTTGTTATTTATTTGGTT (SEQ ID NO:13451), ATGTTCGTGGGTTCGGAATTTGTTATTTATTTGGT (SEQ ID NO:13452), TGTTCGTGGGTTCGGAATTTGTTATTTATTTGGTTT (SEQ ID NO:13453), ATGTTCGTGGGTTCGGAATTTGTTATTTATTTGGTT (SEQ ID NO:13454) |

FIGURE 5 CONTINUED

Target1424    chr14:57265006-57265030    TTCGGTTTTAGTTTTTTCGGGCGTAGGG (SEQ ID NO:13455), TTTCGGTTTTAGTTTTTTCGGGCGTAGGG (SEQ ID NO:13456), GTTTCGGTTTTAGTTTTTTCGGGCGTAGGG (SEQ ID NO:13457), AGTTTCGGTTTTAGTTTTTTCGGGCGTAGGG (SEQ ID NO:13458), AGTTTCGGTTTTAGTTTTTTCGGGCGTAGG (SEQ ID NO:13459), AGGTTCGGTGGCGAGGTTTGTACGTTC (SEQ ID NO:13460), GAGGTTCGGTGGCGAGGTTTGTACGTT (SEQ ID NO:13461), GAGGTTCGGTGGCGAGGTTTGTACGTTC (SEQ ID NO:13462), GCGGGAGTGGGTCGTTAGTTAGAGTCG (SEQ ID NO:13463), GCGGGAGTGGGTCGTTAGTTAGAGTCGA (SEQ ID NO:13464)

Target1425    chr14:57265126-57265138    AGGTTTGATTGTAGGGTTCGGGCGGGG (SEQ ID NO:13465), GGTTTGATTGTAGGGTTCGGGCGGGGT (SEQ ID NO:13466), GAGGTTTGATTGTAGGGTTCGGGCGGG (SEQ ID NO:13467), GGAGGTTTGATTGTAGGGTTCGGGCGG (SEQ ID NO:13468), GTTTGATTGTAGGGTTCGGGCGGGGTT (SEQ ID NO:13469), GGGCGTAGTTTTTAGGTTTCGGGGGCG (SEQ ID NO:13470), CGGGCGTAGTTTTTAGGTTTCGGGGGC (SEQ ID NO:13471), TAGGTTTCGGGGGCGTCGGTTTTAGGG (SEQ ID NO:13472), GGCGTAGTTTTTAGGTTTCGGGGGCGT (SEQ ID NO:13473), CGTCGGTTTTAGGGCGTTGTGGGTCG (SEQ ID NO:13474)

Target1426    chr14:57265187-57265197    GGTTTATAGCGTTTGGGATCGGCGTT (SEQ ID NO:13475), GGTTTATAGCGTTTGGGATCGGCGTTT (SEQ ID NO:13476), GGTTTATAGCGTTTGGGATCGGCGT (SEQ ID NO:13477), GGTTTATAGCGTTTGGGATCGGCGTTTT (SEQ ID NO:13478), GGTTTATAGCGTTTGGGATCGGCGTTTTC (SEQ ID NO:13479), TTGGCGGGTTAGGTAGGGGCGAGATTG (SEQ ID NO:13480), GTTTGGCGGGTTAGGTAGGGGCGAGAT (SEQ ID NO:13481), GCGGGTTAGGTAGGGGCGAGATTGAGG (SEQ ID NO:13482), GGCGGGTTAGGTAGGGGCGAGATTGAG (SEQ ID NO:13483), TTTGGCGGGTTAGGTAGGGGCGAGATT (SEQ ID NO:13484)

Target1427    chr14:57265461-57265483    GGGGAGTTCGGCGTTTGTTTTAGTTGGGGG (SEQ ID NO:13485), GGGGAGTTCGGCGTTTGTTTTAGTTGGGG (SEQ ID NO:13486), TGGGGGTTTTCGGGGTAGAGATGTGAGT (SEQ ID NO:13487), GGGGGGTTTTCGGGGTAGAGATGTGAGT (SEQ ID NO:13488), TGGGGGTTTTCGGGGTAGAGATGTGAG (SEQ ID NO:13489), TAAGACGTTGGGAGGTTGGGGCGGAAT (SEQ ID NO:13490), GTAAGACGTTGGGAGGTTGGGGCGGAA (SEQ ID NO:13491), AAGACGTTGGGAGGTTGGGGCGGAATT (SEQ ID NO:13492), ACGTTGGGAGGTTGGGGCGGAATTGTT (SEQ ID NO:13493), CGTTGGGAGGTTGGGGCGGAATTGTTA (SEQ ID NO:13494)

Target1428    chr14:57265487-57265500    TGGGGGTTTTCGGGGTAGAGATGTGAGT (SEQ ID NO:13495), GGGGGGTTTTCGGGGTAGAGATGTGAGT (SEQ ID NO:13496), TGGGGGTTTTCGGGGTAGAGATGTGAG (SEQ ID NO:13497), AGTTGGGGGTTTTCGGGGTAGAGATGT (SEQ ID NO:13498), TTGGGGGTTTTCGGGGTAGAGATGTGA (SEQ ID NO:13499), TAAGACGTTGGGAGGTTGGGGCGGAAT (SEQ ID NO:13500), GTAAGACGTTGGGAGGTTGGGGCGGAA (SEQ ID NO:13501), AAGACGTTGGGAGGTTGGGGCGGAATT (SEQ ID NO:13502), ACGTTGGGAGGTTGGGGCGGAATTGTT (SEQ ID NO:13503), CGTTGGGAGGTTGGGGCGGAATTGTTA (SEQ ID NO:13504)

Target1429    chr14:57265549-57265561    TTTTGCGTTTGTGGCGGCGGTAGTACG (SEQ ID NO:13505), GTTTTGCGTTTGTGGCGGCGGTAGTAC (SEQ ID NO:13506), TTTGCGTTTGTGGCGGCGGTAGTACG (SEQ ID NO:13507), GTTTTGCGTTTGTGGCGGCGGTAGTACG (SEQ ID NO:13508), TTGCGTTTGTGGCGGCGGTAGTACG (SEQ ID NO:13509), TTTGTGGGTGATTTTTTAGGTTCGTATTGTCGTT (SEQ ID NO:13510), TTTTGTGGGTGATTTTTTAGGTTCGT (SEQ ID NO:13511), TTTTGTGGGTGATTTTTTAGGTTCGTATTGTCGTT (SEQ ID NO:13512), TTTTTGTGGGTGATTTTTTAGGTTCGTATTGTCGT (SEQ ID NO:13513), TTTTTGTGGGTGATTTTTTAGGTTCGTATTGTCGTT (SEQ ID NO:13514)

Target1430    chr14:57275051-57275073    TGATGGAAAGGAAATAAAATTACGCGGATTGGC (SEQ ID NO:13515), ATGATGGAAAGGAAATAAAATTACGCGGATTGGC (SEQ ID NO:13516), TATGATGGAAAGGAAATAAAATTACGCGGATTGGC (SEQ ID NO:13517), GTATGATGGAAAGGAAATAAAATTACGCGGATTGGC (SEQ ID NO:13518), TGTATGATGGAAAGGAAATAAAATTACGCGGATTGG (SEQ ID NO:13519)

Target1431    chr14:57275116-57275144    GCGATTGGTTTGCGGTTGGGAAGACGA (SEQ ID NO:13520), TGCGGTTGGGAAGACGACGAAGAGGAG (SEQ ID NO:13521), TTGCGGTTGGGAAGACGACGAAGAGGA (SEQ ID NO:13522), GCGGTTGGGAAGACGACGAAGAGGAGG (SEQ ID NO:13523), TGGTTTGCGGTTGGGAAGACGACGAAG (SEQ ID NO:13524), TCGCGGGTGGTAGAGTTATTTGATTTTTCGA (SEQ ID NO:13525), CGCGGGTGGTAGAGTTATTTGATTTTTCGAGG (SEQ ID NO:13526), CGCGGGTGGTAGAGTTATTTGATTTTTCGAGGT (SEQ ID NO:13527), TCGCGGGTGGTAGAGTTATTTGATTTTTCGAGG (SEQ ID NO:13528), CGCGGGTGGTAGAGTTATTTGATTTTTCGAG (SEQ ID NO:13529)

Target1432    chr14:57275599-57275613    TCGGTGGAATTTTGATAGGGGATTTGGGT (SEQ ID NO:13530), TCGGTGGAATTTTGATAGGGGATTTGGGTT (SEQ ID NO:13531), TTCGGTGGAATTTTGATAGGGGATTTGGGT (SEQ ID NO:13532), TCGGTGGAATTTTGATAGGGGATTTGGGTTT (SEQ ID NO:13533), TTCGGTGGAATTTTGATAGGGGATTTGGGTT (SEQ ID NO:13534), GCGTTGTTGCGTTTAAGTGATTTTTGAAATCGA (SEQ ID NO:13535), GCGTTGTTGCGTTTAAGTGATTTTTGAAATCGAT (SEQ ID NO:13536), GCGTTGTTGCGTTTAAGTGATTTTTGAAATCGATG (SEQ ID NO:13537),

FIGURE 5 CONTINUED

GCGTTGTTGCGTTTAAGTGATTTTTGAAATCGATGT (SEQ ID NO:13538),
CGTTGTTGCGTTTAAGTGATTTTTGAAATCGATGT (SEQ ID NO:13539)

Target1433    chr14:57275633-57275644    TCGGTGGAATTTTGATAGGGGGATTTGGGT (SEQ ID NO:13540),
TCGGTGGAATTTTGATAGGGGGATTTGGGTT (SEQ ID NO:13541),
TTCGGTGGAATTTTGATAGGGGGATTTGGGT (SEQ ID NO:13542),
TCGGTGGAATTTTGATAGGGGGATTTGGGTTT (SEQ ID NO:13543),
TTCGGTGGAATTTTGATAGGGGGATTTGGGTT (SEQ ID NO:13544),
AGGGGGTTCGTCGAGGTTTAGTTTGTGT (SEQ ID NO:13545), GAGGGGGTTCGTCGAGGTTTAGTTTGTGT
(SEQ ID NO:13546), AGGGGGTTCGTCGAGGTTTAGTTTGTGTT (SEQ ID NO:13547),
GAGGGGGTTCGTCGAGGTTTAGTTTGTGTT (SEQ ID NO:13548),
AGGGGGTTCGTCGAGGTTTAGTTTGTGTTA (SEQ ID NO:13549)

Target1434    chr14:57275681-57275688    CGCGAAGATTTTTTGGGAGTTTGTAGAGCG (SEQ ID NO:13550),
TTTTTGGGAGTTTGTAGAGCGATTCGTCG (SEQ ID NO:13551),
ACGCGAAGATTTTTTGGGAGTTTGTAGAGC (SEQ ID NO:13552),
GCGAAGATTTTTTGGGAGTTTGTAGAGCGA (SEQ ID NO:13553),
TTTTTGGGAGTTTGTAGAGCGATTCGTCG (SEQ ID NO:13554), AGGGGTTCGTCGAGGTTTAGTTTGTGT
(SEQ ID NO:13555), GAGGGGTTCGTCGAGGTTTAGTTTGTGT (SEQ ID NO:13556),
AGGGGGTTCGTCGAGGTTTAGTTTGTGTT (SEQ ID NO:13557), GAGGGGTTCGTCGAGGTTTAGTTTGTGTT
(SEQ ID NO:13558), AGGGGGTTCGTCGAGGTTTAGTTTGTGTTA (SEQ ID NO:13559)

Target1435    chr14:57275821-57275836    TGTTTTGGAGTTTGGGAAGGGGGTGCG (SEQ ID NO:13560), GTTTTGGAGTTTGGGAAGGGGGTGCGC
(SEQ ID NO:13561), TTTTGGAGTTTGGGAAGGGGGTGCGC (SEQ ID NO:13562),
TTGTTTTGGAGTTTGGGAAGGGGGTGCG (SEQ ID NO:13563), TTTTGGAGTTTGGGAAGGGGGTGCGCG
(SEQ ID NO:13564), TTTGGCGGGGAGAGGTAGGGTTCGTTC (SEQ ID NO:13565),
TTTTGGCGGGGAGAGGTAGGGTTCGTT (SEQ ID NO:13566), TTTTTGGCGGGGAGAGGTAGGGTTCGT
(SEQ ID NO:13567), TTTTTGGCGGGGAGAGGTAGGGTTCGTTC (SEQ ID NO:13568),
TTGGCGGGGAGAGGTAGGGTTCGTTC (SEQ ID NO:13569)

Target1436    chr14:57275967-57276001    GTTTTTGGTTCGGTCGCGGTTTTTGGGC (SEQ ID NO:13570), TTTGTTCGTTTTAGGTGCGCGCGGAGG (SEQ
ID NO:13571), CGGTTTTTGGTTCGGTCGCGCGGTTTTGG (SEQ ID NO:13572),
GGTTTTTGGTTCGGTCGCGCGGTTTTGGG (SEQ ID NO:13573), GGATTTCGGTTTTTGGTTCGGTCGCGGG (SEQ
ID NO:13574)

Target1437    chr14:60207676-60208076    CGGTTTGGTTGGAGGAGGGGGAAGGAA (SEQ ID NO:13575), TGGAGGAGGGGGAAGGAAGGGAAGTGT
(SEQ ID NO:13576), TGGAAGGTCGGTTTGGTTGGAGGAGGG (SEQ ID NO:13577),
AAGTGTAAGAGAGTGGTGGCGGTGGGG (SEQ ID NO:13578), AGGAGGGGGAAGGAAGGGAAGTGTGGT
(SEQ ID NO:13579)

Target1438    chr14:60952060-60952098    TGAAGTTTTGGGGATGGGGTGGGAAGT (SEQ ID NO:13580), TTGAAGTTTTGGGGATGGGGTGGGAAGT
(SEQ ID NO:13581), TTGAAGTTTTGGGGATGGGGTGGGAAG (SEQ ID NO:13582),
ACGATTTGAAGTTTTGGGGATGGGGTGGG (SEQ ID NO:13583),
CGATTTGAAGTTTTGGGGATGGGGTGGG (SEQ ID NO:13584),
AGGGTATATTTTGTGGAGAAATTTGGGTGTTCGT (SEQ ID NO:13585),
GGGTATATTTTGTGGAGAAATTTGGGTGTTCGTG (SEQ ID NO:13586),
AGGGTATATTTTGTGGAGAAATTTGGGTGTTCGTG (SEQ ID NO:13587),
GGGTATATTTTGTGGAGAAATTTGGGTGTTCGTGA (SEQ ID NO:13588),
AAGGGTATATTTTGTGGAGAAATTTGGGTGTTCG (SEQ ID NO:13589)

Target1439    chr14:60952196-60952265    CGTTTTGAATATGTTTTTTGGTGGCGTGTGT (SEQ ID NO:13590),
ACGTTTTGAATATGTTTTTTGGTGGCGTGTG (SEQ ID NO:13591),
ACGTTTTGAATATGTTTTTTGGTGGCGTGTGT (SEQ ID NO:13592),
AACGTTTTGAATATGTTTTTTGGTGGCGTGTG (SEQ ID NO:13593),
AACGTTTTGAATATGTTTTTTGGTGGCGTGTGT (SEQ ID NO:13594),
TTCGGGTGTTGGGGAAGGGTTTTCGTT (SEQ ID NO:13595), ATTCGGGTGTTGGGGAAGGGTTTTCGT
(SEQ ID NO:13596), TCGGGTGTTGGGGAAGGGTTTTCGTTA (SEQ ID NO:13597),
AGGTTTATTCGGGTGTTGGGGAAGGGT (SEQ ID NO:13598), ATTCGGGTGTTGGGGAAGGGTTTTCGTT
(SEQ ID NO:13599)

Target1440    chr14:60952325-60952340    GGAGGCGTACGGGTTGTGGTTTTTGGG (SEQ ID NO:13600), GGGAGGCGTACGGGTTGTGGTTTTTGG
(SEQ ID NO:13601), TAGGAGGTTGTGAGGGTGGGAGTCGGT (SEQ ID NO:13602),
CGGGAGGCGTACGGGTTGTGGTTTTTG (SEQ ID NO:13603), AGGGTGGGAGTCGGTCGGCGAATTTTT
(SEQ ID NO:13604)

Target1441    chr14:60952398-60952465    ACGTTTGAGGCGGGGTTTTTGTTTATCGT (SEQ ID NO:13605), CGTTTGAGGCGGGGTTTTTGTTTATCGT
(SEQ ID NO:13606), ACGTTTGAGGCGGGGTTTTTGTTTATCG (SEQ ID NO:13607),
CGTTTGAGGCGGGGTTTTTGTTTATCGTG (SEQ ID NO:13608),
CGTTTGAGGCGGGGTTTTTGTTTATCGTGT (SEQ ID NO:13609), TAGGAGGTTGTGAGGGTGGGAGTCGGT
(SEQ ID NO:13610), GATGCGGTGTTGTAGTTTCGGGCGAGG (SEQ ID NO:13611),
GGATGCGGTGTTGTAGTTTCGGGCGAG (SEQ ID NO:13612), AGGGTGGGAGTCGGTCGGCGAATTTTT
(SEQ ID NO:13613), CGGTGTTGTAGTTTCGGGCGAGGGGAA (SEQ ID NO:13614)

FIGURE 5 CONTINUED

Target1442     chr14:60976532-60976549     TTGCGTGGAAGATTTTTGGGATTTGTGGA (SEQ ID NO:13615),
TGCGTGGAAGATTTTTGGGATTTGTGGAT (SEQ ID NO:13616),
GGTTGAGAAGTTGCGTGGAAGATTTTTGGG (SEQ ID NO:13617),
GTTGCGTGGAAGATTTTTGGGATTTGTGG (SEQ ID NO:13618),
AGTTGCGTGGAAGATTTTTGGGATTTGTGG (SEQ ID NO:13619), GGGGTTAGTTCGGTTGTTTGGGCGAGT
(SEQ ID NO:13620), AGGGGTTAGTTCGGTTGTTTGGGCGAGT (SEQ ID NO:13621),
AGGGGGTTAGTTCGGTTGTTTGGGCGAG (SEQ ID NO:13622), GCGTAGGGGTTAGTTCGGTTGTTTGGGC
(SEQ ID NO:13623), CGTAGGGGTTAGTTCGGTTGTTTGGGCG (SEQ ID NO:13624)

Target1443     chr14:60976654-60976671     ACGTAGGTGGGTAATTGGTTTAAAAATCGTCGA (SEQ ID NO:13625),
TCGGATTGATTTTTACGTAGGTGGGTAATTGGT (SEQ ID NO:13626),
ACGTAGGTGGGTAATTGGTTTAAAAATCGTCGAT (SEQ ID NO:13627),
TCGGATTGATTTTTACGTAGGTGGGTAATTGGTT (SEQ ID NO:13628),
TACGTAGGTGGGTAATTGGTTTAAAAATCGTCGA (SEQ ID NO:13629),
GGAGTCGTTAGGGATTGGGTAAGGGCGT (SEQ ID NO:13630),
TGGAGTCGTTAGGGATTGGGTAAGGGCG (SEQ ID NO:13631), GGAGTCGTTAGGGATTGGGTAAGGGCG
(SEQ ID NO:13632), GGGATTGGGTAAGGGCGTTAGAGGTGT (SEQ ID NO:13633),
GAGTCGTTAGGGATTGGGTAAGGGCGT (SEQ ID NO:13634)

Target1444     chr14:60976708-60976725     TCGGTATTTAGAGGTTTTCGCGTTTTGAGC (SEQ ID NO:13635),
GGTCGGTATTTAGAGGTTTTCGCGTTTTGAGC (SEQ ID NO:13636),
AGGTCGGTATTTAGAGGTTTTCGCGTTTTG (SEQ ID NO:13637),
GGTCGGTATTTAGAGGTTTTCGCGTTTTGA (SEQ ID NO:13638),
GGGATCGAGCGGTTGTAGTTAAGAATAGGT (SEQ ID NO:13639),
GGAGTCGTTAGGGATTGGGTAAGGGCGT (SEQ ID NO:13640),
TGGAGTCGTTAGGGATTGGGTAAGGGCG (SEQ ID NO:13641), GGAGTCGTTAGGGATTGGGTAAGGGCG
(SEQ ID NO:13642), GGGATTGGGTAAGGGCGTTAGAGGTGT (SEQ ID NO:13643),
GAGTCGTTAGGGATTGGGTAAGGGCGT (SEQ ID NO:13644)

Target1445     chr14:60976829-60976862     AGGAGTTGGGAGCGCGGTTTGTTTTGG (SEQ ID NO:13645), AGTTGGGAGCGCGGTTTGTTTTGGGTT
(SEQ ID NO:13646), GGGGAGGAGGCGGGTGGAGGTATTTTT (SEQ ID NO:13647),
GAGTTGGGAGCGCGGTTTGTTTTGGGT (SEQ ID NO:13648), GAGGCGGGTGGAGGTATTTTTGGCGTT
(SEQ ID NO:13649), TGGGGAGTTAGCGGGTGGGGAAGTAGA (SEQ ID NO:13650),
GTGGGGAGTTAGCGGGTGGGGAAGTAG (SEQ ID NO:13651), GCGGGTGGGGAAGTAGAGTCGGTAAGG
(SEQ ID NO:13652), GGGGAGTTAGCGGGTGGGGAAGTAGAG (SEQ ID NO:13653),
CGGGTGGGGAAGTAGAGTCGGTAAGGG (SEQ ID NO:13654)

Target1446     chr14:60976879-60976899     AGGAGTTGGGAGCGCGGTTTGTTTTGG (SEQ ID NO:13655), AGTTGGGAGCGCGGTTTGTTTTGGGTT
(SEQ ID NO:13656), GAGTTGGGAGCGCGGTTTGTTTTGGGT (SEQ ID NO:13657),
GGAGTTGGGAGCGCGGTTTGTTTTGGG (SEQ ID NO:13658), AGTTGGGAGCGCGGTTTGTTTTGGGT
(SEQ ID NO:13659), TCGGGATTAGTTGTTGTAGTTGTTCGTAGGC (SEQ ID NO:13660),
TGGTTTGGTGATCGGGATTAGTTGTTGTAGT (SEQ ID NO:13661),
CGTTTTAGTGAAGTTTTGGTTTGGTGATCGGG (SEQ ID NO:13662),
GGTGATCGGGATTAGTTGTTGTAGTTGTCGT (SEQ ID NO:13663),
TGGTGATCGGGATTAGTTGTTGTAGTTGTTCG (SEQ ID NO:13664)

Target1447     chr14:61104242-61104720     CGTCGCGGCGGTAGTTGTTTACGTTGT (SEQ ID NO:13665), TCGGAGGGGGGGTTTAGGTTTTACGCGT
(SEQ ID NO:13666), TGGTTTGGAGGTCGCGCGGTTTAAGTT (SEQ ID NO:13667),
ATGGTTTGGAGGTCGCGCGGTTTAAGT (SEQ ID NO:13668), CGCGAGGGAGTTGAGTGAGGTTTTTGCG
(SEQ ID NO:13669), AGTATAGGTTGGGGGGGAGGGTTGGGGT (SEQ ID NO:13670),
GGTTGGGGTCGCGGTTGGAAGGTTTTT (SEQ ID NO:13671), TTTGTTTTAGGGGTTTGGGTCGCGCGG
(SEQ ID NO:13672), GTTTTAGGGGTTTGGGTCGCGCGGTTT (SEQ ID NO:13673),
TTTAGGGGTTTGGGTCGCGCGGTTTTT (SEQ ID NO:13674)

Target1448     chr14:61104754-61104791     TCGGAGGGGGGGTTTAGGTTTTACGCGT (SEQ ID NO:13675), CGGAGGGGGGGTTTAGGTTTTACGCGTT
(SEQ ID NO:13676), TCGGAGGGGGGGTTTAGGTTTTACGCGTT (SEQ ID NO:13677),
TTCGGAGGGGGGGTTTAGGTTTTACGCGT (SEQ ID NO:13678), TTCGGAGGGGGGGTTTAGGTTTTACGCG
(SEQ ID NO:13679), TCGGTTTGGAGTTGATGGAGGGGAAAGT (SEQ ID NO:13680),
TTCGGTTTGGAGTTGATGGAGGGGAAAGT (SEQ ID NO:13681), TGAATTCGGTTTGGAGTTGATGGAGGGA
(SEQ ID NO:13682), ATTCGGTTTGGAGTTGATGGAGGGGAAAGT (SEQ ID NO:13683),
TGAATTCGGTTTGGAGTTGATGGAGGGAA (SEQ ID NO:13684)

Target1449     chr14:61104836-61104851     TTGTTGGGGGAGATGTGGGCGTAGGAG (SEQ ID NO:13685), TTGTGTTTGTTGGGGGGAGATGTGGGCG
(SEQ ID NO:13686), TTTGTTGGGGGAGATGTGGGCGTAGGA (SEQ ID NO:13687),
TGTGTTTGTTGGGGGAGATGTGGGCGT (SEQ ID NO:13688), GTTTGTTGGGGGAGATGTGGGCGTAGG
(SEQ ID NO:13689), CGTTCGGTTTGATGTGGGGATAAAAATTTTGGA (SEQ ID NO:13690),
TCGTTCGGTTTGATGTGGGGATAAAAATTTTGG (SEQ ID NO:13691),
TCGTTCGGTTTGATGTGGGGATAAAAATTTTGGA (SEQ ID NO:13692),
CGTTCGGTTTGATGTGGGGATAAAAATTTTGGAT (SEQ ID NO:13693),
ATCGTTCGGTTTGATGTGGGGATAAAAATTTTGG (SEQ ID NO:13694)

Target1450     chr14:73712422-73713084     TTTGGTCGCGGGTTGTTGGGTTGGTTT (SEQ ID NO:13695), TTTTGGTCGCGGGTTGTTGGGTTGGTT (SEQ
ID NO:13696), TTTTTGGTCGCGGGTTGTTGGGTTGGT (SEQ ID NO:13697),
TCGTTTTTGGTCGCGGGTTGTTGGGTT (SEQ ID NO:13698), TTCGTTTTTGGTCGCGGGTTGTTGGGT (SEQ

FIGURE 5 CONTINUED

|  |  | ID NO:13699), CGGAGTCGTCGGAGGTGGAGTTCGTTT (SEQ ID NO:13700), GGGGAAATCGGTTAGGAGGGGTTGGGG (SEQ ID NO:13701), GGGAAGTCGGGATTTAGGAGGGCGGAG (SEQ ID NO:13702), GAGGGGAAGTCGGGATTTAGGAGGGCG (SEQ ID NO:13703), GCGGAGGGGAAGTCGGGATTTAGGAGG (SEQ ID NO:13704) |
| Target1451 | chr14:77491793-77492862 | TGGAATGGGGTTTTAGAGGTGGGGGGCG (SEQ ID NO:13705), TTCGGTTGAGTTCGGGGGGTTTCGGAGA (SEQ ID NO:13706), TGGGGGGGTTGATTTAGGTGGGGTGGTT (SEQ ID NO:13707), TTGGGGGGGTTGATTTAGGTGGGGTGGT (SEQ ID NO:13708), GGTAGGGTTGGGGTAGTATGTCGGCGT (SEQ ID NO:13709), AGTGGATGGCGAATTAGAGCGAGGCGT (SEQ ID NO:13710), TTCGTGTCGGGGTAGCGTCGTTTGGTA (SEQ ID NO:13711), TCGTGTCGGGGTAGCGTCGTTTGGTAT (SEQ ID NO:13712), TTTCGTGTCGGGGTAGCGTCGTTTGGT (SEQ ID NO:13713), GGTTTTCGTGTCGGGGTAGCGTCGTTT (SEQ ID NO:13714) |
| Target1452 | chr14:93153236-93153428 | GACGGAGGGGAGTGGGTCGGGTTTTTT (SEQ ID NO:13715), TTCGGTTATAAGGGGGTAGTTTCGCGC (SEQ ID NO:13716), GACGGAGGGGAGTGGGTCGGGTTTTT (SEQ ID NO:13717), ACGGAGGGAGTGGGTCGGGTTTTTT (SEQ ID NO:13718), ATTCGGTTATAAGGGGGTAGTTTCGCGC (SEQ ID NO:13719), AGGGTTGTAGGGTAGAGAGGTTGCGCGC (SEQ ID NO:13720), CGGGTTGAGGATTTCGGTTCGGCGGAGA (SEQ ID NO:13721), GAGAGGTTGCGCGCGGGGGTTGTTTTTT (SEQ ID NO:13722), TAGGCGTTGGAAGTTTCGGTTCGGAGC (SEQ ID NO:13723), TAGAGAGGTTGCGCGCGGGGTTGTTTT (SEQ ID NO:13724) |
| Target1453 | chr14:93153466-93153595 | AGTTTTGAGTTTCGGGGAAGGCGAGGT (SEQ ID NO:13725), GGTCGTTTCGGGTCGGAGTTTTTAGCG (SEQ ID NO:13726), AGGTCGTTTCGGGTCGGAGTTTTTAGCG (SEQ ID NO:13727), GTTTTGAGTTTCGGGGAAGGCGAGGTC (SEQ ID NO:13728), AGTTTTGAGTTTCGGGGAAGGCGAGGTC (SEQ ID NO:13729), CGTTTGCGGGTTGGGGTTGGGTATTCG (SEQ ID NO:13730), TGCGGGTTGGGGTTGGGTATTCGTAGT (SEQ ID NO:13731), GTTTGCGGGTTGGGGTTGGGTATTCGT (SEQ ID NO:13732), TAGGCGTTGGAAGTTTCGGTTCGGAGC (SEQ ID NO:13733), GCGAGTAGGCGTTGGAAGTTTCGGTTCG (SEQ ID NO:13734) |
| Target1454 | chr14:93153630-93153691 | TTGGGTTTTTAGGGGTGGAGGACGGCG (SEQ ID NO:13735), GGTGTGGGGTTGGGTTTTTAGGGGTGG (SEQ ID NO:13736), GTTGGGTTTTTAGGGGTGGAGGACGGC (SEQ ID NO:13737), TGGGGTTGGGTTTTTAGGGGTGGAGGA (SEQ ID NO:13738), GTGGGGTTGGGTTTTTAGGGGTGGAGG (SEQ ID NO:13739), ATTGGTAAAGCGGGAGGGGATCGGGTG (SEQ ID NO:13740), GGGTAGGGATTGGTAAAGCGGGAGGGG (SEQ ID NO:13741), GGGGTAGGGATTGGTAAAGCGGGAGGG (SEQ ID NO:13742), GATTGGTAAAGCGGGAGGGGATCGGGT (SEQ ID NO:13743), TGGGGTTTTGAGGAGTTGCGTGGGGTA (SEQ ID NO:13744) |
| Target1455 | chr14:93153713-93153873 | TTGGGTTTTTAGGGGTGGAGGACGGCG (SEQ ID NO:13745), GGTGTGGGGTTGGGTTTTTAGGGGTGG (SEQ ID NO:13746), GTTGGGTTTTTAGGGGTGGAGGACGGC (SEQ ID NO:13747), TGGGGTTGGGTTTTTAGGGGTGGAGGA (SEQ ID NO:13748), GTGGGGTTGGGTTTTTAGGGGTGGAGG (SEQ ID NO:13749), ATTGGTAAAGCGGGAGGGGATCGGGTG (SEQ ID NO:13750), GGGTAGGGATTGGTAAAGCGGGAGGGG (SEQ ID NO:13751), GGGGTAGGGATTGGTAAAGCGGGAGGG (SEQ ID NO:13752), GATTGGTAAAGCGGGAGGGGATCGGGT (SEQ ID NO:13753), TGGGGTTTTGAGGAGTTGCGTGGGGTA (SEQ ID NO:13754) |
| Target1456 | chr14:93154010-93154728 | GGACGGGCGTTGTTTTTTAGTTGGCGGA (SEQ ID NO:13755), CGGGCGGGAGTTCGTTTTGTTTGGTGGT (SEQ ID NO:13756), CGGGCGTTGTTTTTAGTTGGCGGACGA (SEQ ID NO:13757), TGGGAAGTTAGGTAGGGAGGGGGACGG (SEQ ID NO:13758), GGAAGTTAGGTAGGGAGGGGGACGGGT (SEQ ID NO:13759), GGGTTTGTGGTTACGGCGGGGTTTTGT (SEQ ID NO:13760), GAGGGGAGGCGTTTCGGAGGGGTTTTA (SEQ ID NO:13761), AGTGGAAGTCGCGTTTGGGTTCGTTGC (SEQ ID NO:13762), TGGCGGGCGTTAAGTTGTTTGCGAGTT (SEQ ID NO:13763), TAGAGGCGGGGTTAGACGTGCGTTTGG (SEQ ID NO:13764) |
| Target1457 | chr14:93522233-93522387 | TGATGAGGTTGGGGTAGGTGAGGTGTT (SEQ ID NO:13765), TTGATGAGGTTGGGGTAGGTGAGGTGT (SEQ ID NO:13766), TGATGAGGTTGGGGTAGGTGAGGTGTTT (SEQ ID NO:13767), TTGATGAGGTTGGGGTAGGTGAGGTGTT (SEQ ID NO:13768), GATGAGGTTGGGGTAGGTGAGGTGTTT (SEQ ID NO:13769) |
| Target1458 | chr14:97499613-97499723 | CGGGGTCGTAGTAGTTTTAGTTTTTTGGCG (SEQ ID NO:13770), CGGGGTCGTAGTAGTTTTAGTTTTTTGGCGT (SEQ ID NO:13771), CGGGGTCGTAGTAGTTTTAGTTTTTTGGCGTT (SEQ ID NO:13772), GGGGTCGTAGTAGTTTTAGTTTTTTGGCGTT (SEQ ID NO:13773), CGGGGTCGTAGTAGTTTTAGTTTTTTGGCGTTT (SEQ ID NO:13774), GTCGGTTAGGAGTTGGGGCGGGAGTC (SEQ ID NO:13775), CGGGGCGAGGGAAGGTATTTGTTTTGGG (SEQ ID NO:13776), ACGCGTTGGGTCGGTTAGGAGTTGGG (SEQ ID NO:13777), GGTCGGTTAGGAGTTGGGGCGGGAGTC (SEQ ID NO:13778), CGGGGCGAGGGAAGGTATTTGTTTTGG (SEQ ID NO:13779) |
| Target1459 | chr14:97499764-97499857 | GGGCGCGGGATTTTAGTAGGTGAGGGT (SEQ ID NO:13780), CGGGCGCGGGATTTTAGTAGGTGAGGG (SEQ ID NO:13781), GCGGGCGCGGGATTTTAGTAGGTGAGG (SEQ ID NO:13782), GGGCGCGGGATTTTAGTAGGTGAGGGTT (SEQ ID NO:13783), GGCGCGGGATTTTAGTAGGTGAGGGTT (SEQ ID NO:13784), GGTTACGCGTGGGGATAGAGGAGGTCG (SEQ ID NO:13785), GTTACGCGTGGGGATAGAGGAGGTCGA (SEQ ID NO:13786), AGGTTACGCGTGGGGATAGAGGAGGTC (SEQ ID NO:13787), GTCGGTTAGGAGTTGGGGCGGGAGTC (SEQ ID NO:13788), TTACGCGTGGGGATAGAGGAGGTCGAA (SEQ ID NO:13789) |

FIGURE 5 CONTINUED

| | | |
|---|---|---|
| Target1460 | chr14:97499908-97499941 | TATGTTTTCGGGGCGCGGCGTAGTAGT (SEQ ID NO:13790), TGTATGTTTTCGGGGCGCGGCGTAGTA (SEQ ID NO:13791), GTATGTTTTCGGGGCGCGGCGTAGTAG (SEQ ID NO:13792), GTTGTATGTTTTCGGGGCGCGGCGTAG (SEQ ID NO:13793), GGTGTCGCGGTGGGTATTTGTTCGGTT (SEQ ID NO:13794), GGGAGGAGTTGGACGCGCGGTTTTC (SEQ ID NO:13795), CGGCGTAGTTTTGGGTTTGTATCGTGGG (SEQ ID NO:13796), CGGCGTAGTTTTGGGTTTGTATCGTGGGA (SEQ ID NO:13797), TCGGCGTAGTTTTGGGTTTGTATCGTGGG (SEQ ID NO:13798), AATTTAGGTTCGGGAGGAGTTGGACGC (SEQ ID NO:13799) |
| Target1461 | chr14:97499959-97499972 | TATGTTTTCGGGGCGCGGCGTAGTAGT (SEQ ID NO:13800), TGTATGTTTTCGGGGCGCGGCGTAGTA (SEQ ID NO:13801), GTATGTTTTCGGGGCGCGGCGTAGTAG (SEQ ID NO:13802), GGTGTCGCGGTGGGTATTTGTTCGGTT (SEQ ID NO:13803), TTGGTGTCGCGGTGGGTATTTGTTCGG (SEQ ID NO:13804), GGGAGGAGTTGGACGCGCGGTTTTC (SEQ ID NO:13805), AATTTAGGTTCGGGAGGAGTTGGACGC (SEQ ID NO:13806), GGGAGGAGTTGGACGCGCGCGGTTTT (SEQ ID NO:13807), TGCGTTGTTTGAGAAGTTGGGGTTACG (SEQ ID NO:13808), TGCGTTGTTTGAGAAGTTGGGGTTACGA (SEQ ID NO:13809) |
| Target1462 | chr14:100857049-100857175 | TGGGGGTTGTGTAGCGTTTAGTGTTTGA (SEQ ID NO:13810), TTGGGGGTTGTGTAGCGTTTAGTGTTTG (SEQ ID NO:13811), TTCGGTATTTGAGTTGGGGAAGAGGGTT (SEQ ID NO:13812), TTTCGGTATTTGAGTTGGGGAAGAGGGT (SEQ ID NO:13813), TTGGGGGTTGTGTAGCGTTTAGTGTTTGA (SEQ ID NO:13814), TTGTCGTTGTGGAGGGTGAGAAGACGT (SEQ ID NO:13815), TGTCGTTGTGGAGGGTGAGAAGACGTA (SEQ ID NO:13816), TTTGTCGTTGTGGAGGGTGAGAAGACGT (SEQ ID NO:13817), TTTGTCGTTGTGGAGGGTGAGAAGACG (SEQ ID NO:13818), TGTCGTTGTGGAGGGTGAGAAGACGT (SEQ ID NO:13819) |
| Target1463 | chr14:100857249-100857281 | TGGGGGTTGTGTAGCGTTTAGTGTTTGA (SEQ ID NO:13820), TTGGGGGTTGTGTAGCGTTTAGTGTTTG (SEQ ID NO:13821), TTGGGGGTTGTGTAGCGTTTAGTGTTTGA (SEQ ID NO:13822), TGGGGGTTGTGTAGCGTTTAGTGTTTGAT (SEQ ID NO:13823), TTTGGGGGTTGTGTAGCGTTTAGTGTTTG (SEQ ID NO:13824), GGGGGGAAGAGGGTAAAATATGATGAAAGGT (SEQ ID NO:13825), GGGGGGAAGAGGGTAAAATATGATGAAAGGTT (SEQ ID NO:13826), AGGGAAAGGGTTAGAGATTTGATAGCGAAAAATGT (SEQ ID NO:13827), GGGGGGAAGAGGGTAAAATATGATGAAAGGTTAAT (SEQ ID NO:13828), AGGGAAAGGGTTAGAGATTTGATAGCGAAAAATGTT (SEQ ID NO:13829) |
| Target1464 | chr14:104155814-104156033 | AGTGTTGGGGGTTGTTGGTTCGGGGTTA (SEQ ID NO:13830), TAGTGTTGGGGGTTGTTGGTTCGGGGTT (SEQ ID NO:13831), ATAGTGTTGGGGGTTGTTGGTTCGGGGT (SEQ ID NO:13832), AGTGTTGGGGGTTGTTGGTTCGGGGTT (SEQ ID NO:13833), GTGTTGGGGGTTGTTGGTTCGGGGTTAT (SEQ ID NO:13834), GGGATTTAGGAATTGGAAATTTAGGGGTGGGG (SEQ ID NO:13835), GGGATTTAGGAATTGGAAATTTAGGGGTGGGGT (SEQ ID NO:13836), AGGGATTTAGGAATTGGAAATTTAGGGGTGGGG (SEQ ID NO:13837), AGGGATTTAGGAATTGGAAATTTAGGGGTGGGGT (SEQ ID NO:13838), GGATTTAGGAATTGGAAATTTAGGGGTGGGGT (SEQ ID NO:13839) |
| Target1465 | chr14:104156111-104156182 | AGTGTTGGGGGTTGTTGGTTCGGGGTTA (SEQ ID NO:13840), TAGTGTTGGGGGTTGTTGGTTCGGGGTT (SEQ ID NO:13841), ATAGTGTTGGGGGTTGTTGGTTCGGGGT (SEQ ID NO:13842), AGTGTTGGGGGTTGTTGGTTCGGGGTT (SEQ ID NO:13843), GTGTTGGGGGTTGTTGGTTCGGGGTTAT (SEQ ID NO:13844) |
| Target1466 | chr14:105750359-105750500 | GTGGAGAGGAAGAGGGATGTGTTGCGT (SEQ ID NO:13845), AGTGGAGAGGAAGAGGGATGTGTTGCGT (SEQ ID NO:13846), AGTGGAGAGGAAGAGGGATGTGTTGCG (SEQ ID NO:13847), TGGAGAGGAAGAGGGATGTGTTGCGTT (SEQ ID NO:13848), GGAGAGGAAGAGGGATGTGTTGCGTTGT (SEQ ID NO:13849), TGTGGACGTGTATGTGTGTTGGGCGTT (SEQ ID NO:13850), TTGTGGACGTGTATGTGTGTTGGGCGT (SEQ ID NO:13851), TGTGGACGTGTATGTGTGTTGGGCGTTT (SEQ ID NO:13852), TTGTGGACGTGTATGTGTGTTGGGCGTT (SEQ ID NO:13853), TTTGTGGACGTGTATGTGTGTTGGGCGT (SEQ ID NO:13854) |
| Target1467 | chr14:105750529-105750596 | GTGGAGAGGAAGAGGGATGTGTTGCGT (SEQ ID NO:13855), AGTGGAGAGGAAGAGGGATGTGTTGCGT (SEQ ID NO:13856), AGTGGAGAGGAAGAGGGATGTGTTGCG (SEQ ID NO:13857), TGGAGAGGAAGAGGGATGTGTTGCGTT (SEQ ID NO:13858), GGAGAGGAAGAGGGATGTGTTGCGTTGT (SEQ ID NO:13859), GGGTTTGCGATGATTTTTTATAGTAGAGTGGATGGA (SEQ ID NO:13860) |
| Target1468 | chr14:106330434-106330539 | TGAGGAGACGGTGATTAGGGTTTTTTGGT (SEQ ID NO:13861), TGAGGAGACGGTGATTAGGGTTTTTTGGTT (SEQ ID NO:13862), TTGAGGAGACGGTGATTAGGGTTTTTTGGT (SEQ ID NO:13863), TGAGGAGACGGTGATTAGGGTTTTTTGGTTT (SEQ ID NO:13864), TTGAGGAGACGGTGATTAGGGTTTTTTGGTT (SEQ ID NO:13865), GGGTTGGTTGTTACGGTCGGTTCGGGA (SEQ ID NO:13866), ACGGGGTTGGTTGTTACGGTCGGTTCG (SEQ ID NO:13867), GGATACGGGGTTGGTTGTTACGGTCGGT (SEQ ID NO:13868), GGATACGGGGTTGGTTGTTACGGTCGG (SEQ ID NO:13869), GGTTGGTTGTTACGGTCGGTTCGGGAT (SEQ ID NO:13870) |
| Target1469 | chr14:106330669-106330724 | GGAGTTTCGGAGGGGTTTTATATGGTTTAGCGT (SEQ ID NO:13871), AGGAGTTTCGGAGGGGTTTTATATGGTTTAGCG (SEQ ID NO:13872), AGGAGTTTCGGAGGGGTTTTATATGGTTTAGCGT (SEQ ID NO:13873), AAGGAGTTTCGGAGGGGTTTTATATGGTTTAGCG (SEQ ID NO:13874), |

FIGURE 5 CONTINUED

|  |  |  |
|---|---|---|
|  |  | AAGGAGTTTCGGAGGGTTTTATATGGTTTAGCGT (SEQ ID NO:13875),<br>CGGGGGTTTTTTGGTTTGCGTTGGGTT (SEQ ID NO:13876), TCGGGGGTTTTTTGGTTTGCGTTGGGTT<br>(SEQ ID NO:13877), GCGTTGGGTTATGTGGGGTTTTTCGGGG (SEQ ID NO:13878),<br>TGCGTTGGGTTATGTGGGGTTTTTCGGG (SEQ ID NO:13879), GCGTTGGGTTATGTGGGGTTTTTCGGG<br>(SEQ ID NO:13880) |
| Target1470 | chr15:22908326-22908385 | TTGGGTAGGTAGACGGGGTTGGGGTTG (SEQ ID NO:13881), TGGGTAGGTAGACGGGGTTGGGGTTGG<br>(SEQ ID NO:13882), GGGTAGGTAGACGGGGTTGGGGTTGGT (SEQ ID NO:13883),<br>TTTGGGTAGGTAGACGGGGTTGGGGTT (SEQ ID NO:13884), ATTTGGGTAGGTAGACGGGGTTGGGGT<br>(SEQ ID NO:13885), AGTGTAGTCGGCGAAGATGTTACGGGT (SEQ ID NO:13886),<br>AAGTGTAGTCGGCGAAGATGTTACGGGT (SEQ ID NO:13887), AAGTGTAGTCGGCGAAGATGTTACGGG<br>(SEQ ID NO:13888), GTGTAGTCGGCGAAGATGTTACGGGTA (SEQ ID NO:13889),<br>AGTGTAGTCGGCGAAGATGTTACGGGTA (SEQ ID NO:13890) |
| Target1471 | chr15:22908489-22908561 | TTTCGGGGAGTTGTCGGGTAGGGGAAA (SEQ ID NO:13891), TTTTCGGGGAGTTGTCGGGTAGGGGAA<br>(SEQ ID NO:13892), TTTTTCGGGGAGTTGTCGGGTAGGGGA (SEQ ID NO:13893),<br>TCGGGGAGTTGTCGGGTAGGGGAAATT (SEQ ID NO:13894), TTCGGGGAGTTGTCGGGTAGGGGAAAT<br>(SEQ ID NO:13895), TGTTCGGTAGTTTTTCGGGGAGTCGGG (SEQ ID NO:13896),<br>TGTTCGGTAGTTTTTCGGGGAGTCGGGA (SEQ ID NO:13897), GTTCGGTAGTTTTTCGGGGAGTCGGGA<br>(SEQ ID NO:13898), TTCGGTAGTTTTTCGGGGAGTCGGGAA (SEQ ID NO:13899),<br>TCGGTAGTTTTTCGGGGAGTCGGGAAT (SEQ ID NO:13900) |
| Target1472 | chr15:27112861-27113062 | TCGGTTGGGGGTGGGGGATATTCGTTG (SEQ ID NO:13901), CGTTGTTCGCGGGGTGGATTCGGATTT<br>(SEQ ID NO:13902), CGGTTGGGGGTGGGGGATATTCGTTGT (SEQ ID NO:13903),<br>CGGGCGGTTTATTTTTGTCGGACGGGG (SEQ ID NO:13904), GGTGATCGGTTGGGGGTGGGGGATATT<br>(SEQ ID NO:13905), TTTTTTGGGTTGGGAGCGCGCGGTGTA (SEQ ID NO:13906),<br>TTTTTGGGTTGGGAGCGCGCGGTGTAG (SEQ ID NO:13907), TTTGGGTTGGGAGCGCGCGGTGTAGTA<br>(SEQ ID NO:13908), CGCGTTTTAGAGTTTCGGGGTTGACGT (SEQ ID NO:13909),<br>TTGGGTTGGGAGCGCGCGGTGTAGTAG (SEQ ID NO:13910) |
| Target1473 | chr15:27113091-27113120 | CGGGGTAGGAGTAGGGGAAGTTTGCGA (SEQ ID NO:13911), TCGGGGTAGGAGTAGGGGAAGTTTGCG<br>(SEQ ID NO:13912), GCGCGGGTTGTTCGAGGTTAGGGGATT (SEQ ID NO:13913),<br>CGCGGGTTGTTCGAGGTTAGGGGATTT (SEQ ID NO:13914), TCGGGGTAGGAGTAGGGGAAGTTTGCGA<br>(SEQ ID NO:13915), TTTGGGTCGTTTTGGTATTCGCGGTCG (SEQ ID NO:13916),<br>GTTTGGGTCGTTTTGGTATTCGCGGTCG (SEQ ID NO:13917), GGTAGGTGGGCGCGGGGGTTGTATTG<br>(SEQ ID NO:13918), GTAGGTGGGCGCGGGGGTTGTATTG (SEQ ID NO:13919),<br>TAGGGTAGGTGGGCGCGGGGGGTTGTAT (SEQ ID NO:13920) |
| Target1474 | chr15:27113137-27113160 | TCGGGGAGTTGGAGATTTTCGGCGTGT (SEQ ID NO:13921), TTGGAGATTTTCGGCGTGTCGTTGCGG<br>(SEQ ID NO:13922), AGGGTCGGGGAGTTGGAGATTTTCGGC (SEQ ID NO:13923),<br>GGGGAGTTGGAGATTTTCGGCGTGTCG (SEQ ID NO:13924), CGGGGAGTTGGAGATTTTCGGCGTGTC<br>(SEQ ID NO:13925), ATTAGGGTCGGCGCGTTAGGGTAGGTG (SEQ ID NO:13926),<br>TTAGGGTCGGCGCGTTAGGGTAGGTG (SEQ ID NO:13927), TATTAGGGTCGGCGCGTTAGGGTAGGT<br>(SEQ ID NO:13928), TTAGGGTCGGCGCGTTAGGGTAGGTGG (SEQ ID NO:13929),<br>GGTTTATTAGGGTCGGCGCGTTAGGGT (SEQ ID NO:13930) |
| Target1475 | chr15:27113170-27113203 | TCGGGGAGTTGGAGATTTTCGGCGTGT (SEQ ID NO:13931), GCGGGTGTTAGGGCGATTTAGGTTGCG<br>(SEQ ID NO:13932), TTGGAGATTTTCGGCGTGTCGTTGCGG (SEQ ID NO:13933),<br>AGGGTCGGGGAGTTGGAGATTTTCGGC (SEQ ID NO:13934), CGGGTGTTAGGGCGATTTAGGTTGCGG<br>(SEQ ID NO:13935), ATTAGGGTCGGCGCGTTAGGGTAGGTG (SEQ ID NO:13936),<br>TTAGGGTCGGCGCGTTAGGGTAGGTG (SEQ ID NO:13937), TATTAGGGTCGGCGCGTTAGGGTAGGT<br>(SEQ ID NO:13938), TTAGGGTCGGCGCGTTAGGGTAGGTGG (SEQ ID NO:13939),<br>GGTTTATTAGGGTCGGCGCGTTAGGGT (SEQ ID NO:13940) |
| Target1476 | chr15:27113216-27113240 | TCGGGGAGTTGGAGATTTTCGGCGTGT (SEQ ID NO:13941), GCGGGTGTTAGGGCGATTTAGGTTGCG<br>(SEQ ID NO:13942), TTGGAGATTTTCGGCGTGTCGTTGCGG (SEQ ID NO:13943),<br>AGGGTCGGGGAGTTGGAGATTTTCGGC (SEQ ID NO:13944), CGGGTGTTAGGGCGATTTAGGTTGCGG<br>(SEQ ID NO:13945), TATGCGGGAAATTCGGGCGGCGTTTTT (SEQ ID NO:13946),<br>ATTAGGGTCGGCGCGTTAGGGTAGGTG (SEQ ID NO:13947), GTATGCGGGAAATTCGGGCGGCGTTTT<br>(SEQ ID NO:13948), ATGCGGGAAATTCGGGCGGCGTTTTTC (SEQ ID NO:13949),<br>TATGCGGGAAATTCGGGCGGCGTTTT (SEQ ID NO:13950) |
| Target1477 | chr15:27113348-27113363 | AGTTTTTGTGGGGGTTCGGAGGGTCGT (SEQ ID NO:13951), TGTTTTGGCGCGTCGGTTTTGGTGAGT<br>(SEQ ID NO:13952), GTTTTTGTGGGGGTTCGGAGGGTCGTG (SEQ ID NO:13953),<br>GGTGAGTTTTTGTGGGGGTTCGGAGGG (SEQ ID NO:13954), TTGGGGGTTTTTGGTTCGGGGGTTGAGG<br>(SEQ ID NO:13955), GGTTCGGGTTAGAGTTAGGCGGCGAGT (SEQ ID NO:13956),<br>GGGTTCGGGTTAGAGTTAGGCGGCGAG (SEQ ID NO:13957), GGGTTCGGGTTAGAGTTAGGCGGCGA<br>(SEQ ID NO:13958), GGGGTTCGGGTTAGAGTTAGGCGGCGA (SEQ ID NO:13959),<br>GGTTCGGGTTAGAGTTAGGCGGCGAGTA (SEQ ID NO:13960) |
| Target1478 | chr15:27113386-27113412 | TTGGGGGTTTTTGGTTCGGGGTTGAGG (SEQ ID NO:13961), TGGGGGTTTTTGGTTCGGGGTTGAGGG<br>(SEQ ID NO:13962), TCGGGTTTTTCGTATGTAGCGTCGCGT (SEQ ID NO:13963),<br>GGGTTTTTGGTTCGGGGTTGAGGGGC (SEQ ID NO:13964), GGGGTTTTTGGTTCGGGGTTGAGGGG (SEQ<br>ID NO:13965), AGAAGGGTAGGGTGTTATGCGGTGGTC (SEQ ID NO:13966),<br>AAGAAGGGTAGGGTGTTATGCGGTGGT (SEQ ID NO:13967), AAGAAGGGTAGGGTGTTATGCGGTGGTC |

FIGURE 5 CONTINUED (SEQ ID NO:13968), AGAAGGGTAGGGTGTTATGCGGTGGT (SEQ ID NO:13969), TAAGAAGGGTAGGGTGTTATGCGGTGGT (SEQ ID NO:13970)

Target1479    chr15:27113413-27113429    TTGGGGGTTTTTGGTTCGGGGTTGAGG (SEQ ID NO:13971), TGGGGGTTTTTGGTTCGGGGTTGAGGG (SEQ ID NO:13972), TCGGGTTTTTCGTATGTAGCGTCGCGT (SEQ ID NO:13973), GGGTTTTTGGTTCGGGGTTGAGGGGC (SEQ ID NO:13974), GGGGTTTTTGGTTCGGGGTTGAGGGG (SEQ ID NO:13975), AGAAGGGTAGGGTGTTATGCGGTGGTC (SEQ ID NO:13976), AAGAAGGGTAGGGTGTTATGCGGTGGT (SEQ ID NO:13977), AAGAAGGGTAGGGTGTTATGCGGTGGTC (SEQ ID NO:13978), AGAAGGGTAGGGTGTTATGCGGTGGT (SEQ ID NO:13979), TAAGAAGGGTAGGGTGTTATGCGGTGGT (SEQ ID NO:13980)

Target1480    chr15:29395738-29395767    GAGTTGGGGTCGGTAGGGCGATTTTTT (SEQ ID NO:13981), GAGTTGGGGTCGGTAGGGCGATTTTTT (SEQ ID NO:13982), AGTTGGGGTCGGTAGGGCGATTTTTT (SEQ ID NO:13983), CGTTTATAGGTTTGGTTGCGAGTTGGGGT (SEQ ID NO:13984), ACGTTTATAGGTTTGGTTGCGAGTTGGGG (SEQ ID NO:13985), CGGTGTTATTTGGGTCGTTGGTGTGTCG (SEQ ID NO:13986), CGGTGTTATTTGGGTCGTTGGTGTGTCGT (SEQ ID NO:13987), TCGGTGTTATTTGGGTCGTTGGTGTGTCG (SEQ ID NO:13988), TCGGTGTTATTTGGGTCGTTGGTGTGT (SEQ ID NO:13989), TCGGTGTTATTTGGGTCGTTGGTGTGTCGT (SEQ ID NO:13990)

Target1481    chr15:29395777-29395803    GCGGTTTAGATGATATCGGAAGGAGGCG (SEQ ID NO:13991), AGCGGTTTAGATGATATCGGAAGGAGGCG (SEQ ID NO:13992), AGCGGTTTAGATGATATCGGAAGGAGGC (SEQ ID NO:13993), TAGCGGTTTAGATGATATCGGAAGGAGGCG (SEQ ID NO:13994), GTGGAGTGACGGGGAGGCGGCGGTTG (SEQ ID NO:13995), TCGGATTTTATTTGGGTTTTTTCGGGTTATCGTT (SEQ ID NO:13996), TTCGGATTTTATTTGGGTTTTTTCGGGTTATCGT (SEQ ID NO:13997), TTCGGATTTTATTTGGGTTTTTTCGGGTTATCGTT (SEQ ID NO:13998), TTTCGGATTTTATTTGGGTTTTTTCGGGTTATCGT (SEQ ID NO:13999), TTTCGGATTTTATTTGGGTTTTTTCGGGTTATCGTT (SEQ ID NO:14000)

Target1482    chr15:29395810-29395819    GCGGTTTAGATGATATCGGAAGGAGGCGT (SEQ ID NO:14001), GCGGTTTAGATGATATCGGAAGGAGGCG (SEQ ID NO:14002), AGCGGTTTAGATGATATCGGAAGGAGGCG (SEQ ID NO:14003), AGCGGTTTAGATGATATCGGAAGGAGGCGT (SEQ ID NO:14004), AGCGGTTTAGATGATATCGGAAGGAGGC (SEQ ID NO:14005), TCGGATTTTATTTGGGTTTTTTCGGGTTATCGTT (SEQ ID NO:14006), TTCGGATTTTATTTGGGTTTTTTCGGGTTATCGT (SEQ ID NO:14007), TTCGGATTTTATTTGGGTTTTTTCGGGTTATCGTT (SEQ ID NO:14008), TTTCGGATTTTATTTGGGTTTTTTCGGGTTATCGT (SEQ ID NO:14009), TTTCGGATTTTATTTGGGTTTTTTCGGGTTATCGTT (SEQ ID NO:14010)

Target1483    chr15:29395962-29395993    AGGAAGAATGGCGGTGGTTCGAGGGAG (SEQ ID NO:14011), GAGGAAGAATGGCGGTGGTTCGAGGGA (SEQ ID NO:14012), GGAAGAATGGCGGTGGTTCGAGGGAGT (SEQ ID NO:14013), GGGCGGAGGATGTCGTTTAAGGGGAGG (SEQ ID NO:14014), GGGGCGGAGGATGTCGTTTAAGGGGAG (SEQ ID NO:14015), GTTGATGGGGTTCGGTAGGAGGGTCGG (SEQ ID NO:14016), GGTTGGTTTGCGGAGTTGGCGAGTTGA (SEQ ID NO:14017), GCGTAGGAGAGGGTCGGGGTTTTTGGGA (SEQ ID NO:14018), GCGAGTTGATGGGGTTCGGTAGGAGGG (SEQ ID NO:14019), GGCGAGTTGATGGGGTTCGGTAGGAGG (SEQ ID NO:14020)

Target1484    chr15:29396043-29396084    GTGGTGGAGTCGGGGTTTTCGGGGTTTT (SEQ ID NO:14021), GGTGGTGGAGTCGGGGTTTTCGGGGTTT (SEQ ID NO:14022), TGGAGTCGGGGTTTTCGGGGTTTTAGGGT (SEQ ID NO:14023), GGAGTCGGGGTTTTCGGGGTTTTAGGGT (SEQ ID NO:14024), TGGAGTCGGGGTTTTCGGGGTTTTAGGG (SEQ ID NO:14025), GTTGATGGGGTTCGGTAGGAGGGTCGG (SEQ ID NO:14026), GGTTGGTTTGCGGAGTTGGCGAGTTGA (SEQ ID NO:14027), GCGAGTTGATGGGGTTCGGTAGGAGGG (SEQ ID NO:14028), GGCGAGTTGATGGGGTTCGGTAGGAGG (SEQ ID NO:14029), TGGTTTGCGGAGTTGGCGAGTTGATGG (SEQ ID NO:14030)

Target1485    chr15:37180583-37180588    GGGGTCGGGGTTGGGAGAAAGTGTCG (SEQ ID NO:14031), CGGGGTCGGGGTTGGGAGAAAGTGTC (SEQ ID NO:14032), GTCGGGGTTGGGAGAAAGTGTCGCGT (SEQ ID NO:14033), GGGTCGGGGTTGGGAGAAAGTGTCGC (SEQ ID NO:14034), GTCGGGGTTGGGAGAAAGTGTCGCGCG (SEQ ID NO:14035)

Target1486    chr15:37180634-37180639    GGAGGGGGTTCGTTTCGGCGCG (SEQ ID NO:14036), CGGAGGGGGTTCGTTTCGGCGC (SEQ ID NO:14037), GAGGGGGTTCGTTTCGGCGCGC (SEQ ID NO:14038), CGGAGGGGGTTCGTTTCGGCGCG (SEQ ID NO:14039), GGAGGGGGTTCGTTTCGGCGCGC (SEQ ID NO:14040), TGTAAATTATGGGGGTACGGGGGGGTTCG (SEQ ID NO:14041), GTAAATTATGGGGGTACGGGGGGGTTCG (SEQ ID NO:14042), TGTAAATTATGGGGGTACGGGGGGGTTC (SEQ ID NO:14043), TTGTAAATTATGGGGGTACGGGGGGGTTCG (SEQ ID NO:14044), TTGTAAATTATGGGGGTACGGGGGGGTTC (SEQ ID NO:14045)

Target1487    chr15:41787560-41787839    GGGAGAGTTGTGGTCGCGCGTTTGTTT (SEQ ID NO:14046), AGAGTTGTGGTCGCGCGTTTGTTTCGT (SEQ ID NO:14047), TAGGTGTTGGGTGCGTCGGTTCGGTTA (SEQ ID NO:14048), AGGTGTTGGGTGCGTCGGTTCGGTTAT (SEQ ID NO:14049), GTCGTTAGGTGTTGGGTGCGTCGGTTC (SEQ ID NO:14050), AGTATTTGGCGGCGGGGGGGTGTTTTTG (SEQ ID NO:14051),

FIGURE 5 CONTINUED

GCGGTAGGTTAGTGATCGAGTCGGCGT (SEQ ID NO:14052), GCGTATTTAGTATTTGGCGGCGGGGGG
{SEQ ID NO:14053}, AGCGGTAGGTTAGTGATCGAGTCGGCG (SEQ ID NO:14054),
GCGGGAGTAGGCGCGCGGTTATAGTTTT {SEQ ID NO:14055}

Target1488    chr15:41787877-41787949    TAGGTGTTGGGTGCGTCGGTTCGGTTA (SEQ ID NO:14056), AGGTGTTGGGTGCGTCGGTTCGGTTAT
{SEQ ID NO:14057}, GTCGTTAGGTGTTGGGTGCGTCGGTTC (SEQ ID NO:14058),
TTAGGTGTTGGGTGCGTCGGTTCGGTT {SEQ ID NO:14059}, GGTGTTGGGTGCGTCGGTTCGGTTATT
{SEQ ID NO:14060}, CGAGTTTTTGCGGGCGGAAGAGGGAAG {SEQ ID NO:14061},
GAGTTTTTGCGGGCGGAAGAGGGAAGC {SEQ ID NO:14062}, TTCGTCGAGTTTTTGCGGGCGGAAGAG
{SEQ ID NO:14063}, GGCGGGGCGGGGGGGTTTTTTATTGTTT {SEQ ID NO:14064},
TCGAGTTTTTGCGGGCGGAAGAGGGAA {SEQ ID NO:14065}

Target1489    chr15:41787977-41788111    TCGGCGAAGTGTTTGGGAGAGGGAGTG {SEQ ID NO:14066}, TGGGAGAGGGAGTGCGTTAGGAGGAGG
{SEQ ID NO:14067}, GGGAGAGGGAGTGCGTTAGGAGGAGGT {SEQ ID NO:14068},
TTCGGCGAAGTGTTTGGGAGAGGGAGT {SEQ ID NO:14069}, GGGAGTGCGTTAGGAGGAGGTTTTGCG
{SEQ ID NO:14070}, CGAGTTTTTGCGGGCGGAAGAGGGAAG {SEQ ID NO:14071},
GAGTTTTTGCGGGCGGAAGAGGGAAGC {SEQ ID NO:14072}, TTCGTCGAGTTTTTGCGGGCGGAAGAG
{SEQ ID NO:14073}, TCGAGTTTTTGCGGGCGGAAGAGGGAA {SEQ ID NO:14074},
TTTCGTCGAGTTTTTGCGGGCGGAAGA {SEQ ID NO:14075}

Target1490    chr15:41788184-41788200    TCGGCGAAGTGTTTGGGAGAGGGAGTG {SEQ ID NO:14076}, TGGGAGAGGGAGTGCGTTAGGAGGAGG
{SEQ ID NO:14077}, GGGAGAGGGAGTGCGTTAGGAGGAGGT {SEQ ID NO:14078},
TTCGGCGAAGTGTTTGGGAGAGGGAGT {SEQ ID NO:14079}, GGAGTGCGTTAGGAGGAGGTTTTGCGG
{SEQ ID NO:14080}, GATTTCGGGGAGGTTTCGGCGGGGTTTG {SEQ ID NO:14081},
GTTTGATTTCGGGGAGGTTTCGGCGGG {SEQ ID NO:14082}, GGGGGTGGGGAAGGTTTGGAAGTCGTA
{SEQ ID NO:14083}, TTGGGGGTGGGGAAGGTTTGGAAGTCG {SEQ ID NO:14084},
TGTTTGATTTCGGGGAGGTTTCGGCGG {SEQ ID NO:14085}

Target1491    chr15:41788209-41788242    GGAGTGCGTTAGGAGGAGGTTTTGCGG {SEQ ID NO:14086}, GGGAGTGCGTTAGGAGGAGGTTTTGCG
{SEQ ID NO:14087}, GAGTGCGTTAGGAGGAGGTTTTGCGGT {SEQ ID NO:14088},
AGTGCGTTAGGAGGAGGTTTTGCGGTT {SEQ ID NO:14089}, GGAGTGCGTTAGGAGGAGGTTTTGCGGT
{SEQ ID NO:14090}, GATTTCGGGGAGGTTTCGGCGGGGTTTG {SEQ ID NO:14091},
GTTTGATTTCGGGGAGGTTTCGGCGGG {SEQ ID NO:14092}, GGGGGTGGGGAAGGTTTGGAAGTCGTA
{SEQ ID NO:14093}, TTGGGGGTGGGGAAGGTTTGGAAGTCG {SEQ ID NO:14094},
TGTTTGATTTCGGGGAGGTTTCGGCGG {SEQ ID NO:14095}

Target1492    chr15:41793563-41793583    TTTAGTTGTTTTCGGTGGGTCGGGGGC {SEQ ID NO:14096}, TTAGTTGTTTTCGGTGGGTCGGGGGCG
{SEQ ID NO:14097}, TTTTAGTTGTTTTCGGTGGGTCGGGGGC {SEQ ID NO:14098},
TTAGTTGTTTTCGGTGGGTCGGGGGC {SEQ ID NO:14099}, TAGTTGTTTTCGGTGGGTCGGGGGCG {SEQ
ID NO:14100}, GGGTTAAGGTTTGATAATCGGCGTTTCGG {SEQ ID NO:14101},
GGGTTAAGGTTTGATAATCGGCGTTTCGGT {SEQ ID NO:14102},
AGGGTTAAGGTTTGATAATCGGCGTTTCGG {SEQ ID NO:14103},
AGGGTTAAGGTTTGATAATCGGCGTTTCGGT {SEQ ID NO:14104},
GGTTAAGGTTTGATAATCGGCGTTTCGGT {SEQ ID NO:14105}

Target1493    chr15:41793621-41794126    GCGTGTTTTGTTAGGTCGGTTGGGGGG {SEQ ID NO:14106}, TGGGGGGGATTAAGTAGGGGTTCGGGGT
{SEQ ID NO:14107}, GTCGGGGGCGTGGCGAGATTTTGTTTT {SEQ ID NO:14108},
CGGGGTCGGGATAGTTGTTTGAGGGGG {SEQ ID NO:14109}, ATATTGGTGAGTAGTGGGGCGGGTGGG
{SEQ ID NO:14110}, AGGTAGCGGTTAGGGTATGAGGGGGCG {SEQ ID NO:14111},
GGTAGCGGTTAGGGTATGAGGGGGCG {SEQ ID NO:14112}, GTAGCGGTTAGGGTATGAGGGGGCGTA
{SEQ ID NO:14113}, GGTAGCGGTTAGGGTATGAGGGGGCGT {SEQ ID NO:14114},
TAGGTAGCGGTTAGGGTATGAGGGGGCG {SEQ ID NO:14115}

Target1494    chr15:41794130-41795305    GCGTGTTTTGTTAGGTCGGTTGGGGGG {SEQ ID NO:14116}, TAGGGCGGGAATTCGGTAAGGGCGTTT
{SEQ ID NO:14117}, TTAGGGCGGGAATTCGGTAAGGGCGTT {SEQ ID NO:14118},
GGGCGGGAATTCGGTAAGGGCGTTTTT {SEQ ID NO:14119}, TGGGGGGATTAAGTAGGGGTTCGGGGT
{SEQ ID NO:14120}, ATTTGGTTATCGGGGAGGGGCGTGGTT {SEQ ID NO:14121},
AGGGTGGGGTGGGAGAGGAGGGTAAAT {SEQ ID NO:14122}, AGGATTTGGTTATCGGGGAGGGGCGTG
{SEQ ID NO:14123}, TTGGTTATCGGGGAGGGGCGTGGTTTT {SEQ ID NO:14124},
TTTGGTTATCGGGGAGGGGCGTGGTTT {SEQ ID NO:14125}

Target1495    chr15:45427396-45427418    ACGTGTTTTTAGATTTGGTGAGCGTGGAAA {SEQ ID NO:14126},
ACGTGTTTTTAGATTTGGTGAGCGTGGAAAT {SEQ ID NO:14127},
ACGTGTTTTTAGATTTGGTGAGCGTGGAAATT {SEQ ID NO:14128},
TTACGTGTTTTTAGATTTGGTGAGCGTGGAAA {SEQ ID NO:14129},
ACGTGTTTTTAGATTTGGTGAGCGTGGAAATTT {SEQ ID NO:14130},
TCGGGGATTGTTGGGATTTCGTTCGGT {SEQ ID NO:14131}, CGGGGATTGTTGGGATTTCGTTCGGTT
{SEQ ID NO:14132}, TCGGGGATTGTTGGGATTTCGTTCGGTT {SEQ ID NO:14133},
TTCGGGGATTGTTGGGATTTCGTTCGGT {SEQ ID NO:14134}, GGGTTTCGGGGATTGTTGGGATTTCGT
{SEQ ID NO:14135}

Target1496    chr15:45427505-45427520    GGATTCGGTGAGGCGGGGAAGGC {SEQ ID NO:14136}, GGGATTCGGTGAGGCGGGGAAGGC {SEQ ID
NO:14137}, GGGATTCGGTGAGGCGGGGAAGG {SEQ ID NO:14138}, GGAAGGCGGCGGGAAGGGATCG
{SEQ ID NO:14139}, GGGAAGGCGGCGGGAAGGGATC {SEQ ID NO:14140},
CGGCGAGTTAGGGAAGGTCGGGGGTTC {SEQ ID NO:14141}, CGGCGAGTTAGGGAAGGTCGGGGGTT {SEQ

FIGURE 5 CONTINUED

|  |  | ID NO:14142), GCGGCGAGTTAGGGAAGGTCGGGGTTC (SEQ ID NO:14143), CGGCGAGTTAGGGAAGGTCGGGGT (SEQ ID NO:14144), GCGGCGAGTTAGGGAAGGTCGGGGTT (SEQ ID NO:14145) |
| Target1497 | chr15:45427592-45427656 | GGTAGGGTTTGGAGGGGAGAGGCGTTT (SEQ ID NO:14146), TTTGGTAGGGTTTGGAGGGGAGAGGCG (SEQ ID NO:14147), CGGGTTTGGTAGGGTTTGGAGGGGAGA (SEQ ID NO:14148), TCGGGTTTGGTAGGGTTTGGAGGGGAG (SEQ ID NO:14149), GGAAGGCGGCGGGAAGGGATCGTATTT (SEQ ID NO:14150), CGGCGAGTTAGGGAAGGTCGGGGTTC (SEQ ID NO:14151), CGGCGAGTTAGGGAAGGTCGGGGTT (SEQ ID NO:14152), GCGGCGAGTTAGGGAAGGTCGGGGTTC (SEQ ID NO:14153), CGGCGAGTTAGGGAAGGTCGGGGT (SEQ ID NO:14154), GCGGCGAGTTAGGGAAGGTCGGGGTT (SEQ ID NO:14155) |
| Target1498 | chr15:45427660-45427773 | TAGGTGACGGGTTGGTTGGACGGTAGC (SEQ ID NO:14156), TGACGGGTTGGTTGGACGGTAGCGTTA (SEQ ID NO:14157), GGTAGGGTTTGGAGGGGAGAGGCGTTT (SEQ ID NO:14158), TTTGGTAGGGTTTGGAGGGGAGAGGCG (SEQ ID NO:14159), CGGGTTTGGTAGGGTTTGGAGGGGAGA (SEQ ID NO:14160), GGTTCGTTTTGTTCGGTGGCGGGGTC (SEQ ID NO:14161), GGGTTCGTTTTGTTCGGTGGCGGGGTC (SEQ ID NO:14162), GGTTCGTTTTGTTCGGTGGCGGGGT (SEQ ID NO:14163), CGGGCGTCGTTTATATGAGTAGGGGGT (SEQ ID NO:14164), GGGTTCGTTTTGTTCGGTGGCGGGG (SEQ ID NO:14165) |
| Target1499 | chr15:53083258-53083384 | GGAGAGCGGAGGGAGTGTTTTGGAGG (SEQ ID NO:14166), GGGAGAGCGGAGGGAGTGTTTTGGAGG (SEQ ID NO:14167), GAGAGCGGAGGGAGTGTTTTGGAGGGT (SEQ ID NO:14168), CGAGGGAGAGCGGAGGGAGTGTTTTGG (SEQ ID NO:14169), GATGATTCGGTTTGTGGAGGGGGGCGA (SEQ ID NO:14170), AGGAGGGTTTGGGAGTAATCGTAGGGA (SEQ ID NO:14171), CGGGTGTTTTAGTAGGAGGGTTTTGGA (SEQ ID NO:14172), TCGGGTGTTTTAGTAGGAGGGTTTTGGG (SEQ ID NO:14173), GGAGGGTTTTAGGGAGTAATCGTAGGGAC (SEQ ID NO:14174), TCGGGTGTTTTAGTAGGAGGGTTTTGGGA (SEQ ID NO:14175) |
| Target1500 | chr15:53083406-53083519 | GTGGAGGTTCGGGTCGTTTTTGCGGTT (SEQ ID NO:14176), GGTCGTGGAGGTTCGGGTCGTTTTTGC (SEQ ID NO:14177), GGAGAGCGGAGGGAGTGTTTTGGAGGG (SEQ ID NO:14178), GGGAGAGCGGAGGGAGTGTTTTGGAGG (SEQ ID NO:14179), GGGTCGTGGAGGTTCGGGTCGTTTTTG (SEQ ID NO:14180), GATTGGAGCGTGATTGTGGGAAGGGCGA (SEQ ID NO:14181), ATTGGAGCGTGATTGTGGGAAGGGCGA (SEQ ID NO:14182), GGAGCGTGATTGTGGGAAGGGCGAAAT (SEQ ID NO:14183), TGGAGCGTGATTGTGGGAAGGGCGAAA (SEQ ID NO:14184), TTGGAGCGTGATTGTGGGAAGGGCGAA (SEQ ID NO:14185) |
| Target1501 | chr15:53083529-53083576 | GGCGCGCGGGTTTTCGTTTGGTTTTTA (SEQ ID NO:14186), GCGCGCGGGTTTTCGTTTGGTTTTTAGG (SEQ ID NO:14187), GGCGCGCGGGTTTTCGTTTGGTTTTTAG (SEQ ID NO:14188), GGCGCGCGGGTTTTCGTTTGGTTTTTT (SEQ ID NO:14189), CGCGCGGGTTTTCGTTTGGTTTTTAGGG (SEQ ID NO:14190), GATTGGAGCGTGATTGTGGGAAGGGCG (SEQ ID NO:14191), ATTGGAGCGTGATTGTGGGAAGGGCGA (SEQ ID NO:14192), GGAGCGTGATTGTGGGAAGGGCGAAAT (SEQ ID NO:14193), TGGAGCGTGATTGTGGGAAGGGCGAAA (SEQ ID NO:14194), TTGGAGCGTGATTGTGGGAAGGGCGAA (SEQ ID NO:14195) |
| Target1502 | chr15:53087132-53087162 | TGAATTGTTCGGATTTGGGGTGGCGGT (SEQ ID NO:14196), TGAATTGTTCGGATTTGGGGTGGCGGTT (SEQ ID NO:14197), TTGAATTGTTCGGATTTGGGGTGGCGGT (SEQ ID NO:14198), GAATTGTTCGGATTTGGGGTGGCGGTT (SEQ ID NO:14199), GGGCGTTGAATTGTTCGGATTTGGGGT (SEQ ID NO:14200), AGCGCGGGGTTAATGGAATGTAGGGTT (SEQ ID NO:14201), TAGCGCGGGGTTAATGGAATGTAGGGT (SEQ ID NO:14202), GCGCGGGGTTAATGGAATGTAGGGTTT (SEQ ID NO:14203), AGCGCGGGGTTAATGGAATGTAGGGTTT (SEQ ID NO:14204), AGCGCGGGGTTAATGGAATGTAGGGT (SEQ ID NO:14205) |
| Target1503 | chr15:53087229-53087254 | GGGGTTGGAGAGGATAAGGGGAAGGACG (SEQ ID NO:14206), GGGGTTGGAGAGGATAAGGGGAAGGACGA (SEQ ID NO:14207), AGGGGTTGGAGAGGATAAGGGGAAGGACG (SEQ ID NO:14208), AGGGGTTGGAGAGGATAAGGGGAAGGA (SEQ ID NO:14209), GGGTTGGAGAGGATAAGGGGAAGGACG (SEQ ID NO:14210), AGGGCGAGAGAATGGTGCGTTTGAAGA (SEQ ID NO:14211), GGGCGAGAGAATGGTGCGTTTGAAGATC (SEQ ID NO:14212), GGGCGAGAGAATGGTGCGTTTGAAGAT (SEQ ID NO:14213), AGGGCGAGAGAATGGTGCGTTTGAAGAT (SEQ ID NO:14214), TGGTGCGTTTGAAGATCGTTTTGGGTCG (SEQ ID NO:14215) |
| Target1504 | chr15:53087282-53087306 | TAGAAGGGGCGGACGGAGGGTAAAGTC (SEQ ID NO:14216), TTAGAAGGGGCGGACGGAGGGTAAAGT (SEQ ID NO:14217), AGAAGGGGCGGACGGAGGGTAAAGTC (SEQ ID NO:14218), GGGGTTGGAGAGGATAAGGGGAAGGACG (SEQ ID NO:14219), TTAGAAGGGGCGGACGGAGGGTAAAGTC (SEQ ID NO:14220), AGGGCGAGAGAATGGTGCGTTTGAAGA (SEQ ID NO:14221), CGGGTGGGGTGGTTGGTTTAAGTTTCGT (SEQ ID NO:14222), CGGGTGGGGTGGTTGGTTTAAGTTTCG (SEQ ID NO:14223), TCGGGTGGGGTGGTTGGTTTAAGTTTCG (SEQ ID NO:14224), TCGGGTGGGGTGGTTGGTTTAAGTTTCGT (SEQ ID NO:14225) |
| Target1505 | chr15:53087377-53087420 | GCGGAGGGTGGTTGTTTAGTCGGAGT (SEQ ID NO:14226), AGCGGAGGGTGGTTGTTTAGTCGGGAG (SEQ ID NO:14227), CGTTTTGGAGGGATAGGGAAGGGCGGA (SEQ ID NO:14228), TCGTTTTGGAGGGATAGGGAAGGGCGGA (SEQ ID NO:14229), AAGCGGAGGGTGGTTGTTTAGTCGGGA (SEQ ID NO:14230), CGGGTGGGGTGGTTGGTTTAAGTTTCGT (SEQ ID NO:14231), CGGGTGGGGTGGTTGGTTTAAGTTTCG (SEQ ID NO:14232), TCGGGTGGGGTGGTTGGTTTAAGTTTCG |

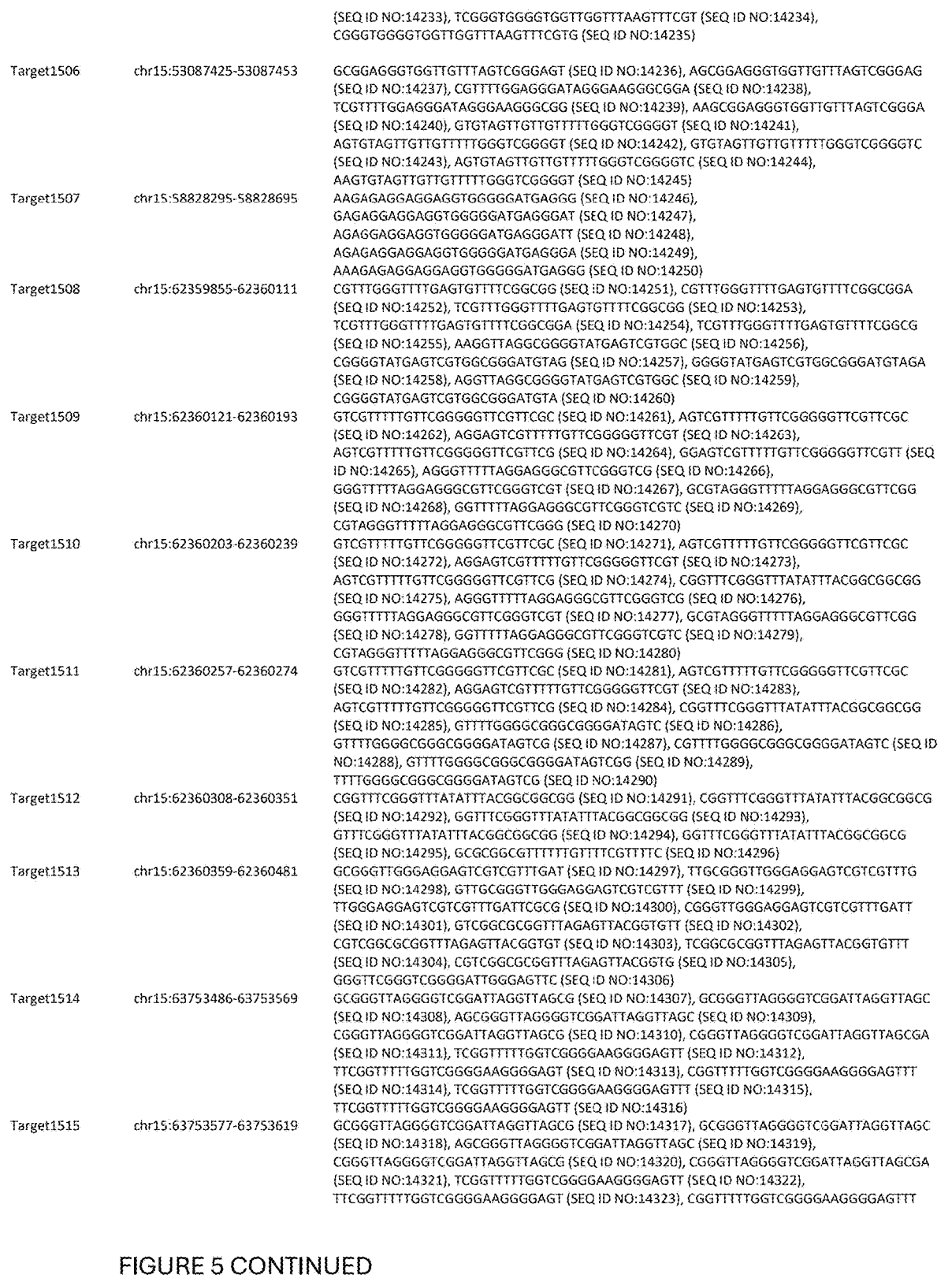

FIGURE 5 CONTINUED (SEQ ID NO:14233), TCGGGTGGGGTGGTTGGTTTAAGTTTCGT (SEQ ID NO:14234),
CGGGTGGGGTGGTTGGTTTAAGTTTCGTG (SEQ ID NO:14235)

Target1506   chr15:53087425-53087453   GCGGAGGGTGGTTGTTTAGTCGGGAGT (SEQ ID NO:14236), AGCGGAGGGTGGTTGTTTAGTCGGGAG
(SEQ ID NO:14237), CGTTTTGGAGGGGATAGGGAAGGGCGGA (SEQ ID NO:14238),
TCGTTTTGGAGGGGATAGGGAAGGGCGG (SEQ ID NO:14239), AAGCGGAGGGTGGTTGTTTAGTCGGGA
(SEQ ID NO:14240), GTGTAGTTGTTGTTTTTGGGTCGGGGT (SEQ ID NO:14241),
AGTGTAGTTGTTGTTTTTGGGTCGGGGT (SEQ ID NO:14242), GTGTAGTTGTTGTTTTTGGGTCGGGGTC
(SEQ ID NO:14243), AGTGTAGTTGTTGTTTTTGGGTCGGGGTC (SEQ ID NO:14244),
AAGTGTAGTTGTTGTTTTTGGGTCGGGGT (SEQ ID NO:14245)

Target1507   chr15:58828295-58828695   AAGAGAGGAGGAGGTGGGGGATGAGGG (SEQ ID NO:14246),
GAGAGGAGGAGGTGGGGGATGAGGGAT (SEQ ID NO:14247),
AGAGGAGGAGGTGGGGGATGAGGGATT (SEQ ID NO:14248),
AGAGAGGAGGAGGTGGGGGATGAGGGA (SEQ ID NO:14249),
AAAGAGAGGAGGAGGTGGGGGATGAGGG (SEQ ID NO:14250)

Target1508   chr15:62359855-62360111   CGTTTGGGTTTTGAGTGTTTTCGGCGG (SEQ ID NO:14251), CGTTTGGGTTTTGAGTGTTTTCGGCGGA
(SEQ ID NO:14252), TCGTTTGGGTTTTGAGTGTTTTCGGCGG (SEQ ID NO:14253),
TCGTTTGGGTTTTGAGTGTTTTCGGCGGA (SEQ ID NO:14254), TCGTTTGGGTTTTGAGTGTTTTCGGCG
(SEQ ID NO:14255), AAGGTTAGGCGGGGTATGAGTCGTGGC (SEQ ID NO:14256),
CGGGGTATGAGTCGTGGCGGGATGTAG (SEQ ID NO:14257), GGGGTATGAGTCGTGGCGGGATGTAGA
(SEQ ID NO:14258), AGGTTAGGCGGGGTATGAGTCGTGGC (SEQ ID NO:14259),
CGGGGTATGAGTCGTGGCGGGATGTA (SEQ ID NO:14260)

Target1509   chr15:62360121-62360193   GTCGTTTTTGTTCGGGGGTTCGTTCGC (SEQ ID NO:14261), AGTCGTTTTTGTTCGGGGGTTCGTTCGC
(SEQ ID NO:14262), AGGAGTCGTTTTTGTTCGGGGGTTCGT (SEQ ID NO:14263),
AGTCGTTTTTGTTCGGGGGTTCGTTCG (SEQ ID NO:14264), GGAGTCGTTTTTGTTCGGGGGTTCGTT (SEQ
ID NO:14265), AGGGTTTTTAGGAGGGCGTTCGGGTCG (SEQ ID NO:14266),
GGGTTTTTAGGAGGGCGTTCGGGTCGT (SEQ ID NO:14267), GCGTAGGGTTTTTAGGAGGGCGTTCGG
(SEQ ID NO:14268), GGTTTTTAGGAGGGCGTTCGGGTCGTC (SEQ ID NO:14269),
CGTAGGGTTTTTAGGAGGGCGTTCGGG (SEQ ID NO:14270)

Target1510   chr15:62360203-62360239   GTCGTTTTTGTTCGGGGGTTCGTTCGC (SEQ ID NO:14271), AGTCGTTTTTGTTCGGGGGTTCGTTCGC
(SEQ ID NO:14272), AGGAGTCGTTTTTGTTCGGGGGTTCGT (SEQ ID NO:14273),
AGTCGTTTTTGTTCGGGGGTTCGTTCG (SEQ ID NO:14274), CGGTTTCGGGTTTATATTTACGGCGGCGG
(SEQ ID NO:14275), AGGGTTTTTAGGAGGGCGTTCGGGTCG (SEQ ID NO:14276),
GGGTTTTTAGGAGGGCGTTCGGGTCGT (SEQ ID NO:14277), GCGTAGGGTTTTTAGGAGGGCGTTCGG
(SEQ ID NO:14278), GGTTTTTAGGAGGGCGTTCGGGTCGTC (SEQ ID NO:14279),
CGTAGGGTTTTTAGGAGGGCGTTCGGG (SEQ ID NO:14280)

Target1511   chr15:62360257-62360274   GTCGTTTTTGTTCGGGGGTTCGTTCGC (SEQ ID NO:14281), AGTCGTTTTTGTTCGGGGGTTCGTTCGC
(SEQ ID NO:14282), AGGAGTCGTTTTTGTTCGGGGGTTCGT (SEQ ID NO:14283),
AGTCGTTTTTGTTCGGGGGTTCGTTCG (SEQ ID NO:14284), CGGTTTCGGGTTTATATTTACGGCGGCGG
(SEQ ID NO:14285), GTTTTGGGGCGGGCGGGGATAGTC (SEQ ID NO:14286),
GTTTTGGGGCGGGCGGGGATAGTCG (SEQ ID NO:14287), CGTTTTGGGGCGGGCGGGGATAGTC (SEQ ID
NO:14288), GTTTTGGGGCGGGCGGGGATAGTCGG (SEQ ID NO:14289),
TTTTGGGGCGGGCGGGGATAGTCG (SEQ ID NO:14290)

Target1512   chr15:62360308-62360351   CGGTTTCGGGTTTATATTTACGGCGGCGG (SEQ ID NO:14291), CGGTTTCGGGTTTATATTTACGGCGGCG
(SEQ ID NO:14292), GGTTTCGGGTTTATATTTACGGCGGCGG (SEQ ID NO:14293),
GTTTCGGGTTTATATTTACGGCGGCGG (SEQ ID NO:14294), GGTTTCGGGTTTATATTTACGGCGGCG
(SEQ ID NO:14295), GCGCGGCGTTTTTTGTTTTCGTTTTC (SEQ ID NO:14296)

Target1513   chr15:62360359-62360481   GCGGGTTGGGAGGAGTCGTCGTTTGAT (SEQ ID NO:14297), TTGCGGGTTGGGAGGAGTCGTCGTTTG
(SEQ ID NO:14298), GTTGCGGGTTGGGAGGAGTCGTCGTTT (SEQ ID NO:14299),
TTGGGAGGAGTCGTCGTTTGATTCGCG (SEQ ID NO:14300), CGGGTTGGGAGGAGTCGTCGTTTGATT
(SEQ ID NO:14301), GTCGGCGCGGTTTAGAGTTACGGTGTT (SEQ ID NO:14302),
CGTCGGCGCGGTTTAGAGTTACGGTGT (SEQ ID NO:14303), TCGGCGCGGTTTAGAGTTACGGTGTTT
(SEQ ID NO:14304), CGTCGGCGCGGTTTAGAGTTACGGTG (SEQ ID NO:14305),
GGGTTCGGGTCGGGGATTGGGAGTTC (SEQ ID NO:14306)

Target1514   chr15:63753486-63753569   GCGGGTTAGGGGTCGGATTAGGTTAGC (SEQ ID NO:14307), GCGGGGTTAGGGGTCGGATTAGGTTAGC
(SEQ ID NO:14308), AGCGGGTTAGGGGTCGGATTAGGTTAGC (SEQ ID NO:14309),
CGGGTTAGGGGTCGGATTAGGTTAGCG (SEQ ID NO:14310), CGGGTTAGGGGTCGGATTAGGTTAGCGA
(SEQ ID NO:14311), TCGGTTTTTGGTCGGGGAAGGGGAGT (SEQ ID NO:14312),
TTCGGTTTTTGGTCGGGGAAGGGGAGT (SEQ ID NO:14313), CGGTTTTTGGTCGGGGAAGGGGAGTTT
(SEQ ID NO:14314), TCGGTTTTTGGTCGGGGAAGGGGAGTTT (SEQ ID NO:14315),
TTCGGTTTTTGGTCGGGGAAGGGGAGTT (SEQ ID NO:14316)

Target1515   chr15:63753577-63753619   GCGGGTTAGGGGTCGGATTAGGTTAGCG (SEQ ID NO:14317), GCGGGTTAGGGGTCGGATTAGGTTAGC
(SEQ ID NO:14318), AGCGGGTTAGGGGTCGGATTAGGTTAGC (SEQ ID NO:14319),
CGGGTTAGGGGTCGGATTAGGTTAGCG (SEQ ID NO:14320), CGGGTTAGGGGTCGGATTAGGTTAGCGA
(SEQ ID NO:14321), TCGGTTTTTGGTCGGGGAAGGGGAGT (SEQ ID NO:14322),
TTCGGTTTTTGGTCGGGGAAGGGGAGT (SEQ ID NO:14323), CGGTTTTTGGTCGGGGAAGGGGAGTTT

FIGURE 5 CONTINUED

{SEQ ID NO:14324), TCGGTTTTTGGTCGGGGAAGGGGAGTTT (SEQ ID NO:14325),
TTCGGTTTTTGGTCGGGGAAGGGGAGTT (SEQ ID NO:14326)

| Target1516 | chr15:63753681-63753700 | CGGGTGTAAGAGGAGTTTGGGGGAGGGA (SEQ ID NO:14327), TCGGGTGTAAGAGGAGTTTGGGGGAGGG {SEQ ID NO:14328), TCGGGTGTAAGAGGAGTTTGGGGGAGGGA (SEQ ID NO:14329), GTCGGGTGTAAGAGGAGTTTGGGGGAGGG (SEQ ID NO:14330), CGGGTGTAAGAGGAGTTTGGGGGAGGGAG (SEQ ID NO:14331), CGGGCGGGTTGTTTTTTATGGTCGTGA {SEQ ID NO:14332), TCGGGCGGGTTGTTTTTTATGGTCGTG (SEQ ID NO:14333), TCGGGCGGGTTGTTTTTTATGGTCGTGA (SEQ ID NO:14334), ATCGGGCGGGTTGTTTTTTATGGTCGT {SEQ ID NO:14335), CGGGCGGGTTGTTTTTTATGGTCGTGAG (SEQ ID NO:14336) |
|---|---|---|
| Target1517 | chr15:65689058-65689153 | TGAGTTCGTTTTTTAGGAGAGCGTTTGAGTGT (SEQ ID NO:14337), GAGTTCGTTTTTTAGGAGAGCGTTTGAGTGTT {SEQ ID NO:14338), TTGAGTTCGTTTTTTAGGAGAGCGTTTGAGTG (SEQ ID NO:14339), TGAGTTCGTTTTTTAGGAGAGCGTTTGAGTGTT (SEQ ID NO:14340), TTGAGTTCGTTTTTTAGGAGAGCGTTTGAGTGT (SEQ ID NO:14341), AGCGGGTTAGTTGGGGTTGGGGTGAAT (SEQ ID NO:14342), ATAGAGTAGGGGGAGGTGGACGGGTGG {SEQ ID NO:14343), GAGCGGGTTAGTTGGGGTTGGGGTGAA (SEQ ID NO:14344), GGACGGGTGGGTGTGTTGGGGGTATTT (SEQ ID NO:14345), TTGAGTTTCGTGTGTTGGGTGAGGCGG {SEQ ID NO:14346) |
| Target1518 | chr15:65689202-65689213 | CGGAGTTTAGCGGTTGTAGTGGCGAAGT (SEQ ID NO:14347), CGGAGTTTAGCGGTTGTAGTGGCGAAG {SEQ ID NO:14348), CGGAGTTTAGCGGTTGTAGTGGCGAAGTC (SEQ ID NO:14349), GGAGTTTAGCGGTTGTAGTGGCGAAGT (SEQ ID NO:14350), GGAGTTTAGCGGTTGTAGTGGCGAAGTC (SEQ ID NO:14351), CGCGTAGTTTTGGTATTTCGGCGTTTATGT (SEQ ID NO:14352), CGCGTAGTTTTGGTATTTCGGCGTTTATGTT (SEQ ID NO:14353), CGCGTAGTTTTGGTATTTCGGCGTTTATGTTT (SEQ ID NO:14354), CGCGTAGTTTTGGTATTTCGGCGTTTATGTTTG (SEQ ID NO:14355), CGCGTAGTTTTGGTATTTCGGCGTTTATGTTGT (SEQ ID NO:14356) |
| Target1519 | chr15:65689216-65689289 | TCGGAGTGTTAGGGTTGCGCGTTGGTA (SEQ ID NO:14357), TGCGGGGTTTGTTGGCGCGGTAGATAT {SEQ ID NO:14358), CGGAGTGTTAGGGTTGCGCGTTGGTAA (SEQ ID NO:14359), GCGGGGTTTGTTGGCGCGGTAGATATA (SEQ ID NO:14360), GTCGGAGTGTTAGGGTTGCGCGTTGGT {SEQ ID NO:14361), GGGTGTAGAGTGTTTTTGAGGTTCGGAGA (SEQ ID NO:14362), CGCGTAGTTTTGGTATTTCGGCGTTTATGT (SEQ ID NO:14363), CGGAGATTGAAGGGAAGGGTAGTTTTTAGCG (SEQ ID NO:14364), CGGAGATTGAAGGGAAGGGTAGTTTTTAGCGT {SEQ ID NO:14365), TCGGAGATTGAAGGGAAGGGTAGTTTTTAGCG (SEQ ID NO:14366) |
| Target1520 | chr15:65689325-65689391 | TCGGAGTGTTAGGGTTGCGCGTTGGTA (SEQ ID NO:14367), TTTGGGGGAAGGAGAGGGGAGACGCGTTG {SEQ ID NO:14368), GTTTGGGGGAAGGAGAGGGGAGACGCGTT (SEQ ID NO:14369), TGCGGGGTTTGTTGGCGCGGTAGATAT (SEQ ID NO:14370), CGGAGTGTTAGGGTTGCGCGTTGGTAA {SEQ ID NO:14371), CGGGTGTAGAGTGTTTTTGAGGTTCGGA (SEQ ID NO:14372), TCGGGTGTAGAGTGTTTTTGAGGTTCGG (SEQ ID NO:14373), TCGGGTGTAGAGTGTTTTTGAGGTTCGGA {SEQ ID NO:14374), GGGACGGTTGTGTTTGTTTTATTCGGGT (SEQ ID NO:14375), CGGGTGTAGAGTGTTTTTGAGGTTCGGAG (SEQ ID NO:14376) |
| Target1521 | chr15:68114430-68114445 | CGAGGGAAAAACGAGGCGAGAGGGGAG (SEQ ID NO:14377), CGAGGCGAGAGGGGAGAAGGCGATTTC {SEQ ID NO:14378), GAGGGAAAAACGAGGCGAGAGGGGAGA (SEQ ID NO:14379), AAAAACGAGGCGAGAGGGGAGAAGGCG (SEQ ID NO:14380), AGGGAAAAACGAGGCGAGAGGGGAGAA (SEQ ID NO:14381), CGGGTCGTTTGGGTAGGGGGCGTAG (SEQ ID NO:14382), CGGGTCGTTTGGGTAGGGGGCGTA (SEQ ID NO:14383), TAGGGATGGTTTGGGGCGCGACGGGTC (SEQ ID NO:14384), AGTTTGTTTTTGGAATTCGGGAGGCGT {SEQ ID NO:14385), TAGGGATGGTTTGGGGCGCGACGG (SEQ ID NO:14386) |
| Target1522 | chr15:68114507-68114529 | CGAGGGAAAAACGAGGCGAGAGGGGAG (SEQ ID NO:14387), CGAGGCGAGAGGGGAGAAGGCGATTTC {SEQ ID NO:14388), GAGGGAAAAACGAGGCGAGAGGGGAGA (SEQ ID NO:14389), AAAAACGAGGCGAGAGGGGAGAAGGCG (SEQ ID NO:14390), AGGGAAAAACGAGGCGAGAGGGGAGAA (SEQ ID NO:14391), TAATGGTAGGGATGGTTTGGGGCGCGA (SEQ ID NO:14392), AATGGTAGGGATGGTTTGGGGCGCGAC (SEQ ID NO:14393), ATAATGGTAGGGATGGTTTGGGGCGCG (SEQ ID NO:14394), ATAATGGTAGGGATGGTTTGGGGCGCGA (SEQ ID NO:14395), TAATGGTAGGGATGGTTTGGGGCGCGAC (SEQ ID NO:14396) |
| Target1523 | chr15:68114543-68114554 | CGTGGTCGTTGCGTTTTTTGTTTAGGCGG (SEQ ID NO:14397), TGGTCGTTGCGTTTTTTGTTTAGGCGGT {SEQ ID NO:14398), GGTCGTTGCGTTTTTTGTTTAGGCGGT (SEQ ID NO:14399), TGGTCGTTGCGTTTTTTGTTTAGGCGG (SEQ ID NO:14400), CGTGGTCGTTGCGTTTTTTGTTTAGGCG (SEQ ID NO:14401), TAATGGTAGGGATGGTTTGGGGCGCGA (SEQ ID NO:14402), AATGGTAGGGATGGTTTGGGGCGCGAC (SEQ ID NO:14403), ATAATGGTAGGGATGGTTTGGGGCGCG (SEQ ID NO:14404), ATAATGGTAGGGATGGTTTGGGGCGCGA (SEQ ID NO:14405), TAATGGTAGGGATGGTTTGGGGCGCGAC (SEQ ID NO:14406) |
| Target1524 | chr15:76632205-76632494 | GGGAGAGATCGTTGCGGGGTAGTTCGG (SEQ ID NO:14407), GGAGAGATCGTTGCGGGGTAGTTCGGT {SEQ ID NO:14408), AGATCGTTGCGGGGTAGTTCGGTTCGG (SEQ ID NO:14409), CGGGAGAGATCGTTGCGGGGTAGTTCG (SEQ ID NO:14410), TCGGGAGAGATCGTTGCGGGGTAGTTC |

FIGURE 5 CONTINUED

|  |  | (SEQ ID NO:14411), TTGCGGGGAGGGAGTGGTTGTTTAGGG (SEQ ID NO:14412), TCGTTGCGGGGAGGGAGTGGTTGTTTA (SEQ ID NO:14413), GCGGGGAGGGAGTGGTTGTTTAGGGAT (SEQ ID NO:14414), CGTTGCGGGGAGGGAGTGGTTGTTTAG (SEQ ID NO:14415), GTTGCGGGGAGGGAGTGGTTGTTTAGG (SEQ ID NO:14416) |
|---|---|---|
| Target1525 | chr15:76639497-76639614 | TCGTTTGGGAGGAGTATTGGGGGCGTT (SEQ ID NO:14417), TTCGTTTGGGAGGAGTATTGGGGGCGT (SEQ ID NO:14418), GGTCGTTCGTTGGGTTCGCGGTAGTTT (SEQ ID NO:14419), GGAGGAGTATTGGGGGCGTTAGGGGTT (SEQ ID NO:14420), TTGGGAGGAGTATTGGGGGCGTTAGGG (SEQ ID NO:14421), GAGTCGTAGGGTCGGGTTGAGTTTCGC (SEQ ID NO:14422), CGGAGTCGTAGGGTCGGGTTGAGTTTCG (SEQ ID NO:14423), GGAGTCGTAGGGTCGGGTTGAGTTTCGC (SEQ ID NO:14424), GGAGTCGTAGGGTCGGGTTGAGTTTCG (SEQ ID NO:14425), CGGAGTCGTAGGGTCGGGTTGAGTTTC (SEQ ID NO:14426) |
| Target1526 | chr15:76639646-76639659 | GTTTCGTTTTTTGGTGTTCGGCGGCGG (SEQ ID NO:14427), GGTTTCGTTTTTTGGTGTTCGGCGGCG (SEQ ID NO:14428), GGGTTTCGTTTTTTGGTGTTCGGCGGC (SEQ ID NO:14429), TTTCGTTTTTTGGTGTTCGGCGGCGGA (SEQ ID NO:14430), TTCGTTTTTTGGTGTTCGGCGGCGGAG (SEQ ID NO:14431), CGAGGGCGGGGATTCGTAGTTTTAAGT (SEQ ID NO:14432), CGAGGGCGGGGATTCGTAGTTTTAAGTT (SEQ ID NO:14433), GGGTGTTTAGCGCGGCGTTTCGG (SEQ ID NO:14434), CGAGGGCGGGGATTCGTAGTTTTAAGTTA (SEQ ID NO:14435), GGGCGGGGATTCGTAGTTTTAAGTTAGAGGG (SEQ ID NO:14436) |
| Target1527 | chr15:76639663-76639693 | GTTTCGTTTTTTGGTGTTCGGCGGCGG (SEQ ID NO:14437), GGTTTCGTTTTTTGGTGTTCGGCGGCG (SEQ ID NO:14438), GGGTTTCGTTTTTTGGTGTTCGGCGGC (SEQ ID NO:14439), TTTCGTTTTTTGGTGTTCGGCGGCGGA (SEQ ID NO:14440), TTCGTTTTTTGGTGTTCGGCGGCGGAG (SEQ ID NO:14441), CGAGGGCGGGGATTCGTAGTTTTAAGT (SEQ ID NO:14442), CGAGGGCGGGGATTCGTAGTTTTAAGTT (SEQ ID NO:14443), GGGTGTTTAGCGCGGCGTTTCGG (SEQ ID NO:14444), CGAGGGCGGGGATTCGTAGTTTTAAGTTA (SEQ ID NO:14445), GGGCGGGGATTCGTAGTTTTAAGTTAGAGGG (SEQ ID NO:14446) |
| Target1528 | chr15:76639721-76639743 | GTTTCGTTTTTTGGTGTTCGGCGGCGG (SEQ ID NO:14447), GGTTTCGTTTTTTGGTGTTCGGCGGCG (SEQ ID NO:14448), GGGTTTCGTTTTTTGGTGTTCGGCGGC (SEQ ID NO:14449), TTTCGTTTTTTGGTGTTCGGCGGCGGA (SEQ ID NO:14450), TTCGTTTTTTGGTGTTCGGCGGCGGAG (SEQ ID NO:14451), GGGTGTTTAGCGCGGCGTTTCGG (SEQ ID NO:14452), GGTGTTTAGCGCGGCGTTTCGG (SEQ ID NO:14453), GGGTGTTTAGCGCGGCGTTTCG (SEQ ID NO:14454), GCGCGGCGTTTCGGTTCGA (SEQ ID NO:14455) |
| Target1529 | chr15:82532826-82532881 | TGAGGTGAGAATAGGTTTTTTGTGGGGTGA (SEQ ID NO:14456), TGAGGTGAGAATAGGTTTTTTGTGGGGTGAA (SEQ ID NO:14457), TTGAGGTGAGAATAGGTTTTTTGTGGGGTGA (SEQ ID NO:14458), TTGAGGTGAGAATAGGTTTTTTGTGGGGTGAA (SEQ ID NO:14459), TTTGAGGTGAGAATAGGTTTTTTGTGGGGTGA (SEQ ID NO:14460) |
| Target1530 | chr15:89952204-89952273 | AGCGTTTGTTAAGTGGGGGAGATTTTATCGA (SEQ ID NO:14461), GCGTTTGTTAAGTGGGGGAGATTTTATCGATCG (SEQ ID NO:14462), AAGCGTTTGTTAAGTGGGGGAGATTTTATCGA (SEQ ID NO:14463), TGTTAAGTGGGGGAGATTTTATCGATCGAACG (SEQ ID NO:14464), AGCGTTTGTTAAGTGGGGGAGATTTTATCGAT (SEQ ID NO:14465), AGTCGAGGTTGGATTTTTAGCGGTCGT (SEQ ID NO:14466), CGAGGTTGGATTTTTAGCGGTCGTTTGC (SEQ ID NO:14467), GAGTCGAGGTTGGATTTTTAGCGGTCGT (SEQ ID NO:14468), TCGAGGTTGGATTTTTAGCGGTCGTTTGC (SEQ ID NO:14469), GAGTCGAGGTTGGATTTTTAGCGGTCG (SEQ ID NO:14470) |
| Target1531 | chr15:89952299-89952387 | TGGCGGTGGTTATACGGGTTTTAGGGA (SEQ ID NO:14471), ATGGCGGTGGTTATACGGGTTTTAGGG (SEQ ID NO:14472), TGGCGGTGGTTATACGGGTTTTAGGGAT (SEQ ID NO:14473), ATGGCGGTGGTTATACGGGTTTTAGGGA (SEQ ID NO:14474), GGCGGTGGTTATACGGGTTTTAGGGAT (SEQ ID NO:14475), AGTCGAGGTTGGATTTTTAGCGGTCGT (SEQ ID NO:14476), CGAGGTTGGATTTTTAGCGGTCGTTTGC (SEQ ID NO:14477), GAGTCGAGGTTGGATTTTTAGCGGTCGT (SEQ ID NO:14478), TCGAGGTTGGATTTTTAGCGGTCGTTTGC (SEQ ID NO:14479), GAGTCGAGGTTGGATTTTTAGCGGTCG (SEQ ID NO:14480) |
| Target1532 | chr15:89952454-89952474 | TTTCGGGGTTTTGCGACGGTGTTGGAG (SEQ ID NO:14481), GGTTTTGCGACGGTGTTGGAGGGTGTT (SEQ ID NO:14482), TTGCGACGGTGTTGGAGGGTGTTTTCG (SEQ ID NO:14483), TTTTCGGGGTTTTGCGACGGTGTTGGA (SEQ ID NO:14484), CGACGGTGTTGGAGGGTGTTTTCGGTT (SEQ ID NO:14485), GGAGTTGGGGAGGTATGGTTATTGGCGT (SEQ ID NO:14486), GGAGTTGGGGAGGTATGGTTATTGGCG (SEQ ID NO:14487), AGGAGTTGGGGAGGTATGGTTATTGGCGT (SEQ ID NO:14488), AGGAGTTGGGGAGGTATGGTTATTGGCG (SEQ ID NO:14489), GAGTTGGGGAGGTATGGTTATTGGCGT (SEQ ID NO:14490) |
| Target1533 | chr15:89952488-89952529 | TTTCGGGGTTTTGCGACGGTGTTGGAG (SEQ ID NO:14491), GGTTTTGCGACGGTGTTGGAGGGTGTT (SEQ ID NO:14492), TTGCGACGGTGTTGGAGGGTGTTTTCG (SEQ ID NO:14493), TTTTCGGGGTTTTGCGACGGTGTTGGA (SEQ ID NO:14494), GGGAGGTTTGCGCGGGGATTAGGTTTT (SEQ ID NO:14495), GATTGGGGTTGGGAGGAGTTGGGGAGG (SEQ ID NO:14496), TGGGGTTGGGAGGAGTTGGGGAGGTAT (SEQ ID NO:14497), TGGGGAGGATTTTCGGGTTAGGCGTCGG (SEQ ID NO:14498), GGGAGGATTTTCGGGTTAGGCGTCGGT (SEQ ID NO:14499), AGTGATTGGGGTTGGGAGGAGTTGGGG (SEQ ID NO:14500) |

FIGURE 5 CONTINUED

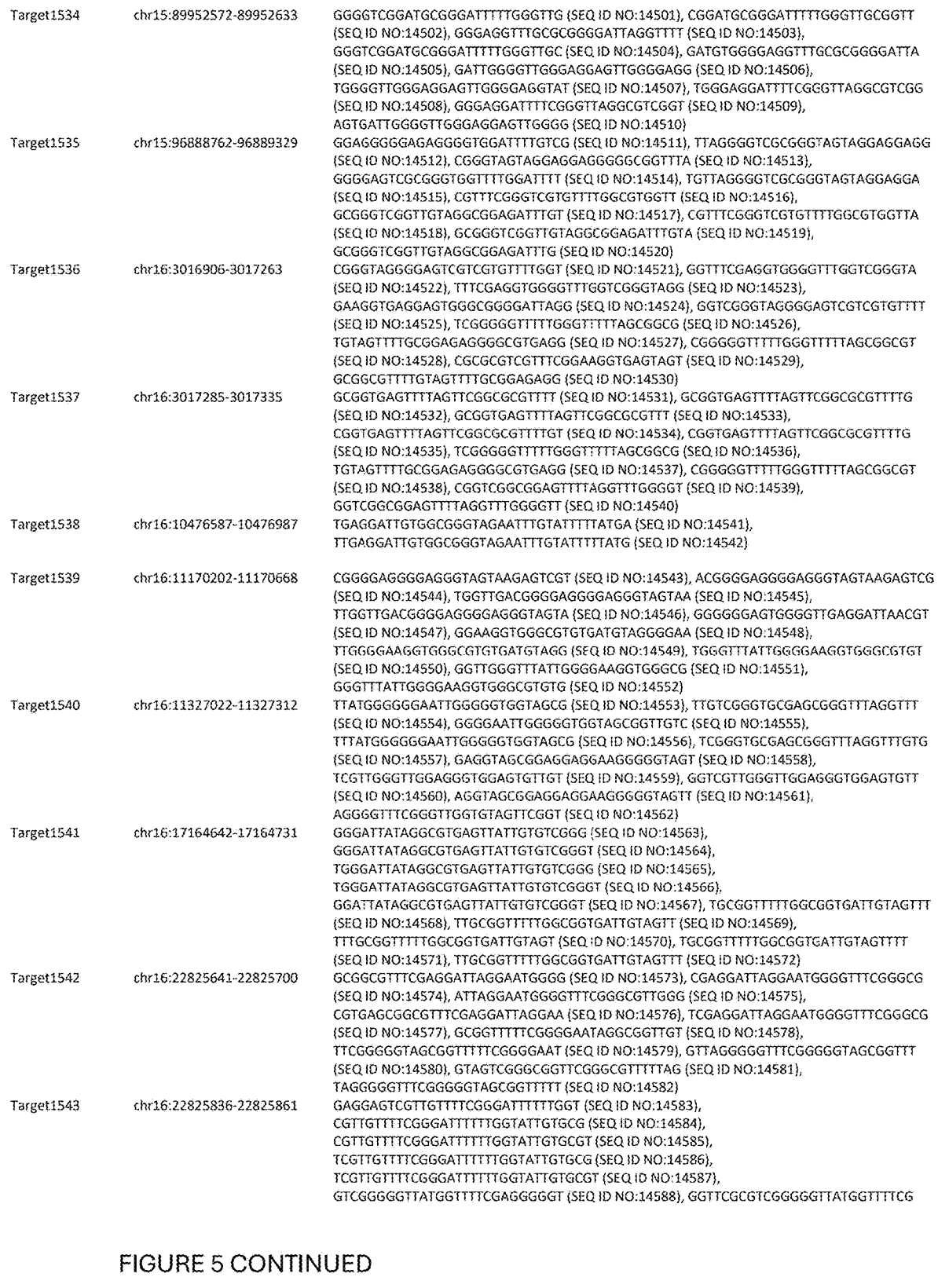

Target1534    chr15:89952572-89952633    GGGGTCGGATGCGGGATTTTTGGGTTG (SEQ ID NO:14501), CGGATGCGGGATTTTTGGGTTGCGGTT (SEQ ID NO:14502), GGGAGGTTTGCGCGGGGATTAGGTTTT (SEQ ID NO:14503), GGGGTCGGATGCGGGATTTTTGGGTTGC (SEQ ID NO:14504), GATGTGGGGAGGTTTGCGCGGGGATTA (SEQ ID NO:14505), GATTGGGGTTGGGAGGAGTTGGGGAGG (SEQ ID NO:14506), TGGGGTTGGGAGGAGTTGGGGAGGTAT (SEQ ID NO:14507), TGGGAGGATTTTCGGGTTAGGCGTCGG (SEQ ID NO:14508), GGGAGGATTTTCGGGTTAGGCGTCGGT (SEQ ID NO:14509), AGTGATTGGGGTTGGGAGGAGTTGGGG (SEQ ID NO:14510)

Target1535    chr15:96888762-96889329    GGAGGGGGGAGAGGGGTGGATTTTGTCG (SEQ ID NO:14511), TTAGGGGTCGCGGGTAGTAGGAGGAGG (SEQ ID NO:14512), CGGGTAGTAGGAGGAGGGGGCGGTTTA (SEQ ID NO:14513), GGGGAGTCGCGGGTGGTTTTGGATTTT (SEQ ID NO:14514), TGTTAGGGGTCGCGGGTAGTAGGAGGA (SEQ ID NO:14515), CGTTTCGGGTCGTGTTTTGGCGTGGTT (SEQ ID NO:14516), GCGGGTCGGTTGTAGGCGGAGATTTGT (SEQ ID NO:14517), CGTTTCGGGTCGTGTTTTGGCGTGGTTA (SEQ ID NO:14518), GCGGGTCGGTTGTAGGCGGAGATTTGTA (SEQ ID NO:14519), GCGGGTCGGTTGTAGGCGGAGATTTG (SEQ ID NO:14520)

Target1536    chr16:3016906-3017263    CGGGTAGGGGAGTCGTCGTGTTTTGGT (SEQ ID NO:14521), GGTTTCGAGGTGGGGTTTGGTCGGGTA (SEQ ID NO:14522), TTTCGAGGTGGGGTTTGGTCGGGTAGG (SEQ ID NO:14523), GAAGGTGAGGAGTGGGCGGGGATTAGG (SEQ ID NO:14524), GGTCGGGTAGGGGAGTCGTCGTGTTTT (SEQ ID NO:14525), TCGGGGGTTTTTGGGTTTTTAGCGGCG (SEQ ID NO:14526), TGTAGTTTTGCGGAGAGGGGCGTGAGG (SEQ ID NO:14527), CGGGGGTTTTTGGGTTTTTAGCGGCGT (SEQ ID NO:14528), CGCGCGTCGTTCGGAAGGTGAGTAGT (SEQ ID NO:14529), GCGGCGTTTTGTAGTTTTGCGGAGAGG (SEQ ID NO:14530)

Target1537    chr16:3017285-3017335    GCGGTGAGTTTTAGTTCGGCGCGTTTT (SEQ ID NO:14531), GCGGTGAGTTTTAGTTCGGCGCGTTTTG (SEQ ID NO:14532), GCGGTGAGTTTTAGTTCGGCGCGTTT (SEQ ID NO:14533), CGGTGAGTTTTAGTTCGGCGCGTTTTGT (SEQ ID NO:14534), CGGTGAGTTTTAGTTCGGCGCGTTTTG (SEQ ID NO:14535), TCGGGGGTTTTTGGGTTTTTAGCGGCG (SEQ ID NO:14536), TGTAGTTTTGCGGAGAGGGGCGTGAGG (SEQ ID NO:14537), CGGGGGTTTTTGGGTTTTTAGCGGCGT (SEQ ID NO:14538), CGGTCGGCGGAGTTTTAGGTTTGGGGT (SEQ ID NO:14539), GGTCGGCGGAGTTTTAGGTTTGGGGTT (SEQ ID NO:14540)

Target1538    chr16:10476587-10476987    TGAGGATTGTGGCGGGTAGAATTTGTATTTTTATGA (SEQ ID NO:14541), TTGAGGATTGTGGCGGGTAGAATTTGTATTTTTATG (SEQ ID NO:14542)

Target1539    chr16:11170202-11170668    CGGGGAGGGGAGGGTAGTAAGAGTCGT (SEQ ID NO:14543), ACGGGGAGGGGAGGGTAGTAAGAGTCG (SEQ ID NO:14544), TGGTTGACGGGGAGGGGAGGGTAGTAA (SEQ ID NO:14545), TTGGTTGACGGGGAGGGGAGGGTAGTA (SEQ ID NO:14546), GGGGGGGAGTGGGGTTGAGGATTAACGT (SEQ ID NO:14547), GGAAGGTGGGCGTGTGATGTAGGGGAA (SEQ ID NO:14548), TTGGGGAAGGTGGGCGTGTGATGTAGG (SEQ ID NO:14549), TGGGTTTATTGGGGAAGGTGGGCGTGT (SEQ ID NO:14550), GGTTGGGTTTATTGGGGAAGGTGGGCG (SEQ ID NO:14551), GGGTTTATTGGGGAAGGTGGGCGTGTG (SEQ ID NO:14552)

Target1540    chr16:11327022-11327312    TTATGGGGGGGAATTGGGGGGTGGTAGCG (SEQ ID NO:14553), TTGTCGGGGTGCGAGCGGGTTTAGGTTT (SEQ ID NO:14554), GGGGAATTGGGGGTGGTAGCGGTTGTC (SEQ ID NO:14555), TTTATGGGGGGGAATTGGGGGTGGTAGCG (SEQ ID NO:14556), TCGGGTGCGAGCGGGTTTAGGTTTGTG (SEQ ID NO:14557), GAGGTAGCGGAGGAGGAAGGGGGTAGT (SEQ ID NO:14558), TCGTTGGGTTGGAGGGTGGAGTGTTGT (SEQ ID NO:14559), GGTCGTTGGGTTGGAGGGTGGAGTGTT (SEQ ID NO:14560), AGGTAGCGGAGGAGGAAGGGGGTAGTT (SEQ ID NO:14561), AGGGGTTTCGGGTTGGTGTAGTTCGGT (SEQ ID NO:14562)

Target1541    chr16:17164642-17164731    GGGATTATAGGCGTGAGTTATTGTGTCGGG (SEQ ID NO:14563), GGGATTATAGGCGTGAGTTATTGTGTCGGGT (SEQ ID NO:14564), TGGGATTATAGGCGTGAGTTATTGTGTCGGG (SEQ ID NO:14565), TGGGATTATAGGCGTGAGTTATTGTGTCGGGT (SEQ ID NO:14566), GGATTATAGGCGTGAGTTATTGTGTCGGGT (SEQ ID NO:14567), TGCGGTTTTTGGCGGTGATTGTAGTTT (SEQ ID NO:14568), TTGCGGTTTTTGGCGGTGATTGTAGTT (SEQ ID NO:14569), TTTGCGGTTTTTGGCGGTGATTGTAGT (SEQ ID NO:14570), TGCGGTTTTTGGCGGTGATTGTAGTTTT (SEQ ID NO:14571), TTGCGGTTTTTGGCGGTGATTGTAGTTTT (SEQ ID NO:14572)

Target1542    chr16:22825641-22825700    GCGGCGTTTCGAGGATTAGGAATGGGG (SEQ ID NO:14573), CGAGGATTAGGAATGGGGTTTCGGGCG (SEQ ID NO:14574), ATTAGGAATGGGGTTTCGGGCGTTGGG (SEQ ID NO:14575), CGTGAGCGGCGTTTCGAGGATTAGGAA (SEQ ID NO:14576), TCGAGGATTAGGAATGGGGTTTCGGGCG (SEQ ID NO:14577), GCGGTTTTTCGGGGAATAGGCGGTTGT (SEQ ID NO:14578), TTCGGGGGTAGCGGTTTTTCGGGGAAT (SEQ ID NO:14579), GTTAGGGGGTTTCGGGGGTAGCGGTTT (SEQ ID NO:14580), GTAGTCGGGCGGTTCGGGCGTTTTTAG (SEQ ID NO:14581), TAGGGGGTTTCGGGGGTAGCGGTTTTT (SEQ ID NO:14582)

Target1543    chr16:22825836-22825861    GAGGAGTCGTTGTTTTCGGGATTTTTTGGT (SEQ ID NO:14583), CGTTGTTTTCGGGATTTTTTGGTATTGTGCG (SEQ ID NO:14584), CGTTGTTTTCGGGATTTTTTGGTATTGTGCGT (SEQ ID NO:14585), TCGTTGTTTTCGGGATTTTTTGGTATTGTGCG (SEQ ID NO:14586), TCGTTGTTTTCGGGATTTTTTGGTATTGTGCGT (SEQ ID NO:14587), GTCGGGGGTTATGGTTTTCGAGGGGGT (SEQ ID NO:14588), GGTTCGCGTCGGGGGGTTATGGTTTTCG

FIGURE 5 CONTINUED

|  |  |  |
|---|---|---|
|  |  | (SEQ ID NO:14589), AGGGGGTATCGGCGGTTGAGTTGTTGT (SEQ ID NO:14590), GGGTTCGCGTCGGGGGGTTATGGTTTTC (SEQ ID NO:14591), GGTTGAGGTGGTTTCGCGCGGTTTAGG (SEQ ID NO:14592) |
| Target1544 | chr16:22825912-22825918 | GGCGATCGTAGGGTTATAGTAGTTTAGTCGTCGG (SEQ ID NO:14593), GCGAGTTTTTTAGGCGATCGTAGGGTTATAGT (SEQ ID NO:14594), GGCGATCGTAGGGTTATAGTAGTTTAGTCGTCGGT (SEQ ID NO:14595), GCGATCGTAGGGTTATAGTAGTTTAGTCGTCGG (SEQ ID NO:14596), GGCGATCGTAGGGTTATAGTAGTTTAGTCGTCG (SEQ ID NO:14597), GGTTGAGGTGGTTTCGCGCGGTTTAGG (SEQ ID NO:14598), CGGTTGAGGTGGTTTCGCGCGGTTTAG (SEQ ID NO:14599), GTTGAGGTGGTTTCGCGCGGTTTAGGA (SEQ ID NO:14600), CGGTTGAGGTGGTTTCGCGCGGTTTA (SEQ ID NO:14601), TGAGGTGGTTTCGCGCGGTTTAGGATT (SEQ ID NO:14602) |
| Target1545 | chr16:22825953-22825973 | GTTTATAGGGGTTTTGGGTCGCGCGGGG (SEQ ID NO:14603), GGTTTATAGGGTTTTGGGTCGCGCGGG (SEQ ID NO:14604), TATAGGGTTTTGGGTCGCGCGGGGTTA (SEQ ID NO:14605), ATAGGGTTTTGGGTCGCGCGGGGTTAT (SEQ ID NO:14606), GGGTTTTGGGTCGCGCGGGGTTATTTT (SEQ ID NO:14607), CGTTTTTCGCGGTTGAGGTGGTTTCG (SEQ ID NO:14608), AGGAAGTTGTAATATAGGTAAGTGTAGGAGAGCGAG (SEQ ID NO:14609), GGAAGTTGTAATATAGGTAAGTGTAGGAGAGCGAGA (SEQ ID NO:14610) |
| Target1546 | chr16:22825974-22825984 | GTTTATAGGGGTTTTGGGTCGCGCGGGG (SEQ ID NO:14611), GGTTTATAGGGTTTTGGGTCGCGCGGG (SEQ ID NO:14612), TATAGGGTTTTGGGTCGCGCGGGGTTA (SEQ ID NO:14613), ATAGGGTTTTGGGTCGCGCGGGGTTAT (SEQ ID NO:14614), GGGTTTTGGGTCGCGCGGGGTTATTTT (SEQ ID NO:14615), AGGAAGTTGTAATATAGGTAAGTGTAGGAGAGCGAG (SEQ ID NO:14616), GGAAGTTGTAATATAGGTAAGTGTAGGAGAGCGAGA (SEQ ID NO:14617) |
| Target1547 | chr16:22825997-22826012 | CGGAGGGCGCGTAGGTTGTTTTTCGTT (SEQ ID NO:14618), GTTTATAGGGGTTTTGGGTCGCGCGGGG (SEQ ID NO:14619), GGTTTATAGGGTTTTGGGTCGCGCGGG (SEQ ID NO:14620), TATAGGGTTTTGGGTCGCGCGGGGTTA (SEQ ID NO:14621), ATAGGGTTTTGGGTCGCGCGGGGGTTAT (SEQ ID NO:14622), CGTTGGGGTCGCGGAGGTAGC (SEQ ID NO:14623), AGGAAGTTGTAATATAGGTAAGTGTAGGAGAGCGAG (SEQ ID NO:14624), GGAAGTTGTAATATAGGTAAGTGTAGGAGAGCGAGA (SEQ ID NO:14625) |
| Target1548 | chr16:22826054-22826118 | CGGAGGGCGCGTAGGTTGTTTTTCGTT (SEQ ID NO:14626), GTTTATAGGGGTTTTGGGTCGCGCGGGG (SEQ ID NO:14627), GGTTTATAGGGTTTTGGGTCGCGCGGG (SEQ ID NO:14628), TATAGGGTTTTGGGTCGCGCGGGGTTA (SEQ ID NO:14629), ATAGGGTTTTGGGTCGCGCGGGGGTTAT (SEQ ID NO:14630), CGTCGGTTCGGAGGGATTATAGGGGCG (SEQ ID NO:14631), GTCGGTTCGGAGGGATTATAGGGGCGG (SEQ ID NO:14632), GGCGTCGGTTCGGAGGGATTATAGGGG (SEQ ID NO:14633), GGGCGTCGGTTCGGAGGGATTATAGGG (SEQ ID NO:14634), GCGTCGGTTCGGAGGGATTATAGGGGC (SEQ ID NO:14635) |
| Target1549 | chr16:24267075-24267088 | GAATGTCGCGTTGGGTGGGTGTTGAGG (SEQ ID NO:14636), GGGTGGGTGTTGAGGGAGCGTTAGAGT (SEQ ID NO:14637), TGGGTGGGTGTTGAGGGAGCGTTAGAG (SEQ ID NO:14638), CGTTGGGTGGGTGTTGAGGGAGCGTTA (SEQ ID NO:14639), TTGGGTGGGTGTTGAGGGAGCGTTAGA (SEQ ID NO:14640), AGGGTTAAGGAAAGGGGAAGGGGAGCG (SEQ ID NO:14641), GGGTTAAGGAAAGGGGAAGGGGAGCGA (SEQ ID NO:14642), AAGGGTTAAGGAAAGGGGAAGGGGAGCG (SEQ ID NO:14643), GGGTTAAGGAAAGGGGAAGGGGAGCGAA (SEQ ID NO:14644), AGGGTTAAGGAAAGGGGAAGGGGAGCGA (SEQ ID NO:14645) |
| Target1550 | chr16:24267162-24267195 | CGGAGGAATCGGGTCGTGTTGTAGCGT (SEQ ID NO:14646), GGGTGGGTGTTGAGGGAGCGTTAGAGT (SEQ ID NO:14647), TGGGTGGGTGTTGAGGGAGCGTTAGAG (SEQ ID NO:14648), AGCGGAGGAATCGGGTCGTGTTGTAGC (SEQ ID NO:14649), CGTTGGGTGGGTGTTGAGGGAGCGTTA (SEQ ID NO:14650), GTCGTTCGGGTTAGAAATTCGGGGTGT (SEQ ID NO:14651), TCGTTCGGGTTAGAAATTCGGGGTGTT (SEQ ID NO:14652), GTCGTTCGGGTTAGAAATTCGGGGTGTT (SEQ ID NO:14653), TCGTTCGGGTTAGAAATTCGGGGTGT (SEQ ID NO:14654), TCGGGTTAGTTAGTCGGTTCGGTTTGT (SEQ ID NO:14655) |
| Target1551 | chr16:27240431-27240445 | TTCGGGTTGTTTTTCGTTTGTTCGTTTCG (SEQ ID NO:14656), TTTCGGGTTGTTTTTCGTTTGTTCGTTTCG (SEQ ID NO:14657), TTTTCGGGTTGTTTTTCGTTTGTTCGTTTCG (SEQ ID NO:14658), GCGTATTTTTCGGGTTGTTTTTCGTTTGTTCG (SEQ ID NO:14659), GCGTATTTTTCGGGTTGTTTTTCGTTTGTTCGT (SEQ ID NO:14660), TGGGAGTTGTTTGGAGTTTGGGGTGGG (SEQ ID NO:14661), TGGGAGTTGTTTGGAGTTTGGGGTGGGA (SEQ ID NO:14662), GGGAGTTGTTTGGAGTTTGGGGTGGGA (SEQ ID NO:14663), GTGGGAGTTGTTTGGAGTTTGGGGTGGG (SEQ ID NO:14664), GGAGTTGTTTGGAGTTTGGGGTGGGAGG (SEQ ID NO:14665) |
| Target1552 | chr16:27240514-27240685 | CGGGTTGTTTTTCGTTTGTTCGTTTCGT (SEQ ID NO:14666), TCGGGTTGTTTTTCGTTTGTTCGTTTCGT (SEQ ID NO:14667), TTCGGGTTGTTTTTCGTTTGTTCGTTTCG (SEQ ID NO:14668), TTCGGGTTGTTTTTCGTTTGTTCGTTTCGT (SEQ ID NO:14669), TCGGGTTGTTTTTCGTTTGTTCGTTTCGTA (SEQ ID NO:14670), TGGGAGTTGTTTGGAGTTTGGGGTGGG (SEQ ID NO:14671), TGGGAGTTGTTTGGAGTTTGGGGTGGGA (SEQ ID NO:14672), GGGAGTTGTTTGGAGTTTGGGGTGGGA (SEQ ID NO:14673), TGGGGTTATGGTTTGGAGGGGGGAGTTCG (SEQ ID NO:14674), GGGGTTATGGTTTGGAGGGGGGAGTTCG (SEQ ID NO:14675) |

FIGURE 5 CONTINUED

| | | |
|---|---|---|
| Target1553 | chr16:51189878-51190020 | GGGCGTCGGGTGTAGCGTCGTGATC (SEQ ID NO:14676), GGCGTCGGGTGTAGCGTCGTGATC (SEQ ID NO:14677), CGAAGTATGGAGTAGGTTTGGGTGGGT (SEQ ID NO:14678), GGGCGTCGGGTGTAGCGTCGTGAT (SEQ ID NO:14679), TCGAAGTATGGAGTAGGTTTGGGTGGGT (SEQ ID NO:14680), TTGGAGATAGTTTTTGGTGGCGGGCGG (SEQ ID NO:14681), TTTGGAGATAGTTTTTGGTGGCGGGCGG (SEQ ID NO:14682), TGGAGATAGTTTTTGGTGGCGGGCGG (SEQ ID NO:14683), TTTTGGAGATAGTTTTTGGTGGCGGGCG (SEQ ID NO:14684), GTTTGGAGATAGTTTTTGGTGGCGGGCGG (SEQ ID NO:14685) |
| Target1554 | chr16:51190029-51190202 | GGTGGTAAGCGGAGGGTGGGTTTGGTA (SEQ ID NO:14686), GGGTGGGTTTGGTAATTATTCGCGCGC (SEQ ID NO:14687), GGTGGTAAGCGGAGGGTGGGTTTGGTAA (SEQ ID NO:14688), AGGGTGGGTTTGGTAATTATTCGCGCGC (SEQ ID NO:14689), GTGGTAAGCGGAGGGTGGGTTTGGTAA (SEQ ID NO:14690), TTGGCGAGGTATTGTTGTATGCGGGGC (SEQ ID NO:14691), GCGAGGTATTGTTGTATGCGGGGCGTA (SEQ ID NO:14692), TGGCGAGGTATTGTTGTATGCGGGGCG (SEQ ID NO:14693), GGCGAGGTATTGTTGTATGCGGGGCG (SEQ ID NO:14694), GGCGAGGTATTGTTGTATGCGGGGCGT (SEQ ID NO:14695) |
| Target1555 | chr16:54968681-54968739 | TGGAGGAAGGAGAAGAGAGATTTAAGTGTGTGT (SEQ ID NO:14696), TGGAGGAAGGAGAAGAGAGATTTAAGTGTGTGTT (SEQ ID NO:14697), TTGGAGGAAGGAGAAGAGAGATTTAAGTGTGTGT (SEQ ID NO:14698), GGAGGAAGGAGAAGAGAGATTTAAGTGTGTGTT (SEQ ID NO:14699), TTTGGAGGAAGGAGAAGAGAGATTTAAGTGTGTG (SEQ ID NO:14700), GGGGTAGAGAAGAAGACGGTGATTTGGG (SEQ ID NO:14701), AGGGGTAGAGAAGAAGACGGTGATTTGGG (SEQ ID NO:14702), GGGGTAGAGAAGAAGACGGTGATTTGGGA (SEQ ID NO:14703), AGGGGTAGAGAAGAAGACGGTGATTTGGGA (SEQ ID NO:14704), AAGGGGTAGAGAAGAAGACGGTGATTTGGG (SEQ ID NO:14705) |
| Target1556 | chr16:54968897-54968917 | AGTGCGGGCGGGAGTATTTAGGGATGT (SEQ ID NO:14706), CGGGTTAGTGCGGGCGGGAGTATTTAG (SEQ ID NO:14707), GGGTTAGTGCGGGCGGGAGTATTTAGGG (SEQ ID NO:14708), GGTTAGTGCGGGCGGGAGTATTTAGGG (SEQ ID NO:14709), GGGTTAGTGCGGGCGGGAGTATTTAGG (SEQ ID NO:14710), CGTAGTTGAGCGGGTATTTTTGGGTCGT (SEQ ID NO:14711), CGTAGTTGAGCGGGTATTTTTGGGTCG (SEQ ID NO:14712), TCGTAGTTGAGCGGGTATTTTTGGGTCGT (SEQ ID NO:14713), TCGTAGTTGAGCGGGTATTTTTGGGTCG (SEQ ID NO:14714), CGTAGTTGAGCGGGTATTTTTGGGTCGTT (SEQ ID NO:14715) |
| Target1557 | chr16:54968927-54969052 | GTTCGTTTAGTTGCGGGGTTGGGGTCG (SEQ ID NO:14716), TTCGTTTAGTTGCGGGGTTGGGGTCGA (SEQ ID NO:14717), GTGTTCGTTTAGTTGCGGGGTTGGGGT (SEQ ID NO:14718), TCGTTTAGTTGCGGGGTTGGGGTCGAG (SEQ ID NO:14719), AGTGTTCGTTTAGTTGCGGGGTTGGGG (SEQ ID NO:14720), AAAGAGGTTCGTTGTGAGAGGGAGGGA (SEQ ID NO:14721), AGAGGTTCGTTGTGAGAGGGAGGGATT (SEQ ID NO:14722), AAGAGGTTCGTTGTGAGAGGGAGGGAT (SEQ ID NO:14723), AAAAGAGGTTCGTTGTGAGAGGGAGGG (SEQ ID NO:14724), AAAAGAGGTTCGTTGTGAGAGGGAGGGA (SEQ ID NO:14725) |
| Target1558 | chr16:57654022-57654470 | GGTTTTGGGAGGAGGTGGAAGGGGAGG (SEQ ID NO:14726), AGGGTAAGAGACGGGTGGGGGATAGGGG (SEQ ID NO:14727), TGTGGTTTTGGGAGGAGGTGGAAGGGG (SEQ ID NO:14728), TTTGGGAGGAGGTGGAAGGGGAGGAGT (SEQ ID NO:14729), GGGAGGAGGTGGAAGGGGAGGAGTAGG (SEQ ID NO:14730), AGGAGGAAGTTGTTTAGGGCGTTGCGG (SEQ ID NO:14731), GGAGGAAGTTGTTTAGGGCGTTGCGGA (SEQ ID NO:14732), AGGGCGTTGCGGAAAGTAGGTAGGAGA (SEQ ID NO:14733), AGGAGGAAGTTGTTTAGGGCGTTGCGGA (SEQ ID NO:14734), GGAGGAAGTTGTTTAGGGCGTTGCGGAA (SEQ ID NO:14735) |
| Target1559 | chr16:57654537-57654590 | TGGAAGGAATAGGGTGTAGGTTTGGGGGG (SEQ ID NO:14736), GGAAGGAATAGGGTGTAGGTTTGGGGG (SEQ ID NO:14737), TGGAAGGAATAGGGTGTAGGTTTGGGGG (SEQ ID NO:14738), GAAGGAATAGGGTGTAGGTTTGGGGGG (SEQ ID NO:14739), GGAAGGAATAGGGTGTAGGTTTGGGGG (SEQ ID NO:14740), GGGAGGGAGGGTTGTGATGTTGGGTGT (SEQ ID NO:14741), GGGGAGGGAGGGGTTGTGATGTTGGGTG (SEQ ID NO:14742), AGGGGAGGGAGGGTTGTGATGTTGGGT (SEQ ID NO:14743), TAGGGGAGGGAGGGTTGTGATGTTGGG (SEQ ID NO:14744), TCGGTGGAGGGAGGGATCGTTTGAAGT (SEQ ID NO:14745) |
| Target1560 | chr16:67428180-67428190 | CGGGGGCGGGGAGGAGGTTTTTGTATA (SEQ ID NO:14746), ATTTTGGTTAGTGGATCGGGGGCGGGG (SEQ ID NO:14747), GATTTTGGTTAGTGGATCGGGGGCGGG (SEQ ID NO:14748), CGGGGGCGGGGAGGAGGTTTTTGTATAG (SEQ ID NO:14749), TCGGGGGCGGGGAGGAGGTTTTTGTAT (SEQ ID NO:14750) |
| Target1561 | chr16:67428315-67428325 | GGGTCGGGTTTTTGGATGGTTCGTGGT (SEQ ID NO:14751), AGGGTCGGGTTTTTGGATGGTTCGTGG (SEQ ID NO:14752), AGGGTCGGGTTTTTGGATGGTTCGTGGT (SEQ ID NO:14753), GGGTCGGGTTTTTGGATGGTTCGTGGTT (SEQ ID NO:14754), GGTCGGGTTTTTGGATGGTTCGTGGTT (SEQ ID NO:14755), TTAGGGGTTTTTACGGTCGGCGGGATC (SEQ ID NO:14756), TTTTAGGGGTTTTTACGGTCGGCGGGA (SEQ ID NO:14757), TTTAGGGGTTTTTACGGTCGGCGGGAT (SEQ ID NO:14758), TTTAGGGGTTTTTACGGTCGGCGGGATC (SEQ ID NO:14759), ATTTTAGGGGTTTTTACGGTCGGCGGG (SEQ ID NO:14760) |

FIGURE 5 CONTINUED

Target1562    chr16:67428400-67428414    AGTCGGTGGGGCGGGTATTGTTGAGTC (SEQ ID NO:14761), CGGGTATTGTTGAGTCGTGGGGGAGGG
(SEQ ID NO:14762), GAGTCGTGGGGGAGGGAGGTCGATTTC (SEQ ID NO:14763),
TGAGTCGTGGGGGAGGGAGGTCGATTT (SEQ ID NO:14764), TTGAGTCGTGGGGGAGGGAGGTCGATT
(SEQ ID NO:14765), GGCGGTCGGGGAGGTTGGTTTGGTTTAG (SEQ ID NO:14766),
GCGGTCGGGGAGGTTGGTTTGGTTTAGT (SEQ ID NO:14767), TTTTAGGGGTTTTTACGGTCGGCGGGA
(SEQ ID NO:14768), GGCGGTCGGGGAGGTTGGTTTGGTTTAGT (SEQ ID NO:14769),
TTAGGGGTTTTTACGGTCGGCGGGATT (SEQ ID NO:14770)

Target1563    chr16:67428489-67428760    CGAGTGGTAGGCGTCGGTAGGGTTAGC (SEQ ID NO:14771), TTCGGTGCGGTAAGGATGGGGTGTTGT
(SEQ ID NO:14772), CGGGTATTGTTGAGTCGTGGGGGAGGG (SEQ ID NO:14773),
GAGTCGTGGGGGAGGGAGGTCGATTTC (SEQ ID NO:14774), AGGGTTAGCGGCGTGTATAGGGTTGGC
(SEQ ID NO:14775), GCGTTTGGGTAGCGTCGTTTTGGTCGT (SEQ ID NO:14776),
GGCGGTCGGGGAGGTTGGTTTGGTTTAG (SEQ ID NO:14777), GGGCGGTCGGGGAGGTTGGTTTGGTTTA
(SEQ ID NO:14778), GCGGTCGGGGAGGTTGGTTTGGTTTAGT (SEQ ID NO:14779),
GCGTTTGGGTAGCGTCGTTTTGGTCGTT (SEQ ID NO:14780)

Target1564    chr16:67428762-67428885    AGCGGCGGTTGGGGGTTTTAGGTTTTG (SEQ ID NO:14781), CGAGTGGTAGGCGTCGGTAGGGTTAGC
(SEQ ID NO:14782), GAGCGGCGGTTGGGGGTTTTAGGTTTT (SEQ ID NO:14783),
GGCGGTTGGGGGTTTTAGGTTTTGCGT (SEQ ID NO:14784), AGGGTTAGCGGCGTGTATAGGGTTGGC
(SEQ ID NO:14785), TGGGAATTCGAGGGAGGGGAAGGTAGA (SEQ ID NO:14786),
TTTTGGGAATTCGAGGGAGGGGAAGGT (SEQ ID NO:14787),
TGGGAATTCGAGGGAGGGGAAGGTAGAGT (SEQ ID NO:14788),
GGGAATTCGAGGGAGGGGAAGGTAGAGT (SEQ ID NO:14789),
TGGGAATTCGAGGGAGGGGAAGGTAGAG (SEQ ID NO:14790)

Target1565    chr16:70771491-70771501    TGTAGAGGGTAGGAGTATGAGGGAGAGTGT (SEQ ID NO:14791),
TGTAGAGGGTAGGAGTATGAGGGAGAGTGTT (SEQ ID NO:14792),
TTGTAGAGGGTAGGAGTATGAGGGAGAGTGT (SEQ ID NO:14793),
TTTGTAGAGGGTAGGAGTATGAGGGAGAGTG (SEQ ID NO:14794),
TTGTAGAGGGTAGGAGTATGAGGGAGAGTGTT (SEQ ID NO:14795),
AGTTTGGGTTTTTGTGTGGAGTGCGTT (SEQ ID NO:14796), TGGGTTTTTGTGTGGAGTGCGTTTTTGT
(SEQ ID NO:14797), AGTTTGGGTTTTTGTGTGGAGTGCGTTT (SEQ ID NO:14798),
GGGTTTTTGTGTGGAGTGCGTTTTTGT (SEQ ID NO:14799), TGGGTTTTTGTGTGGAGTGCGTTTTTGTG
(SEQ ID NO:14800)

Target1566    chr16:70771558-70771860    GGTGGGCGGTCGGGGAGTTAGTTTTGT (SEQ ID NO:14801), GGGTGGGCGGTCGGGGAGTTAGTTTTG
(SEQ ID NO:14802), GGTGGGCGGTCGGGGAGTTAGTTTTGTA (SEQ ID NO:14803),
GGGTGGGCGGTCGGGGAGTTAGTTTT (SEQ ID NO:14804), GTGGGCGGTCGGGGAGTTAGTTTTGTA
(SEQ ID NO:14805), GGAGGGAGGTCGGAGTGGAGTAGGGAT (SEQ ID NO:14806),
TAGGGAGGGAGGTCGGAGTGGAGTAGG (SEQ ID NO:14807),
GGAGGGAGGTCGGAGTGGAGTAGGGATT (SEQ ID NO:14808),
GTAGGGAGGGAGGTCGGAGTGGAGTAGG (SEQ ID NO:14809), AGGGAGGGAGGTCGGAGTGGAGTAGG
(SEQ ID NO:14810)

Target1567    chr16:75098378-75098639    TGTTTGAGTTCGGGGTGTAGAGGTTGT (SEQ ID NO:14811), AGTTCGGGGTGTAGAGGTTGTAGTGAGT
(SEQ ID NO:14812), TGAGTTCGGGGTGTAGAGGTTGTAGTGA (SEQ ID NO:14813),
TTGTTTGAGTTCGGGGTGTAGAGGTTGT (SEQ ID NO:14814),
TGAGTTCGGGGTGTAGAGGTTGTAGTGAGT (SEQ ID NO:14815),
TGGAGTGGGGTAAGTGAGTAGGAGGAA (SEQ ID NO:14816),
TGGAGTGGGGTAAGTGAGTAGGAGGAAG (SEQ ID NO:14817),
TGGAGTGGGGTAAGTGAGTAGGAGGAAGA (SEQ ID NO:14818),
GGAGTGGGGTAAGTGAGTAGGAGGAAGA (SEQ ID NO:14819),
ATGGAGTGGGGTAAGTGAGTAGGAGGAA (SEQ ID NO:14820)

Target1568    chr16:75098750-75098929    GGGTTTAGTAAATTGGTAGGTGTATGGGGTTGT (SEQ ID NO:14821),
AGGGTTTAGTAAATTGGTAGGTGTATGGGGTTG (SEQ ID NO:14822),
AGGGTTTAGTAAATTGGTAGGTGTATGGGGTTGT (SEQ ID NO:14823),
TGGTAGGTGTATGGGGTTGTAAATTTGGTTTTGT (SEQ ID NO:14824),
AGGTGTATGGGGTTGTAAATTTGGTTTTGTAGGA (SEQ ID NO:14825),
TGAGGGAGTAGGAGGGTGAGTTGTGGT (SEQ ID NO:14826), TGGGTTTTGTGAGGGGTAAAGGACGGT
(SEQ ID NO:14827), GGGAGTAGGAGGGTGAGTTGTGGTAGGGT (SEQ ID NO:14828),
GGGAGTAGGAGGGTGAGTTGTGGTAGGG (SEQ ID NO:14829),
AGGGAGTAGGAGGGTGAGTTGTGGTAGGG (SEQ ID NO:14830)

Target1569    chr16:86321612-86321665    TGGACGGTGTTGATGGGATCGGGGATG (SEQ ID NO:14831), GGACGGTGTTGATGGGATCGGGGATGA
(SEQ ID NO:14832), TTTGGACGGTGTTGATGGGATCGGGGA (SEQ ID NO:14833),
TTGGACGGTGTTGATGGGATCGGGGAT (SEQ ID NO:14834), GTTTGGACGGTGTTGATGGGATCGGGG
(SEQ ID NO:14835), ACGGAAGGGGAGGGTGGGTAGATTGGA (SEQ ID NO:14836),
CGGAAGGGGAGGGTGGGTAGATTGGAG (SEQ ID NO:14837), AACGGAAGGGGAGGGTGGGTAGATTGG
(SEQ ID NO:14838), AACGGAAGGGGAGGGTGGGTAGATTGGA (SEQ ID NO:14839),
CGGAAGGGGAGGGTGGGTAGATTGGAGA (SEQ ID NO:14840)

FIGURE 5 CONTINUED

Target1570    chr16:86612256-86612267    GGATAGAGTACGGAGCGGTCGGGGAGA (SEQ ID NO:14841), AAGGGATAGAGTACGGAGCGGTCGGGG (SEQ ID NO:14842), TGGTTTTTCGGGAGGGTTTTTGCGGCG (SEQ ID NO:14843), GAAGGGATAGAGTACGGAGCGGTCGGG (SEQ ID NO:14844), GGGATAGAGTACGGAGCGGTCGGGGAG (SEQ ID NO:14845), GAGGCGGTTAGGGTAGGTAGTCGGGGA (SEQ ID NO:14846), AGGCGGTTAGGGTAGGTAGTCGGGGAT (SEQ ID NO:14847), ATGGGCGAGGCGGTTAGGGTAGGTAGT (SEQ ID NO:14848), AGTATGGGCGAGGCGGTTAGGGTAGGT (SEQ ID NO:14849), TGGGCGAGGCGGTTAGGGTAGGTAGTC (SEQ ID NO:14850)

Target1571    chr16:86612295-86612313    GGGGCGTAGTGTTTAGGTCGTTCGGGT (SEQ ID NO:14851), GGATAGAGTACGGAGCGGTCGGGGAGA (SEQ ID NO:14852), AAGGGATAGAGTACGGAGCGGTCGGGG (SEQ ID NO:14853), TGGTTTTTCGGGAGGGTTTTTGCGGCG (SEQ ID NO:14854), GAAGGGATAGAGTACGGAGCGGTCGGG (SEQ ID NO:14855), GAGGCGGTTAGGGTAGGTAGTCGGGGA (SEQ ID NO:14856), GGCGAAGGTTAGAGGGAGGTCGGGTTT (SEQ ID NO:14857), AGGCGGTTAGGGTAGGTAGTCGGGGAT (SEQ ID NO:14858), ATGGGCGAGGCGGTTAGGGTAGGTAGT (SEQ ID NO:14859), AGTATGGGCGAGGCGGTTAGGGTAGGT (SEQ ID NO:14860)

Target1572    chr16:86612344-86612369    GGGGCGTAGTGTTTAGGTCGTTCGGGT (SEQ ID NO:14861), TGGTTTTTCGGGAGGGTTTTTGCGGCG (SEQ ID NO:14862), CGGGGCGTAGTGTTTAGGTCGTTCGGG (SEQ ID NO:14863), AGGTCGTTCGGGTTTTTTGCGTTGCGG (SEQ ID NO:14864), TTGGTTTTTCGGGAGGGTTTTTGCGGC (SEQ ID NO:14865), GAGGTTTTTGCGGGGTTTCGGTTCGGT (SEQ ID NO:14866), GAGGCGGTTAGGGTAGGTAGTCGGGGA (SEQ ID NO:14867), GGCGAAGGTTAGAGGGAGGTCGGGTTT (SEQ ID NO:14868), AGGCGGTTAGGGTAGGTAGTCGGGGAT (SEQ ID NO:14869), AGGTTTTTGCGGGGTTTCGGTTCGGTT (SEQ ID NO:14870)

Target1573    chr16:86612425-86612434    TCGGTTGTTTGTTTTGGTCGTTTCGTTTATGTT (SEQ ID NO:14871), CGGTTGTTTGTTTTGGTCGTTTCGTTTATGTT (SEQ ID NO:14872), TCGGTTGTTTGTTTTGGTCGTTTCGTTTATGTT (SEQ ID NO:14873), CGGTTGTTTGTTTTGGTCGTTTCGTTTATGTTG (SEQ ID NO:14874), CGGTTGTTTGTTTTGGTCGTTTCGTTTATGTTGT (SEQ ID NO:14875), GAGGTTTTTGCGGGGTTTCGGTTCGGT (SEQ ID NO:14876), TTCGGGCGCGTTTTGGATCGTTATGGC (SEQ ID NO:14877), AGGTTTTTGCGGGGTTTCGGTTCGGTT (SEQ ID NO:14878), TTTTTGCGGGGTTTCGGTTCGGTTCGA (SEQ ID NO:14879), GGAGGTTTTTGCGGGGTTTCGGTTCGG (SEQ ID NO:14880)

Target1574    chr16:86612451-86612462    CGCGGTTGTTTTAGTTGTTTCGGGTCGG (SEQ ID NO:14881), GCGGTTGTTTTAGTTGTTTCGGGTCGGG (SEQ ID NO:14882), CGCGGTTGTTTTAGTTGTTTCGGGTCGGG (SEQ ID NO:14883), GCGGTTGTTTTAGTTGTTTCGGGTCGGGT (SEQ ID NO:14884), TCGCGGTTGTTTTAGTTGTTTCGGGTCGG (SEQ ID NO:14885), GAGGTTTTTGCGGGGTTTCGGTTCGGT (SEQ ID NO:14886), TTCGGGCGCGTTTTGGATCGTTATGGC (SEQ ID NO:14887), AGGTTTTTGCGGGGTTTCGGTTCGGTT (SEQ ID NO:14888), GGAGGTTTTTGCGGGGTTTCGGTTCGG (SEQ ID NO:14889), GGGAGGTTTTTGCGGGGTTTCGGTTCG (SEQ ID NO:14890)

Target1575    chr16:86612494-86612549    CGCGGTTGTTTTAGTTGTTTCGGGTCGG (SEQ ID NO:14891), GCGGTTGTTTTAGTTGTTTCGGGTCGGG (SEQ ID NO:14892), CGCGGTTGTTTTAGTTGTTTCGGGTCGGG (SEQ ID NO:14893), GCGGTTGTTTTAGTTGTTTCGGGTCGGGT (SEQ ID NO:14894), TCGCGGTTGTTTTAGTTGTTTCGGGTCGG (SEQ ID NO:14895), GGTTGTCGTGGTAGAAGGGGAAGCGGT (SEQ ID NO:14896), TTCGGGCGCGTTTTGGATCGTTATGGC (SEQ ID NO:14897), CGGTTGTCGTGGTAGAAGGGGAAGCGG (SEQ ID NO:14898), GTTCGGGCGCGTTTTGGATCGTTATGG (SEQ ID NO:14899), TGTTCGGGCGCGTTTTGGATCGTTATGG (SEQ ID NO:14900)

Target1576    chr16:86612573-86612642    GCGAGAGGTTGTGGCGGATGTTGTTTT (SEQ ID NO:14901), GCGAGAGGTTGTGGCGGATGTTGTTTTG (SEQ ID NO:14902), GCGAGAGGTTGTGGCGGATGTTGTTTTGT (SEQ ID NO:14903), GCGAGAGGTTGTGGCGGATGTTGTTT (SEQ ID NO:14904), CGAGAGGTTGTGGCGGATGTTGTTTTGT (SEQ ID NO:14905)

Target1577    chr16:86612650-86612839    CGAGAAAGGGCGGTCGGGTAAGGGTAG (SEQ ID NO:14906), GAGAAAGGGCGGTCGGGTAAGGGTAGT (SEQ ID NO:14907), AGAAAGGGCGGTCGGGTAAGGGTAGTT (SEQ ID NO:14908), CGAGAAAGGGCGGTCGGGTAAGGGTA (SEQ ID NO:14909), GGGCGGTCGGGTAAGGGTAGTTATTGG (SEQ ID NO:14910), CGTTGTTTGTAGGCGGGAGATTGCGGG (SEQ ID NO:14911), CGGGGCGTTGTTTGTAGGCGGGAGATTG (SEQ ID NO:14912), GTTGTTTGTAGGCGGGAGATTGCGGGG (SEQ ID NO:14913), CGTTTCGGCGCGGGGTTTTTTGGTTTT (SEQ ID NO:14914), GGGCGTTGTTTGTAGGCGGGAGATTGC (SEQ ID NO:14915)

Target1578    chr16:86612844-86613033    GGGGTTTCGGAGGTTAAGAGGTTTCGCG (SEQ ID NO:14916), CGGGGTTTCGGAGGTTAAGAGGTTTCGC (SEQ ID NO:14917), TCGGGGTTTCGGAGGTTAAGAGGTTTCGC (SEQ ID NO:14918), GGGTTTCGGAGGTTAAGAGGTTTCGCGT (SEQ ID NO:14919), GGGTTTCGGAGGTTAAGAGGTTTCGCG (SEQ ID NO:14920), CGTTGTTTGTAGGCGGGAGATTGCGGG (SEQ ID NO:14921), CGGGGCGTTGTTTGTAGGCGGGAGATTG (SEQ ID NO:14922), TGCGCGTTGTTTGGTCGATCGTTACGG (SEQ ID NO:14923), GCGCGTTGTTTGGTCGATCGTTACGGT (SEQ ID NO:14924), GTTGTTTGTAGGCGGGAGATTGCGGGG (SEQ ID NO:14925)

Target1579    chr16:86613062-86613095    CGGTCGTGGCGGTCGGTTAGGTAGC (SEQ ID NO:14926), GCGGTCGTGGCGGTCGGTTAGGTAG (SEQ ID NO:14927), GCGGTCGTGGCGGTCGGTTAGGTA (SEQ ID NO:14928), GGTCGTGGCGGTCGGTTAGGTAGC (SEQ ID NO:14929), GCGGTCGTGGCGGTCGGTTAGGTAGC (SEQ ID NO:14930), GGAGTTCGTTTTTTTGAAGGCGGTTTTTGG (SEQ ID NO:14931),

FIGURE 5 CONTINUED

GGAGTTCGTTTTTTGAAGGCGGTTTTTGGT (SEQ ID NO:14932),
AGGAGTTCGTTTTTTGAAGGCGGTTTTTGG (SEQ ID NO:14933),
AGGAGTTCGTTTTTTGAAGGCGGTTTTTGGT (SEQ ID NO:14934),
GGAGTTCGTTTTTTGAAGGCGGTTTTTGGTT (SEQ ID NO:14935)

Target1580    chr16:86613166-86613217    GGGGTGTTAAGTTTGGGTTCGGCGGTC (SEQ ID NO:14936), AGGGGGTGTTAAGTTTGGGTTCGGCGG
(SEQ ID NO:14937), GGGGGTGTTAAGTTTGGGTTCGGCGGT (SEQ ID NO:14938),
GGGGGTGTTAAGTTTGGGTTCGGCGG (SEQ ID NO:14939), TAGGGGGTGTTAAGTTTGGGTTCGGCGG
(SEQ ID NO:14940), TTGAAAGGCGGACGGAGGTTGGAGGAG (SEQ ID NO:14941),
GTTGAAAGGCGGACGGAGGTTGGAGGA (SEQ ID NO:14942), GACGGAGGTTGGAGGAGGCGGTTAGGA
(SEQ ID NO:14943), ACGGAGGTTGGAGGAGGCGGTTAGGAG (SEQ ID NO:14944),
TGAAAGGCGGACGGAGGTTGGAGGAG (SEQ ID NO:14945)

Target1581    chr16:86613256-86613290    GGGGTGTTAAGTTTGGGTTCGGCGGTC (SEQ ID NO:14946), AGGGGGTGTTAAGTTTGGGTTCGGCGG
(SEQ ID NO:14947), CGGCGGTCGTTTGGGTGTTTCGTTTTT (SEQ ID NO:14948),
GGGGGTGTTAAGTTTGGGTTCGGCGGT (SEQ ID NO:14949), GGGGGTGTTAAGTTTGGGTTCGGCGG
(SEQ ID NO:14950), GCGGAGGTTTAGGTTGGGTCGGGAGA (SEQ ID NO:14951),
GCGGAGGTTTAGGTTGGGTCGGGAG (SEQ ID NO:14952), AAGTCGTTTTGGATATGCGGGTCGAGT (SEQ
ID NO:14953), TCGTGTCGGGAATTTGTAGGGGGGAAAT (SEQ ID NO:14954),
ATCGTGTCGGGAATTTGTAGGGGGGAAA (SEQ ID NO:14955)

Target1582    chr16:88599725-88600068    GCGAGTTGGGTTTGGTCGGGGTTTTGT (SEQ ID NO:14956), GGCGAGTTGGGTTTGGTCGGGGTTTTG
(SEQ ID NO:14957), ATTAAGGTGGAGGCGGTGGAGGAGTCG (SEQ ID NO:14958),
GCGAGTTGGGTTTGGTCGGGGTTTTGTT (SEQ ID NO:14959), TTAAGGTGGAGGCGGTGGAGGAGTCGG
(SEQ ID NO:14960), TTCGGTTTTGATTTTGGTCGGGGCGGG (SEQ ID NO:14961),
GGTTTTGATTTTGGTCGGGGCGGGGTT (SEQ ID NO:14962), TCGGCGTGGGGTTGGATAGTTCGGTTT
(SEQ ID NO:14963), TTCGGCGTGGGGTTGGATAGTTCGGTT (SEQ ID NO:14964),
TGGGGGTTTCGGGGAAGAGTTCGGTTT (SEQ ID NO:14965)

Target1583    chr16:88600094-88600193    TGTATAGTCGGTTGTAGTAGGGCGCGGG (SEQ ID NO:14966), GTATAGTCGGTTGTAGTAGGGCGCGGG
(SEQ ID NO:14967), GTGTATAGTCGGTTGTAGTAGGGCGCGGG (SEQ ID NO:14968),
GGTGTATAGTCGGTTGTAGTAGGGCGCGG (SEQ ID NO:14969), TGTATAGTCGGTTGTAGTAGGGCGCGG
(SEQ ID NO:14970), CGTTTTGGGTTTGCGCGCGGTAGG (SEQ ID NO:14971),
GTCGGGTCGGGGGGCGTTTTGGGTTTG (SEQ ID NO:14972), GGGTCGGGGGGCGTTTTGGGTTTG (SEQ
ID NO:14973), GGGTCGGGGGGCGTTTTGGGTTTT (SEQ ID NO:14974),
GGTCGGGGGGCGTTTTGGGTTTGC (SEQ ID NO:14975)

Target1584    chr16:88769741-88770164    ATTGGTAGGGCGGTTGGGTTCGAGGAG (SEQ ID NO:14976), TAGGGCGGTTGGGTTCGAGGAGTAGGA
(SEQ ID NO:14977), GATTGGTAGGGCGGTTGGGTTCGAGGA (SEQ ID NO:14978),
AAGGAAGTGGTTGAGGGCGATGGGTGT (SEQ ID NO:14979), TTCGATTGGTAGGGCGGTTGGGTTCGA
(SEQ ID NO:14980), GGGTGTTTGTTGGGAGGGTTAGTGCGC (SEQ ID NO:14981),
GGTGTTTGTTGGGAGGGTTAGTGCGCG (SEQ ID NO:14982), CGGGTGTTTGTTGGGAGGGTTAGTGCG
(SEQ ID NO:14983), GTGTTTGTTGGGAGGGTTAGTGCGCGA (SEQ ID NO:14984),
TGTTTGTTGGGAGGGTTAGTGCGCGAT (SEQ ID NO:14985)

Target1585    chr17:4425211-4425222    ACGTGGGTAGTTTGAATTTAGTTAGGGCGG (SEQ ID NO:14986),
CGACGTGGGTAGTTTGAATTTAGTTAGGGCGG (SEQ ID NO:14987),
CGTGGGTAGTTTGAATTTAGTTAGGGCGGA (SEQ ID NO:14988),
ACGTGGGTAGTTTGAATTTAGTTAGGGCGGA (SEQ ID NO:14989),
ACGACGTGGGTAGTTTGAATTTAGTTAGGGCGG (SEQ ID NO:14990),
GTGTTGGGATTATAGGGGTGAGTTATCGTGT (SEQ ID NO:14991),
AGTGTTGGGATTATAGGGGTGAGTTATCGTGT (SEQ ID NO:14992),
GTGTTGGGATTATAGGGGTGAGTTATCGTGTT (SEQ ID NO:14993),
AAGTGTTGGGATTATAGGGGTGAGTTATCGTG (SEQ ID NO:14994),
TGTTGGGATTATAGGGGTGAGTTATCGTGTTC (SEQ ID NO:14995)

Target1586    chr17:8516474-8516531    TGGTCGGGGTGGGAAAAGGAAAATCGA (SEQ ID NO:14996), GTGGTCGGGGTGGGAAAAGGAAAATCG
(SEQ ID NO:14997), AGTGGTCGGGGTGGGAAAAGGAAAATCG (SEQ ID NO:14998),
GTGGTCGGGGTGGGAAAAGGAAAATCGA (SEQ ID NO:14999),
AGTGGTCGGGGTGGGAAAAGGAAAATCGA (SEQ ID NO:15000),
TGGATTTGGAATTTAGAGTCGGCGGTTGT (SEQ ID NO:15001),
TGTTGGATTTGGAATTTAGAGTCGGCGGT (SEQ ID NO:15002),
TGGATTTGGAATTTAGAGTCGGCGGTTGTT (SEQ ID NO:15003),
TTGGATTTGGAATTTAGAGTCGGCGGTTGT (SEQ ID NO:15004),
TGTTGGATTTGGAATTTAGAGTCGGCGGTT (SEQ ID NO:15005)

Target1587    chr17:25867500-25867639    TTAGTGGGAGGTTTGGCGGGGAGGTTG (SEQ ID NO:15006), TTGTTAGTGGGAGGTTTGGCGGGGAGG
(SEQ ID NO:15007), GTTAGTGGGAGGTTTGGCGGGGAGGTT (SEQ ID NO:15008),
TTAGGAGAGTGCGGGTATGGGTCGGGT (SEQ ID NO:15009), GGGAGGTTTGGCGGGGAGGTTGTTTTT
(SEQ ID NO:15010), AGGGAAAGTGGGGTAAGGAGAGGAGAA (SEQ ID NO:15011),
AGGGAAAGTGGGGTAAGGAGAGGAGAAA (SEQ ID NO:15012),
GGGAAAGTGGGGTAAGGAGAGGAGAAGT (SEQ ID NO:15013),
GGGAAAGTGGGGTAAGGAGAGGAGAAAG (SEQ ID NO:15014),
AGGGAAAGTGGGGTAAGGAGAGGAGA (SEQ ID NO:15015)

FIGURE 5 CONTINUED

| | | |
|---|---|---|
| *Target1588* | chr17:25867805-25867830 | CGTGGGCGTTTTTGAGGGGTTGGGTAGT (SEQ ID NO:15016), TCGGAGTTGGGTGTTATGGTCGTTGCG (SEQ ID NO:15017), CGTGGGCGTTTTTGAGGGTTGGGTAGTG (SEQ ID NO:15018), TGGGCGTTTTTGAGGGGTTGGGTAGTGT (SEQ ID NO:15019), TTCGGAGTTGGGTGTTATGGTCGTTGCG (SEQ ID NO:15020), AGGGAGGTTTTTGGAGGTTGTGATGTAGTTGA (SEQ ID NO:15021), AAGGGAGGTTTTTGGAGGTTGTGATGTAGTTGA (SEQ ID NO:15022), AGGGAGGTTTTTGGAGGTTGTGATGTAGTTGAT (SEQ ID NO:15023), TGAGAATGTAAGGAGGTTTTTGGAGGTTGTGA (SEQ ID NO:15024), TGTAAGGAGGTTTTTGGAGGTTGTGATGTAGT (SEQ ID NO:15025) |
| *Target1589* | chr17:28705582-28706059 | CGGGGTTAGCGGCGTTGTTGGAAGATG (SEQ ID NO:15026), GTTTCGGACGGGAGGAGGGTAGGTTCG (SEQ ID NO:15027), GGGGTTAGCGGCGTTGTTGGAAGATGG (SEQ ID NO:15028), TTAGAGGGCGGGATGGGGTTGTTAGGC (SEQ ID NO:15029), CGGTTAGAGGGCGGGATGGGGTTGTTA (SEQ ID NO:15030), CGTTAAGGCGGTCGTTCGTTTCGGTCG (SEQ ID NO:15031), GCGGTCGTTCGTTTCGGTCGTTCGTTA (SEQ ID NO:15032), GTTAAGGCGGTCGTTCGTTTCGGTCGT (SEQ ID NO:15033), GTCGTTAAGGCGGTCGTTCGTTTCGGT (SEQ ID NO:15034), AGTCGTTAAGGCGGTCGTTCGTTTCGG (SEQ ID NO:15035) |
| *Target1590* | chr17:32964522-32964532 | GCGGGTGTATTTTGGGAGGGACGAGGA (SEQ ID NO:15036), TGCGGGTGTATTTTGGGAGGGACGAGG (SEQ ID NO:15037), TGGGTTTGCGGGTGTATTTTGGGAGGG (SEQ ID NO:15038), GGGTTTGCGGGTGTATTTTGGGAGGGA (SEQ ID NO:15039), TGGGTTTGCGGGTGTATTTTGGGAGGGA (SEQ ID NO:15040), TGTTCGGGTTTGGAGTTTTCGGTGCGG (SEQ ID NO:15041), CGGGTAGCGTAGAGTTCGGCGGGTTAG (SEQ ID NO:15042), CGGGTTTGGAGTTTTCGGTGCGGGTAG (SEQ ID NO:15043), TCGGGTTTGGAGTTTTCGGTGCGGGTA (SEQ ID NO:15044), GTTCGGGTTTGGAGTTTTCGGTGCGGG (SEQ ID NO:15045) |
| *Target1591* | chr17:32964537-32964582 | GCGGGTGTATTTTGGGAGGGACGAGGA (SEQ ID NO:15046), GGGAGTTGGTTCGTCGGGTTTTGCGTT (SEQ ID NO:15047), TGCGGGTGTATTTTGGGAGGGACGAGG (SEQ ID NO:15048), GGTTCGGGGAGTTGGTTCGTCGGGTTT (SEQ ID NO:15049), GTTCGGGGAGTTGGTTCGTCGGGTTTT (SEQ ID NO:15050), TGTTCGGGTTTGGAGTTTTCGGTGCGG (SEQ ID NO:15051), CGGGTAGCGTAGAGTTCGGCGGGTTAG (SEQ ID NO:15052), CGGGTTTGGAGTTTTCGGTGCGGGTAG (SEQ ID NO:15053), TCGGGTTTGGAGTTTTCGGTGCGGGTA (SEQ ID NO:15054), GTTCGGGTTTGGAGTTTTCGGTGCGGG (SEQ ID NO:15055) |
| *Target1592* | chr17:32964670-32964727 | GGGAGTTGGTTCGTCGGGTTTTGCGTT (SEQ ID NO:15056), GGGAGTTGGTTCGTCGGGTTTTGCGT (SEQ ID NO:15057), GGGAGTTGGTTCGTCGGGTTTTGCGTTA (SEQ ID NO:15058), GGAGATCGGTATGTACGCGTTGTTGGGC (SEQ ID NO:15059), GGAGTTGGTTCGTCGGGTTTTGCGTTA (SEQ ID NO:15060), CGGGATGCGTTTGTGTCGGTAGCGTAG (SEQ ID NO:15061), GGGATGCGTTTGTGTCGGTAGCGTAGT (SEQ ID NO:15062), GCGGGATGCGTTTGTGTCGGTAGCGTA (SEQ ID NO:15063), TGATGAGGAAGACGAGGATGGCGAGGT (SEQ ID NO:15064), AGACGAGGATGGCGAGGTAGAAGACGT (SEQ ID NO:15065) |
| *Target1593* | chr17:32964769-32964785 | GGAGATCGGTATGTACGCGTTGTTGGGC (SEQ ID NO:15066), GAGATCGGTATGTACGCGTTGTTGGGC (SEQ ID NO:15067), TGGAGATCGGTATGTACGCGTTGTTGGGC (SEQ ID NO:15068), TGGAGATCGGTATGTACGCGTTGTTGGG (SEQ ID NO:15069), GGAGATCGGTATGTACGCGTTGTTGGG (SEQ ID NO:15070), TTTAGCGGGTTGTTTGTTGGCGGCGAT (SEQ ID NO:15071), TTTTAGCGGGTTGTTTGTTGGCGGCGA (SEQ ID NO:15072), TAGCGGGTTGTTTGTTGGCGGCGATAG (SEQ ID NO:15073), TTTTTAGCGGGTTGTTTGTTGGCGGCG (SEQ ID NO:15074), TTAGCGGGTTGTTTGTTGGCGGCGATA (SEQ ID NO:15075) |
| *Target1594* | chr17:32964854-32964913 | TGCGGGTGTAAGGAGAGTTGTCGTCGT (SEQ ID NO:15076), CGTTGCGGGTGTAAGGAGAGTTGTCGT (SEQ ID NO:15077), TGCGGGTGTAAGGAGAGTTGTCGTCGTT (SEQ ID NO:15078), TTGCGGGTGTAAGGAGAGTTGTCGTCGT (SEQ ID NO:15079), GCGGGTGTAAGGAGAGTTGTCGTCGTT (SEQ ID NO:15080), TTTAGCGGGTTGTTTGTTGGCGGCGAT (SEQ ID NO:15081), TTTTAGCGGGTTGTTTGTTGGCGGCGA (SEQ ID NO:15082), GTGGTCGTCGTGGTAGAAGGCGGGTAC (SEQ ID NO:15083), TTGGCGGGGTTTTCGGTTTGGTTTCGG (SEQ ID NO:15084), GCGGGGTTTTCGGTTTGGTTTCGGGTT (SEQ ID NO:15085) |
| *Target1595* | chr17:33640320-33640895 | TGTTTTATGTGAAGGGTGGGGCGGGGA (SEQ ID NO:15086), GTGAAGGGTGGGGCGGGGAGAGTTTTA (SEQ ID NO:15087), TGGGGTAGGGTGGTTGTGTTGTGGGTT (SEQ ID NO:15088), TTTATGTGAAGGGTGGGGCGGGGAGAG (SEQ ID NO:15089), ATGGGGTAGGGTGGTTGTGTTGTGGGT (SEQ ID NO:15090), TGCGTGGGAGGGAAGTGTAAGAGTGTT (SEQ ID NO:15091), TTGCGTGGGAGGGAAGTGTAAGAGTGT (SEQ ID NO:15092), GCGTGGGAGGGAAGTGTAAGAGTGTTTCG (SEQ ID NO:15093), TGCGTGGGAGGGAAGTGTAAGAGTGTTT (SEQ ID NO:15094), TTGCGTGGGAGGGAAGTGTAAGAGTGTT (SEQ ID NO:15095) |
| *Target1596* | chr17:35165510-35165531 | GGGAATCGTCGGGTAGGGGGTTGCG (SEQ ID NO:15096), CGGGAATCGTCGGGTAGGGGGTTTGC (SEQ ID NO:15097), GAATCGTCGGGTAGGGGGTTTGCGC (SEQ ID NO:15098), GCGGTTTGGTTAAGGGTAGCGTTAAGGGC (SEQ ID NO:15099), GGAATCGTCGGGTAGGGGGTTTGCGC (SEQ ID NO:15100), GGGGTTTCGTTCGGGGTAGTTGCGTTT (SEQ ID NO:15101), GGGGTTTCGTTCGGGGTAGTTGCGTT (SEQ ID NO:15102), GGGGTTTCGTTCGGGGTAGTTGCGTTTT (SEQ ID NO:15103), GGGGTTTCGTTCGGGGTAGTTGCGTT (SEQ ID NO:15104), TGTTTTGGAGTATTCGCGCGGTTGTGG (SEQ ID NO:15105) |

FIGURE 5 CONTINUED

Target1597     chr17:35165543-35165563     GCGGTTTGGTTAAGGGTAGCGTTAAGGGC (SEQ ID NO:15106),
CGGTTTGGTTAAGGGTAGCGTTAAGGGC (SEQ ID NO:15107), GCGGTTTGGTTAAGGGTAGCGTTAAGGG
(SEQ ID NO:15108), GCGGTTTGGTTAAGGGTAGCGTTAAGG (SEQ ID NO:15109),
GGTTTGGTTAAGGGTAGCGTTAAGGGC (SEQ ID NO:15110), TGTTTTGGAGTATTCGCGCGGTTGTGG
(SEQ ID NO:15111), TGGATGTTTTGGAGTATTCGCGCGGTT (SEQ ID NO:15112),
TTGGATGTTTTGGAGTATTCGCGCGGT (SEQ ID NO:15113), ATGTTTTGGAGTATTCGCGCGGTTGTGG
(SEQ ID NO:15114), GGATGTTTTGGAGTATTCGCGCGGTTGT (SEQ ID NO:15115)

Target1598     chr17:35165609-35165622     GCGGAGGGCGTAGTTGTTTCGGAC (SEQ ID NO:15116), GCGGAGGGCGTAGTTGTTTCGGA (SEQ ID
NO:15117), CGGAGTTTTCGTTATTTTTATAGTCGCGCGGG (SEQ ID NO:15118),
CGGAGTTTTCGTTATTTTTATAGTCGCGCGGGT (SEQ ID NO:15119),
TCGTTATTTTTATAGTCGCGCGGGTGTTTT (SEQ ID NO:15120), AGGCGAGGCGGATATAAAGGAGAGGCG
(SEQ ID NO:15121), GGCGAGGCGGATATAAAGGAGAGGCGA (SEQ ID NO:15122),
GGCGAGGCGAGGCGGATATAAAGGAGA (SEQ ID NO:15123),
GCGAGGCGGATATAAAGGAGAGGCGAGG (SEQ ID NO:15124),
GGCGAGGCGGATATAAAGGAGAGGCGAG (SEQ ID NO:15125)

Target1599     chr17:35165672-35165692     TTTTATTAGCGGTCGGGGAGTCGGGCG (SEQ ID NO:15126), CGGGCGGGAGATAGGAGGTCGGTTTTG
(SEQ ID NO:15127), GGGCGGGAGATAGGAGGTCGGTTTTGA (SEQ ID NO:15128),
TCGGGCGGGAGATAGGAGGTCGGTTTT (SEQ ID NO:15129), CGGGCGGGAGATAGGAGGTCGGTTTT
(SEQ ID NO:15130), AGGCGAGGCGGATATAAAGGAGAGGCG (SEQ ID NO:15131),
GGCGAGGCGGATATAAAGGAGAGGCGA (SEQ ID NO:15132), GGCGAGGCGAGGCGGATATAAAGGAGA
(SEQ ID NO:15133), GCGAGGCGGATATAAAGGAGAGGCGAGG (SEQ ID NO:15134),
GGCGAGGCGGATATAAAGGAGAGGCGAG (SEQ ID NO:15135)

Target1600     chr17:35165694-35165705     TTTTATTAGCGGTCGGGGAGTCGGGCG (SEQ ID NO:15136), CGGGCGGGAGATAGGAGGTCGGTTTTG
(SEQ ID NO:15137), GGGCGGGAGATAGGAGGTCGGTTTTGA (SEQ ID NO:15138),
TCGGGCGGGAGATAGGAGGTCGGTTTT (SEQ ID NO:15139), CGGGCGGGAGATAGGAGGTCGGTTTT
(SEQ ID NO:15140), AGGCGAGGCGGATATAAAGGAGAGGCG (SEQ ID NO:15141),
GGCGAGGCGGATATAAAGGAGAGGCGA (SEQ ID NO:15142), GGCGAGGCGAGGCGGATATAAAGGAGA
(SEQ ID NO:15143), GCGAGGCGGATATAAAGGAGAGGCGAGG (SEQ ID NO:15144),
GGCGAGGCGGATATAAAGGAGAGGCGAG (SEQ ID NO:15145)

Target1601     chr17:35165739-35165758     CGGGCGGGAGATAGGAGGTCGGTTTTG (SEQ ID NO:15146), GGGCGGGAGATAGGAGGTCGGTTTTGA
(SEQ ID NO:15147), TCGGGCGGGAGATAGGAGGTCGGTTTT (SEQ ID NO:15148),
CGGGCGGGAGATAGGAGGTCGGTTTT (SEQ ID NO:15149), GTCGGGCGGGAGATAGGAGGTCGGTTT
(SEQ ID NO:15150), GGGTTAGCGTCGCGGGAATGGAGC (SEQ ID NO:15151),
AGGAGTAGACGGGTTTTGGAGTTTCGC (SEQ ID NO:15152), GTTTTCGGTTGTTTCGGCGCGTTTAAC (SEQ
ID NO:15153), TAGGAGTAGACGGGTTTTGGAGTTTCGC (SEQ ID NO:15154),
TGGGGGGTATTAGGAGTAGACGGGTTTTGG (SEQ ID NO:15155)

Target1602     chr17:35165762-35165787     CGTTTTATTTTCGCGGCGTTGGTTCG (SEQ ID NO:15156), CGGAGATTGTTCGATACGTTTTGGTTAGGGCG
(SEQ ID NO:15157), TCGGAGATTGTTCGATACGTTTTGGTTAGGGCG (SEQ ID NO:15158),
GGAGATTGTTCGATACGTTTTGGTTAGGGCG (SEQ ID NO:15159),
CGGAGATTGTTCGATACGTTTTGGTTAGGGC (SEQ ID NO:15160),
TCGGTCGGATTTTGAGGAGTTGGGGGT (SEQ ID NO:15161), TTCGGTCGGATTTTGAGGAGTTGGGGGT
(SEQ ID NO:15162), TTCGGTCGGATTTTGAGGAGTTGGGGG (SEQ ID NO:15163),
CGGTCGGATTTTGAGGAGTTGGGGGTA (SEQ ID NO:15164), TCGGTCGGATTTTGAGGAGTTGGGGGTA
(SEQ ID NO:15165)

Target1603     chr17:35165817-35165847     CGTTTTATTTTCGCGGCGTTGGTTCGG (SEQ ID NO:15166), CGTTTTATTTTCGCGGCGTTGGTTCG (SEQ ID
NO:15167), GTTTTATTTTCGCGGCGTTGGTTCGG (SEQ ID NO:15168),
CGGGTCGAGCGAATTGTTTTGTTTTTGGT (SEQ ID NO:15169), CGGGTCGAGCGAATTGTTTTGTTTTTGG
(SEQ ID NO:15170), TTGCGGGGGAGGAGTAGCGAGGTTTTT (SEQ ID NO:15171),
TGCGGGGGAGGAGTAGCGAGGTTTTG (SEQ ID NO:15172), GCGGGGGAGGAGTAGCGAGGTTTTTGT
(SEQ ID NO:15173), GTTGCGGGGGAGGAGTAGCGAGGTTTT (SEQ ID NO:15174),
TCGGTCGGATTTTGAGGAGTTGGGGGT (SEQ ID NO:15175)

Target1604     chr17:35299479-35299683     AGGCGGTGAAGGGGTGTTGGTTAGGTT (SEQ ID NO:15176), GCGGTGAAGGGGTGTTGGTTAGGTTCG
(SEQ ID NO:15177), TTGGTGGATCGTTTGGAGTCGGGCGAG (SEQ ID NO:15178),
GGTGGATCGTTTGGAGTCGGGCGAGTT (SEQ ID NO:15179), GGCGGTGAAGGGGTGTTGGTTAGGTTC
(SEQ ID NO:15180), GGGGATGAGTTCGTTCGGTTTTAGGCGG (SEQ ID NO:15181),
GTCGGGCGTTTAGGGCGTTTAGTTGTT (SEQ ID NO:15182), GGGATGAGTTCGTTCGGTTTTAGGCGGT
(SEQ ID NO:15183), TGGGGATGAGTTCGTTCGGTTTTAGGCG (SEQ ID NO:15184),
GGGATGAGTTCGTTCGGTTTTAGGCGG (SEQ ID NO:15185)

Target1605     chr17:35299710-35299742     TTGGTGGATCGTTTGGAGTCGGGCGAG (SEQ ID NO:15186), GGTGGATCGTTTGGAGTCGGGCGAGTT
(SEQ ID NO:15187), GTCGTTGGTGGATCGTTTGGAGTCGGG (SEQ ID NO:15188),
GGTCGTTGGTGGATCGTTTGGAGTCGG (SEQ ID NO:15189), GTTGGTGGATCGTTTGGAGTCGGGCGA
(SEQ ID NO:15190), AGGGTCGTGAATTGGGTTTTCGGTTTC (SEQ ID NO:15191),
AGTGGTTTATAGAGAGCGAGGCGTGTT (SEQ ID NO:15192), AGTGGTTTATAGAGAGCGAGGCGTGTTT
(SEQ ID NO:15193), AGTGGTTTATAGAGAGCGAGGCGTGTTTT (SEQ ID NO:15194),
AGTGGTTTATAGAGAGCGAGGCGTGTTTTT (SEQ ID NO:15195)

FIGURE 5 CONTINUED

| | | |
|---|---|---|
| Target1606 | chr17:35299913-35300021 | TGGGAGTAAATTAAGGGGAGGCGGCGA (SEQ ID NO:15196),<br>TGGGAGTAAATTAAGGGGAGGCGGCGAG (SEQ ID NO:15197),<br>GGGGAGTAAATTAAGGGGAGGCGGCGAG (SEQ ID NO:15198), TTGGGAGTAAATTAAGGGGAGGCGGCG<br>(SEQ ID NO:15199), GGGAGTAAATTAAGGGGAGGCGGCGAGA (SEQ ID NO:15200),<br>CGGGGGGTTTTGCGGGAAGAAGTCGTA (SEQ ID NO:15201), TAGGACGTTAGGGTTCGGTCGGGGGTC<br>(SEQ ID NO:15202), GGGGGGGTTTTGCGGGAAGAAGTCGTAG (SEQ ID NO:15203),<br>GTAGGACGTTAGGGTTCGGTCGGGGGT (SEQ ID NO:15204), GAGGACGGGGGGGTTTTGCGGGAAGAAG<br>(SEQ ID NO:15205) |
| Target1607 | chr17:35300059-35300075 | CGGGGGGTTTTGCGGGAAGAAGTCGTA (SEQ ID NO:15206), GGGGGGGTTTTGCGGGAAGAAGTCGTAG<br>(SEQ ID NO:15207), GAGGACGGGGGGGTTTTGCGGGAAGAAG (SEQ ID NO:15208),<br>GGACGGGGGGGTTTTGCGGGAAGAAGTC (SEQ ID NO:15209), GGGGGGGTTTTGCGGGAAGAAGTCGTAGT<br>(SEQ ID NO:15210) |
| Target1608 | chr17:35300778-35300801 | GCGGGTGCGTATAGTCGTTGGC (SEQ ID NO:15211), GCGTTTGGTAGGCGGGCGG (SEQ ID NO:15212),<br>TTGGTTGGTTCGGGAGCGTTTTGGGTC (SEQ ID NO:15213), TTTGGTTGGTTCGGGAGCGTTTTGGGT<br>(SEQ ID NO:15214), TTTTGGTTGGTTCGGGAGCGTTTTGGGTC (SEQ ID NO:15215),<br>TGGTTGGTTCGGGAGCGTTTTGGGTC (SEQ ID NO:15216), TTTTTGGTTGGTTCGGGAGCGTTTTGGGT<br>(SEQ ID NO:15217) |
| Target1609 | chr17:37321375-37321792 | GGTTCGGGGGCGTTTCGGGGTTTGTTAA (SEQ ID NO:15218), AAGCGTCGGAGGAAGGGTAGCGTTAGG<br>(SEQ ID NO:15219), GGAAGCGTCGGAGGAAGGGTAGCGTTA (SEQ ID NO:15220),<br>TTTGGAAGCGTCGGAGGAAGGGTAGCG (SEQ ID NO:15221), AGGTTCGGGGCGTTTCGGGGTTTGTTA<br>(SEQ ID NO:15222), GATTTGTGGTCGGACGTACGGGGGGGAT (SEQ ID NO:15223),<br>GGGTAGGTGTCGGAGTTGGGTGGGAAG (SEQ ID NO:15224), CGTTTCGGAGTGGGGTAGGTGTCGGAG<br>(SEQ ID NO:15225), GAGTGGGGTAGGTGTCGGAGTTGGGTG (SEQ ID NO:15226),<br>TTGTGGTCGGACGTACGGGGGGATTTC (SEQ ID NO:15227) |
| Target1610 | chr17:37321886-37321895 | GAGTAGGTAGGGACGGGGGGTAGGGGAG (SEQ ID NO:15228),<br>GAGGAGTAGGTAGGGACGGGGGTAGGG (SEQ ID NO:15229), TAGGTAGGGACGGGGGTAGGGGAGGTC<br>(SEQ ID NO:15230), GGAGTAGGTAGGGACGGGGGTAGGGGA (SEQ ID NO:15231),<br>AGTAGGTAGGGACGGGGGTAGGGGAGG (SEQ ID NO:15232),<br>GGGGCGTATAGGGTATTTAAGCGAGCGT (SEQ ID NO:15233), GGGGCGTATAGGGTATTTAAGCGAGCG<br>(SEQ ID NO:15234), AGGGGCGTATAGGGTATTTAAGCGAGCGT (SEQ ID NO:15235),<br>AGGGGCGTATAGGGTATTTAAGCGAGCG (SEQ ID NO:15236),<br>CGGGAATTAGGGTAAGGGGCGTATAGGGT (SEQ ID NO:15237) |
| Target1611 | chr17:41477218-41477617 | CGTCGGGGGGTAGGAGAAGTTGCGATT (SEQ ID NO:15238), GTGTTTGTGGTGGACGTTGCGGAGGTT<br>(SEQ ID NO:15239), TGTTTGTGGTGGACGTTGCGGAGGTTG (SEQ ID NO:15240),<br>TTAAGTGTGGGACGTCGGGGGGGTAGGA (SEQ ID NO:15241), GTTTGTGGTGGACGTTGCGGAGGTTGA<br>(SEQ ID NO:15242), TCGTTTGTTCGGCGGGTATAAGAGCGT (SEQ ID NO:15243),<br>TATTAGGTGGGAGGAAAGGGAGGGGGG (SEQ ID NO:15244), ATTAGGTGGGAGGAAAGGGAGGGGGG<br>(SEQ ID NO:15245), CGTTTGTTCGGCGGGTATAAGAGCGTT (SEQ ID NO:15246),<br>TCGTTTGTTCGGCGGGTATAAGAGCGTT (SEQ ID NO:15247) |
| Target1612 | chr17:46618870-46618983 | GGAATTAGGTAGGGTGTGGTGGGGGAT (SEQ ID NO:15248), GGTAGGGTGTGGTGGGGGATAGATAGG<br>(SEQ ID NO:15249), AGGTAGGGTGTGGTGGGGGATAGATAGG (SEQ ID NO:15250),<br>GGTAGGGTGTGGTGGGGGATAGATAGGA (SEQ ID NO:15251),<br>AGGTAGGGTGTGGTGGGGGATAGATAGGA (SEQ ID NO:15252),<br>GGAGAGTTCGGGTGGATGTGGGAAGGG (SEQ ID NO:15253), GGGTGGATGTGGGAAGGGAAGGAGAGC<br>(SEQ ID NO:15254), CGGGTGGATGTGGGAAGGGAAGGAGAG (SEQ ID NO:15255),<br>GTGGATGTGGGAAGGGAAGGAGAGCGG (SEQ ID NO:15256),<br>GGTGGATGTGGGAAGGGAAGGAGAGCGG (SEQ ID NO:15257) |
| Target1613 | chr17:46619088-46619146 | TCGGTTGGGTCGGCGTTTTTTGTAGCG (SEQ ID NO:15258), GGTTGGGTCGGCGTTTTTTGTAGCGGT<br>(SEQ ID NO:15259), GTAGGGGCGGGGGTAGATTTCGGTTGG (SEQ ID NO:15260),<br>TGGGTCGGCGTTTTTTGTAGCGGTTGT (SEQ ID NO:15261), CGTAGGGGCGGGGGTAGATTTCGGTTG<br>(SEQ ID NO:15262), CGAGGAGAGCGGGAGGGAGATAGGGAA (SEQ ID NO:15263),<br>ATTTGCGGGGAGAGAAGGAGGAGCGA (SEQ ID NO:15264), GATTTGCGGGGAGAGAAGGAGGAGCGA<br>(SEQ ID NO:15265), TGTTTAAAATGGCGTTGGGGTCGGGCG (SEQ ID NO:15266),<br>GGATTTGCGGGGAGAGAAGGAGGAGCG (SEQ ID NO:15267) |
| Target1614 | chr17:46619180-46619314 | TCGGTTGGGTCGGCGTTTTTTGTAGCG (SEQ ID NO:15268), GGTTGGGTCGGCGTTTTTTGTAGCGGT<br>(SEQ ID NO:15269), GTAGGGGCGGGGGTAGATTTCGGTTGG (SEQ ID NO:15270),<br>TGGGTCGGCGTTTTTTGTAGCGGTTGT (SEQ ID NO:15271), CGTAGGGGCGGGGGTAGATTTCGGTTG<br>(SEQ ID NO:15272), CGAGGAGAGCGGGAGGGAGATAGGGAA (SEQ ID NO:15273),<br>TCGGGCGAGAAGTTTAGGGTGGTTCGG (SEQ ID NO:15274), TGGATTTGCGGGGAGAGAAGGAGGAGC<br>(SEQ ID NO:15275), ATTTGCGGGGAGAGAAGGAGGAGCGAG (SEQ ID NO:15276),<br>GATTTGCGGGGAGAGAAGGAGGAGCGA (SEQ ID NO:15277) |
| Target1615 | chr17:46619368-46619465 | TCGAGTTTATGGGTGTTTCGGTAGCGT (SEQ ID NO:15278), TGGGTGCGGGATTTTGTTTTTCGAGAA (SEQ<br>ID NO:15279), TTGGGTGCGGGATTTTGTTTTTCGAGA (SEQ ID NO:15280),<br>TCGAGTTTATGGGTGTTTCGGTAGCGTT (SEQ ID NO:15281), TTCGAGTTTATGGGTGTTTCGGTAGCGT<br>(SEQ ID NO:15282), GGAGTGGGGTCGGGGATTTTTTCGGGA (SEQ ID NO:15283),<br>TAGGGACGCGAGGTTTGGGGTTTGAGT (SEQ ID NO:15284), TGGAGTGGGGTCGGGGATTTTTTCGGG |

FIGURE 5 CONTINUED (SEQ ID NO:15285), GCGAGGTTTGGGGTTTGAGTCGGGTTT (SEQ ID NO:15286),
AGGGACGCGAGGTTTGGGGTTTGAGTC (SEQ ID NO:15287)

| | | |
|---|---|---|
| Target1616 | chr17:46621872-46622196 | TCGGGTTGGAGGTTGGGGAAGGTTTGT (SEQ ID NO:15288), GCGGTGGCGGCGGTAGAGTAGGTTTAT (SEQ ID NO:15289), GTGGCGGATTGGTTGGGTTTTTTGGCG (SEQ ID NO:15290), CGTGGCGGATTGGTTGGGTTTTTTGGC (SEQ ID NO:15291), CGGAGAAGGAGACGTGGCGGATTGGTT (SEQ ID NO:15292), CGGGGTCGGATCGTTTGTAGGTCGGTA (SEQ ID NO:15293), CGGGGTCGGATCGTTTGTAGGTCGGT (SEQ ID NO:15294), CGGGGTCGGATCGTTTGTAGGTCGGTAA (SEQ ID NO:15295), CGGGGTCGGATCGTTTGTAGGTCGGTAAG (SEQ ID NO:15296), GGGGTCGGATCGTTTGTAGGTCGGTAA (SEQ ID NO:15297) |
| Target1617 | chr17:46622219-46622227 | TCGGGTTGGAGGTTGGGGAAGGTTTGT (SEQ ID NO:15298), CGTCGGGTTGGAGGTTGGGGAAGGTTT (SEQ ID NO:15299), GTCGGGTTGGAGGTTGGGGAAGGTTTG (SEQ ID NO:15300), CGGGTTGGAGGTTGGGGAAGGTTTGTT (SEQ ID NO:15301), TCGGGTTGGAGGTTGGGGAAGGTTTGTT (SEQ ID NO:15302), AGAGGGAGATTGGGTTTATAAATAGTTAGTCGTCGT (SEQ ID NO:15303), GAGAGGGAGATTGGGTTTATAAATAGTTAGTCGTCG (SEQ ID NO:15304) |
| Target1618 | chr17:46832359-46832403 | CGGGTTCGGGTTTTGCGTTGGAGTCG (SEQ ID NO:15305), AGCGAGAGGGAACGGGTTGGTTTAGTT (SEQ ID NO:15306), GCGAGAGGGAACGGGTTGGTTTAGTTT (SEQ ID NO:15307), AGCGAGAGGGAACGGGTTGGTTTAGTTT (SEQ ID NO:15308), AGCGAGAGGGAACGGGTTGGTTTAGT (SEQ ID NO:15309), TCGACGTTGAGTTTTGTAGGCGGGGTT (SEQ ID NO:15310), TTCGACGTTGAGTTTTGTAGGCGGGGT (SEQ ID NO:15311), CGACGTTGAGTTTTGTAGGCGGGGTTT (SEQ ID NO:15312), TCGACGTTGAGTTTTGTAGGCGGGGTTT (SEQ ID NO:15313), TTCGACGTTGAGTTTTGTAGGCGGGGTT (SEQ ID NO:15314) |
| Target1619 | chr17:46832417-46832446 | TGCGTTGGAGTCGGGATGTTTTTCGGC (SEQ ID NO:15315), GTTCGGGTTTTGCGTTGGAGTCGGGAT (SEQ ID NO:15316), TCGGGTTTTGCGTTGGAGTCGGGATGT (SEQ ID NO:15317), GTCGGGATGTTTTTCGGCGGAGGGTG (SEQ ID NO:15318), TTGCGTTGGAGTCGGGATGTTTTTCGGC (SEQ ID NO:15319), TCGACGTTGAGTTTTGTAGGCGGGGTT (SEQ ID NO:15320), TTCGACGTTGAGTTTTGTAGGCGGGGT (SEQ ID NO:15321), CGACGTTGAGTTTTGTAGGCGGGGTTT (SEQ ID NO:15322), TCGACGTTGAGTTTTGTAGGCGGGGTTT (SEQ ID NO:15323), TTCGACGTTGAGTTTTGTAGGCGGGGTT (SEQ ID NO:15324) |
| Target1620 | chr17:46832470-46832494 | TGCGTTGGAGTCGGGATGTTTTTCGGC (SEQ ID NO:15325), GTTCGGGTTTTGCGTTGGAGTCGGGAT (SEQ ID NO:15326), TCGGGTTTTGCGTTGGAGTCGGGATGT (SEQ ID NO:15327), GTCGGGATGTTTTTCGGCGGAGGGTG (SEQ ID NO:15328), TTGCGTTGGAGTCGGGATGTTTTTCGGC (SEQ ID NO:15329), GAGTTTTTGAGTTTCGAGTTTTTTGGCGGAAAA (SEQ ID NO:15330), TGTTTGAAATTGGAGATTAGGACGTTTAGAGAGGAA (SEQ ID NO:15331), TTGTTTGAAATTGGAGATTAGGACGTTTAGAGAGGA (SEQ ID NO:15332) |
| Target1621 | chr17:48042255-48042272 | TCGGAGAGGGGGGACGTAGGTTTTTT (SEQ ID NO:15333), TCGGAGAGGGGGGACGTAGGTTTTTT (SEQ ID NO:15334), CGGAGAGGGGGGACGTAGGTTTTTT (SEQ ID NO:15335), TCGGAGAGGGGGGACGTAGGTTTT (SEQ ID NO:15336), CGGAGAGGGGGGACGTAGGTTTTTT (SEQ ID NO:15337), CGGTTTGGCGGCGGGAAGGAAAGAATT (SEQ ID NO:15338), AATTCGGTTTGGCGGCGGGAAGGAAAG (SEQ ID NO:15339), TCGGTTTGGCGGCGGGAAGGAAAGAAT (SEQ ID NO:15340), ATTCGGTTTGGCGGCGGGAAGGAAAGA (SEQ ID NO:15341), TAATTCGGTTTGGCGGCGGGAAGGAAA (SEQ ID NO:15342) |
| Target1622 | chr17:48042289-48042294 | CGGGTTTCGTTGAATGCGGGGGTTTTA (SEQ ID NO:15343), CGGGTTTCGTTGAATGCGGGGGTTTT (SEQ ID NO:15344), CGGGTTTCGTTGAATGCGGGGGTTTAT (SEQ ID NO:15345), AATGCGGGGGTTTTATTTATAGCGCGC (SEQ ID NO:15346), CGGGTTTCGTTGAATGCGGGGGTTT (SEQ ID NO:15347), CGGTTTGGCGGCGGGAAGGAAAGAATT (SEQ ID NO:15348), AATTCGGTTTGGCGGCGGGAAGGAAAG (SEQ ID NO:15349), TCGGTTTGGCGGCGGGAAGGAAAGAAT (SEQ ID NO:15350), ATTCGGTTTGGCGGCGGGAAGGAAAGA (SEQ ID NO:15351), TAATTCGGTTTGGCGGCGGGAAGGAAA (SEQ ID NO:15352) |
| Target1623 | chr17:48042490-48042509 | GTCGGTGGGTGGGATGGAGGAGAAAGG (SEQ ID NO:15353), GGTCGGTGGGTGGGATGGAGGAGAAAG (SEQ ID NO:15354), GGGTGGGATGGAGGAGAAAGGGTACGG (SEQ ID NO:15355), TTCGTTTTGGGGTCGGTGGGTGGGATG (SEQ ID NO:15356), GTTCGTTTTGGGGTCGGTGGGTGGGAT (SEQ ID NO:15357), GAGTCGTATTTGCGCGGATGTGTTAGC (SEQ ID NO:15358), AGAGTCGTATTTGCGCGGATGTGTTAGC (SEQ ID NO:15359), AGTCGTATTTGCGCGGATGTGTTAGC (SEQ ID NO:15360), TAGAGTCGTATTTGCGCGGATGTGTTAGC (SEQ ID NO:15361), TTAGAGTCGTATTTGCGCGGATGTGTTAGC (SEQ ID NO:15362) |
| Target1624 | chr17:48042531-48042573 | GTCGGTGGGTGGGATGGAGGAGAAAGG (SEQ ID NO:15363), GGTCGGTGGGTGGGATGGAGGAGAAAG (SEQ ID NO:15364), GGGTGGGATGGAGGAGAAAGGGTACGG (SEQ ID NO:15365), CGGAGTGAGGAGGATTATGGTCGCGGT (SEQ ID NO:15366), GCGGAGTGAGGAGGATTATGGTCGCGG (SEQ ID NO:15367), GAGTCGTATTTGCGCGGATGTGTTAGC (SEQ ID NO:15368), AGAGTCGTATTTGCGCGGATGTGTTAGC (SEQ ID NO:15369), AGTCGTATTTGCGCGGATGTGTTAGC (SEQ ID NO:15370), TAGAGTCGTATTTGCGCGGATGTGTTAGC (SEQ ID NO:15371), TTAGAGTCGTATTTGCGCGGATGTGTTAGC (SEQ ID NO:15372) |
| Target1625 | chr17:48042663-48042696 | GTGCGGTTTTGAGTGTTGGTTCGGGGT (SEQ ID NO:15373), AGGTGCGGTTTTGAGTGTTGGTTCGGG (SEQ ID NO:15374), GGTGCGGTTTTGAGTGTTGGTTCGGGG (SEQ ID NO:15375), TGCGGTTTTGAGTGTTGGTTCGGGGTT (SEQ ID NO:15376), GTGCGGTTTTGAGTGTTGGTTCGGGGTT |

FIGURE 5 CONTINUED (SEQ ID NO:15377), TGGTGAGTGCGTAGTGTTTTCGGTAGT (SEQ ID NO:15378), TGGTGAGTGCGTAGTGTTTTCGGTAGTT (SEQ ID NO:15379), TTGGTGAGTGCGTAGTGTTTTCGGTAGT (SEQ ID NO:15380), TGGTGAGTGCGTAGTGTTTTCGGTAGTTT (SEQ ID NO:15381), TTGGTGAGTGCGTAGTGTTTTCGGTAGTT (SEQ ID NO:15382)

Target1626 chr17:48546447-48546852 GTTCGGTCGGGTGTTTTGGATGCGAGG (SEQ ID NO:15383), GTGTTTTGGATGCGAGGCGGGAGGAAG (SEQ ID NO:15384), CGTTCGGTCGGGTGTTTTGGATGCGAG (SEQ ID NO:15385), CGTGTATGAGGGGGTGGGATCGTGGTT (SEQ ID NO:15386), TCGTGTATGAGGGGGTGGGATCGTGGT (SEQ ID NO:15387), TAGGAGAGCGGGGGGGTTATAGTCGGGG (SEQ ID NO:15388), GCGGGGGGGTTATAGTCGGGGTTTAGGG (SEQ ID NO:15389), GGATGGCGCGGCGTGGAGGTTTAAATT (SEQ ID NO:15390), GTAAGCGGGGGTTGGAAGAGAGGGGTGG (SEQ ID NO:15391), TGGCGCGGCGTGGAGGTTTAAATTTGA (SEQ ID NO:15392)

Target1627 chr17:48546884-48546900 GACGCGTCGAAGTTGGTTTTGGGTAGA (SEQ ID NO:15393), ACGCGTCGAAGTTGGTTTTGGGTAGAT (SEQ ID NO:15394), GACGCGTCGAAGTTGGTTTTGGGTAGAT (SEQ ID NO:15395), ACGCGTCGAAGTTGGTTTTGGGTAGATT (SEQ ID NO:15396), CGCGTCGAAGTTGGTTTTGGGTAGATT (SEQ ID NO:15397), GGGGGGATGGTGCGATTGTGTTTGTGG (SEQ ID NO:15398), GGGGGATGGTGCGATTGTGTTTGTGGT (SEQ ID NO:15399), TAGCGGTGGAAAAAGGGGATGAGGGCG (SEQ ID NO:15400), GGTGGAAAAAGGGGATGAGGGCGTCGG (SEQ ID NO:15401), TTAGCGGTGGAAAAAGGGGATGAGGGC (SEQ ID NO:15402)

Target1628 chr17:55520634-55520788 TCGGTTTTGGGTAAAGGGAGTGGGGGG (SEQ ID NO:15403), CGGTTTTGGGTAAAGGGAGTGGGGGGT (SEQ ID NO:15404), TTCGGTTTTGGGTAAAGGGAGTGGGGGG (SEQ ID NO:15405), AGGGAGTGGGGGGTTATGTGTGGAGTT (SEQ ID NO:15406), AAGGGAGTGGGGGGTTATGTGTGGAGT (SEQ ID NO:15407), GTCGAGGAGAGGTAGTTTTTGTCGGTGT (SEQ ID NO:15408), TGGTGGTTGGGGTATAGATTGGGTAGTCG (SEQ ID NO:15409), AGTCGAGGAGAGGTAGTTTTTGTCGGTGT (SEQ ID NO:15410), GGTGGTTGGGGTATAGATTGGGTAGTCG (SEQ ID NO:15411), AGTCGAGGAGAGGTAGTTTTTGTCGGTG (SEQ ID NO:15412)

Target1629 chr17:55951722-55951752 GGTGTTGGGGGAGTTTTTTAGGAGGTCGT (SEQ ID NO:15413), AGGTGTTGGGGGAGTTTTTTAGGAGGTCGT (SEQ ID NO:15414), AGGTGTTGGGGGAGTTTTTTAGGAGGTCG (SEQ ID NO:15415), GGTGTTGGGGGAGTTTTTTAGGAGGTCGTG (SEQ ID NO:15416), GGTGTTGGGGGAGTTTTTTAGGAGGTCGTGT (SEQ ID NO:15417), ACGGGTTTGGAAAGAGCGGTTTTAGAGT (SEQ ID NO:15418), ACGGGTTTGGAAAGAGCGGTTTTAGAGTA (SEQ ID NO:15419), ACGGGTTTGGAAAGAGCGGTTTTAGAGTAT (SEQ ID NO:15420), ACGGGTTTGGAAAGAGCGGTTTTAGAGTATT (SEQ ID NO:15421), ACGGGTTTGGAAAGAGCGGTTTTAGAGTATTT (SEQ ID NO:15422)

Target1630 chr17:55951816-55952168 GTCGGGCGGTGGGGGTTGTTTTAGTTT (SEQ ID NO:15423), TGCGTGGAGATGTGAGTGTGGAAGGGA (SEQ ID NO:15424), CGTGCGTGGAGATGTGAGTGTGGAAGG (SEQ ID NO:15425), GTGCGTGGAGATGTGAGTGTGGAAGGG (SEQ ID NO:15426), TCGGGCGGTGGGGGGTTGTTTTAGTTTT (SEQ ID NO:15427), GGGAGTTTGGGGGGTTAGGGAGGGTGTG (SEQ ID NO:15428), TAGTGAGGGGGCGGGCGGGATTTTTAG (SEQ ID NO:15429), TTAGTGAGGGGGCGGGCGGGATTTTTA (SEQ ID NO:15430), TTTAGTGAGGGGGCGGGCGGGATTTTT (SEQ ID NO:15431), TTTTTTAGTGAGGGGGCGGGCGGGATT (SEQ ID NO:15432)

Target1631 chr17:56405826-56405850 TGTTTGTGTGTGTGTGTGTGGGTGTTT (SEQ ID NO:15433), TGTTTGTGTGTGTGTGTGTGGGGTGTTTG (SEQ ID NO:15434), TTGTTTGTGTGTGTGTGTGTGGGTGTTT (SEQ ID NO:15435), TGTTTGTGTGTGTGTGTGTGGGTGTT (SEQ ID NO:15436), AGTGTCGTGTAGTTGTGTGTATCGGTGTC (SEQ ID NO:15437), AGTTTTTGGTCGGGGTTGAGGGGTTGCG (SEQ ID NO:15438), GTTTTTGGTCGGGTTGAGGGGTTGCGA (SEQ ID NO:15439), TTTTTGGTCGGGGTTGAGGGGTTGCGAT (SEQ ID NO:15440), AAGTTTTTGGTCGGGTTGAGGGGTTGCG (SEQ ID NO:15441), TTTGGTCGGGTTGAGGGGTTGCGATAG (SEQ ID NO:15442)

Target1632 chr17:56405948-56405995 GGGGGTGATTTTTAGTGGTTCGTTGTGGT (SEQ ID NO:15443), TGGGGGTGATTTTTAGTGGTTCGTTGTGG (SEQ ID NO:15444), TGGGGGGTGATTTTTAGTGGTTCGTTGTGGT (SEQ ID NO:15445), GGGGGTGATTTTTAGTGGTTCGTTGTGG (SEQ ID NO:15446), CGGTTAGAGGTTTTAGGAGTTGTTGGGGGT (SEQ ID NO:15447), AGCGAAAGAGTAGTAGTAGAGAGTAGAGTCGGA (SEQ ID NO:15448), GCGAAAGAGTAGTAGTAGAGAGTAGAGTCGGAG (SEQ ID NO:15449), AAGCGAAAGAGTAGTAGTAGAGAGTAGAGTCGG (SEQ ID NO:15450), AGCGAAAGAGTAGTAGTAGAGAGTAGAGTCGGA (SEQ ID NO:15451), GCGAAAGAGTAGTAGTAGAGAGTAGAGTCGGAGA (SEQ ID NO:15452)

Target1633 chr17:59481954-59482071 GGCGGGAGAAAAGGTGAGAGGTCGAGG (SEQ ID NO:15453), AGCGAGTAGGAGGGATGGAGGGATGGG (SEQ ID NO:15454), GAACGGTCGGCGGGAGAAAAGGTGAGA (SEQ ID NO:15455), AACGGTCGGCGGGAGAAAAGGTGAGAG (SEQ ID NO:15456), CGGCGGGAGAAAAGGTGAGAGGTCGAG (SEQ ID NO:15457), TTGCGTTCGGGGAGGTGGGTGGTTTTC (SEQ ID NO:15458), GTTGCGTTCGGGGAGGTGGGTGGTTTT (SEQ ID NO:15459), TTGCGTTCGGGGAGGTGGGTGGTTTTT (SEQ ID NO:15460), GTTCGGGGAGGTGGGTGGTTTTCGC (SEQ ID NO:15461), GCGTTCGGGGAGGTGGGTGGTTTTC (SEQ ID NO:15462)

FIGURE 5 CONTINUED

Target1634　chr17:59482089-59482145　CGATGGCGCGGAGTTAGACGTTTCG (SEQ ID NO:15463), GCGTTTAGTTCGTTGCGTTTGTATCGGG (SEQ ID NO:15464), GCGTTTAGTTCGTTGCGTTTGTATCGGGT (SEQ ID NO:15465), AGCGTTTAGTTCGTTGCGTTTGTATCGGG (SEQ ID NO:15466), AGCGTTTAGTTCGTTGCGTTTGTATCGGGT (SEQ ID NO:15467), AGCGGGTGGTTTAGTAAAAGATTAGTTTAGCGA (SEQ ID NO:15468), AGCGGGTGGTTTAGTAAAAGATTAGTTTAGCGAT (SEQ ID NO:15469), TTTTTTGGTTTTTTAGGTTAGCGGGTGGTTTAGT (SEQ ID NO:15470), TAGCGGGTGGTTTAGTAAAAGATTAGTTTAGCGA (SEQ ID NO:15471), TGGTTTTTTAGGTTAGCGGGTGGTTTAGTAAAAGA (SEQ ID NO:15472)

Target1635　chr17:59482185-59482293　GCGGGGGGTTTTTAGGTCGTTGGGTTG (SEQ ID NO:15473), GGTGAGGGTCGGATCGGAGGAGGGATA (SEQ ID NO:15474), GTCGGATCGGAGGAGGGATAGGGAGGT (SEQ ID NO:15475), TCGGATCGGAGGAGGGATAGGGAGGTG (SEQ ID NO:15476), TGAGGGTCGGATCGGAGGAGGGATAGG (SEQ ID NO:15477), ACGGCGTTTAAGGGGTTAGGTTCGGAGT (SEQ ID NO:15478), CGGCGTTTAAGGGGTTAGGTTCGGAGT (SEQ ID NO:15479), ACGGCGTTTAAGGGGGTTAGGTTCGGAG (SEQ ID NO:15480), CGGCGTTTAAGGGGGTTAGGTTCGGAGTT (SEQ ID NO:15481), ACGGCGTTTAAGGGGGTTAGGTTCGGAGTT (SEQ ID NO:15482)

Target1636　chr17:59482315-59482975　AGGGTTTGGCGTCGTTGGTGGTGTAGA (SEQ ID NO:15483), AGGCGGTCGAGGGTAAGGAGTAGGGTT (SEQ ID NO:15484), GAGGAGTTTGGAGAAGGAGCGCGTCGA (SEQ ID NO:15485), AGGAGGCGGTCGAGGGTAAGGAGTAGG (SEQ ID NO:15486), AGGAGTTTGGAGAAGGAGCGCGTCGAA (SEQ ID NO:15487), GAGTGGGGTTGGCGTTGTTTGGAGTCG (SEQ ID NO:15488), CGAGTGGGGTTGGCGTTGTTTGGAGTC (SEQ ID NO:15489), GGTTAGGTCGGGTAGGTGTTCGGCGTT (SEQ ID NO:15490), TCGGGAAGGGTTGTTTTCGGGGAGGTC (SEQ ID NO:15491), AGGTCGGGTAGGTGTTCGGCGTTAGG (SEQ ID NO:15492)

Target1637　chr17:59528980-59529045　TGTCGCGGAATTTTGGTTTTGGGTCGT (SEQ ID NO:15493), TTGTCGCGGAATTTTGGTTTTGGGTCGT (SEQ ID NO:15494), TTGTCGCGGAATTTTGGTTTTGGGTCG (SEQ ID NO:15495), GTTGTCGCGGAATTTTGGTTTTGGGTCG (SEQ ID NO:15496), GTTGTCGCGGAATTTTGGTTTTGGGTCGT (SEQ ID NO:15497), GCGGAGGTTAGGGGTGAGGATTGGGAG (SEQ ID NO:15498), GTCGCGGAGGTTAGGGGTGAGGATTGG (SEQ ID NO:15499), GGTCGCGGAGGTTAGGGGTGAGGATTG (SEQ ID NO:15500), TTTTGTTTCGGTTTAGGGGGTCGCGGG (SEQ ID NO:15501), GGGGTGAGGATTGGGAGGAAGTTCGGT (SEQ ID NO:15502)

Target1638　chr17:59529083-59529153　GGTTTTTTGGGTCGGGATAAGGAGGGCG (SEQ ID NO:15503), CGGTTTTTTGGGTCGGGATAAGGAGGGC (SEQ ID NO:15504), GCGGTTTTTTGGGTCGGGATAAGGAGGG (SEQ ID NO:15505), GTTTTTTGGGTCGGGATAAGGAGGGCG (SEQ ID NO:15506), GCGGTTTTTTGGGTCGGGATAAGGAGG (SEQ ID NO:15507), TTTTGTTTCGGTTTAGGGGGTCGCGGG (SEQ ID NO:15508), TTTTTGTTTCGGTTTAGGGGGTCGCGGG (SEQ ID NO:15509), TTTGTTTCGGTTTAGGGGGTCGCGGG (SEQ ID NO:15510), TTTTTGTTTCGGTTTAGGGGGTCGCGG (SEQ ID NO:15511), TTTTTTGTTTCGGTTTAGGGGGTCGCGGG (SEQ ID NO:15512)

Target1639　chr17:59529220-59529627　TTAAGAGGAGGGTATTGGGTCGCGCGG (SEQ ID NO:15513), CGTGGTGGGTATGGTAGGGAAGCGGAG (SEQ ID NO:15514), TTGGAAGTGTAAGGTCGCGTGGTGGGT (SEQ ID NO:15515), GGGCGTCGGTAGGGGGTGGTTAGATTC (SEQ ID NO:15516), GGGCGGGTGAGTAGAAGGGTCGTGTTT (SEQ ID NO:15517), TTGCGTTCGTTGTTTTTCGGGGAGGGG (SEQ ID NO:15518), CGAGTCGGGTAGGGGTTGGGAGTTTCG (SEQ ID NO:15519), GCGAGTCGGGTAGGGGTTGGGAGTTTC (SEQ ID NO:15520), GGGAGGGGGGGTTTTAGGGTTTTTCGGC (SEQ ID NO:15521), GAGTCGGGTAGGGGTTGGGAGTTTCGT (SEQ ID NO:15522)

Target1640　chr17:59531878-59531893　CGCGGAGGAGTGGATGTGAAGGACGAG (SEQ ID NO:15523), GCGGAGGAGTGGATGTGAAGGACGAGA (SEQ ID NO:15524), TCGCGGAGGAGTGGATGTGAAGGACGA (SEQ ID NO:15525), CGCGGAGGAGTGGATGTGAAGGACGA (SEQ ID NO:15526), TCGCGGAGGAGTGGATGTGAAGGACG (SEQ ID NO:15527)

Target1641　chr17:59532030-59532059　CGAGGTTTGGATGTGGTTTCGTGGCGG (SEQ ID NO:15528), TCGAGGTTTGGATGTGGTTTCGTGGCG (SEQ ID NO:15529), AGGTTTGGATGTGGTTTCGTGGCGGAG (SEQ ID NO:15530), GGTTTGGATGTGGTTTCGTGGCGGAGA (SEQ ID NO:15531), GAGGTTTGGATGTGGTTTCGTGGCGGA (SEQ ID NO:15532), TGTTTTGTGAGGAGTTGGTTTATCGTTCGC (SEQ ID NO:15533), CGCGTTTAGTTTTGTTTTGTGAGGAGTTGGT (SEQ ID NO:15534), ACGCGTTTAGTTTTGTTTTGTGAGGAGTTGG (SEQ ID NO:15535), ACGCGTTTAGTTTTGTTTTGTGAGGAGTTGGT (SEQ ID NO:15536), TTGTTTTGTGAGGAGTTGGTTTATCGTTCGC (SEQ ID NO:15537)

Target1642　chr17:59532095-59532136　GGGTTGAGCGCGTAGGATTGAGAGC (SEQ ID NO:15538), CGGGAGGGAGAGTATTGAGTAGGTTTCGT (SEQ ID NO:15539), TCGGGAGGGAGAGTATTGAGTAGGTTTCGT (SEQ ID NO:15540), TCGGGAGGGAGAGTATTGAGTAGGTTTCG (SEQ ID NO:15541), TGAGTTCGGGAGGGAGAGTATTGAGTAGGT (SEQ ID NO:15542), CGCGTTTGGTTCGTATGGTTATGGGGT (SEQ ID NO:15543), TCGCGTTTGGTTCGTATGGTTATGGGGT (SEQ ID NO:15544), TCGCGTTTGGTTCGTATGGTTATGGGG (SEQ ID NO:15545), GCGATTCGTTGGTTTTAGATGTGGCGGT (SEQ ID NO:15546), GCGATTCGTTGGTTTTAGATGTGGCGG (SEQ ID NO:15547)

FIGURE 5 CONTINUED

| | | |
|---|---|---|
| Target1643 | chr17:59532148-59532224 | GGGTTGAGCGCGTAGGATTGAGAGC (SEQ ID NO:15548), GGTTGAGCGCGTAGGATTGAGAGC (SEQ ID NO:15549), GCGGGCGGTGAATTAGTTTTTTATAGGGTAGGG (SEQ ID NO:15550), GCGGGCGGTGAATTAGTTTTTTATAGGGTAGGGT (SEQ ID NO:15551), GCGGGCGGTGAATTAGTTTTTTATAGGGTAGG (SEQ ID NO:15552), TGTTCGTTTCGGTTAGCGCGTTGGGTT (SEQ ID NO:15553), TTGTTCGTTTCGGTTAGCGCGTTGGGT (SEQ ID NO:15554), GTTGTTCGTTTCGGTTAGCGCGTTGGG (SEQ ID NO:15555), AGTTGTTCGTTTCGGTTAGCGCGTTGGG (SEQ ID NO:15556), GTTGTTCGTTTCGGTTAGCGCGTTGGGT (SEQ ID NO:15557) |
| Target1644 | chr17:59532248-59532271 | TAGCGGATCGTTTGGTCGTTGGAGTCG (SEQ ID NO:15558), AGCGGATCGTTTGGTCGTTGGAGTCG (SEQ ID NO:15559), TGGGATTAGCGGATCGTTTGGTCGTTGG (SEQ ID NO:15560), GGGATTAGCGGATCGTTTGGTCGTTGG (SEQ ID NO:15561), TTAGCGGATCGTTTGGTCGTTGGAGTCG (SEQ ID NO:15562), TGTTCGTTTCGGTTAGCGCGTTGGGTT (SEQ ID NO:15563), TTGTTCGTTTCGGTTAGCGCGTTGGGT (SEQ ID NO:15564), GTTGTTCGTTTCGGTTAGCGCGTTGGG (SEQ ID NO:15565), AGTTGTTCGTTTCGGTTAGCGCGTTGGG (SEQ ID NO:15566), GTTGTTCGTTTCGGTTAGCGCGTTGGGT (SEQ ID NO:15567) |
| Target1645 | chr17:59532279-59532309 | TAGCGGATCGTTTGGTCGTTGGAGTCG (SEQ ID NO:15568), AGCGGATCGTTTGGTCGTTGGAGTCG (SEQ ID NO:15569), TGGGATTAGCGGATCGTTTGGTCGTTGG (SEQ ID NO:15570), GGGATTAGCGGATCGTTTGGTCGTTGG (SEQ ID NO:15571), TTAGCGGATCGTTTGGTCGTTGGAGTCG (SEQ ID NO:15572), TGTTCGTTTCGGTTAGCGCGTTGGGTT (SEQ ID NO:15573), TTGTTCGTTTCGGTTAGCGCGTTGGGT (SEQ ID NO:15574), GTTGTTCGTTTCGGTTAGCGCGTTGGG (SEQ ID NO:15575), AGTTGTTCGTTTCGGTTAGCGCGTTGGG (SEQ ID NO:15576), GTTGTTCGTTTCGGTTAGCGCGTTGGGT (SEQ ID NO:15577) |
| Target1646 | chr17:59532372-59532387 | GGTCGGAGCGGGTAGTTATTTTATTGGCG (SEQ ID NO:15578), GGTCGGAGCGGGTAGTTATTTTATTGGCGT (SEQ ID NO:15579), TGGTCGGAGCGGGTAGTTATTTTATTGGCG (SEQ ID NO:15580), TCGGAGCGGGTAGTTATTTTATTGGCGT (SEQ ID NO:15581), TGGTCGGAGCGGGTAGTTATTTTATTGGCGT (SEQ ID NO:15582), GGGAGTGAGATTCGTTGGATATGGTTAGCG (SEQ ID NO:15583), GGGAGTGAGATTCGTTGGATATGGTTAGCGT (SEQ ID NO:15584), AGGGAGTGAGATTCGTTGGATATGGTTAGCG (SEQ ID NO:15585), AGGGAGTGAGATTCGTTGGATATGGTTAGCGT (SEQ ID NO:15586), GGAGTGAGATTCGTTGGATATGGTTAGCGT (SEQ ID NO:15587) |
| Target1647 | chr17:62775572-62775676 | GCGGTGGGGAGATTGTGGGTAGTTTTGG (SEQ ID NO:15588), TGCGGTGGGGAGATTGTGGGTAGTTTT (SEQ ID NO:15589), TTGCGGTGGGGAGATTGTGGGTAGTTT (SEQ ID NO:15590), TTTGCGGTGGGGAGATTGTGGGTAGTT (SEQ ID NO:15591), TTTTGCGGTGGGGAGATTGTGGGTAGT (SEQ ID NO:15592), CGTTTAGGCGGGATAGGGTTCGGGGAG (SEQ ID NO:15593), GGTTCGGGGAGCGGTAGGAAATGGGTT (SEQ ID NO:15594), TCGGGGAGCGGTAGGAAATGGGTTGTT (SEQ ID NO:15595), TTCGGGGAGCGGTAGGAAATGGGTTGT (SEQ ID NO:15596), GTTTAGGCGGGATAGGGTTCGGGGAGC (SEQ ID NO:15597) |
| Target1648 | chr17:62775700-62775722 | GGTTGGGATGCGGGTTTTGTAGGCGTT (SEQ ID NO:15598), TGGGATGCGGGTTTTGTAGGCGTTTCG (SEQ ID NO:15599), GGGATGCGGGTTTTGTAGGCGTTTCGG (SEQ ID NO:15600), GGGGTTAGGGTTGGGATGCGGGTTTTG (SEQ ID NO:15601), GGGTTAGGGTTGGGATGCGGGTTTTGT (SEQ ID NO:15602), GGTAGAGTTGTTCGTCGGGGCGTTTGT (SEQ ID NO:15603), AGGTAGAGTTGTTCGTCGGGGCGTTTGT (SEQ ID NO:15604), AGGTAGAGTTGTTCGTCGGGGCGTTTG (SEQ ID NO:15605), CGTTGAAGTCGTTGGGGAAGGGGAGAG (SEQ ID NO:15606), CGTTGAAGTCGTTGGGGAAGGGGAGAGA (SEQ ID NO:15607) |
| Target1649 | chr17:62775797-62775847 | GTGGGGGTTTTCGTTGTTAAGGCGGGG (SEQ ID NO:15608), GGTTGGGATGCGGGTTTTGTAGGCGTT (SEQ ID NO:15609), TGGGATGCGGGTTTTGTAGGCGTTTCG (SEQ ID NO:15610), GGGATGCGGGTTTTGTAGGCGTTTCGG (SEQ ID NO:15611), GGGGTTAGGGTTGGGATGCGGGTTTTG (SEQ ID NO:15612), TTGCGTTGAAGTCGTTGGGGAAGGGGA (SEQ ID NO:15613), GCGTTGAAGTCGTTGGGGAAGGGGAGA (SEQ ID NO:15614), TTTGCGTTGAAGTCGTTGGGGAAGGGG (SEQ ID NO:15615), TGCGTTGAAGTCGTTGGGGAAGGGGAG (SEQ ID NO:15616), GTTTGCGTTGAAGTCGTTGGGGAAGGGG (SEQ ID NO:15617) |
| Target1650 | chr17:62775871-62775904 | GTGGGGGTTTTCGTTGTTAAGGCGGGG (SEQ ID NO:15618), TGTGGGGGTTTTCGTTGTTAAGGCGGG (SEQ ID NO:15619), GGGGTTTTCGTTGTTAAGGCGGGGGAA (SEQ ID NO:15620), GGGGGTTTTCGTTGTTAAGGCGGGGGA (SEQ ID NO:15621), TGGGGGTTTTCGTTGTTAAGGCGGGGG (SEQ ID NO:15622), TTTTTTCGGGGGGCGGCGTGAGAGTC (SEQ ID NO:15623), TTTTTTCGGGGGGCGGCGTGAGAGT (SEQ ID NO:15624), TTTTTTCGGGGGGCGGCGTGAGAGT (SEQ ID NO:15625), TTTTTTCGGGGGGCGGCGTGAGAG (SEQ ID NO:15626), TTTTTCGGGGGGCGGCGTGAGAGTC (SEQ ID NO:15627) |
| Target1651 | chr17:62775998-62776036 | TGTTCGTGCGGAGTTTTAAAGTAGGGGT (SEQ ID NO:15628), TGTTCGTGCGGAGTTTTAAAGTAGGGGTT (SEQ ID NO:15629), TTGTTCGTGCGGAGTTTTAAAGTAGGGGT (SEQ ID NO:15630), TGTTCGTGCGGAGTTTTAAAGTAGGGGTTT (SEQ ID NO:15631), TTGTTCGTGCGGAGTTTTAAAGTAGGGGT (SEQ ID NO:15632), TTATGGTTTTGGTGGAGGGGCGTCGGT (SEQ ID NO:15633), GGTTTTGGTGGAGGGGCGTCGGTAGAT (SEQ ID NO:15634), |

FIGURE 5 CONTINUED

ATGGTTTTGGTGGAGGGGCGTCGGTAG (SEQ ID NO:15635), TATGGTTTTGGTGGAGGGGCGTCGGTA (SEQ ID NO:15636), TTTATGGTTTTGGTGGAGGGGCGTCGG (SEQ ID NO:15637)

Target1652    chr17:70216183-70216505    AAGGTTAGGGTAGGTGGGGTGGGAGGT (SEQ ID NO:15638), GGGGTGGGAGGTGGGGAGAGGGATATGT (SEQ ID NO:15639), AGGTTAGGGTAGGTGGGGTGGGAGGTG (SEQ ID NO:15640), GGGAAGGTTAGGGTAGGTGGGGTGGGA (SEQ ID NO:15641), AGGGAAGGTTAGGGTAGGTGGGGTGGG (SEQ ID NO:15642), TGTTTGGTTCGTGTTGTTCGGGGTTGT (SEQ ID NO:15643), TGTTTGGTTCGTGTTGTTCGGGGTTGTT (SEQ ID NO:15644), TGGTAGTGGGGAGGGATAGTTCGAAGGT (SEQ ID NO:15645), GTTTGGTTCGTGTTGTTCGGGGTTGTT (SEQ ID NO:15646), GGTAGTGGGGAGGGATAGTTCGAAGGT (SEQ ID NO:15647)

Target1653    chr17:73483829-73483938    GGGGTTGGAGTGGTCGGGTAGGGTTTT (SEQ ID NO:15648), TTTTGGGGTTGGAGTGGTCGGGTAGGG (SEQ ID NO:15649), AGAGGTTTTGGGGTTGGAGTGGTCGGG (SEQ ID NO:15650), GGGAAGTGTTGGAACGAGTGGAGGGGT (SEQ ID NO:15651), GAGGTTTTGGGGTTGGAGTGGTCGGGT (SEQ ID NO:15652), AGGGTATTTGAGGGGAATGGAAAGAGGGA (SEQ ID NO:15653), TGAGGGTATTTGAGGGGAATGGAAAGAGGG (SEQ ID NO:15654), GAGGGTATTTGAGGGGAATGGAAAGAGGG (SEQ ID NO:15655), GAGGGTATTTGAGGGGAATGGAAAGAGGGA (SEQ ID NO:15656), TGAGGGTATTTGAGGGGAATGGAAAGAGGGA (SEQ ID NO:15657)

Target1654    chr17:73635995-73636378    CGAGGGTGGAATTTCGGTGTTGCGACG (SEQ ID NO:15658), CGGTGTTGCGACGAGTGTGGGGTTAGT (SEQ ID NO:15659), GGTGTTGCGACGAGTGTGGGGTTAGTC (SEQ ID NO:15660), CGGTGTTGCGACGAGTGTGGGGTTAG (SEQ ID NO:15661), CGGTGTTGCGACGAGTGTGGGGTTAGTC (SEQ ID NO:15662), TTGTTTCGGGGGTTGTCGGTTAAGGCG (SEQ ID NO:15663), TGTTTCGGGGGTTGTCGGTTAAGGCGG (SEQ ID NO:15664), GTTTCGGGGGTTGTCGGTTAAGGCGGT (SEQ ID NO:15665), AAGGGTTTGTTTCGGGGGTTGTCGGTT (SEQ ID NO:15666), GTTTCGGGGGTTGTCGGTTAAGGCGG (SEQ ID NO:15667)

Target1655    chr17:73749587-73749620    TTTCGGGATTTCGGGGTGTGTGTTGGG (SEQ ID NO:15668), TTCGGGATTTCGGGGTGTGTGTTGGGG (SEQ ID NO:15669), TTTTCGGGATTTCGGGGTGTGTGTTGGG (SEQ ID NO:15670), TCGGGATTTCGGGGTGTGTGTTGGGG (SEQ ID NO:15671), TTCGGGATTTCGGGGTGTGTGTTGGG (SEQ ID NO:15672)

Target1656    chr17:73749654-73750226    TTCGGGATTTCGGGAGTTGGAGACGGG (SEQ ID NO:15673), GCGTTACGTGGCGGTTGTTTTCGGAGT (SEQ ID NO:15674), AGGTTCGGGTTTTGGCGGTTGGGAGTA (SEQ ID NO:15675), CGGGATTTCGGGAGTTGGAGACGGGTT (SEQ ID NO:15676), GTCGCGGTTTTTTCGTTTCGGTCGTGC (SEQ ID NO:15677), GGGGGCGGCGGGTGAGTTTGTTATTTT (SEQ ID NO:15678), AGTAGGGTTAGGCGGGGGAAGGTCGTA (SEQ ID NO:15679), GCGGGATGAGTTTCGGGGGTAGTCGTT (SEQ ID NO:15680), TAGGCGGGGGAAGGTCGTAGGTTTTGC (SEQ ID NO:15681), GGTTAGGCGGGGGAAGGTCGTAGGTTT (SEQ ID NO:15682)

Target1657    chr17:75369378-75370663    GGGTTTGCGTGCGGGTAGGGAGAGTAT (SEQ ID NO:15683), TTGAGGGGCGGGTTTGTTTTTTGTCGGG (SEQ ID NO:15684), GGAGAGGATTTTGCGGGTGGGTTTGGC (SEQ ID NO:15685), AAGGTGGGTGTTGGGTTGGTTGTTGCG (SEQ ID NO:15686), CGTGTTGGAGAGGATTTTGCGGGTGGG (SEQ ID NO:15687), AGGGGCGGGGGTTTTAGGTTTCGGTAG (SEQ ID NO:15688), GGGGCGGGGGTTTTAGGTTTCGGTAGA (SEQ ID NO:15689), GAGGGGCGGGGGTTTTAGGTTTCGGTA (SEQ ID NO:15690), TCGTCGGGGAGAGTTAAAGGGAGGGGA (SEQ ID NO:15691), GCGTGGGGGAGGGGAGGGTTGTTTATT (SEQ ID NO:15692)

Target1658    chr17:77386082-77386160    AGGGTTTTAGTTGAGAAGGAGGTTTTGGAGT (SEQ ID NO:15693), GAGGGTTTTAGTTGAGAAGGAGGTTTTGGAGT (SEQ ID NO:15694), AGAGGGTTTTAGTTGAGAAGGAGGTTTTGGAG (SEQ ID NO:15695), AGAGAGGGTTTTAGTTGAGAAGGAGGTTTTGG (SEQ ID NO:15696), GAGAGGGTTTTAGTTGAGAAGGAGGTTTTGGA (SEQ ID NO:15697), TTTCGGTCGGGTGGTTGGTTACGGAGA (SEQ ID NO:15698), TTCGGTCGGGTGGTTGGTTACGGAGAT (SEQ ID NO:15699), CGGTCGGGTGGTTGGTTACGGAGATTC (SEQ ID NO:15700), TTTTCGGTCGGGTGGTTGGTTACGGAG (SEQ ID NO:15701), TCGGTCGGGTGGTTGGTTACGGAGATTC (SEQ ID NO:15702)

Target1659    chr17:77386167-77386185    TTTCGGTCGGGTGGTTGGTTACGGAGA (SEQ ID NO:15703), TCGGTCGGGTGGTTGGTTACGGAGATT (SEQ ID NO:15704), TTCGGTCGGGTGGTTGGTTACGGAGAT (SEQ ID NO:15705), TCGGGTGGTTGGTTACGGAGATTCGGA (SEQ ID NO:15706), GTCGGGTGGTTGGTTACGGAGATTCGG (SEQ ID NO:15707)

Target1660    chr17:77789396-77789413    GCGGTGGGCGGGTAGGTACGTTTTTTC (SEQ ID NO:15708), GCGGGCGGGATAGGAGGGGAATAGTTG (SEQ ID NO:15709), CGGTGGGCGGGTAGGTACGTTTTTTCG (SEQ ID NO:15710), CGGGCGGGATAGGAGGGGAATAGTTGG (SEQ ID NO:15711), GGGCGGGATAGGAGGGGAATAGTTGGT (SEQ ID NO:15712), TGGATAAGGCGGTTGGTTGGACGTGGG (SEQ ID NO:15713), ATGGATAAGGCGGTTGGTTGGACGTGG (SEQ ID NO:15714), GATAAGGCGGTTGGTTGGACGTGGGGG (SEQ ID NO:15715), GGATAAGGCGGTTGGTTGGACGTGGGG (SEQ ID NO:15716), GATAAGGCGGTTGGTTGGACGTGGGG (SEQ ID NO:15717)

Target1661    chr17:77789425-77789530    GCGGTGGGCGGGTAGGTACGTTTTTTC (SEQ ID NO:15718), GCGGGCGGGATAGGAGGGGAATAGTTG (SEQ ID NO:15719), CGGTGGGCGGGTAGGTACGTTTTTTCG (SEQ ID NO:15720), CGGGCGGGATAGGAGGGGAATAGTTGG (SEQ ID NO:15721), GGGCGGGATAGGAGGGGAATAGTTGGT

FIGURE 5 CONTINUED

{SEQ ID NO:15722), CGTGGCGGGTGGTATTCGGGTATTGGA (SEQ ID NO:15723),
ACGTGGCGGGTGGTATTCGGGTATTGG (SEQ ID NO:15724), TGGATAAGGCGGTTGGTTGGACGTGGG
(SEQ ID NO:15725), ATGGATAAGGCGGTTGGTTGGACGTGG (SEQ ID NO:15726),
GATAAGGCGGTTGGTTGGACGTGGGGG (SEQ ID NO:15727)

| Target1662 | chr17:77789575-77789686 | AGTCGAGGGGAGAAAATGGTCGGTGGC (SEQ ID NO:15728), GTGGTCGTCGGGTTGTCGTTTCGGTTT (SEQ ID NO:15729), CGGGTTGTCGTTTCGGTTTTTGTGCGG (SEQ ID NO:15730), GGGTTGTCGTTTCGGTTTTTGTGCGGG (SEQ ID NO:15731), TGGTCGTCGGGTTGTCGTTTCGGTTTT (SEQ ID NO:15732), CGTTTGATCGAGTTTTGAGAGCGGCGT (SEQ ID NO:15733), TCGGGTATTAGGAGTCGTAGGGGTCGT (SEQ ID NO:15734), GTCGGGTATTAGGAGTCGTAGGGGTCGT (SEQ ID NO:15735), GTCGGGTATTAGGAGTCGTAGGGGTCG (SEQ ID NO:15736), CGTTTGATCGAGTTTTGAGAGCGGCGTT (SEQ ID NO:15737) |

| Target1663 | chr17:77789701-77789719 | AGTCGAGGGGAGAAAATGGTCGGTGGC (SEQ ID NO:15738), GTGGTCGTCGGGTTGTCGTTTCGGTTT (SEQ ID NO:15739), CGGGTTGTCGTTTCGGTTTTTGTGCGG (SEQ ID NO:15740), GGGTTGTCGTTTCGGTTTTTGTGCGGG (SEQ ID NO:15741), TGGTCGTCGGGTTGTCGTTTCGGTTTT (SEQ ID NO:15742), CGTTTGATCGAGTTTTGAGAGCGGCGT (SEQ ID NO:15743), TCGGGTATTAGGAGTCGTAGGGGTCGT (SEQ ID NO:15744), GTCGGGTATTAGGAGTCGTAGGGGTCGT (SEQ ID NO:15745), GTCGGGTATTAGGAGTCGTAGGGGTCG (SEQ ID NO:15746), CGTTTGATCGAGTTTTGAGAGCGGCGTT (SEQ ID NO:15747) |

| Target1664 | chr17:77789751-77789785 | TCGTTGGAGGGGCGTCGTTTTTAGGGT (SEQ ID NO:15748), AGTCGAGGGGAGAAAATGGTCGGTGGC (SEQ ID NO:15749), CGGTCGTTGGAGGGGCGTCGTTTTTAG (SEQ ID NO:15750), GTCGTTGGAGGGGCGTCGTTTTTAGGG (SEQ ID NO:15751), GGTCGTTGGAGGGGCGTCGTTTTTAGG (SEQ ID NO:15752), AAAAGCGAGATGGGGTGAGAAGGGGCG (SEQ ID NO:15753), AAAAAGCGAGATGGGGTGAGAAGGGGC (SEQ ID NO:15754), AAAGCGAGATGGGGTGAGAAGGGGCG (SEQ ID NO:15755), AGATGGGGTGAGAAGGGGCGGGGTTTC (SEQ ID NO:15756), GAGATGGGGTGAGAAGGGGCGGGGTTT (SEQ ID NO:15757) |

| Target1665 | chr17:77789814-77789824 | TCGTTGGAGGGGCGTCGTTTTTAGGGT (SEQ ID NO:15758), CGGTCGTTGGAGGGGCGTCGTTTTTAG (SEQ ID NO:15759), GTCGTTGGAGGGGCGTCGTTTTTAGGG (SEQ ID NO:15760), GGTCGTTGGAGGGGCGTCGTTTTTAGG (SEQ ID NO:15761), TGGAGGGGCGTCGTTTTTAGGGTTCGG (SEQ ID NO:15762), AAAAGCGAGATGGGGTGAGAAGGGGC (SEQ ID NO:15763), AAAAAGCGAGATGGGGTGAGAAGGGGC (SEQ ID NO:15764), AAAGCGAGATGGGGTGAGAAGGGGCG (SEQ ID NO:15765), AGATGGGGTGAGAAGGGGCGGGGTTTC (SEQ ID NO:15766), GAGATGGGGTGAGAAGGGGCGGGGTTT (SEQ ID NO:15767) |

| Target1666 | chr17:78999585-78999726 | AGGTTTTGGTAGTAGTTTGCGGCGTTT (SEQ ID NO:15768), AAGGTTTTGGTAGTAGTTTGCGGCGTTT (SEQ ID NO:15769), AAAGGTTTTGGTAGTAGTTTGCGGCGTT (SEQ ID NO:15770), TGGTAGTAGTTTGCGGCGTTTTTTGGAA (SEQ ID NO:15771), TTGGTAGTAGTTTGCGGCGTTTTTTGGA (SEQ ID NO:15772), AGGGTTGGTTAGAGATGGCGGTCGTGG (SEQ ID NO:15773), TCGGGGTTTAGAGGAGGCGTGGTTGTG (SEQ ID NO:15774), GGGTTGGTTAGAGATGGCGGTCGTGGT (SEQ ID NO:15775), CGGGGTTTAGAGGAGGCGTGGTTGTGT (SEQ ID NO:15776), TTAGGAGGCGGGTAGGGTGGGACGTAG (SEQ ID NO:15777) |

| Target1667 | chr17:78999741-78999784 | TGGCGTTAAGTCGGTTGGAGATTGGTT (SEQ ID NO:15778), TTGGCGTTAAGTCGGTTGGAGATTGGT (SEQ ID NO:15779), CGGTAGTTTTGGCGTTAAGTCGGTTGG (SEQ ID NO:15780), CGGTAGTTTTGGCGTTAAGTCGGTTGGA (SEQ ID NO:15781), TCGGTAGTTTTGGCGTTAAGTCGGTTGG (SEQ ID NO:15782), AGGGTTGGTTAGAGATGGCGGTCGTGG (SEQ ID NO:15783), GGGTTGGTTAGAGATGGCGGTCGTGGT (SEQ ID NO:15784), TTAGGAGGCGGGTAGGGTGGGACGTAG (SEQ ID NO:15785), TTAGGGGTTAGGAGGCGGGTAGGGTGG (SEQ ID NO:15786), TGGTTAGGGGTTAGGAGGCGGGTAGGG (SEQ ID NO:15787) |

| Target1668 | chr17:78999895-78999909 | TTGTGTGGTTTCGTGGTTGGGTTGGGG (SEQ ID NO:15788), GTTGTGTGGTTTCGTGGTTGGGTTGGGG (SEQ ID NO:15789), GTTGTGTGGTTTCGTGGTTGGGTTGGG (SEQ ID NO:15790), TGTGTGGTTTCGTGGTTGGGTTGGGG (SEQ ID NO:15791), AGTTGTGTGGTTTCGTGGTTGGGTTGGG (SEQ ID NO:15792), AGGGGTTAGGTTGGATGTGTAGCGGGG (SEQ ID NO:15793), GGGGTTAGGTTGGATGTGTAGCGGGGA (SEQ ID NO:15794), GGGTTAGGTTGGATGTGTAGCGGGGAGG (SEQ ID NO:15795), GGGGTTAGGTTGGATGTGTAGCGGGGAG (SEQ ID NO:15796), GAGGGGTTAGGTTGGATGTGTAGCGGGG (SEQ ID NO:15797) |

| Target1669 | chr17:80535181-80535365 | CGGGCGGTCGGGTTAAGGTTTCGTAGT (SEQ ID NO:15798), TAATTTGTATGTAGGGCGTGGCGGGCG (SEQ ID NO:15799), GCGGGCGGTCGGGTTAAGGTTTCGTAG (SEQ ID NO:15800), AATTTGTATGTAGGGCGTGGCGGGGCG (SEQ ID NO:15801), GGGCGGTCGGGTTAAGGTTTCGTAGTT (SEQ ID NO:15802), GCGGTATGTATAGAGGGTTCGGCGGGG (SEQ ID NO:15803), GGCGGTATGTATAGAGGGTTCGGCGGG (SEQ ID NO:15804), ATAGGCGGGGTAGGAGTTTGTTCGGGG (SEQ ID NO:15805), GCGGGGTAGGAGTTTGTTCGGGGTTGT (SEQ ID NO:15806), TAGGCGGGGTAGGAGTTTGTTCGGGGT (SEQ ID NO:15807) |

| Target1670 | chr17:80535398-80535474 | CGGGCGGTCGGGTTAAGGTTTCGTAGT (SEQ ID NO:15808), TAATTTGTATGTAGGGCGTGGCGGGGCG (SEQ ID NO:15809), AATTTGTATGTAGGGCGTGGCGGGGCG (SEQ ID NO:15810), GGGCGGTCGGGTTAAGGTTTCGTAGTT (SEQ ID NO:15811), AATTTGTATGTAGGGCGTGGCGGGCGG (SEQ ID NO:15812), GCGGTATGTATAGAGGGTTCGGCGGGG (SEQ ID NO:15813), GGCGGTATGTATAGAGGGTTCGGCGGG (SEQ ID NO:15814), CGGTATGTATAGAGGGTTCGGCGGGGT |

FIGURE 5 CONTINUED (SEQ ID NO:15815), CGGTATGTATAGAGGGTTCGGCGGGGTT (SEQ ID NO:15816),
CGAGATTTTGGTTCGTAGTGTCGGCGGT (SEQ ID NO:15817)

| Target1671 | chr17:80535562-80535677 | TTGTTTAGGTTGGAGTGTAGTGGCGCG (SEQ ID NO:15818), GTTGTTTAGGTTGGAGTGTAGTGGCGCG (SEQ ID NO:15819), TGTTGTTTAGGTTGGAGTGTAGTGGCGCG (SEQ ID NO:15820), TGTTGTTTAGGTTGGAGTGTAGTGGCGC (SEQ ID NO:15821), CGTCGATATTGCGGGTTAAGGTTTCGGT (SEQ ID NO:15822), GGAGGTAAAGGTTGTAGTGAGTTGAGATCGC (SEQ ID NO:15823), AGGAGGTAAAGGTTGTAGTGAGTTGAGATCGC (SEQ ID NO:15824), TAGGAGGTAAAGGTTGTAGTGAGTTGAGATCGC (SEQ ID NO:15825), TTAGGAGGTAAAGGTTGTAGTGAGTTGAGATCGC (SEQ ID NO:15826), TTTAGGAGGTAAAGGTTGTAGTGAGTTGAGATCGC (SEQ ID NO:15827) |
|---|---|---|
| Target1672 | chr17:80846604-80846653 | GGTTAGAGGTGGTGGGCGCGTTTGTTT (SEQ ID NO:15828), TGATTGGTTAGAGGTGGTGGGCGCGTT (SEQ ID NO:15829), GTGTGATTGGTTAGAGGTGGTGGGCGC (SEQ ID NO:15830), ATTGGTTAGAGGTGGTGGGCGCGTTTG (SEQ ID NO:15831), GATTGGTTAGAGGTGGTGGGCGCGTTT (SEQ ID NO:15832), GTAAGGGGCGAGGTTAGGGAGGTTGGC (SEQ ID NO:15833), GGCGAGGTTAGGGAGGTTGGCGGTTTT (SEQ ID NO:15834), AGTAAGGGGCGAGGTTAGGGAGGTTGG (SEQ ID NO:15835), GCGAGGTTAGGGAGGTTGGCGGTTTTA (SEQ ID NO:15836), GGCGAGGTTAGGGAGGTTGGCGGTTTTA (SEQ ID NO:15837) |
| Target1673 | chr17:80846860-80847737 | GTTGGTGGTGTGTGTGGTGGTCGTG (SEQ ID NO:15838), TATCGTGTTATGGGTGCGGGTAGGGCG (SEQ ID NO:15839), GTTTTCGCGTGGGTGTTGTTGGGGAGGT (SEQ ID NO:15840), TAAGGGGGGTAGGGTGTTTGGGGAGGA (SEQ ID NO:15841), TTGGTCGGTGCGTTTAAGGGGGGTAGG (SEQ ID NO:15842), CGTGTCGTTTTTTAGGGAGGGCGTTTT (SEQ ID NO:15843), CGTGTCGTTTTTTAGGGAGGGCGTTTTGT (SEQ ID NO:15844), CGTGTCGTTTTTTAGGGAGGGCGTTTTG (SEQ ID NO:15845), CGTTTTTTAGGGAGGGCGTTTTGTTCGT (SEQ ID NO:15846), TCGTTTTTTAGGGAGGGCGTTTTGTTCGT (SEQ ID NO:15847) |
| Target1674 | chr18:909104-909196 | GGGAGAAAGGTTAGGTTTGAAGCGCGCG (SEQ ID NO:15848), GGAGAAAGGTTAGGTTTGAAGCGCGCG (SEQ ID NO:15849), GGAGAAAGGTTAGGTTTGAAGCGCGCGT (SEQ ID NO:15850), TGGGAGAAAGGTTAGGTTTGAAGCGCGC (SEQ ID NO:15851), GGGGAGAAAGGTTAGGTTTGAAGCGCGC (SEQ ID NO:15852), CGGAGGGGGTTCGGGATAAGATTCGGG (SEQ ID NO:15853), TGCGGAGGGGGTTCGGGATAAGATTCG (SEQ ID NO:15854), TGGAAGTAGTCGTGGGGAGGGTCGAGA (SEQ ID NO:15855), GCGGAGGGGGTTCGGGATAAGATTCGG (SEQ ID NO:15856), TCGTGGGGAGGGTCGAGACGGTAGTTT (SEQ ID NO:15857) |
| Target1675 | chr18:909310-909332 | GATTTTGCGTGGGGAGGGGGGTATCGA (SEQ ID NO:15858), ATTTTGCGTGGGGAGGGGGGTATCGAG (SEQ ID NO:15859), AGATTTTGCGTGGGGAGGGGGGTATCG (SEQ ID NO:15860), GGAGATTTTGCGTGGGGAGGGGGGTAT (SEQ ID NO:15861), TTAGGAGATTTTGCGTGGGGAGGGGGG (SEQ ID NO:15862), AAGTAAAGGGGTCGGGAAGAGGGTGGC (SEQ ID NO:15863), GGTGGCGGGGCGGGAGATATAGGTTTA (SEQ ID NO:15864), GGAGTTTTCGGGGAGGGTTCGGGGTTC (SEQ ID NO:15865), GAAGAGGGTGGCGGGGCGGGAGATATA (SEQ ID NO:15866), AAGAGGGTGGCGGGGCGGGAGATATAG (SEQ ID NO:15867) |
| Target1676 | chr18:909349-909389 | GATTTTGCGTGGGGAGGGGGGTATCGA (SEQ ID NO:15868), ATTTTGCGTGGGGAGGGGGGTATCGAG (SEQ ID NO:15869), AGATTTTGCGTGGGGAGGGGGGTATCG (SEQ ID NO:15870), GGAGATTTTGCGTGGGGAGGGGGGTAT (SEQ ID NO:15871), TGGGGTGGGGTTCGTTTGTTTTTCGCG (SEQ ID NO:15872), AAGTAAAGGGGTCGGGAAGAGGGTGGC (SEQ ID NO:15873), GGTGGCGGGGCGGGAGATATAGGTTTA (SEQ ID NO:15874), GAAGAGGGTGGCGGGGCGGGAGATATA (SEQ ID NO:15875), AAGAGGGTGGCGGGGCGGGAGATATAG (SEQ ID NO:15876), GGTGGCGGGGCGGGAGATATAGGTTTT (SEQ ID NO:15877) |
| Target1677 | chr18:5543287-5543382 | TGTTTAGCGGGGATGTTTTGTGCGGAG (SEQ ID NO:15878), TTGTTTAGCGGGGATGTTTTGTGCGGA (SEQ ID NO:15879), CGGGGGTCGTTGTTTTAGTTTGGGGAA (SEQ ID NO:15880), TTGTTTAGCGGGGATGTTTTGTGCGGAG (SEQ ID NO:15881), TTTGTTTAGCGGGGATGTTTTGTGCGG (SEQ ID NO:15882), TTTTTTCGGGGAGGTGCGGGGGATAGG (SEQ ID NO:15883), AGTTGTTTTTCGGGTTGGGGGCGAGC (SEQ ID NO:15884), TTTTTTCGGGGAGGTGCGGGGGATAGG (SEQ ID NO:15885), GAGGTGCGGGGGATAGGGGGCGATATT (SEQ ID NO:15886), AGGTGCGGGGGATAGGGGGCGATATTG (SEQ ID NO:15887) |
| Target1678 | chr18:5543424-5543453 | CGGCGTCGTAGTGTCGTTTTTTGTTTTTCG (SEQ ID NO:15888), GGCGTCGTAGTGTCGTTTTTTTGTTTTCG (SEQ ID NO:15889), CGGCGTCGTAGTGTCGTTTTTTGTTTTTC (SEQ ID NO:15890), AAGTTGTTTTTCGGGTTGGGGGCGAGC (SEQ ID NO:15891), TTTTTTCGGGGAGGTGCGGGGGATAGG (SEQ ID NO:15892), AGTTGTTTTTCGGGTTGGGGGCGAGC (SEQ ID NO:15893), TTTTTCGGGGAGGTGCGGGGGATAGG (SEQ ID NO:15894), GAGGTGCGGGGGATAGGGGGCGATATT (SEQ ID NO:15895) |
| Target1679 | chr18:5543518-5543528 | TCGTATTTTTTCGGGGGAGGGGTCGGT (SEQ ID NO:15896), ATTTTTTCGGGGGAGGGGTCGGTTCGC (SEQ ID NO:15897), CGTATTTTTTCGGGGGAGGGGTCGGTT (SEQ ID NO:15898), TCGTATTTTTTCGGGGGAGGGGTCGGTT (SEQ ID NO:15899), TTCGTATTTTTTTCGGGGGAGGGGTCGGT (SEQ ID NO:15900), TAGTGGTTGGGTCGGCGCGTAGAGTTT (SEQ ID NO:15901), GTAGTGGTTGGGTCGGCGCGTAGAGTT (SEQ ID NO:15902), GGTCGGCGCGTAGAGTTTGAGTTTCGG (SEQ ID NO:15903), GGGTCGGCGCGTAGAGTTTGAGTTTCG (SEQ ID NO:15904), TGGTTGGGTCGGCGCGTAGAGTTTGAG (SEQ ID NO:15905) |

FIGURE 5 CONTINUED

| | | |
|---|---|---|
| Target1680 | chr18:5543548-5543582 | GCGTTTCGGGCGGGGGATTTGTGTAAA (SEQ ID NO:15906), TCGTATTTTTTCGGGGGAGGGGTCGGT (SEQ ID NO:15907), ATTTTTTCGGGGGAGGGGTCGGTTCGC (SEQ ID NO:15908), GCGTTTCGGGCGGGGGATTTGTGTAA (SEQ ID NO:15909), CGTATTTTTTCGGGGGAGGGGTCGGTT (SEQ ID NO:15910), TAGTGGTTGGGTCGGCGCGTAGAGTTT (SEQ ID NO:15911), GTAGTGGTTGGGTCGGCGCGTAGAGTT (SEQ ID NO:15912), GGTCGGCGCGTAGAGTTTGAGTTTCGG (SEQ ID NO:15913), GGGTCGGCGCGTAGAGTTTGAGTTTCG (SEQ ID NO:15914), GTAGTAGTGGTTGGGTCGGCGCGTAGA (SEQ ID NO:15915) |
| Target1681 | chr18:5543634-5543674 | GAGGTCGGGGTTTAGGTTTTGCGCGTC (SEQ ID NO:15916), GCGTTTCGGGCGGGGGATTTGTGTAAA (SEQ ID NO:15917), CGGGGGTTTAGGTTTTGCGCGTCGGTTT (SEQ ID NO:15918), GCGTTTCGGGCGGGGGATTTGTGTAA (SEQ ID NO:15919), TCGGGGGTTTAGGTTTTGCGCGTCGGTT (SEQ ID NO:15920), GTTCGTCGCGGCGTAGTAGTGGTTGGG (SEQ ID NO:15921), CGTTCGTCGCGGCGTAGTAGTGGTTG (SEQ ID NO:15922), CGTTCGTCGCGGCGTAGTAGTGGTTGG (SEQ ID NO:15923), GTTCGTCGCGGCGTAGTAGTGGTTGG (SEQ ID NO:15924), TTCGTCGCGGCGTAGTAGTGGTTGGGT (SEQ ID NO:15925) |
| Target1682 | chr18:5543731-5543758 | GAGGTCGGGGTTTAGGTTTTGCGCGTC (SEQ ID NO:15926), CGGGGGTTTAGGTTTTGCGCGTCGGTTT (SEQ ID NO:15927), GTAGGTTCGGTTCGGTGGGGGTTTCGG (SEQ ID NO:15928), CGTAGGTTCGGTTCGGTGGGGGTTTCG (SEQ ID NO:15929), TCGGGGGTTTAGGTTTTGCGCGTCGGTT (SEQ ID NO:15930), TGCGGAGGAAGAGTTCGAGGTTTGGGG (SEQ ID NO:15931), GGAGGAAGAGTTCGAGGTTTGGGGCGA (SEQ ID NO:15932), CGGAGGAAGAGTTCGAGGTTTGGGGCG (SEQ ID NO:15933), GTGCGGAGGAAGAGTTCGAGGTTTGGG (SEQ ID NO:15934), GGTGCGGAGGAAGAGTTCGAGGTTTGG (SEQ ID NO:15935) |
| Target1683 | chr18:5543766-5543879 | GTAGGTTCGGTTCGGTGGGGGTTTCGG (SEQ ID NO:15936), CGTAGGTTCGGTTCGGTGGGGGTTTCG (SEQ ID NO:15937), GCGTAGGTTCGGTTCGGTGGGGGTTTC (SEQ ID NO:15938), TAGGTTCGGTTCGGTGGGGGTTTCGG (SEQ ID NO:15939), GTAGGTTCGGTTCGGTGGGGGTTTCG (SEQ ID NO:15940), TGCGGAGGAAGAGTTCGAGGTTTGGGG (SEQ ID NO:15941), GGAGGAAGAGTTCGAGGTTTGGGGCGA (SEQ ID NO:15942), CGGAGGAAGAGTTCGAGGTTTGGGGCG (SEQ ID NO:15943), GTGCGGAGGAAGAGTTCGAGGTTTGGG (SEQ ID NO:15944), GGTGCGGAGGAAGAGTTCGAGGTTTGG (SEQ ID NO:15945) |
| Target1684 | chr18:46514295-46514374 | TGGGGAGAGGAAGTTGATTGGTTGGGG (SEQ ID NO:15946), TGGGGAGAGGAAGTTGATTGGTTGGGGA (SEQ ID NO:15947), GGGGAGAGGAAGTTGATTGGTTGGGGA (SEQ ID NO:15948), TGGGGAGAGGAAGTTGATTGGTGGGGAG (SEQ ID NO:15949), GGGGAGAGGAAGTTGATTGGTGGGGAG (SEQ ID NO:15950), CGGTTTTTTGTCGTTTGGAGTTTGGAGGG (SEQ ID NO:15951), CGGTTTTTTGTCGTTTGGAGTTTGGAGGGT (SEQ ID NO:15952), TCGGTTTTTTGTCGTTTGGAGTTTGGAGGG (SEQ ID NO:15953), TCGGTTTTTTGTCGTTTGGAGTTTGGAGGGT (SEQ ID NO:15954), TCGGTTTTTTGTCGTTTGGAGTTTGGAGG (SEQ ID NO:15955) |
| Target1685 | chr18:46514427-46514468 | TGGGGAGAGGAAGTTGATTGGTTGGGG (SEQ ID NO:15956), TGGGGAGAGGAAGTTGATTGGTTGGGGA (SEQ ID NO:15957), GGGGAGAGGAAGTTGATTGGTTGGGGA (SEQ ID NO:15958), TGGGGAGAGGAAGTTGATTGGTGGGGAG (SEQ ID NO:15959), GGGGAGAGGAAGTTGATTGGTGGGGAG (SEQ ID NO:15960), TGTTTGTTGGGGTTTGGGTAAAGTCGTTG (SEQ ID NO:15961), TGTTTGTTGGGGTTTGGGTAAAGTCGTTGA (SEQ ID NO:15962), GTTTGTTGGGGTTTGGGTAAAGTCGTTGA (SEQ ID NO:15963), TTGTTTGTTGGGGTTTGGGTAAAGTCGTT (SEQ ID NO:15964), TTTGTTTGTTGGGGTTTGGGTAAAGTCGT (SEQ ID NO:15965) |
| Target1686 | chr18:47794580-47794978 | GGGTTTCGGTGGGTGATTGTGGTTGGG (SEQ ID NO:15966), GGGCGGTTAGGTTAGGGGTGATGGGTG (SEQ ID NO:15967), GGCGGTTAGGTTAGGGGTGATGGGTGA (SEQ ID NO:15968), GGGTGATGGGTGACGAGCGGTGTTTTT (SEQ ID NO:15969), GTTAGGGGTGATGGGTGACGAGCGGTG (SEQ ID NO:15970), TGGTTTGGTCGTTTTGGGGCGTGGTTT (SEQ ID NO:15971), TTGGTTTGGTCGTTTTGGGGCGTGGTT (SEQ ID NO:15972), TTTGGTTTGGTCGTTTTGGGGCGTGGT (SEQ ID NO:15973), AGTTCGTTTAGGGTGAGGGCGGGGGTTC (SEQ ID NO:15974), GAGTTCGTTTAGGGTGAGGGCGGGGTT (SEQ ID NO:15975) |
| Target1687 | chr18:47794982-47794996 | GGGTTTCGGTGGGTGATTGTGGTTGGG (SEQ ID NO:15976), GGGCGGTTAGGTTAGGGGTGATGGGTG (SEQ ID NO:15977), GGCGGTTAGGTTAGGGGTGATGGGTGA (SEQ ID NO:15978), GGGTGATGGGTGACGAGCGGTGTTTTT (SEQ ID NO:15979), GTTAGGGGTGATGGGTGACGAGCGGTG (SEQ ID NO:15980), TATTTATTTAGGTCGCGGGGGCGGGGG (SEQ ID NO:15981), TTGTTGGTGGGTTCGTTAGGGGGCGT (SEQ ID NO:15982), TTTGTTGGTGGGTTCGTTAGGGGGCGT (SEQ ID NO:15983), ATTTGTTGGTGGGTTCGTTAGGGGGCG (SEQ ID NO:15984), CGGGGGGGTTGGTTGAAGGTTGAGGTTT (SEQ ID NO:15985) |
| Target1688 | chr18:56939637-56939654 | GTCGGTTAGTTTTTCGCGGTTGTATACGT (SEQ ID NO:15986), TGTCGGTTAGTTTTTCGCGGTTGTATACG (SEQ ID NO:15987), TGTCGGTTAGTTTTTCGCGGTTGTATACGT (SEQ ID NO:15988), GGTTGATTTTGTCGGTTAGTTTTTCGCGGT (SEQ ID NO:15989), CGGTTAGTTTTTCGCGGTTGTATACGTTCG (SEQ ID NO:15990), TAGTTGTATGAGTTGGAGCGCGCGTTC (SEQ ID NO:15991), TTAGTTGTATGAGTTGGAGCGCGCGTT (SEQ ID NO:15992), |

FIGURE 5 CONTINUED

|  |  | ATTAGTTGTATGAGTTGGAGCGCGCGT (SEQ ID NO:15993), AGTTGTATGAGTTGGAGCGCGCGTTC (SEQ ID NO:15994), TTAGTTGTATGAGTTGGAGCGCGCGTTC (SEQ ID NO:15995) |
| Target1689 | chr18:56939670-56939788 | CGCGGTTGTATACGTTCGGGTAGTGGG (SEQ ID NO:15996), CGCGGTTGTATACGTTCGGGTAGTGGGA (SEQ ID NO:15997), GCGGTTGTATACGTTCGGGTAGTGGGA (SEQ ID NO:15998), AGTTTCGTTCGTCGGTGGTTGGTTCG (SEQ ID NO:15999), GTTTCGTTCGTCGGTGGTTGGTTCGA (SEQ ID NO:16000), TCGGGGAGGTACGGTCGAGTTTAGGGT (SEQ ID NO:16001), AGGGAGTTCGGGGAGGTACGGTCGAGTT (SEQ ID NO:16002), AAGGAGTTCGGGGAGGTACGGTCGAGT (SEQ ID NO:16003), CGGGGTCGGTTTAAGGGTGTTTTGGGG (SEQ ID NO:16004), GGAGTTCGGGGAGGTACGGTCGAGTTT (SEQ ID NO:16005) |
| Target1690 | chr18:56939939-56939978 | AGATGGTTCGGGGAGGTTCGTGGTGAG (SEQ ID NO:16006), GAGATGGTTCGGGGAGGTTCGTGGTGA (SEQ ID NO:16007), GATGGTTCGGGGAGGTTCGTGGTGAGG (SEQ ID NO:16008), TTGGGGTAGTAGGGTCGAGGGGTTGGG (SEQ ID NO:16009), TTTGGGGTAGTAGGGTCGAGGGGTTGG (SEQ ID NO:16010), GGGTTGGGGATCGTTTATGGCGGGAGT (SEQ ID NO:16011), ATTAAGGTAATTGGGCGCGGGGTTGGG (SEQ ID NO:16012), GGGGTTGGGGATCGTTTATGGCGGGAG (SEQ ID NO:16013), TTAAGGTAATTGGGCGCGGGGTTGGGG (SEQ ID NO:16014), GGTTGGGGATCGTTTATGGCGGGAGTT (SEQ ID NO:16015) |
| Target1691 | chr18:61143902-61144251 | GTAGTGGGCGTGGCGGTGTTGTTTAGG (SEQ ID NO:16016), GGTAGTGGGCGTGGCGGTGTTGTTTAG (SEQ ID NO:16017), TAGTGGGCGTGGCGGTGTTGTTTAGGT (SEQ ID NO:16018), GGCGTGGCGGTGTTGTTTAGGTGAGTT (SEQ ID NO:16019), TGGTAGTGGGCGTGGCGGTGTTGTTTA (SEQ ID NO:16020), TGGATGTGGAGGCGATCGTGTTTGGGT (SEQ ID NO:16021), TTGGATGTGGAGGCGATCGTGTTTGGG (SEQ ID NO:16022), CGTTTCGTTTCGTTTCGTTTCGGCGGT (SEQ ID NO:16023), TTGGATGTGGAGGCGATCGTGTTTGGGT (SEQ ID NO:16024), TGGATGTGGAGGCGATCGTGTTTGGGTA (SEQ ID NO:16025) |
| Target1692 | chr18:76150846-76150881 | CGGAGGATTTAGGGCGGAGTTGTCGGT (SEQ ID NO:16026), TCGGAGGATTTAGGGCGGAGTTGTCGG (SEQ ID NO:16027), CGGAGGATTTAGGGCGGAGTTGTCGGTT (SEQ ID NO:16028), TTCGGAGGATTTAGGGCGGAGTTGTCGG (SEQ ID NO:16029), GGAGGATTTAGGGCGGAGTTGTCGGTT (SEQ ID NO:16030), AACGGGGAAAGTACGGTGAGGTCGGAG (SEQ ID NO:16031), AAACGGGGAAAGTACGGTGAGGTCGGA (SEQ ID NO:16032), GAAACGGGGAAAGTACGGTGAGGTCGG (SEQ ID NO:16033), AAACGGGGAAAGTACGGTGAGGTCGGAG (SEQ ID NO:16034), GAAACGGGGAAAGTACGGTGAGGTCGGA (SEQ ID NO:16035) |
| Target1693 | chr18:76150902-76150929 | CGGTGGTTGTGATCGGAGGTTTTACGCG (SEQ ID NO:16036), ACGGTGGTTGTGATCGGAGGTTTTACGC (SEQ ID NO:16037), GGTGGTTGTGATCGGAGGTTTTACGCG (SEQ ID NO:16038), CGGTGGTTGTGATCGGAGGTTTTACGC (SEQ ID NO:16039), ACGGTGGTTGTGATCGGAGGTTTTACG (SEQ ID NO:16040), GTGGGAGGGAAACGGGGAAAGTACGGT (SEQ ID NO:16041), TGGGAGGGAAACGGGGAAAGTACGGTG (SEQ ID NO:16042), AGTGGGAGGGAAACGGGGAAAGTACGG (SEQ ID NO:16043), CGGTAGTGGGAGGGAAACGGGGAAAGT (SEQ ID NO:16044), GGGAGGGAAACGGGGAAAGTACGGTGA (SEQ ID NO:16045) |
| Target1694 | chr18:76151034-76151043 | CGGAGGTTTTACGCGTTTGTTTGAGGA (SEQ ID NO:16046), TCGGAGGTTTTACGCGTTTGTTTGAGG (SEQ ID NO:16047), TCGGAGGTTTTACGCGTTTGTTTGAGGA (SEQ ID NO:16048), CGGAGGTTTTACGCGTTTGTTTGAGGAA (SEQ ID NO:16049), ATCGGAGGTTTTACGCGTTTGTTTGAGG (SEQ ID NO:16050), TTTTTTAGGGGTTGGCGAGGGGGACG (SEQ ID NO:16051), TTTTTAGGGGTTGGCGAGGGGGACG (SEQ ID NO:16052), TTTTAGGGGTTGGCGAGGGGGACG (SEQ ID NO:16053), TTTTTTAGGGGTTGGCGAGGGGGAC (SEQ ID NO:16054), TTTAGGGGTTGGCGAGGGGGACG (SEQ ID NO:16055) |
| Target1695 | chr18:76709439-76709463 | TGTGGACGGGATTGATGTTTTTAGAAAAGAGG (SEQ ID NO:16056), GTGTGGACGGGATTGATGTTTTTAGAAAAGAGG (SEQ ID NO:16057), GTGTGGACGGGATTGATGTTTTTAGAAAAGAGGT (SEQ ID NO:16058), TGTGGACGGGATTGATGTTTTTAGAAAAGAGGTT (SEQ ID NO:16059), GTGTGGACGGGATTGATGTTTTTAGAAAAGAGGTT (SEQ ID NO:16060), TGGATGTTGGTGTTGGATTTCGGTGAGGT (SEQ ID NO:16061), GGATGTTGGTGTTGGATTTCGGTGAGGT (SEQ ID NO:16062), TGGATGTTGGTGTTGGATTTCGGTGAGG (SEQ ID NO:16063), GGATGTTGGTGTTGGATTTCGGTGAGG (SEQ ID NO:16064), TGGTGTTGGATTTCGGTGAGGTTGTTGT (SEQ ID NO:16065) |
| Target1696 | chr18:77548101-77548126 | TTCGCGGCGTATAAGGGTTGTTCGAGC (SEQ ID NO:16066), TTTCGCGGCGTATAAGGGTTGTTCGAGC (SEQ ID NO:16067), TCGCGGCGTATAAGGGTTGTTCGAGC (SEQ ID NO:16068), CGGTTTTCGCGGCGTATAAGGGTTGTT (SEQ ID NO:16069), CGGTTTTCGCGGCGTATAAGGGTTGTTCG (SEQ ID NO:16070), TTCGTTAGGAGGGATTCGGGAGGTCGC (SEQ ID NO:16071), TTTCGTTAGGAGGGATTCGGGAGGTCGC (SEQ ID NO:16072), CGGTTTCGTTAGGAGGGATTCGGGAGGT (SEQ ID NO:16073), TCGTTAGGAGGGATTCGGGAGGTCGC (SEQ ID NO:16074), GCGGGGATTTTTTGCGTTTCGGGGAC (SEQ ID NO:16075) |
| Target1697 | chr18:77548141-77548153 | GCGGCGTATAAGGGTTGTTCGAGCGTT (SEQ ID NO:16076), TTCGCGGCGTATAAGGGTTGTTCGAGC (SEQ ID NO:16077), GCGGCGTATAAGGGTTGTTCGAGCGTTT (SEQ ID NO:16078), TTTCGCGGCGTATAAGGGTTGTTCGAGC (SEQ ID NO:16079), GCGGCGTATAAGGGTTGTTCGAGCGT (SEQ ID NO:16080), TTCGTTAGGAGGGATTCGGGAGGTCGC (SEQ ID NO:16081), TTTCGTTAGGAGGGATTCGGGAGGTCGC (SEQ ID NO:16082), CGGTTTCGTTAGGAGGGATTCGGGAGGT |

FIGURE 5 CONTINUED

{SEQ ID NO:16083}, TCGTTAGGAGGGATTCGGGAGGTCGC {SEQ ID NO:16084}, GCGGGGATTTTTTGCGTTCGGGGAC {SEQ ID NO:16085}

| Target1698 | chr18:77548166-77548177 | GCGGCGTATAAGGGTTGTTCGAGCGTT {SEQ ID NO:16086}, TTCGCGGCGTATAAGGGTTGTTCGAGC {SEQ ID NO:16087}, GCGGCGTATAAGGGTTGTTCGAGCGTTT {SEQ ID NO:16088}, TTTCGCGGCGTATAAGGGTTGTTCGAGC {SEQ ID NO:16089}, GCGGCGTATAAGGGTTGTTCGAGCGT {SEQ ID NO:16090}, TTTTAAGCGGGTTTATCGGGTCGGCGG {SEQ ID NO:16091}, TTTTAAGCGGGTTTATCGGGTCGGCGGG {SEQ ID NO:16092}, TTCGTTAGGAGGGATTCGGGAGGTCGT {SEQ ID NO:16093}, TTTTTAAGCGGGTTTATCGGGTCGGCGG {SEQ ID NO:16094}, CGGTTTCGTTAGGAGGGATTCGGGAGGT {SEQ ID NO:16095} |
| Target1699 | chr18:77548190-77548312 | GCGGCGTATAAGGGTTGTTCGAGCGTT {SEQ ID NO:16096}, TTCGCGGCGTATAAGGGTTGTTCGAGC {SEQ ID NO:16097}, GCGTAGGTTTCGTCGGTTCGGTGGATT {SEQ ID NO:16098}, CGTCGGTTCGGTGGATTCGTTTGAGGA {SEQ ID NO:16099}, TCGTCGGTTCGGTGGATTCGTTTGAGG {SEQ ID NO:16100}, CGGGGGCGGTAGTTGAGTTTCGTTCGA {SEQ ID NO:16101}, TTTTAAGCGGGTTTATCGGGTCGGCGG {SEQ ID NO:16102}, ACGGGGGCGGTAGTTGAGTTTCGTTCG {SEQ ID NO:16103}, TTTAAGCGGGTTTATCGGGTCGGCGGG {SEQ ID NO:16104}, GGTAACGGGGGCGGTAGTTGAGTTTCG {SEQ ID NO:16105} |
| Target1700 | chr18:77548319-77548340 | GCGTAGGTTTCGTCGGTTCGGTGGATT {SEQ ID NO:16106}, CGTCGGTTCGGTGGATTCGTTTGAGGA {SEQ ID NO:16107}, TCGTCGGTTCGGTGGATTCGTTTGAGG {SEQ ID NO:16108}, TCGTCGGTTCGGTGGATTCGTTTGAGGA {SEQ ID NO:16109}, AGGTTTCGTCGGTTCGGTGGATTCGTT {SEQ ID NO:16110}, CGGGGGCGGTAGTTGAGTTTCGTTCGA {SEQ ID NO:16111}, ACGGGGGCGGTAGTTGAGTTTCGTTCG {SEQ ID NO:16112}, GGTAACGGGGGCGGTAGTTGAGTTTCG {SEQ ID NO:16113}, GGGGGCGGTAGTTGAGTTTCGTTCGAG {SEQ ID NO:16114}, GGGGGCGGTAGTTGAGTTTCGTTCGAGT {SEQ ID NO:16115} |
| Target1701 | chr18:77548341-77548384 | GCGTAGGTTTCGTCGGTTCGGTGGATT {SEQ ID NO:16116}, CGTCGGTTCGGTGGATTCGTTTGAGGA {SEQ ID NO:16117}, TCGTCGGTTCGGTGGATTCGTTTGAGG {SEQ ID NO:16118}, TCGTCGGTTCGGTGGATTCGTTTGAGGA {SEQ ID NO:16119}, AGGTTTCGTCGGTTCGGTGGATTCGTT {SEQ ID NO:16120}, CGGGGGCGGTAGTTGAGTTTCGTTCGA {SEQ ID NO:16121}, ACGGGGGCGGTAGTTGAGTTTCGTTCG {SEQ ID NO:16122}, GGTAACGGGGGCGGTAGTTGAGTTTCG {SEQ ID NO:16123}, GGGGGCGGTAGTTGAGTTTCGTTCGAG {SEQ ID NO:16124}, GGGGGCGGTAGTTGAGTTTCGTTCGAGT {SEQ ID NO:16125} |
| Target1702 | chr18:77548429-77548460 | GGGTGGATGGGATTTTGCGCGTGGAAT {SEQ ID NO:16126}, GGGTGGATGGGATTTTGCGCGTGGAA {SEQ ID NO:16127}, GGGTGGATGGGATTTTGCGCGTGGAATT {SEQ ID NO:16128}, TTTTTCGGGTGGATGGGATTTTGCGCG {SEQ ID NO:16129}, GGTGGATGGGATTTTGCGCGTGGAATT {SEQ ID NO:16130}, TCGTGGAGAAGGAATGGGTTTTGCGGT {SEQ ID NO:16131}, CGTGGAGAAGGAATGGGTTTTGCGGTT {SEQ ID NO:16132}, CGTGGAGAAGGAATGGGTTTTGCGGTTCG {SEQ ID NO:16133}, TCGTGGAGAAGGAATGGGTTTTGCGGTT {SEQ ID NO:16134}, TGGAGAAGGAATGGGTTTTGCGGTTCG {SEQ ID NO:16135} |
| Target1703 | chr18:77548478-77548486 | GGGTGGATGGGATTTTGCGCGTGGAAT {SEQ ID NO:16136}, GGGTGGATGGGATTTTGCGCGTGGAA {SEQ ID NO:16137}, GGGTGGATGGGATTTTGCGCGTGGAATT {SEQ ID NO:16138}, TTTTTCGGGTGGATGGGATTTTGCGCG {SEQ ID NO:16139}, GGTGGATGGGATTTTGCGCGTGGAATT {SEQ ID NO:16140}, TTTTTAAGCGGGGCGGGGTTGTCGTTC {SEQ ID NO:16141}, TTGTTTTTAAGCGGGGCGGGGTTGTCG {SEQ ID NO:16142}, GTTTTTAAGCGGGGCGGGGTTGTCGTT {SEQ ID NO:16143}, CGGGGTTGTCGTTCGGATGTGAGTCGT {SEQ ID NO:16144}, CGGGGTTGTCGTTCGGATGTGAGTCGTA {SEQ ID NO:16145} |
| Target1704 | chr18:77548546-77548582 | GGGTGGATGGGATTTTGCGCGTGGAAT {SEQ ID NO:16146}, TTTTTACGGTGGCGTTGGGGAGGGGTT {SEQ ID NO:16147}, TTTTTTACGGTGGCGTTGGGGAGGGGT {SEQ ID NO:16148}, GGTGGCGTTGGGGAGGGGTTGTTTTTA {SEQ ID NO:16149}, TTTTACGGTGGCGTTGGGGAGGGGTTG {SEQ ID NO:16150}, TTTTTAAGCGGGGCGGGGTTGTCGTTC {SEQ ID NO:16151}, TTGTTTTTAAGCGGGGCGGGGTTGTCG {SEQ ID NO:16152}, GTTTTTAAGCGGGGCGGGGTTGTCGTT {SEQ ID NO:16153}, CGGGGTTGTCGTTCGGATGTGAGTCGT {SEQ ID NO:16154}, CGGGGTTGTCGTTCGGATGTGAGTCGTA {SEQ ID NO:16155} |
| Target1705 | chr19:641826-641902 | GGTCGGGTTGGGAGGTTGTTTCGAGGA {SEQ ID NO:16156}, AGGTCGGGTTGGGAGGTTGTTTCGAGG {SEQ ID NO:16157}, TCGGGTTGGGAGGTTGTTTCGAGGAGT {SEQ ID NO:16158}, GGAAGGTCGGGTTGGGAGGTTGTTTCG {SEQ ID NO:16159}, GTCGGGTTGGGAGGTTGTTTCGAGGAGT {SEQ ID NO:16160}, GGGGTTAGTTGAGGTTTGGGAGTGGTAG {SEQ ID NO:16161}, GGGGTTAGTTGAGGTTTGGGAGTGGT {SEQ ID NO:16162}, GGGGTTAGTTGAGGTTTGGGAGTGGTAGA {SEQ ID NO:16163}, GGGGTTAGTTGAGGTTTGGGAGTGGTAGAG {SEQ ID NO:16164}, GGGGTTAGTTGAGGTTTGGGAGTGGTAGAGT {SEQ ID NO:16165} |
| Target1706 | chr19:1210277-1210342 | TGGGAGTTGGTGTGTTTTGATTGGAGGT {SEQ ID NO:16166}, TTGGGAGTTGGTGTGTGTTTTGATTGGAGGT {SEQ ID NO:16167}, GGGAGTTGGTGTGTGTTTTGATTGGAGGTTGT {SEQ ID NO:16168}, TGGGAGTTGGTGTGTGTTTTGATTGGAGGTTG {SEQ ID NO:16169}, GGGAGTTGGTGTGTGTTTTGATTGGAGGTTG {SEQ ID NO:16170}, CGGACGTTTGAGGTTTGTTTGGAAGGT {SEQ ID NO:16171}, TCGGACGTTTGAGGTTTGTTTGGAAGGT {SEQ ID NO:16172}, TCGGACGTTTGAGGTTTGTTTGGAAGG {SEQ ID NO:16173}, AGGATCGGACGTTTGAGGTTTGTTTGGA {SEQ ID NO:16174}, CGGACGTTTGAGGTTTGTTTGGAAGGTT {SEQ ID NO:16175} |

FIGURE 5 CONTINUED

| Target1707 | chr19:1210346-1210414 | AGGCGTTCGGTTTTTTTAGTTGGTGTGG (SEQ ID NO:16176), GGCGTTCGGTTTTTTTAGTTGGTGTGGA (SEQ ID NO:16177), AGGCGTTCGGTTTTTTTAGTTGGTGTGGA (SEQ ID NO:16178), GGCGTTCGGTTTTTTTAGTTGGTGTGGAA (SEQ ID NO:16179), AGGCGTTCGGTTTTTTTAGTTGGTGTGGAA (SEQ ID NO:16180), TTTTGGGAAGGAAGGGAAGAGACGGGA (SEQ ID NO:16181), TGGGAAGGAAGGGAAGAGACGGGATTT (SEQ ID NO:16182), TTGGGAAGGAAGGGAAGAGACGGGATT (SEQ ID NO:16183), TTTGGGAAGGAAGGGAAGAGACGGGAT (SEQ ID NO:16184), TTTTTGGGAAGGAAGGGAAGAGACGGG (SEQ ID NO:16185) |
|---|---|---|
| Target1708 | chr19:1210449-1210462 | TAAGGGGGGTGGGTTGGGGTAGATGGA (SEQ ID NO:16186), GGTTGGGGTAGATGGAGTCGGCGTGAG (SEQ ID NO:16187), GTTGGGGTAGATGGAGTCGGCGTGAGT (SEQ ID NO:16188), TGGGGTAGATGGAGTCGGCGTGAGTTT (SEQ ID NO:16189), TTGGGGTAGATGGAGTCGGCGTGAGTT (SEQ ID NO:16190), TTTTGGGAAGGAAGGGAAGAGACGGGA (SEQ ID NO:16191), TGGGAAGGAAGGGAAGAGACGGGATTT (SEQ ID NO:16192), TTGGGAAGGAAGGGAAGAGACGGGATT (SEQ ID NO:16193), TTTGGGAAGGAAGGGAAGAGACGGGAT (SEQ ID NO:16194), TTTTTGGGAAGGAAGGGAAGAGACGGG (SEQ ID NO:16195) |
| Target1709 | chr19:1467092-1468062 | GGAGTAGTTTCGGGGCGCGGGTAAGAA (SEQ ID NO:16196), CGGGGCGCGGGTAAGAATAGAGTAGGG (SEQ ID NO:16197), GGGAGTCGTCGTGTTTGTTCGGTTGCG (SEQ ID NO:16198), ATTTTGTAGGGTATCGGCGGCGGGAGG (SEQ ID NO:16199), GAGCGTTCGTAGGGTCGGAAGGAGGTT (SEQ ID NO:16200), GTTCGTTGAGGGAGTTGGCGGAGGAGT (SEQ ID NO:16201), TGAGTCGTTTTTGTTTGCGGGGGCGTT (SEQ ID NO:16202), GGGAGTGCGCGGCGATTTGGTATTAGC (SEQ ID NO:16203), GCGGCGGGGTAGTTGGTGTAGTTTTGG (SEQ ID NO:16204), GGCGGCGGGGTAGTTGGTGTAGTTTTG (SEQ ID NO:16205) |
| Target1710 | chr19:1468067-1468130 | TTGTTTCGTTTAAGGTTGTATTAGTTGTTTCGTCGT (SEQ ID NO:16206), AGGTTAGATACGGGGGGTCGGCGTTTG (SEQ ID NO:16207), GTCGGCGTTTGGGTAGGGTCGAGTTGA (SEQ ID NO:16208), TCGGCGTTTGGGTAGGGTCGAGTTGAT (SEQ ID NO:16209), TAGATACGGGGGGTCGGCGTTTGGGTA (SEQ ID NO:16210), CGGCGTTTGGGTAGGGTCGAGTTGATG (SEQ ID NO:16211) |
| Target1711 | chr19:1468146-1468230 | TAAGGATTCGGGTTTAGGAGGCGGACG (SEQ ID NO:16212), AAGGATTCGGGTTTAGGAGGCGGACG (SEQ ID NO:16213), TTAAGGATTCGGGTTTAGGAGGCGGACG (SEQ ID NO:16214), TTAAGGATTCGGGTTTAGGAGGCGGAC (SEQ ID NO:16215), GGGAGTTCGCGGTTATTAAGGATTCGGGT (SEQ ID NO:16216), AGGTTAGATACGGGGGGTCGGCGTTTG (SEQ ID NO:16217), GTCGGCGTTTGGGTAGGGTCGAGTTGA (SEQ ID NO:16218), TCGGCGTTTGGGTAGGGTCGAGTTGAT (SEQ ID NO:16219), TAGATACGGGGGGTCGGCGTTTGGGTA (SEQ ID NO:16220), CGGCGTTTGGGTAGGGTCGAGTTGATG (SEQ ID NO:16221) |
| Target1712 | chr19:1468242-1468249 | CGGTTTTTCGTGTTTGGTTTGCGGCGT (SEQ ID NO:16222), TCGGTTTTTCGTGTTTGGTTTGCGGCG (SEQ ID NO:16223), CGGTTTTTCGTGTTTGGTTTGCGGCGTC (SEQ ID NO:16224), GTCGGTTTTTCGTGTTTGGTTTGCGGCG (SEQ ID NO:16225), CGTCGGTTTTTCGTGTTTGGTTTGCGGC (SEQ ID NO:16226), ATTTAGTCGGGTGGTTCGGGGTTTGCG (SEQ ID NO:16227), TTTAGTCGGGTGGTTCGGGGTTTGCGG (SEQ ID NO:16228), TTTAGTCGGGTGGTTCGGGGTTTGCG (SEQ ID NO:16229), TGCGGGTCGTTTATTTAGTCGGGTGGT (SEQ ID NO:16230), ATTTAGTCGGGTGGTTCGGGGTTTCG (SEQ ID NO:16231) |
| Target1713 | chr19:3687798-3687839 | TGGTTGGAGGGGAGGGTATATTTGGGGG (SEQ ID NO:16232), GGTTGGAGGGGAGGGTATATTTGGGGG (SEQ ID NO:16233), TGGTTGGAGGGGAGGGTATATTTGGGGGA (SEQ ID NO:16234), GGTTGGAGGGGAGGGTATATTTGGGGGA (SEQ ID NO:16235), GTGGTTGGAGGGGAGGGTATATTTGGGGG (SEQ ID NO:16236), GGGTTTGCGGAGTTTTGGATGTTTCGT (SEQ ID NO:16237), AGGGTTTGCGGAGTTTTGGATGTTTCGT (SEQ ID NO:16238), AGGGTTTGCGGAGTTTTGGATGTTTCG (SEQ ID NO:16239), TGCGGAGTTTTGGATGTTTCGTTCGTT (SEQ ID NO:16240), TTGCGGAGTTTTGGATGTTTCGTTCGT (SEQ ID NO:16241) |
| Target1714 | chr19:3687873-3687901 | TAGGTGGGCGGGTAGGAGTTAGGTCGG (SEQ ID NO:16242), GGTGGGCGGGTAGGAGTTAGGTCGGTA (SEQ ID NO:16243), GTAGGTGGGCGGGTAGGAGTTAGGTCG (SEQ ID NO:16244), GTGGGCGGGTAGGAGTTAGGTCGGTAA (SEQ ID NO:16245), AGTAGGTGGGCGGGTAGGAGTTAGGTCG (SEQ ID NO:16246), TCGGTTCGTTCGGGAGTTTGGTGTTGA (SEQ ID NO:16247), CGGTTCGTTCGGGAGTTTGGTGTTGAG (SEQ ID NO:16248), CGGTTCGTTCGGGAGTTTGGTGTTGAGA (SEQ ID NO:16249), TCGGTTCGTTCGGGAGTTTGGTGTTGAG (SEQ ID NO:16250), TGTTTCGGTTCGTTCGGGAGTTTGGTGT (SEQ ID NO:16251) |
| Target1715 | chr19:3687981-3688011 | TTAAGTTTTCGGGCGGGTCGGGGTAGG (SEQ ID NO:16252), TAAGTTTTCGGGCGGGTCGGGGTAGGA (SEQ ID NO:16253), TAAGTTTTCGGGCGGGTCGGGGTAGG (SEQ ID NO:16254), ATTAAGTTTTCGGGCGGGTCGGGGTAGG (SEQ ID NO:16255), GTATTAAGTTTTCGGGCGGGTCGGGGT (SEQ ID NO:16256), CGGTTTCGTTATTTGCGGGTTGGTTACG (SEQ ID NO:16257), CGGTTTCGTTATTTGCGGGTTGGTTACGT (SEQ ID NO:16258), TTTTAGGGGTTGGCGTGTGTTTTGTGT (SEQ ID NO:16259), AGGGGTTGGCGTGTGTTTTGTGTATTT (SEQ ID NO:16260), GGTTTCGTTATTTGCGGGTTGGTTACGT (SEQ ID NO:16261) |
| Target1716 | chr19:3688088-3688105 | TTTTTGGGGGAAGTTCGGTTCGTGCGG (SEQ ID NO:16262), TGTGGGGCGTGGTTAGTTCGTAGGTGG (SEQ ID NO:16263), TTAAGTTTTCGGGCGGGTCGGGGTAGG (SEQ ID NO:16264), GGGTAGGAGGTTGTGGGGCGTGGTTAG (SEQ ID NO:16265), AGGAGGTTGTGGGGCGTGGTTAGTTCG (SEQ ID NO:16266), TTTTGTTGTGTTGGAGACGGAGCGCGT (SEQ ID NO:16267), TTGTTGTGTTGGAGACGGAGCGCGTAA (SEQ ID NO:16268), TTTGTTGTGTTGGAGACGGAGCGCGTA |

FIGURE 5 CONTINUED (SEQ ID NO:16269), TTTTTGTTGTGTTGGAGACGGAGCGCG (SEQ ID NO:16270), TTTTTGTTGTGTTGGAGACGGAGCGCGT (SEQ ID NO:16271)

Target1717    chr19:3688174-3688206    TTTTTGGGGGAAGTTCGGTTCGTGCGG (SEQ ID NO:16272), GCGGGTTGCGGGAGATTTTGATGGGTT (SEQ ID NO:16273), GTTTTTGGGGGAAGTTCGGTTCGTGCG (SEQ ID NO:16274), GCGGGTTGCGGGAGATTTTGATGGGTT (SEQ ID NO:16275), TTTTGGGGGAAGTTCGGTTCGTGCGG (SEQ ID NO:16276), GCGTTTTTGGAGGATAGGGACGTTGGGG (SEQ ID NO:16277), TGCGTTTTTGGAGGATAGGGACGTTGGG (SEQ ID NO:16278), GCGTTTTTGGAGGATAGGGACGTTGGGGA (SEQ ID NO:16279), GCGTTTTTGGAGGATAGGGACGTTGGG (SEQ ID NO:16280), TGCGTTTTTGGAGGATAGGGACGTTGGGG (SEQ ID NO:16281)

Target1718    chr19:3688313-3688339    TCGTGGTGGGAAATAGAGCGGGGTGTC (SEQ ID NO:16282), GTCGTGGTGGGAAATAGAGCGGGGTGT (SEQ ID NO:16283), GGTCGTGGTGGGAAATAGAGCGGGGTG (SEQ ID NO:16284), TAGGTCGTGGTGGGAAATAGAGCGGGG (SEQ ID NO:16285), CGTGGTGGGAAATAGAGCGGGGTGTCG (SEQ ID NO:16286), AGGTGAGGAATAGGAGTTTTTGCGGGT (SEQ ID NO:16287), AGGTGAGGAATAGGAGTTTTTGCGGGTT (SEQ ID NO:16288), CGTAGGTGAGGAATAGGAGTTTTTGCGGG (SEQ ID NO:16289), CGTAGGTGAGGAATAGGAGTTTTTGCGGGT (SEQ ID NO:16290), TCGTAGGTGAGGAATAGGAGTTTTTGCGGG (SEQ ID NO:16291)

Target1719    chr19:4792019-4792085    GTGGAGTATTTGGTGGATCGGTGCGGC (SEQ ID NO:16292), GGTGGAGTATTTGGTGGATCGGTGCGG (SEQ ID NO:16293), TGGAGTATTTGGTGGATCGGTGCGGCG (SEQ ID NO:16294), GGAGTATTTGGTGGATCGGTGCGGCG (SEQ ID NO:16295), TGGTGGAGTATTTGGTGGATCGGTGCG (SEQ ID NO:16296), GAGGTTTCGCGGCGTAGTAGGTTTCGT (SEQ ID NO:16297), TTACGTTTAGGTGGTCGGTTGCGGAGG (SEQ ID NO:16298), AGGTTTCGCGGCGTAGTAGGTTTCGTA (SEQ ID NO:16299), ATTACGTTTAGGTGGTCGGTTGCGGAGG (SEQ ID NO:16300), TACGTTTAGGTGGTCGGTTGCGGAGG (SEQ ID NO:16301)

Target1720    chr19:4792308-4792366    GAGGTGGTGCGTTATTTGGTCGGCGAG (SEQ ID NO:16302), TTGGAGGTGGTGCGTTATTTGGTCGGC (SEQ ID NO:16303), AGGTGGTGCGTTATTTGGTCGGCGAGT (SEQ ID NO:16304), GGTGGTGCGTTATTTGGTCGGCGAGTA (SEQ ID NO:16305), GGAGGTGGTGCGTTATTTGGTCGGCGA (SEQ ID NO:16306), GGGTCGTGTTGTTTTTGGCGTTGCGTC (SEQ ID NO:16307), AGGGTCGTGTTGTTTTTGGCGTTGCGT (SEQ ID NO:16308), GCGTTGCGTCGGTTTATTTGGGCGTTT (SEQ ID NO:16309), GGCGTTGCGTCGGTTTATTTGGGCGTT (SEQ ID NO:16310), TAGGGTCGTGTTGTTTTTGGCGTTGCG (SEQ ID NO:16311)

Target1721    chr19:5229275-5229659    GCGGTAGGGGAGAGAGGAGGAAGGTGA (SEQ ID NO:16312), AGGTGAGCGGGGGAGGTTAGAGATGGA (SEQ ID NO:16313), TAGGGGAGAGAGGAGGAAGGTGAGCGG (SEQ ID NO:16314), AGGAAGGTGAGCGGGGGAGGTTAGAGA (SEQ ID NO:16315), GAGGCGGTAGGGGAGAGAGGAGGAAGG (SEQ ID NO:16316), GTATTGTTCGGGGTAGGGTCGGGCGTT (SEQ ID NO:16317), TATTGTTCGGGGTAGGGTCGGGCGTTT (SEQ ID NO:16318), ATTGTTCGGGGTAGGGTCGGGCGTTTT (SEQ ID NO:16319), GTGGTATTGTTCGGGGTAGGGTCGGGC (SEQ ID NO:16320), TGTTGGTCGATGTTTAGGTGGGCGGGG (SEQ ID NO:16321)

Target1722    chr19:5229744-5229840    AGGGCGTTCGGTTTTGTTTCGGGTAGT (SEQ ID NO:16322), GGGCGTTCGGTTTTGTTTCGGGTAGTGT (SEQ ID NO:16323), GGGCGTTCGGTTTTGTTTCGGGTAGTG (SEQ ID NO:16324), AGGGCGTTCGGTTTTGTTTCGGGTAGTG (SEQ ID NO:16325), GGCGTTCGGTTTTGTTTCGGGTAGTGT (SEQ ID NO:16326), TAGGGTTGTGGGGGGTGTGTAGGAGGT (SEQ ID NO:16327), GTGGTATTGTTCGGGGTAGGGTCGGGT (SEQ ID NO:16328), AGTGGTATTGTTCGGGGTAGGGTCGGG (SEQ ID NO:16329), AGGGTTGTGGGGGGTGTGTAGGAGGTT (SEQ ID NO:16330), GGGTTGTGGGGGGTGTGTAGGAGGTTA (SEQ ID NO:16331)

Target1723    chr19:11002310-11002590    GGGGGGTGGTTTTTAGTTCGGTTTGTT (SEQ ID NO:16332), GGGGGGTGGTTTTTAGTTCGGTTTGTTT (SEQ ID NO:16333), AGTTAGTAGGGTTTAAAAGGATGTTGGGGGG (SEQ ID NO:16334), TTAGTTAGTAGGGTTTAAAAGGATGTTGGGGGG (SEQ ID NO:16335), TTTAGTTAGTAGGGTTTAAAAGGATGTTGGGGGG (SEQ ID NO:16336), AGATGGGCGGGGAAGGGATAGAGGGAG (SEQ ID NO:16337), AAAAGGTAATGGCGAAGGTTGGGGGCG (SEQ ID NO:16338), TAGATGGGCGGGGAAGGGATAGAGGGA (SEQ ID NO:16339), GGGGAAGGGATAGAGGGAGGAGGGGTA (SEQ ID NO:16340), GATGGGCGGGGAAGGGATAGAGGGAGG (SEQ ID NO:16341)

Target1724    chr19:15292415-15292441    GGGGTTGTAGTCGGGTAGGTTTTGTTCGT (SEQ ID NO:16342), TGGGGTTGTAGTCGGGTAGGTTTTGTTCG (SEQ ID NO:16343), GGGGTTGTAGTCGGGTAGGTTTTGTTCG (SEQ ID NO:16344), TGGGGTTGTAGTCGGGTAGGTTTTGTTCGT (SEQ ID NO:16345), TGGGGTTGTAGTCGGGTAGGTTTTGTT (SEQ ID NO:16346), AGTGTTTGAGTAATTTTTGCGGTTCGGGT (SEQ ID NO:16347), GAGTGTTTGAGTAATTTTTGCGGTTCGGGT (SEQ ID NO:16348), TGAGTGTTTGAGTAATTTTTGCGGTTCGGG (SEQ ID NO:16349), TGAGTGTTTGAGTAATTTTTGCGGTTCGGGT (SEQ ID NO:16350), ATGAGTGTTTGAGTAATTTTTGCGGTTCGGG (SEQ ID NO:16351)

Target1725    chr19:15292472-15292542    TGGCGGGTAGGTGTAGGTGAAGGAGGT (SEQ ID NO:16352), CGTGGTCGGTATAGGTGTTCGGGTCGT (SEQ ID NO:16353), GGCGGGTAGGTGTAGGTGAAGGAGGTT (SEQ ID NO:16354), TTGGCGGGTAGGTGTAGGTGAAGGAGG (SEQ ID NO:16355), CGGTATAGGTGTTCGGGTCGTAGGGGT (SEQ ID NO:16356), AGTGTTTGAGTAATTTTTGCGGTTCGGGT (SEQ ID NO:16357),

FIGURE 5 CONTINUED

GAGTGTTTGAGTAATTTTTGCGGTTCGGGT (SEQ ID NO:16358),
TGAGTGTTTGAGTAATTTTTGCGGTTCGGG (SEQ ID NO:16359),
TGAGTGTTTGAGTAATTTTTGCGGTTCGGGT (SEQ ID NO:16360),
ATGAGTGTTTGAGTAATTTTTGCGGTTCGGG (SEQ ID NO:16361)

Target1726    chr19:15580432-15580647    TCGTCGGGAAGTTGGGGGTTTGGTTGA (SEQ ID NO:16362), AGTCGGTGCGTATTAGTTGGCGGTGGT (SEQ ID NO:16363), TCGGGAAGTTGGGGGTTTGGTTGAGGT (SEQ ID NO:16364), AGGTAGGGGGTAGGGGTTTCGTGGAGT (SEQ ID NO:16365), TCGTGGAGTTTGTGTAGACGGAGGGGC (SEQ ID NO:16366), TCGGGGTTTCGGCGTGGTTATAGTGGG (SEQ ID NO:16367), TGTAGTTTCGTGGTGGGTTCGGACGGT (SEQ ID NO:16368), CGGGGTTTCGGCGTGGTTATAGTGGGT (SEQ ID NO:16369), CGGGGTTTCGGCGTGGTTATAGTGGGTA (SEQ ID NO:16370), TGTAGTTTCGTGGTGGGTTCGGACGGTT (SEQ ID NO:16371)

Target1727    chr19:15580657-15580773    GTTTCGGGAGTTGTGGTCGAGCGTGTG (SEQ ID NO:16372), AGTTTCGGGAGTTGTGGTCGAGCGTGT (SEQ ID NO:16373), AAGTTTCGGGAGTTGTGGTCGAGCGTG (SEQ ID NO:16374), TTTCGGGAGTTGTGGTCGAGCGTGTGG (SEQ ID NO:16375), GAAGTTTCGGGAGTTGTGGTCGAGCGT (SEQ ID NO:16376), CGGGTTTTGGGGTCGGTGGTTTTTGGT (SEQ ID NO:16377), GAGGGGGAGCGGATAAGGGTTCGGGTTT (SEQ ID NO:16378), TGTAGTTTCGTGGTGGGTTCGGACGGT (SEQ ID NO:16379), AGGGGAGCGGATAAGGGTTCGGGTTTT (SEQ ID NO:16380), AATCGGGGAGGGGAGCGGATAAGGGTT (SEQ ID NO:16381)

Target1728    chr19:15580839-15580863    TATTATGCGGCGTGAGGGGGATTCGGG (SEQ ID NO:16382), GTATTATGCGGCGTGAGGGGGATTCGG (SEQ ID NO:16383), CGGCGTGAGGGGGATTCGGGTTTTTAT (SEQ ID NO:16384), AGTATTATGCGGCGTGAGGGGGATTCGG (SEQ ID NO:16385), GCGGCGTGAGGGGGATTCGGGTTTTTA (SEQ ID NO:16386), GGGGAGGAGAAGGGTAGAAAGGGGCGTG (SEQ ID NO:16387), GTGGGGAGGAGAAGGGTAGAAAGGGGC (SEQ ID NO:16388), AGGGGCGTGTTAGTATTGAAGGGCGGA (SEQ ID NO:16389), GGAGGAGAAGGGTAGAAAGGGGCGTGT (SEQ ID NO:16390), TGGGGAGGAGAAGGGTAGAAAGGGGCG (SEQ ID NO:16391)

Target1729    chr19:18043907-18044307    GAAGGTTGGAGGAGGGGTGTTGGGAGG (SEQ ID NO:16392), GGAAGGTTGGAGGAGGGGTGTTGGGAG (SEQ ID NO:16393), TTTCGAGAGGGATAGAGTTGGGCGCGG (SEQ ID NO:16394), AGGTTGGAGGAGGGGTGTTGGGAGGTA (SEQ ID NO:16395), GGCGTTGGGGTAAGAAGGTAGGAGCGT (SEQ ID NO:16396), GGAGTGGTTTAGGTTGGGCGAGGGGTA (SEQ ID NO:16397), TAGGGAGTGGTTTAGGTTGGGCGAGGG (SEQ ID NO:16398), GGAGTGGTTTAGGTTGGGCGAGGGGT (SEQ ID NO:16399), AGGGAGTGGTTTAGGTTGGGCGAGGGG (SEQ ID NO:16400), AGGGAGTGGTTTAGGTTGGGCGAGGGG (SEQ ID NO:16401)

Target1730    chr19:31231293-31231693    AGCGGTATTGTTGACGTTAGGGGTTTGA (SEQ ID NO:16402), AGCGGTATTGTTGACGTTAGGGGTTTGAT (SEQ ID NO:16403), GCGGTATTGTTGACGTTAGGGGTTTGATG (SEQ ID NO:16404), AGCGGTATTGTTGACGTTAGGGGTTTGATG (SEQ ID NO:16405), GCGGTATTGTTGACGTTAGGGGTTTGATGA (SEQ ID NO:16406), TGTGTTTCGGGAATAGCGGGTAGTGTT (SEQ ID NO:16407), TTGTGTTTCGGGAATAGCGGGTAGTGT (SEQ ID NO:16408), TGTGTTTCGGGAATAGCGGGTAGTGTTT (SEQ ID NO:16409), TTGTGTTTCGGGAATAGCGGGTAGTGTT (SEQ ID NO:16410), TTTGTGTTTCGGGAATAGCGGGTAGTGT (SEQ ID NO:16411)

Target1731    chr19:32397371-32397537    AGAGTTAGGAGGCGGAGTTTTTTGTGAGT (SEQ ID NO:16412), AGAGTTAGGAGGCGGAGTTTTTTGTGAGTT (SEQ ID NO:16413), GGAGGCGGAGTTTTTTGTGAGTTTTTAAGGG (SEQ ID NO:16414), AGAGTTAGGAGGCGGAGTTTTTTGTGAGTTT (SEQ ID NO:16415), AGGAGGCGGAGTTTTTTGTGAGTTTTTAAGGG (SEQ ID NO:16416)

Target1732    chr19:39055972-39056314    GTTGGAGACGAGGAGGAGGCGGTGTAC (SEQ ID NO:16417), GCGGTTTGGTGGAGGGCGTTAAGAAGG (SEQ ID NO:16418), GGCGGTTTGGTGGAGGGCGTTAAGAAG (SEQ ID NO:16419), CGTAGTGGCGGCGTTGTTTTGGGTAGT (SEQ ID NO:16420), TCGTAGTGGCGGCGTTGTTTTGGGTAG (SEQ ID NO:16421), TCGTCGTTGGTGGGGTCGGGTATGTTT (SEQ ID NO:16422), TTCGTCGTTGGTGGGGTCGGGTATGTT (SEQ ID NO:16423), TTTCGTCGTTGGTGGGGTCGGGTATGT (SEQ ID NO:16424), TGTATTTCGTCGTTGGTGGGGTCGGGT (SEQ ID NO:16425), AGGATGGGAGAGTTTTCGGGTGTGGGC (SEQ ID NO:16426)

Target1733    chr19:39056318-39056354    GTTGGAGACGAGGAGGAGGCGGTGTAC (SEQ ID NO:16427), TTGGAGACGAGGAGGAGGCGGTGTAC (SEQ ID NO:16428), GTTGGAGACGAGGAGGAGGCGGTGTA (SEQ ID NO:16429), GTTGGAGACGAGGAGGAGGCGGTGT (SEQ ID NO:16430), TGGAGACGAGGAGGAGGCGGTGTAC (SEQ ID NO:16431), AGGATGGGAGAGTTTTCGGGTGTGGGC (SEQ ID NO:16432), GGAGAGTTTTCGGGTGTGGGCGGTTTC (SEQ ID NO:16433), GGGAGAGTTTTCGGGTGTGGGCGGTTT (SEQ ID NO:16434), GATGGGAGAGTTTTCGGGTGTGGGCGG (SEQ ID NO:16435), GGATGGGAGAGTTTTCGGGTGTGGGCG (SEQ ID NO:16436)

Target1734    chr19:39754800-39754842    CGGACGTTTTTTAGGGGATAGTGGTCGGT (SEQ ID NO:16437), CGGACGTTTTTTAGGGGATAGTGGTCGG (SEQ ID NO:16438), TCGGACGTTTTTTAGGGGATAGTGGTCGG (SEQ ID NO:16439), TCGGACGTTTTTTAGGGGATAGTGGTCGGT (SEQ ID NO:16440), TCGGACGTTTTTTAGGGGATAGTGGTCG (SEQ ID NO:16441), TGGGTTAGGTTTATAGGGGAGGCGTAGT (SEQ ID NO:16442), GGTGTTGTCGGTTATTGTTTTTTGGGGGG (SEQ ID NO:16443), GGTGTTGTCGGTTATTGTTTTTTGGGGGGT (SEQ ID NO:16444), AGGTGTTGTCGGTTATTGTTTTTTGGGGGG (SEQ ID NO:16445), AGGTGTTGTCGGTTATTGTTTTTTGGGGGGT (SEQ ID NO:16446)

FIGURE 5 CONTINUED

Target1735    chr19:39755042-39755067    AGGTAGGGGATTGGACGCGTGGGATTT (SEQ ID NO:16447), AAGGTAGGGGATTGGACGCGTGGGATT (SEQ ID NO:16448), TTAAGGTAGGGGATTGGACGCGTGGGA (SEQ ID NO:16449), TAAGGTAGGGGATTGGACGCGTGGGAT (SEQ ID NO:16450), GGTAGGGGATTGGACGCGTGGGATTTT (SEQ ID NO:16451), GTTCGGGGTTTTAGCGAGCGGTAGTGC (SEQ ID NO:16452), TTCGGGGTTTTAGCGAGCGGTAGTGC (SEQ ID NO:16453), CGTTAGCGTTCGGGGTTTTAGCGAGC (SEQ ID NO:16454), TCGGGGTTTTAGCGAGCGGTAGTGC (SEQ ID NO:16455), GTTCGGGGTTTTAGCGAGCGGTAGTG (SEQ ID NO:16456)

Target1736    chr19:39755074-39755167    AGGTAGGGGATTGGACGCGTGGGATTT (SEQ ID NO:16457), AAGGTAGGGGATTGGACGCGTGGGATT (SEQ ID NO:16458), TTAAGGTAGGGGATTGGACGCGTGGGA (SEQ ID NO:16459), TAAGGTAGGGGATTGGACGCGTGGGAT (SEQ ID NO:16460), GGTAGGGGATTGGACGCGTGGGATTTT (SEQ ID NO:16461), AATTCGGCGGGGGTTAGTGTATCGGGGG (SEQ ID NO:16462), TGTGTGGGAATTCGGCGGGGGTTAGTGT (SEQ ID NO:16463), GTTCGGGGTTTTAGCGAGCGGTAGTGC (SEQ ID NO:16464), GTGTGTGGGAATTCGGCGGGGGTTAGTG (SEQ ID NO:16465), GTTAGCGACGGGTGTGTGGGAATTCGG (SEQ ID NO:16466)

Target1737    chr19:39889822-39889941    GATTATCGGGTCGGGGGCGGTGGTTTA (SEQ ID NO:16467), ATTATCGGGTCGGGGGCGGTGGTTTAC (SEQ ID NO:16468), AATTGATTATCGGGTCGGGGGCGGTGG (SEQ ID NO:16469), GGTCGGGGGCGGTGGTTTACGTTTGTA (SEQ ID NO:16470), AAATTGATTATCGGGTCGGGGGCGGTG (SEQ ID NO:16471), CGGGGTTTTATCGTGTTGGTTAGGTTGGT (SEQ ID NO:16472), CGGGGTTTTATCGTGTTGGTTAGGTTGG (SEQ ID NO:16473), AGTCGGGGTTTTATCGTGTTGGTTAGGT (SEQ ID NO:16474), TCGGGGTTTTATCGTGTTGGTTAGGTTGG (SEQ ID NO:16475), TCGGGGTTTTATCGTGTTGGTTAGGTTGGT (SEQ ID NO:16476)

Target1738    chr19:39889945-39889971    TTTGGGAGTTCGAGGCGGGCGGATTAT (SEQ ID NO:16477), TATTTTGGGAGTTCGAGGCGGGCGGAT (SEQ ID NO:16478), ATATTTTGGGAGTTCGAGGCGGGCGGA (SEQ ID NO:16479), GATTATCGGGTCGGGGGCGGTGGTTTA (SEQ ID NO:16480), TTTTGGGAGTTCGAGGCGGGCGGATTA (SEQ ID NO:16481), CGGGGTTTTATCGTGTTGGTTAGGTTGGT (SEQ ID NO:16482), CGGGGTTTTATCGTGTTGGTTAGGTTGG (SEQ ID NO:16483), AGTCGGGGTTTTATCGTGTTGGTTAGGT (SEQ ID NO:16484), TCGGGGTTTTATCGTGTTGGTTAGGTTGG (SEQ ID NO:16485), TCGGGGTTTTATCGTGTTGGTTAGGTTGGT (SEQ ID NO:16486)

Target1739    chr19:40939079-40939095    GAGATGGTAGTGGTATCGTTTCGGTTTATCGT (SEQ ID NO:16487), TGAGATGGTAGTGGTATCGTTTCGGTTTATCG (SEQ ID NO:16488), TGAGATGGTAGTGGTATCGTTTCGGTTTATCGT (SEQ ID NO:16489), TGTTTTTTGAGATGGTAGTGGTATCGTTTCGGT (SEQ ID NO:16490), TTGAGATGGTAGTGGTATCGTTTCGGTTTATCG (SEQ ID NO:16491)

Target1740    chr19:40939114-40939316    CGGAGGTTGCGGTGAGTCGAGAC (SEQ ID NO:16492), CGGAGGTTGCGGTGAGTCGAGA (SEQ ID NO:16493), CGTTTAGGTTGGAGTATAGTGGGGCGA (SEQ ID NO:16494), TCGTTTAGGTTGGAGTATAGTGGGGCG (SEQ ID NO:16495), TCGTTTAGGTTGGAGTATAGTGGGGCGA (SEQ ID NO:16496), TGTCGTTTAGGTTGGAGTATAGTGGGGCG (SEQ ID NO:16497), GTCGTTTAGGTTGGAGTATAGTGGGGCG (SEQ ID NO:16498)

Target1741    chr19:42005037-42005631    GCGTGGGTATAGGGAGAGGGAGGGGAT (SEQ ID NO:16499), GCGTGGGGGAAGGAAGAGGGTATGAGG (SEQ ID NO:16500), AGGAGCGTGGGTATAGGGAGAGGGAGG (SEQ ID NO:16501), GAGCGTGGGTATAGGGAGAGGGAGGGG (SEQ ID NO:16502), GGAGCGTGGGTATAGGGAGAGGGAGGG (SEQ ID NO:16503), TGTTTTGGGGTATTAGGTTGGGGGAAGG (SEQ ID NO:16504), ATGTTTTGGGGTATTAGGTTGGGGGAAGG (SEQ ID NO:16505), AATGTTTTGGGGTATTAGGTTGGGGGAAGG (SEQ ID NO:16506), GAATGTTTTGGGGTATTAGGTTGGGGGAAGG (SEQ ID NO:16507), AGAATGTTTTGGGGTATTAGGTTGGGGGAA (SEQ ID NO:16508)

Target1742    chr19:46996862-46996888    TTGCGGGGTTTGTTCGTAGTTTGGGCG (SEQ ID NO:16509), CGGGGTTTGTTCGTAGTTTGGGCGGTT (SEQ ID NO:16510), GCGGGTGTTTTGCGGGGTTTGTTCGTA (SEQ ID NO:16511), TCGTAGTTTGGGCGGTTTTTTGGGGGG (SEQ ID NO:16512), GGGCGGTTTTTTGGGGGGGTTATTAGCGG (SEQ ID NO:16513), AAGTAGGAAGAAGAAGGGGAGCGCGGG (SEQ ID NO:16514), GGGTAGGCGAGGTTAAGGGTTAGGCGT (SEQ ID NO:16515), AGGGTAGGCGAGGTTAAGGGTTAGGCG (SEQ ID NO:16516), GCGTCGGGGGTTTATGTTAGGGTAGGCG (SEQ ID NO:16517), GAAGTAGGAAGAAGAAGGGGAGCGCGGG (SEQ ID NO:16518)

Target1743    chr19:46996932-46996965    GCGGTTTTGGATTTAGTGGGCGTTTGGT (SEQ ID NO:16519), GCGGTTTTGGATTTAGTGGGCGTTTGG (SEQ ID NO:16520), CGTTTGTTTTGGTATGGGTTTCGGCGT (SEQ ID NO:16521), AGTGGGCGTTTGGTTTTTGGTTTCGTT (SEQ ID NO:16522), TCGTTTGTTTTGGTATGGGTTTCGGCGT (SEQ ID NO:16523), TCGGTCGGCGCGTTTTTTATCGTTTTC (SEQ ID NO:16524), TGATTTCGGTCGGCGCGTTTTTTATCGT (SEQ ID NO:16525), GATTTCGGTCGGCGCGTTTTTTATCGT (SEQ ID NO:16526), TTCGGTCGGCGCGTTTTTTATCGTTTT (SEQ ID NO:16527), TTTCGGTCGGCGCGTTTTTTATCGTTT (SEQ ID NO:16528)

Target1744    chr19:46997057-46997083    GGTTTCGGAAGCGGTGGGAGGCG (SEQ ID NO:16529), GTTTCGGAAGCGGTGGGAGGCGC (SEQ ID NO:16530), TTTCGGAAGCGGTGGGAGGCGC (SEQ ID NO:16531), GGTTTCGGAAGCGGTGGGAGGCGC (SEQ ID NO:16532), GTTTCGGAAGCGGTGGGAGGCGCGT (SEQ ID NO:16533), TTTAGGGGTTTGATTTCGGTCGGCGCG (SEQ ID NO:16534), GGGGTTTGATTTCGGTCGGCGCGTTTT (SEQ ID NO:16535), TAGGGGTTTGATTTCGGTCGGCGCGTT (SEQ ID NO:16536),

FIGURE 5 CONTINUED

TTAGGGGTTTGATTTCGGTCGGCGCGT (SEQ ID NO:16537), GGGTTTGATTTCGGTCGGCGCGTTTTT (SEQ ID NO:16538)

Target1745    chr19:46997103-46997110    GGAGTTAGGTTTTTGGGGGTCGTGCGC (SEQ ID NO:16539), CGGAGTTAGGTTTTTGGGGGTCGTGCG (SEQ ID NO:16540), CGGTCGGAGTTAGGTTTTTGGGGGTCG (SEQ ID NO:16541), TCGGTCGGAGTTAGGTTTTTGGGGGTC (SEQ ID NO:16542), TCGGAGTTAGGTTTTTGGGGGTCGTGC (SEQ ID NO:16543), TTAGGAAGTTTCGGGTTAAGAGGGCGC (SEQ ID NO:16544), CGAGGGGTCGGAGGAGGTTTCGGA (SEQ ID NO:16545), TTTAGGAAGTTTCGGGTTAAGAGGGCGC (SEQ ID NO:16546), TAGGAAGTTTCGGGTTAAGAGGGCGC (SEQ ID NO:16547), AGGAAGTTTCGGGTTAAGAGGGCGC (SEQ ID NO:16548)

Target1746    chr19:46997148-46997179    GGAGTTAGGTTTTTGGGGGTCGTGCGC (SEQ ID NO:16549), CGGAGTTAGGTTTTTGGGGGTCGTGCG (SEQ ID NO:16550), CGGTCGGAGTTAGGTTTTTGGGGGTCG (SEQ ID NO:16551), TCGGTCGGAGTTAGGTTTTTGGGGGTCG (SEQ ID NO:16552), TCGGAGTTAGGTTTTTGGGGGTCGTGC (SEQ ID NO:16553), GGGGGAGGTATTGGCGTTTTTGGTCGT (SEQ ID NO:16554), TGGGGGAGGTATTGGCGTTTTTGGTCG (SEQ ID NO:16555), TGGGGGAGGTATTGGCGTTTTTGGTCGT (SEQ ID NO:16556), GGGGGAGGTATTGGCGTTTTTGGTCGTT (SEQ ID NO:16557), TTGGGGGAGGTATTGGCGTTTTTGGTCG (SEQ ID NO:16558)

Target1747    chr19:46997189-46997203    GGAGTTAGGTTTTTGGGGGTCGTGCGC (SEQ ID NO:16559), CGGAGTTAGGTTTTTGGGGGTCGTGCG (SEQ ID NO:16560), CGGTCGGAGTTAGGTTTTTGGGGGTCG (SEQ ID NO:16561), TCGGTCGGAGTTAGGTTTTTGGGGGTCG (SEQ ID NO:16562), TCGGAGTTAGGTTTTTGGGGGTCGTGC (SEQ ID NO:16563), GGGGGAGGTATTGGCGTTTTTGGTCGT (SEQ ID NO:16564), TGGGGGAGGTATTGGCGTTTTTGGTCG (SEQ ID NO:16565), TGGGGGAGGTATTGGCGTTTTTGGTCGT (SEQ ID NO:16566), GGGGGAGGTATTGGCGTTTTTGGTCGTT (SEQ ID NO:16567), TTGGGGGAGGTATTGGCGTTTTTGGTCG (SEQ ID NO:16568)

Target1748    chr19:46997364-46997529    TCGTTTGGGGAGGGAGATTCGGTTGCG (SEQ ID NO:16569), CGTTTGGGGAGGGAGATTCGGTTGCGT (SEQ ID NO:16570), GTTTGGGGAGGGAGATTCGGTTGCGTT (SEQ ID NO:16571), TTCGTTTGGGGAGGGAGATTCGGTTGC (SEQ ID NO:16572), GGGGAGGGAGATTCGGTTGCGTTAAGGT (SEQ ID NO:16573), GGGGATGACGGGGATTTTCGGGAGTGT (SEQ ID NO:16574), CGTGGTTTTTCGGGGGTTGGAGCGAG (SEQ ID NO:16575), AGAAGGTTGGGCGTGGTTTTTTCGGGG (SEQ ID NO:16576), GAAGGTTGGGCGTGGTTTTTTCGGGGG (SEQ ID NO:16577), GTGGTTTTTTCGGGGGTTGGAGCGAGT (SEQ ID NO:16578)

Target1749    chr19:49238331-49238365    ACGTTTTATTTAGAGTATTTGAGGTTAGCGCGTTTC (SEQ ID NO:16579), GGATTACGTTTTATTAGAGTATTTGAGGTTAGCGCG (SEQ ID NO:16580), AAGGTTCGGGGCGCGTTAGTTTTTAAGT (SEQ ID NO:16581), AGAAGGTTCGGGGCGCGTTAGTTTTAA (SEQ ID NO:16582), TTAGAAGGTTCGGGGCGCGTTAGTTTT (SEQ ID NO:16583), TTTAGAAGGTTCGGGGCGCGTTAGTTT (SEQ ID NO:16584), TTTTAGAAGGTTCGGGGCGCGTTAGTT (SEQ ID NO:16585)

Target1750    chr19:49238428-49238459    GTATAGGGTTTTGGGCGTGCGGGGTTG (SEQ ID NO:16586), GATGGGGTATAGGGTTTTGGGCGTGCG (SEQ ID NO:16587), ATGGGGTATAGGGTTTTGGGCGTGCGG (SEQ ID NO:16588), TATAGGGTTTTGGGCGTGCGGGGTTGG (SEQ ID NO:16589), GGTATAGGGTTTTGGGCGTGCGGGGTT (SEQ ID NO:16590)

Target1751    chr19:49238493-49238813    GTATAGGGTTTTGGGCGTGCGGGGTTG (SEQ ID NO:16591), GTAGGAAGTAGGGGCGGTTGTTGGGGG (SEQ ID NO:16592), GAAGTAGGGGCGGTTGTTGGGGGTTTG (SEQ ID NO:16593), GATGGGGTATAGGGTTTTGGGCGTGCG (SEQ ID NO:16594), AGTAGGAAGTAGGGGCGGTTGTTGGGG (SEQ ID NO:16595), CGTCGGGTGGGGTAGCGTTGGTTAGTT (SEQ ID NO:16596), TCGGAGTTTAGTTTTTAGGGGCGGCGG (SEQ ID NO:16597), CGTCGGGTGGGGTAGCGTTGGTTAGT (SEQ ID NO:16598), GTCGGGTGGGGTAGCGTTGGTTAGTTT (SEQ ID NO:16599), CGTCGGGTGGGGTAGCGTTGGTTAGTT (SEQ ID NO:16600)

Target1752    chr19:49842341-49843187    ATCGGAGGGTGGGGGCGGTTTAGTTTT (SEQ ID NO:16601), ACGGTAGGAGGGGCGGGGTTTTTTGAA (SEQ ID NO:16602), TAGCGGTAGTTTGTGGGGTGGTTGGGG (SEQ ID NO:16603), TTTGCGGGAGGGGGAGGGTTGTTAGTG (SEQ ID NO:16604), GTTTGCGGGAGGGGGAGGGTTGTTAGT (SEQ ID NO:16605), AGGTTTTGCGCGTAGTTTTGGGGGGTG (SEQ ID NO:16606), GGTTTTGCGCGTAGTTTTGGGGGGTGT (SEQ ID NO:16607), TATTTTTCGGTGTTGGGTGGAGCGGCG (SEQ ID NO:16608), GAGGTTTTGCGCGTAGTTTTGGGGGGT (SEQ ID NO:16609), TGGAGGTTTTGCGCGTAGTTTTGGGGG (SEQ ID NO:16610)

Target1753    chr19:52839445-52839743    TGGAGGCGTGGTTTAGGGAAGTTTCGT (SEQ ID NO:16611), TTCGGTTCGTTTTTTATGTTGCGCGCG (SEQ ID NO:16612), TGGAGGCGTGGTTTAGGGAAGTTTCGTT (SEQ ID NO:16613), TTGGAGGCGTGGTTTAGGGAAGTTTCGT (SEQ ID NO:16614), GGAGGCGTGGTTTAGGGAAGTTTCGTT (SEQ ID NO:16615), ATTTATACGGGGTGGAGGGAGCGGTGC (SEQ ID NO:16616), AAGCGCGGGGGAGTTGGGAAGTTTAGA (SEQ ID NO:16617), AGAAGCGCGGGGGAGTTGGGAAGTTTA (SEQ ID NO:16618), TAGAAGCGCGGGGGAGTTGGGAAGTTT (SEQ ID NO:16619), GCGCGGGGTAGGACGTTGGGTTAGTAA (SEQ ID NO:16620)

Target1754    chr19:52839823-52839845    CGGGTTTTGTTTTCGTTCGTTTTGTTTTGGG (SEQ ID NO:16621), CGGGTTTTGTTTTCGTTCGTTTTGTTTTGGGT (SEQ ID NO:16622), ACGGGTTTTGTTTTCGTTCGTTTTGTTTTGGG (SEQ ID NO:16623), ACGGGTTTTGTTTTCGTTCGTTTTGTTTTGGGT (SEQ ID NO:16624),

FIGURE 5 CONTINUED

|  |  | ACGGGTTTTGTTTTCGTTCGTTTTGTTTTGG (SEQ ID NO:16625), GGTTGGGAGGTTTTTCGGGCGGGAATT (SEQ ID NO:16626), AGGTTGGGAGGTTTTTCGGGCGGGAAT (SEQ ID NO:16627), TTTTTTCGTCGGGATTGGGGTTGCGGC (SEQ ID NO:16628), GAGGTTGGGAGGTTTTTCGGGCGGGAA (SEQ ID NO:16629), GTCGGGGGCGAGGTTGGGAGGTTTTTC (SEQ ID NO:16630) |
| Target1755 | chr19:52839863-52840013 | CGTAGTTTTAGTTTCGGCGGGGGAGGT (SEQ ID NO:16631), TCGTAGTTTTAGTTTCGGCGGGGGAGGT (SEQ ID NO:16632), TAGTTTTAGTTTCGGCGGGGGAGGTCG (SEQ ID NO:16633), TCGTAGTTTTAGTTTCGGCGGGGGAGG (SEQ ID NO:16634), GTAGTTTTAGTTTCGGCGGGGGAGGTCG (SEQ ID NO:16635), GGTTGCGAAGGGGAGGTTTGGGGAGTA (SEQ ID NO:16636), TTGCGAAGGGGAGGTTTGGGGAGTAGG (SEQ ID NO:16637), GATGGTTGCGAAGGGGAGGTTTGGGGA (SEQ ID NO:16638), ATGGTTGCGAAGGGGAGGTTTGGGGAG (SEQ ID NO:16639), TTTTTTCGTCGGGATTGGGGTTGCGGC (SEQ ID NO:16640) |
| Target1756 | chr19:54800281-54800681 | AGTCGGGCGCGGTGGTTTACGTTTATA (SEQ ID NO:16641), TAGTCGGGCGCGGTGGTTTACGTTTAT (SEQ ID NO:16642), ATAGTCGGGCGCGGTGGTTTACGTTTA (SEQ ID NO:16643), TATAGTCGGGCGCGGTGGTTACGTTT (SEQ ID NO:16644), ATATAGTCGGGCGCGGTGGTTTACGTT (SEQ ID NO:16645), TCGGGGGAGGTTAGCGGGGGTTATAGT (SEQ ID NO:16646), ATGGGAAATTCGGGGGAGGTTAGCGGG (SEQ ID NO:16647), GAAATTCGGGGGAGGTTAGCGGGGGTT (SEQ ID NO:16648), CGGGGGAGGTTAGCGGGGGTTATAGTG (SEQ ID NO:16649), AAATTCGGGGGAGGTTAGCGGGGGTTA (SEQ ID NO:16650) |
| Target1757 | chr19:54858790-54858970 | AGGATTAGGAGGAGGTTGATGTGGTGGT (SEQ ID NO:16651), GAGGATTAGGAGGAGGTTGATGTGGTGGT (SEQ ID NO:16652), AGTTTGGAGTGAGGGTTTGGAGAAGAGG (SEQ ID NO:16653), GTTTGGAGTGAGGGTTTGGAGAAGAGGA (SEQ ID NO:16654), GAGGATTAGGAGGAGGTTGATGTGGTGGT (SEQ ID NO:16655) |
| Target1758 | chr19:55593556-55593969 | AGGTTCGGTTGCGCGGTAATATCGTCG (SEQ ID NO:16656), CGTTGGGGGGATTCGTGGATTCGTTTCG (SEQ ID NO:16657), TCGTTGGGGGGATTCGTGGATTCGTTTCG (SEQ ID NO:16658), TTTACGTTTTAGGTTCGGTTGCGCGGT (SEQ ID NO:16659), GGGTTCGATTTGTAGAAGGTGTGGCGGT (SEQ ID NO:16660), TCGTTGTAGGGGGGGTTCGAGGGGTTTGG (SEQ ID NO:16661), GTTGTAGGGGGGGTTCGAGGGGTTTGGGG (SEQ ID NO:16662), CGTTGTAGGGGGGGTTCGAGGGTTTGGG (SEQ ID NO:16663), GGTTCGAGGGGTTTGGGGCGGGTTTTAT (SEQ ID NO:16664), GGGTTCGAGGGGTTTGGGGCGGGTTTTA (SEQ ID NO:16665) |
| Target1759 | chr19:57587592-57587717 | GGCGTGGAAATTATAGGTTTTTGTTTCGTGGT (SEQ ID NO:16666), AGGCGTGGAAATTATAGGTTTTTGTTTCGTGG (SEQ ID NO:16667), AGGCGTGGAAATTATAGGTTTTTGTTTCGTGGT (SEQ ID NO:16668), GGCGTGGAAATTATAGGTTTTTGTTTCGTGGTA (SEQ ID NO:16669), TAGGCGTGGAAATTATAGGTTTTTGTTTCGTGG (SEQ ID NO:16670), GGTTGTTTGTATTATCGGTGTTGGCGGT (SEQ ID NO:16671), AGGTTGTTTGTATTATCGGTGTTGGCGGT (SEQ ID NO:16672), AGGTTGTTTGTATTATCGGTGTTGGCGG (SEQ ID NO:16673), GGTTGTTTGTATTATCGGTGTTGGCGTT (SEQ ID NO:16674), AGGTTGTTTGTATTATCGGTGTTGGCGGTT (SEQ ID NO:16675) |
| Target1760 | chr19:57587880-57587906 | AGGAATGTGAGGGTTTTTAAATGATCGGGGT (SEQ ID NO:16676), GGAATGTGAGGGTTTTTAAATGATCGGGGTC (SEQ ID NO:16677), GAGGAATGTGAGGGTTTTTAAATGATCGGGG (SEQ ID NO:16678), AGGAATGTGAGGGTTTTTAAATGATCGGGGTC (SEQ ID NO:16679), GAGGAATGTGAGGGTTTTTAAATGATCGGGGT (SEQ ID NO:16680), GTTGGGAGTAGGGTGTGATTGTTGCGT (SEQ ID NO:16681), AGTTGGGAGTAGGGTGTGATTGTTGCGT (SEQ ID NO:16682), AGTTGGGAGTAGGGTGTGATTGTTGCG (SEQ ID NO:16683), TTGGGAGTAGGGTGTGATTGTTGCGTT (SEQ ID NO:16684), GTTGGGAGTAGGGTGTGATTGTTGCGTT (SEQ ID NO:16685) |
| Target1761 | chr20:19667703-19668103 | TGCGGTTGTGTAGGTTTTTGATGGTTGT (SEQ ID NO:16686), AGGTATCGGTTTATTGCGGTTGTGTAGGT (SEQ ID NO:16687), TGCGGTTGTGTAGGTTTTTGATGGTTGTT (SEQ ID NO:16688), TTGCGGTTGTGTAGGTTTTTGATGGTTGT (SEQ ID NO:16689), AGGTATCGGTTTATTGCGGTTGTGTAGGTT (SEQ ID NO:16690), AGGTGAAGGTGGAGGGGTTTTGTGGTT (SEQ ID NO:16691), TAGGTGAAGGTGGAGGGGTTTTGTGGT (SEQ ID NO:16692), GGTGAAGGTGGAGGGGTTTTGTGGTTT (SEQ ID NO:16693), AGGTGAAGGTGGAGGGGTTTTGTGGTTT (SEQ ID NO:16694), AGGTGAAGGTGGAGGGGTTTTGTGGT (SEQ ID NO:16695) |
| Target1762 | chr20:22562559-22562585 | AGGAGGTATTTGCGGTTAGGGGCGAGG (SEQ ID NO:16696), GTATTTGCGGTTAGGGGCGAGGCGTTT (SEQ ID NO:16697), ATTTGCGGTTAGGGGCGAGGCGTTTAG (SEQ ID NO:16698), GGAGGTATTTGCGGTTAGGGGCGAGGC (SEQ ID NO:16699), CGGTTAGGGGCGAGGCGTTTAGGTTCG (SEQ ID NO:16700), TTTTTTATGTTTGGTAGTTTGGTTATGGGTTCGGTT (SEQ ID NO:16701) |
| Target1763 | chr20:22562737-22562786 | GTGGTGGTGGTGGTTGTGGTGGTGTTG (SEQ ID NO:16702), ACGGGTGGTTGAAGGCGTAGTGGTGTT (SEQ ID NO:16703), GGTGGTGGTGGTTGTGGTGGTGTTGTT (SEQ ID NO:16704), ATTTTGTGGGGTTGGTGGTGGTGGTGG (SEQ ID NO:16705), TGGTGGTGGTGGTTGTGGTGGTGTTGT (SEQ ID NO:16706), CGTCGGTTGCGGCGTTGAGTTTTTTAG (SEQ ID NO:16707), AGGTCGCGGTTTATTTGTTGGGTTCGT (SEQ ID NO:16708), CGTCGGTTGCGGCGTTGAGTTTTTTAGA (SEQ ID NO:16709), GGGTTTGGGAGAGTTGAAGGGGACGT (SEQ ID NO:16710), CGGTTGCGGCGTTGAGTTTTTTAGAGTCG (SEQ ID NO:16711) |

FIGURE 5 CONTINUED

Target1764    chr20:22562824-22562858    AGGTGGGTTTTAGGCGGTAGGTTCGGG (SEQ ID NO:16712), TTTTAGGCGGTAGGTTCGGGTGGTGGG (SEQ ID NO:16713), TGGGTTTTAGGCGGTAGGTTCGGGTGG (SEQ ID NO:16714), GGGTTTTAGGCGGTAGGTTCGGGTGGT (SEQ ID NO:16715), GGTGGGTTTTAGGCGGTAGGTTCGGGT (SEQ ID NO:16716), AGCGAGGGGGTTTGGGAGAGTTGAAGG (SEQ ID NO:16717), GGGGTTTGGGAGAGTTGAAGGGGACGT (SEQ ID NO:16718), CGAGGGGGTTTGGGAGAGTTGAAGGGG (SEQ ID NO:16719), GGGGGTTTGGGAGAGTTGAAGGGGACG (SEQ ID NO:16720), AGGGGGTTTGGGAGAGTTGAAGGGGAC (SEQ ID NO:16721)

Target1765    chr20:22562884-22563031    AGGTGGGTTTTAGGCGGTAGGTTCGGG (SEQ ID NO:16722), TTTGGTACGGGGGAGGCGTTCGAGTGAG (SEQ ID NO:16723), TTTTAGGCGGTAGGTTCGGGTGGTGGG (SEQ ID NO:16724), TGGGTTTTAGGCGGTAGGTTCGGGTGG (SEQ ID NO:16725), GGGTTTTAGGCGGTAGGTTCGGGTGGT (SEQ ID NO:16726), AGCGAGGGGGTTTGGGAGAGTTGAAGG (SEQ ID NO:16727), TTTAATTCGGGGAGGTCGTCGGGTCGG (SEQ ID NO:16728), GGGGTTTGGGAGAGTTGAAGGGGACGT (SEQ ID NO:16729), CGAGGGGGTTTGGGAGAGTTGAAGGGG (SEQ ID NO:16730), GGGGGTTTGGGAGAGTTGAAGGGGACG (SEQ ID NO:16731)

Target1766    chr20:25062056-25062103    GTTTGGCGTTGGGGGGGAAAAATGGTTT (SEQ ID NO:16732), GGTGGTGGCGGTTTTATATCGTTGAGGG (SEQ ID NO:16733), AGGTGGTGGCGGTTTTATATCGTTGAGGG (SEQ ID NO:16734), GGTGGTGGCGGTTTTATATCGTTGAGGGA (SEQ ID NO:16735), TGGTGGCGGTTTTATATCGTTGAGGGA (SEQ ID NO:16736), TAGGCGGGGAGTTTAGAGCGAGGTTC (SEQ ID NO:16737), TTAGGCGGGGAGTTTAGAGCGAGGTTT (SEQ ID NO:16738), TTTAGGCGGGGAGTTTAGAGCGAGGTT (SEQ ID NO:16739), ATTTAGGCGGGGAGTTTAGAGCGAGGT (SEQ ID NO:16740), AGGCGGGGAGTTTAGAGCGAGGTTTC (SEQ ID NO:16741)

Target1767    chr20:25062153-25062196    AGGATGTAGTAAGGGGTAGGCGGCGTA (SEQ ID NO:16742), TAGGATGTAGTAAGGGGTAGGCGGCGT (SEQ ID NO:16743), GGATGTAGTAAGGGGTAGGCGGCGTAGT (SEQ ID NO:16744), GGATGTAGTAAGGGGTAGGCGGCGTAG (SEQ ID NO:16745), AGGATGTAGTAAGGGGTAGGCGGCGT (SEQ ID NO:16746), TAGGCGGGGAGTTTAGAGCGAGGTTC (SEQ ID NO:16747), TTAGGCGGGGAGTTTAGAGCGAGGTTT (SEQ ID NO:16748), TTTAGGCGGGGAGTTTAGAGCGAGGTT (SEQ ID NO:16749), ATTTAGGCGGGGAGTTTAGAGCGAGGT (SEQ ID NO:16750), AGGCGGGGAGTTTAGAGCGAGGTTTC (SEQ ID NO:16751)

Target1768    chr20:25062210-25062257    GATTTGGGTCGTTGGGGTTAGGGGTGC (SEQ ID NO:16752), ATTTGGGTCGTTGGGGTTAGGGGTGCG (SEQ ID NO:16753), GCGGTGGGGCGATGGTTTGTGATTTTT (SEQ ID NO:16754), AGATTTGGGTCGTTGGGGTTAGGGGTGC (SEQ ID NO:16755), GGTGGGGCGATGGTTTGTGATTTTTGCG (SEQ ID NO:16756), CGTTTTTGTTTTTGTTTTTTAGGTTTTGAGTCGCG (SEQ ID NO:16757), CGTTTTTGTTTTTGTTTTTTAGGTTTTGAGTCGCGT (SEQ ID NO:16758), TCGTTTTTGTTTTTGTTTTTTAGGTTTTGAGTCGCG (SEQ ID NO:16759), TTTTGTTTTTGTTTTTTAGGTTTTGAGTCGCTAGG (SEQ ID NO:16760)

Target1769    chr20:25062287-25062356    GCGCGGGTTTGATTATCGGACGTGGAG (SEQ ID NO:16761), AGCGCGGGTTTGATTATCGGACGTGGA (SEQ ID NO:16762), AAGCGCGGGTTTGATTATCGGACGTGG (SEQ ID NO:16763), GATTTGGGTCGTTGGGGTTAGGGGTGC (SEQ ID NO:16764), CGTTGTCGTTGCGTTTTGGCGGTCGA (SEQ ID NO:16765), CGGCGGTCGTTCGAGTATTTTGTTTGT (SEQ ID NO:16766), CGGCGGTCGTTCGAGTATTTTGTTTGTT (SEQ ID NO:16767), CGTGTCGTTTTTGTCGTTTAGGGGTTTCG (SEQ ID NO:16768), CGGCGGTCGTTCGAGTATTTTGTTTGTTT (SEQ ID NO:16769), CGTGTCGTTTTTGTCGTTTAGGGGTTTCGA (SEQ ID NO:16770)

Target1770    chr20:25062362-25062385    GCGCGGGTTTGATTATCGGACGTGGAG (SEQ ID NO:16771), AGCGCGGGTTTGATTATCGGACGTGGA (SEQ ID NO:16772), AAGCGCGGGTTTGATTATCGGACGTGG (SEQ ID NO:16773), CGTTGTCGTTGCGTTTTGGCGGTCGA (SEQ ID NO:16774), CGTTGTCGTTGCGTTTTGGCGGTCG (SEQ ID NO:16775), CGGCGGTCGTTCGAGTATTTTGTTTGT (SEQ ID NO:16776), CGGCGGTCGTTCGAGTATTTTGTTTGTT (SEQ ID NO:16777), CGTGTCGTTTTTGTCGTTTAGGGGTTTCG (SEQ ID NO:16778), CGGCGGTCGTTCGAGTATTTTGTTTGTTT (SEQ ID NO:16779), CGTGTCGTTTTTGTCGTTTAGGGGTTTCGA (SEQ ID NO:16780)

Target1771    chr20:25062403-25062422    GTTCGGGGTTTTTGGGCGGTAGGAACG (SEQ ID NO:16781), GCGCGGGTTTGATTATCGGACGTGGAG (SEQ ID NO:16782), GGTTCGGGGTTTTTGGGCGGTAGGAAC (SEQ ID NO:16783), AGCGCGGGTTTGATTATCGGACGTGGA (SEQ ID NO:16784), AAGCGCGGGTTTGATTATCGGACGTGG (SEQ ID NO:16785), ACGGTTTTAGTTTGGCGCGTGGGGTTT (SEQ ID NO:16786), TTGACGGTTTTAGTTTGGCGCGTGGGG (SEQ ID NO:16787), GACGGTTTTAGTTTGGCGCGTGGGGTT (SEQ ID NO:16788), TTTGGCGCGTGGGGTTTTATCGTTGGG (SEQ ID NO:16789), GTTTGGCGCGTGGGGTTTTATCGTTGG (SEQ ID NO:16790)

Target1772    chr20:25062443-25062464    GTTCGGGGTTTTTGGGCGGTAGGAACG (SEQ ID NO:16791), GGTTCGGGGTTTTTGGGCGGTAGGAAC (SEQ ID NO:16792), CGGGGTTTTTGGGCGGTAGGAACGGTA (SEQ ID NO:16793), GGGGTTTTTGGGCGGTAGGAACGGTAC (SEQ ID NO:16794), GGGTTCGGGGTTTTTGGGCGGTAGGAA (SEQ ID NO:16795), ACGGTTTTAGTTTGGCGCGTGGGGTTT (SEQ ID NO:16796), TTGACGGTTTTAGTTTGGCGCGTGGGG (SEQ ID NO:16797), GACGGTTTTAGTTTGGCGCGTGGGGTT (SEQ ID NO:16798), TTTGGCGCGTGGGGTTTTATCGTTGGG (SEQ ID NO:16799), GTTTGGCGCGTGGGGTTTTATCGTTGG (SEQ ID NO:16800)

Target1773    chr20:25062496-25062512    GTTCGGGGTTTTTGGGCGGTAGGAACG (SEQ ID NO:16801), GGTTCGGGGTTTTTGGGCGGTAGGAAC (SEQ ID NO:16802), CGGGGTTTTTGGGCGGTAGGAACGGTA (SEQ ID NO:16803), GGGGTTTTTGGGCGGTAGGAACGGTAC (SEQ ID NO:16804), GGGTTCGGGGTTTTTGGGCGGTAGGAA

FIGURE 5 CONTINUED

|  |  | {SEQ ID NO:16805}, ACGGTTTTAGTTTGGCGCGTGGGGTTT {SEQ ID NO:16806}, TTTGACGGTTTTAGTTTGGCGCGTGGGG {SEQ ID NO:16807}, GACGGTTTTAGTTTGGCGCGTGGGGTT {SEQ ID NO:16808}, GGGGTTTGACGGTTTTAGTTTGGCGCG {SEQ ID NO:16809}, CGGGGGTTTGACGGTTTTAGTTTGGCGC {SEQ ID NO:16810} |
| Target1774 | chr20:33759725-33759855 | AATGAAGGGCGGGGTAGAGGGAGGGTA {SEQ ID NO:16811}, TAATGAAGGGCGGGGTAGAGGGAGGGT {SEQ ID NO:16812}, GAGGGAGGGTAGGAGGGAGGTCGGTTT {SEQ ID NO:16813}, AGGGGAGGGTAGGAGGGGAGGTCGGTTTT {SEQ ID NO:16814}, ATGAAGGGCGGGGTAGAGGGAGGGTAG {SEQ ID NO:16815}, GTTTGGGAGGGGCGGAGTTTGGGTAGA {SEQ ID NO:16816}, TTTTTGGTTCGGGTCGGTTGCGGGTTT {SEQ ID NO:16817}, TTTTTGGTTCGGGTCGGTTGCGGGTTTC {SEQ ID NO:16818}, GGGCGGAGTTTGGGTAGAGGAGGATGG {SEQ ID NO:16819}, GGGGCGGAGTTTGGGTAGAGGAGGATG {SEQ ID NO:16820} |
| Target1775 | chr20:39597880-39597893 | GGAAGAGGGTTAGGCGTGGTTGTGTGT {SEQ ID NO:16821}, AGGGTTAGGCGTGGTTGTGTGTTTCGA {SEQ ID NO:16822}, AGGAAGAGGGTTAGGCGTGGTTGTGTGT {SEQ ID NO:16823}, AGGAAGAGGGTTAGGCGTGGTTGTGTG {SEQ ID NO:16824}, TGAGGAAGAGGGTTAGGCGTGGTTGTGT {SEQ ID NO:16825} |
| Target1776 | chr20:39597926-39597993 | GGAAGAGGGTTAGGCGTGGTTGTGTGT {SEQ ID NO:16826}, AGGGTTAGGCGTGGTTGTGTGTTTCGA {SEQ ID NO:16827}, AGGAAGAGGGTTAGGCGTGGTTGTGTGT {SEQ ID NO:16828}, AGGAAGAGGGTTAGGCGTGGTTGTGTG {SEQ ID NO:16829}, TGAGGAAGAGGGTTAGGCGTGGTTGTGT {SEQ ID NO:16830} |
| Target1777 | chr20:48626370-48626406 | GCGTAGGTTGGTTGCGATGTTTGTTTTTT {SEQ ID NO:16831}, GCGTAGGTTGGTTGCGATGTTTGTTTTTTG {SEQ ID NO:16832}, GCGTAGGTTGGTTGCGATGTTTGTTTTTTGT {SEQ ID NO:16833}, AGGTCGATTAGGAGGGTGTTATGGGTTTTG {SEQ ID NO:16834}, GGTTCGATTAGGAGGGTGTTATGGGTTTTGA {SEQ ID NO:16835}, GGCGTTCGGGTTGCGAGGGGTTTTC {SEQ ID NO:16836}, GTTTGGAGGGGCGTTCGGGTTGCGAG {SEQ ID NO:16837}, GGGCGTTCGGGTTGCGAGGGGTTTTC {SEQ ID NO:16838}, GTTTGGAGGGGCGTTCGGGTTGCGAGG {SEQ ID NO:16839}, GGTTTGGAGGGGCGTTCGGGTTGCGAG {SEQ ID NO:16840} |
| Target1778 | chr20:48626473-48626498 | GCGTAGGTTGGTTGCGATGTTTGTTTTTT {SEQ ID NO:16841}, GCGTAGGTTGGTTGCGATGTTTGTTTTTTG {SEQ ID NO:16842}, GCGTAGGTTGGTTGCGATGTTTGTTTTTTGT {SEQ ID NO:16843}, TGAATTTGGAGTTTTGGAGGTTGCGTTTGT {SEQ ID NO:16844}, TGAATTTGGAGTTTTGGAGGTTGCGTTTGTC {SEQ ID NO:16845}, GGGTTAGTTTGGCGACGCGTTGTTTGC {SEQ ID NO:16846}, CGTAGGGTTAGTTTGGCGACGCGTTGT {SEQ ID NO:16847}, ACGTAGGGTTAGTTTGGCGACGCGTTG {SEQ ID NO:16848}, AGGGTTAGTTTGGCGACGCGTTGTTTGC {SEQ ID NO:16849}, CGTAGGGTTAGTTTGGCGACGCGTTGTT {SEQ ID NO:16850} |
| Target1779 | chr20:48626514-48626622 | GAAAAATTCGGAGGTGGAAGGCGAGGCG {SEQ ID NO:16851}, GCGTGGAAAAATTCGGAGGTGGAAGGCG {SEQ ID NO:16852}, GGAAAAATTCGGAGGTGGAAGGCGAGGC {SEQ ID NO:16853}, TGCGTGGAAAAATTCGGAGGTGGAAGGC {SEQ ID NO:16854}, CGTGGAAAAATTCGGAGGTGGAAGGCGA {SEQ ID NO:16855}, GCGGGGGGTGGTCGTCGTTTTTAGTTCG {SEQ ID NO:16856}, CGCGGGGGGTGGTCGTCGTTTTTAGTTC {SEQ ID NO:16857}, GGGTTAGTTTGGCGACGCGTTGTTTGC {SEQ ID NO:16858}, CGGGGGGTGGTCGTCGTTTTTAGTTCGG {SEQ ID NO:16859}, CGTAGGGTTAGTTTGGCGACGCGTTGT {SEQ ID NO:16860} |
| Target1780 | chr20:48626638-48626648 | GAAAAATTCGGAGGTGGAAGGCGAGGCG {SEQ ID NO:16861}, GCGTGGAAAAATTCGGAGGTGGAAGGCG {SEQ ID NO:16862}, GGAAAAATTCGGAGGTGGAAGGCGAGGC {SEQ ID NO:16863}, TGCGTGGAAAAATTCGGAGGTGGAAGGC {SEQ ID NO:16864}, GTTTTATTGAGGGGGGTCGGTAGCGGCG {SEQ ID NO:16865}, GCGGGGGGTGGTCGTCGTTTTTAGTTCG {SEQ ID NO:16866}, CGCGGGGGGTGGTCGTCGTTTTTAGTTC {SEQ ID NO:16867}, CGGGGGGTGGTCGTCGTTTTTAGTTCGG {SEQ ID NO:16868}, AATGCGCGGGGGGTGGTCGTCGTTTTTA {SEQ ID NO:16869}, GGGGGTGGTCGTCGTTTTTAGTTCGGT {SEQ ID NO:16870} |
| Target1781 | chr20:48626653-48626682 | GAAAAATTCGGAGGTGGAAGGCGAGGCG {SEQ ID NO:16871}, GCGTGGAAAAATTCGGAGGTGGAAGGCG {SEQ ID NO:16872}, GGAAAAATTCGGAGGTGGAAGGCGAGGC {SEQ ID NO:16873}, TGCGTGGAAAAATTCGGAGGTGGAAGGC {SEQ ID NO:16874}, TTTTATTGAGGGGGGTCGGTAGCGGCGG {SEQ ID NO:16875}, GCGGGGGGTGGTCGTCGTTTTTAGTTCG {SEQ ID NO:16876}, CGCGGGGGGTGGTCGTCGTTTTTAGTTC {SEQ ID NO:16877}, CGGGGGGTGGTCGTCGTTTTTAGTTCGG {SEQ ID NO:16878}, AATGCGCGGGGGGTGGTCGTCGTTTTTA {SEQ ID NO:16879}, GGGGGTGGTCGTCGTTTTTAGTTCGGT {SEQ ID NO:16880} |
| Target1782 | chr20:48626757-48626767 | GTCGGGTTGGGGGCGGCGATTATTTTC {SEQ ID NO:16881}, AGTCGGGTTGGGGGCGGCGATTATTTT {SEQ ID NO:16882}, GAGTCGGGTTGGGGGCGGCGATTATTT {SEQ ID NO:16883}, GTCGGGTTGGGGGCGGCGATTATTTTT {SEQ ID NO:16884}, TCGGGTTGGGGGCGGCGATTATTTTC {SEQ ID NO:16885}, GGGGACGGTGAGGGCGTTTTTTGTTTT {SEQ ID NO:16886}, GGGGACGGTGAGGGCGTTTTTTGTTTTT {SEQ ID NO:16887}, GGGGACGGTGAGGGCGTTTTTTGTTT {SEQ ID NO:16888}, TTTTTTATTTGTCGGTCGGGGCGCGT {SEQ ID NO:16889}, GGGACGGTGAGGGCGTTTTTTGTTTTT {SEQ ID NO:16890} |

FIGURE 5 CONTINUED

| | | |
|---|---|---|
| Target1783 | chr20:55202029-55202049 | GGGGACGTTGGAGGGAGGTTGTTTTGG (SEQ ID NO:16891), GGGGACGTTGGAGGGAGGTTGTTTTGGA (SEQ ID NO:16892), GGGACGTTGGAGGGAGGTTGTTTTGGA (SEQ ID NO:16893), GGGGACGTTGGAGGGGAGGTTGTTTTGGAT (SEQ ID NO:16894), GGGACGTTGGAGGGAGGTTGTTTTGGAT (SEQ ID NO:16895), TTTTGGGTCGGTATTTAGGTACGCGCG (SEQ ID NO:16896), TTTTTGGGTCGGTATTTAGGTACGCGCG (SEQ ID NO:16897), GGTTTTTGGGTCGGTATTTAGGTACGCGCG (SEQ ID NO:16898), CGGTTTTTGGGTCGGTATTTAGGTACGCGC (SEQ ID NO:16899), TTTGGGTCGGTATTTAGGTACGCGCG (SEQ ID NO:16900) |
| Target1784 | chr20:55202128-55202302 | CGCGCGTGTTTGGGTGTCGGTTTAGAA (SEQ ID NO:16901), GAGGGTAGCGTCGGGGTTTAGGGAAGT (SEQ ID NO:16902), AGAGGGTAGCGTCGGGGTTTAGGGAAG (SEQ ID NO:16903), AGGGTAGCGTCGGGGTTTAGGGAAGTT (SEQ ID NO:16904), TTTTCGTATAGAGGGCGCGGAGGTTGC (SEQ ID NO:16905), GGAGTCGATGGGTATTGAGGGGTTCGCGT (SEQ ID NO:16906), GGAGTCGATGGGTATTGAGGGTTCGCG (SEQ ID NO:16907), GGGGAGTCGATGGGTATTGAGGGTTCGCG (SEQ ID NO:16908), GGGGAGTCGATGGGTATTGAGGGTTCGC (SEQ ID NO:16909), AGGGGAGTCGATGGGTATTGAGGGTTCGC (SEQ ID NO:16910) |
| Target1785 | chr20:55202320-55202359 | GGTACGGTGTTGCGCGAGTTTTTAGTGT (SEQ ID NO:16911), GGTACGGTGTTGCGCGAGTTTTTAGTG (SEQ ID NO:16912), ACGGTGTTGCGCGAGTTTTTAGTGTTT (SEQ ID NO:16913), GTACGGTGTTGCGCGAGTTTTTAGTGT (SEQ ID NO:16914), ACGTTTTTAGGCGGGGAGGTATATCGGT (SEQ ID NO:16915), TGGGGTTCGGAATGGGTAAGAAGGTGT (SEQ ID NO:16916), ACGTTGGGGTTCGGAATGGGTAAGAAGGT (SEQ ID NO:16917), CGTTGGGGTTCGGAATGGGTAAGAAGGT (SEQ ID NO:16918), ACGTTGGGGTTCGGAATGGGTAAGAAGG (SEQ ID NO:16919), CGTTGGGGTTCGGAATGGGTAAGAAGG (SEQ ID NO:16920) |
| Target1786 | chr20:55964847-55964886 | TAGTAGGGGAGGGGTTTTAGGTAGGCG (SEQ ID NO:16921), AGTAGGGGAGGGGTTTTAGGTAGGCG (SEQ ID NO:16922), ATAGTAGGGGAGGGGTTTTAGGTAGGCG (SEQ ID NO:16923), AATAGTAGGGGAGGGGTTTTAGGTAGGCG (SEQ ID NO:16924), TCGTAGCGTTTAAATAGTAGGGGAGGGGT (SEQ ID NO:16925), TCGGTTTTGTGTGTTCGTTTGTTTGGAGT (SEQ ID NO:16926), TCGGTTTTGTGTGTTCGTTTGTTTGGAGTT (SEQ ID NO:16927), TTCGGTTTTGTGTGTTCGTTTGTTTGGAGT (SEQ ID NO:16928), CGGTTTTGTGTGTTCGTTTGTTTGGAGTT (SEQ ID NO:16929) |
| Target1787 | chr20:55964964-55964999 | GCGAAGGAAGGAGAGGAAATTACGCGGG (SEQ ID NO:16930), AGTAGGGGAGGGGTTTTAGGTAGGCGA (SEQ ID NO:16931), ATAGGGTCGGGGAGGTGGGAAATTTCG (SEQ ID NO:16932), GCGAAGGAAGGAGAGGAAATTACGCGGGA (SEQ ID NO:16933), GCGAAGGAAGGAGAGGAAATTACGCGG (SEQ ID NO:16934), AGTTTTTTGTATAGTGGGGATGGGATTTTCGAGT (SEQ ID NO:16935), AGTTTTTTGTATAGTGGGGATGGGATTTTCGAGTT (SEQ ID NO:16936), TAGTTTTTTGTATAGTGGGGATGGGATTTTCGAGT (SEQ ID NO:16937), GTTTTTTGTATAGTGGGGATGGGATTTTCGAGTT (SEQ ID NO:16938), AGTTTTTTGTATAGTGGGGATGGGATTTTCGAGTTT (SEQ ID NO:16939) |
| Target1788 | chr20:55965199-55965345 | GTGGGGGAGGGGGCGGGTAGATTTTTT (SEQ ID NO:16940), TGAGAGGAGGTCGTAGGGTTGGGGTCG (SEQ ID NO:16941), GTTGAGAGGAGGTCGTAGGGTTGGGGT (SEQ ID NO:16942), TGTTGAGAGGAGGTCGTAGGGTTGGGG (SEQ ID NO:16943), TGTTGAGAGGAGGTCGTAGGGTTGGGGT (SEQ ID NO:16944), CGTAGGTGGGGTTTGTGGGGATTGGGA (SEQ ID NO:16945), ACGTAGGTGGGGTTTGTGGGGATTGGG (SEQ ID NO:16946), AGGTGGGGTTTGTGGGGATTGGGAGTG (SEQ ID NO:16947), GTGGGGTTTGTGGGGATTGGGAGTGGT (SEQ ID NO:16948), GCGACGTAGGTGGGGTTTGTGGGGATT (SEQ ID NO:16949) |
| Target1789 | chr20:55965436-55965498 | GGGTTGGAGATGAGGCGGGTTTGAGGT (SEQ ID NO:16950), TGAGAGGAGGTCGTAGGGTTGGGGTCG (SEQ ID NO:16951), GTCGTAGGGTTGGGGTCGGGAGTGATT (SEQ ID NO:16952), GGGGTTGGAGATGAGGCGGGTTTGAGG (SEQ ID NO:16953), GGGGGTTGGAGATGAGGCGGGTTTGAG (SEQ ID NO:16954), AGATTTCGGGATTTCGGATTTGCGGGT (SEQ ID NO:16955), GATTTCGGGATTTCGGATTTGCGGGT (SEQ ID NO:16956), AGATTTCGGGATTTCGGATTTGCGGGTT (SEQ ID NO:16957), TAGATTTCGGGATTTCGGATTTGCGGGT (SEQ ID NO:16958), GATTTCGGGATTTCGGATTTGCGGGT (SEQ ID NO:16959) |
| Target1790 | chr20:57638469-57638543 | TTGAGGTTGTGTATATGATTTTGGTAGTGTCGGA (SEQ ID NO:16960), TGAGGTTGTGTATATGATTTTGGTAGTGTCGGATT (SEQ ID NO:16961), TTGAGGTTGTGTATATGATTTTGGTAGTGTCGGAT (SEQ ID NO:16962), ATTGAGGTTGTGTATATGATTTTGGTAGTGTCGGA (SEQ ID NO:16963), AGGTTGTGTATATGATTTTGGTAGTGTCGGATTTGT (SEQ ID NO:16964) |
| Target1791 | chr20:61200973-61201023 | TCGGTGGTGGGTAGTTTGGTCGGATGG (SEQ ID NO:16965), AGAGTCGGTGGTGGGTAGTTTGGTCGG (SEQ ID NO:16966), GAGTCGGTGGTGGGTAGTTTGGTCGGA (SEQ ID NO:16967), AGTCGGTGGTGGGTAGTTTGGTCGGAT (SEQ ID NO:16968), GGTGGTGGGTAGTTTGGTCGGATGGC (SEQ ID NO:16969), GCGGGGTGGGGGGAGTTTTTTCGTTTT (SEQ ID NO:16970), TAGCGGGGTGGGGGGAGTTTTTTCGTT (SEQ ID NO:16971), GGTAGTAGTAGCGGGGTGGGGGGAGTT (SEQ ID NO:16972), AGTAGCGGGGTGGGGGGAGTTTTTTCG (SEQ ID NO:16973), GTAGCGGGGTGGGGGGAGTTTTTTCGT (SEQ ID NO:16974) |

FIGURE 5 CONTINUED

Target1792    chr20:61201058-61201077    TCGGTGGTGGGTAGTTTGGTCGGATGG (SEQ ID NO:16975), TGGGTAGTTTGGTCGGATGGCGGTGAT (SEQ ID NO:16976), GTGGGTAGTTTGGTCGGATGGCGGTGA (SEQ ID NO:16977), AGAGTCGGTGGTGGGTAGTTTGGTCGG (SEQ ID NO:16978), GAGTCGGTGGTGGGTAGTTTGGTCGGA (SEQ ID NO:16979), GGGGGACGCGGGGGGGTAGTAGTAGT (SEQ ID NO:16980), GGGGGACGCGGGGGGGTAGTAGTAG (SEQ ID NO:16981), GGGGACGCGGGGGGGTAGTAGTAGT (SEQ ID NO:16982), GGGGGACGCGGGGGGGTAGTAGTA (SEQ ID NO:16983), GGGGGACGCGGGGGGGTAGTAGT (SEQ ID NO:16984)

Target1793    chr20:61201085-61201167    CGGGAGGCGGATGGGTCGTGATAGTTT (SEQ ID NO:16985), TCGGTGGTGGGTAGTTTGGTCGGATGG (SEQ ID NO:16986), TGGGTAGTTTGGTCGGATGGCGGTGAT (SEQ ID NO:16987), GTGGGTAGTTTGGTCGGATGGCGGTGA (SEQ ID NO:16988), AGAGTCGGTGGTGGGTAGTTTGGTCGG (SEQ ID NO:16989), CGGTAGGAGGTGTTTTTGATCGCGTGGT (SEQ ID NO:16990), CGGTAGGAGGTGTTTTTGATCGCGTGG (SEQ ID NO:16991), GGTAGGAGGTGTTTTTGATCGCGTGGT (SEQ ID NO:16992), TGATCGCGTGGTTGTTGGAAAGGAGT (SEQ ID NO:16993), CGGTAGGAGGTGTTTTTGATCGCGTGGTT (SEQ ID NO:16994)

Target1794    chr20:61201174-61201292    CGGGAGGCGGATGGGTCGTGATAGTTT (SEQ ID NO:16995), GGCGTTGGGAGAGGTTTTGAGTTCGGG (SEQ ID NO:16996), GCGTTGGGAGAGGTTTTGAGTTCGGGT (SEQ ID NO:16997), TGGCGTTGGGAGAGGTTTTGAGTTCGG (SEQ ID NO:16998), CGGGAGGCGGATGGGTCGTGATAGTT (SEQ ID NO:16999), GGGTTGGGTAGGTGTTGCGGTAGGAGG (SEQ ID NO:17000), GGTTGGGTAGGTGTTGCGGTAGGAGGT (SEQ ID NO:17001), AGGGTTGGGTAGGTGTTGCGGTAGGAG (SEQ ID NO:17002), AGAGGGTTGGGTAGGTGTTGCGGTAGG (SEQ ID NO:17003), GAGGGTTGGGTAGGTGTTGCGGTAGGA (SEQ ID NO:17004)

Target1795    chr20:62690139-62690172    TAGTAGCGAGTGTGGGGGTGCGAGGTA (SEQ ID NO:17005), GCGAGTGTGGGGGTGCGAGGTAGTTTT (SEQ ID NO:17006), TAGCGAGTGTGGGGGTGCGAGGTAGTT (SEQ ID NO:17007), TAGTAGTAGCGAGTGTGGGGGTGCGAG (SEQ ID NO:17008), AGTAGCGAGTGTGGGGGTGCGAGGTAG (SEQ ID NO:17009), TGGTTAGTTGGGTTCGTGGTTGATTCGGT (SEQ ID NO:17010), GGTTAGTTGGGTTCGTGGTTGATTCGGT (SEQ ID NO:17011), TGGTTAGTTGGGTTCGTGGTTGATTCGG (SEQ ID NO:17012), GGTTAGTTGGGTTCGTGGTTGATTCGG (SEQ ID NO:17013), TTGGTTAGTTGGGTTCGTGGTTGATTCGG (SEQ ID NO:17014)

Target1796    chr21:36041376-36041404    GCGGGTCGGGTATTTTTAAAGGCGTAGG (SEQ ID NO:17015), AGCGGGTCGGGTATTTTTAAAGGCGTA (SEQ ID NO:17016), TAGCGGGTCGGGTATTTTTAAAGGCGT (SEQ ID NO:17017), AGCGGGTCGGGTATTTTTAAAGGCGTAGG (SEQ ID NO:17018), GCGGGTCGGGTATTTTTAAAGGCGTAGGA (SEQ ID NO:17019), GCGTAGGATTCGTAGGGTAAATTTCGTTTGG (SEQ ID NO:17020), GCGTAGGATTCGTAGGGTAAATTTCGTTTGGT (SEQ ID NO:17021), GCGTAGGATTCGTAGGGTAAATTTCGTTTGTT (SEQ ID NO:17022), GCGTAGGATTCGTAGGGTAAATTTCGTTTGGTTT (SEQ ID NO:17023), GCGTAGGATTCGTAGGGTAAATTTCGTTTGGTTTT (SEQ ID NO:17024)

Target1797    chr21:36041417-36041426    GCGGGTCGGGTATTTTTAAAGGCGTAGG (SEQ ID NO:17025), AGCGGGTCGGGTATTTTTAAAGGCGTA (SEQ ID NO:17026), TAGCGGGTCGGGTATTTTTAAAGGCGT (SEQ ID NO:17027), AGCGGGTCGGGTATTTTTAAAGGCGTAGG (SEQ ID NO:17028), GCGGGTCGGGTATTTTTAAAGGCGTAGGA (SEQ ID NO:17029), AGTCGGGGTATTGGGGTTTTGCGTAGG (SEQ ID NO:17030), GTCGGGGTATTGGGGTTTTGCGTAGGA (SEQ ID NO:17031), AGTCGGGGTATTGGGGTTTTGCGTAGGA (SEQ ID NO:17032), TCGGGGTATTGGGGTTTTGCGTAGGAT (SEQ ID NO:17033), TGGGGTTTTGCGTAGGATTCGTAGGGT (SEQ ID NO:17034)

Target1798    chr21:36041518-36041546    GGGCGTAGAGGTTTGGGGTTAAGCGGA (SEQ ID NO:17035), AGGGGCGTAGAGGTTTGGGGTTAAGCG (SEQ ID NO:17036), GGGTAGAAGGGGCGTAGAGGTTTGGGG (SEQ ID NO:17037), GGTAGAAGGGGCGTAGAGGTTTGGGGT (SEQ ID NO:17038), TGGGTAGAAGGGGCGTAGAGGTTTGGG (SEQ ID NO:17039), TTAAGGGTCGGTGGCGTTGGGTAAGGG (SEQ ID NO:17040), CGTTGTTTAAGGGTCGGTGGCGTTGGG (SEQ ID NO:17041), ACGTTGTTTAAGGGTCGGTGGCGTTGG (SEQ ID NO:17042), GTTGTTTAAGGGTCGGTGGCGTTGGGT (SEQ ID NO:17043), TGACGTTGTTTAAGGGTCGGTGGCGTT (SEQ ID NO:17044)

Target1799    chr21:36041605-36041627    GGGCGTAGAGGTTTGGGGTTAAGCGGA (SEQ ID NO:17045), GGCGTAGAGGTTTGGGGTTAAGCGGAG (SEQ ID NO:17046), GGCGTAGAGGTTTGGGGTTAAGCGGAGT (SEQ ID NO:17047), GCGTAGAGGTTTGGGGTTAAGCGGAGT (SEQ ID NO:17048), GGGCGTAGAGGTTTGGGGTTAAGCGGAG (SEQ ID NO:17049), TTTTCGGCGGTTTTTGGGGATTCGGGG (SEQ ID NO:17050), CGGGGATTTTCGGCGGTTTTTGGGGAT (SEQ ID NO:17051), TTAAGGGTCGGTGGCGTTGGGTAAGGG (SEQ ID NO:17052), CGTTGTTTAAGGGTCGGTGGCGTTGGG (SEQ ID NO:17053), ACGTTGTTTAAGGGTCGGTGGCGTTGG (SEQ ID NO:17054)

Target1800    chr21:36041632-36041810    TAGGGGTCGTCGGAGGTTTTCGCGTTT (SEQ ID NO:17055), TTAGGGGTCGTCGGAGGTTTTCGCGTT (SEQ ID NO:17056), TTTAGGGGTCGTCGGAGGTTTTCGCGT (SEQ ID NO:17057), GGAGTCGGAGGGGGTTGTTTCGGGTTT (SEQ ID NO:17058), TCGGGTTTTTAGGGGTCGTCGGAGGTT (SEQ ID NO:17059), TCGGCGGTTTTTGGGGATTCGGGGTAA (SEQ ID NO:17060), CGGGTTTTTTAGTTAGAGGCGCGGGGA (SEQ ID NO:17061), TCGGGTTTTTTAGTTAGAGGCGCGGGG (SEQ ID NO:17062), CGGGGATTTTCGGCGGTTTTTGGGGA (SEQ ID NO:17063), TCGGGTTTTTTAGTTAGAGGCGCGGGGA (SEQ ID NO:17064)

FIGURE 5 CONTINUED

Target1801   chr21:36041819-36041924   TAGGGGTCGTCGGAGGTTTTCGCGTTT (SEQ ID NO:17065), TTAGGGGTCGTCGGAGGTTTTCGCGTT (SEQ ID NO:17066), TTTAGGGGTCGTCGGAGGTTTTCGCGT (SEQ ID NO:17067), TAGGAGGCGGCGGGTTAGATAGGGGTT (SEQ ID NO:17068), AGGAGGTAGGAGGCGGCGGGTTAGATA (SEQ ID NO:17069), TTTTTGGGGTATTTCGGTATTTTTCGGGGTTT (SEQ ID NO:17070), TTTTTTGGGGTATTTCGGTATTTTTCGGGGTTT (SEQ ID NO:17071), TTTTTTGGGGTATTTCGGTATTTTTCGGGGTTT (SEQ ID NO:17072)

Target1802   chr21:38068859-38068902   TTGGAGGGGGAGTTTCGGGTTTTCGGA (SEQ ID NO:17073), GTTGGAGGGGGAGTTTCGGGTTTTCGG (SEQ ID NO:17074), GTTGGAGGGGGAGTTTCGGGTTTTCGGA (SEQ ID NO:17075), TGTTGGAGGGGGAGTTTCGGGTTTTCGG (SEQ ID NO:17076), TGGAGGGGGAGTTTCGGGTTTTCGGA (SEQ ID NO:17077)

Target1803   chr21:38068930-38069012   CGTAGTTGTGGTTTTGGGGTTTTTGATGGT (SEQ ID NO:17078), CGTAGTTGTGGTTTTGGGGTTTTTGATGGTA (SEQ ID NO:17079), CGTAGTTGTGGTTTTGGGGTTTTTGATGGTAT (SEQ ID NO:17080), TTGTGGTTTTGGGGTTTTTGATGGTATTACGT (SEQ ID NO:17081), GTTGTGGTTTTGGGGTTTTTGATGGTATTACGT (SEQ ID NO:17082)

Target1804   chr21:38069018-38069046   CGTAGTTGTGGTTTTGGGGTTTTTGATGGT (SEQ ID NO:17083), CGTAGTTGTGGTTTTGGGGTTTTTGATGGTA (SEQ ID NO:17084), CGTAGTTGTGGTTTTGGGGTTTTTGATGGTAT (SEQ ID NO:17085), TTGTGGTTTTGGGGTTTTTGATGGTATTACGT (SEQ ID NO:17086), GTTGTGGTTTTGGGGTTTTTGATGGTATTACGT (SEQ ID NO:17087)

Target1805   chr21:38069497-38070022   CGTAGTTAGGAGCGGGATTTTGGGCGC (SEQ ID NO:17088), GCGTAGTTAGGAGCGGGATTTTGGGCG (SEQ ID NO:17089), CGCGGAGGTGGGTTCGATTCGTTAGGT (SEQ ID NO:17090), GGTAGGGGGAGAGTTCGGGTTTGCGTA (SEQ ID NO:17091), GGAAGTTGCGGTAGGGGTTGGGTTCGT (SEQ ID NO:17092), AGTAGAGGGTTATGGGTTAGCGGCGCG (SEQ ID NO:17093), GGTTATGGGTTAGCGGCGCGGGTTTTT (SEQ ID NO:17094), TGGGTTAGCGGCGCGGGTTTTTAATGT (SEQ ID NO:17095), GTAGAGGGTTATGGGTTAGCGGCGCGG (SEQ ID NO:17096), GGTTATGGGTTAGCGGCGCGGGTTTT (SEQ ID NO:17097)

Target1806   chr21:38076700-38077017   GAAAGGGGAGTTTCGGGCGGTTGTGGG (SEQ ID NO:17098), TCGGAGTTAGTAGTTGTTGGGGCGGCG (SEQ ID NO:17099), CGCGGGGGTTAGAGGAGGGGATTTGGAT (SEQ ID NO:17100), TAGCGCGGGGTTAGAGGAGGGGATTTG (SEQ ID NO:17101), CGGAGTTAGTAGTTGTTGGGGCGGCGT (SEQ ID NO:17102), CGATGGGGAGGGGTAGGGAAGGAGGTT (SEQ ID NO:17103), GTCGATGGGGAGGGGTAGGGAAGGAGG (SEQ ID NO:17104), GGTCGATGGGGAGGGGTAGGGAAGGAG (SEQ ID NO:17105), TCGATGGGGAGGGGTAGGGAAGGAGG (SEQ ID NO:17106), TCGATGGGGAGGGGTAGGGAAGGAGGT (SEQ ID NO:17107)

Target1807   chr21:38077042-38077158   TCGGAGTTAGTAGTTGTTGGGGCGGCG (SEQ ID NO:17108), CGGAGTTAGTAGTTGTTGGGGCGGCGT (SEQ ID NO:17109), GGAGTTAGTAGTTGTTGGGGCGGCGTT (SEQ ID NO:17110), GGAGTTTCGGGCGGTTGTGGGTGTC (SEQ ID NO:17111), GAGTTTCGGGCGGTTGTGGGTGTCG (SEQ ID NO:17112), AATTGGGGATCGGGTGAGAAGGGGGTG (SEQ ID NO:17113), CGATGGGGAGGGGTAGGGAAGGAGGTT (SEQ ID NO:17114), AAATTGGGGATCGGGTGAGAAGGGGGT (SEQ ID NO:17115), GTCGATGGGGAGGGGTAGGGAAGGAGG (SEQ ID NO:17116), GGTCGATGGGGAGGGGTAGGGAAGGAG (SEQ ID NO:17117)

Target1808   chr21:38119951-38120471   GATTCGGTTTTTCGGGGTTGCGCGCGTT (SEQ ID NO:17118), GTCGTGCGTAGGTTCGGCGAGGATATC (SEQ ID NO:17119), CGCGTTGGGTTCGGTTAAAGTCGTTCG (SEQ ID NO:17120), CGCGTTGGGTTCGGTTAAAGTCGTTCGT (SEQ ID NO:17121), ATTCGGTTTTTCGGGGTTGCGGCGTT (SEQ ID NO:17122), GGGAGGTCGGGTTTAGGTTTTTGGCGC (SEQ ID NO:17123), CGAGGCGTTTAGGTAGTGCGGTAGGGG (SEQ ID NO:17124), CGGGAGGTCGGGTTTAGGTTTTTGGCG (SEQ ID NO:17125), GAGGTCGGGTTTAGGTTTTTGGCGCGG (SEQ ID NO:17126), GGAGGTCGGGTTTAGGTTTTTGGCGCG (SEQ ID NO:17127)

Target1809   chr21:38120515-38120542   TCGGTTTTTCGGGGTTGCGGCGTTATC (SEQ ID NO:17128), TTCGGTTTTTCGGGGTTGCGGCGTTAT (SEQ ID NO:17129), ATTCGGTTTTTCGGGGTTGCGGCGTTA (SEQ ID NO:17130), TTGGATTCGGTTTTTCGGGGTTGCGGC (SEQ ID NO:17131), GATTCGGTTTTTCGGGGTTGCGGCGTT (SEQ ID NO:17132), GGTTTTCGTAGGATAGAGGCGGGCGGT (SEQ ID NO:17133), CGGTTTTCGTAGGATAGAGGCGGGCGG (SEQ ID NO:17134), GGTTTTCGTAGGATAGAGGCGGGCGGTT (SEQ ID NO:17135), AGAGGCGGGCGGTTATTTGTTCGGATT (SEQ ID NO:17136), GTTTTCGTAGGATAGAGGCGGGCGGTT (SEQ ID NO:17137)

Target1810   chr21:38120552-38120571   GGTTTTCGTAGGATAGAGGCGGGCGGT (SEQ ID NO:17138), CGGTTTTCGTAGGATAGAGGCGGGCGG (SEQ ID NO:17139), GGTTTTCGTAGGATAGAGGCGGGCGGTT (SEQ ID NO:17140), AGAGGCGGGCGGTTATTTGTTCGGATT (SEQ ID NO:17141), GTTTTCGTAGGATAGAGGCGGGCGGTT (SEQ ID NO:17142)

Target1811   chr21:38120577-38120588   GGTTTTCGTAGGATAGAGGCGGGCGGT (SEQ ID NO:17143), CGGTTTTCGTAGGATAGAGGCGGGCGG (SEQ ID NO:17144), GGTTTTCGTAGGATAGAGGCGGGCGGTT (SEQ ID NO:17145), AGAGGCGGGCGGTTATTTGTTCGGATT (SEQ ID NO:17146), GTTTTCGTAGGATAGAGGCGGGCGGTT (SEQ ID NO:17147)

Target1812   chr21:45604990-45605084   AGCGAAGTTACGGGGTTGGGTTAGGTT (SEQ ID NO:17148), TAGCGAAGTTACGGGGTTGGGTTAGGT (SEQ ID NO:17149), GCGAAGTTACGGGGTTGGGTTAGGTTT (SEQ ID NO:17150), AGCGAAGTTACGGGGTTGGGTTAGGTTT (SEQ ID NO:17151), GTTGTTTGGGGGTATTGGGGTGGAAGT

FIGURE 5 CONTINUED

|  |  |  |
|---|---|---|
|  |  | {SEQ ID NO:17152}, GGGTAGGGGTTGGAAGTTTGGGTAGGGG {SEQ ID NO:17153}, TGGGTAGGGGTTAGGATGAAGTGGGGT {SEQ ID NO:17154}, GGTAGGGGTTGGAAGTTTGGGTAGGGGT {SEQ ID NO:17155}, TGGGTAGGGGTTGGAAGTTTGGGTAGGG {SEQ ID NO:17156}, GGGGTAGTTGTGGGTAGGGGTTGGAAGT {SEQ ID NO:17157} |
| Target1813 | chr21:46372625-46372666 | GGGTGTTCGTGTTATGTGTTTCGGGCG {SEQ ID NO:17158}, GGGTGTTCGTGTTATGTGTTTCGGGCGT {SEQ ID NO:17159}, TGGGTGTTCGTGTTATGTGTTTCGGGCG {SEQ ID NO:17160}, GGTGTTCGTGTTATGTGTTTCGGGC {SEQ ID NO:17161}, TGGGTGTTCGTGTTATGTGTTTCGGGC {SEQ ID NO:17162}, CGTTTTTTAGGTAGGGGGGCGTTCGGA {SEQ ID NO:17163}, TCGTTTTTTAGGTAGGGGGGCGTTCGG {SEQ ID NO:17164}, TCGTTTTTTAGGTAGGGGGGCGTTCGGA {SEQ ID NO:17165}, CGTCGTTTTTTAGGTAGGGGGGCGTTCG {SEQ ID NO:17166}, GTCGTTTTTTAGGTAGGGGGGCGTTCGG {SEQ ID NO:17167} |
| Target1814 | chr22:17082736-17083133 | GCGGCGGCGGGAGTTTTTTAAGAGGAG {SEQ ID NO:17168}, CGGCGGCGGGAGTTTTTTAAGAGGAGG {SEQ ID NO:17169}, GGCGGCGGGAGTTTTTTAAGAGGAGGA {SEQ ID NO:17170}, GCGGCGGCGGGAGTTTTTTAAGAGGA {SEQ ID NO:17171}, CGGCGGCGGGAGTTTTTTAAGAGGAGGA {SEQ ID NO:17172}, GGGGTGGTGGTTGCGGTTGTTTTACGT {SEQ ID NO:17173}, GGGGGGTGGTGGTTGCGGTTGTTTTAC {SEQ ID NO:17174}, GTTCGGTGGTAGTTTCGGTTCGGCGTC {SEQ ID NO:17175}, CGGGGTTTTAGGTTTTTCGGGGGGGTGG {SEQ ID NO:17176}, CGGGGTCGGGGTTTTAGGTTTTTCGGG {SEQ ID NO:17177} |
| Target1815 | chr22:17083251-17083588 | CGTGGGCGTTCGGGAAATTCGGAGTTG {SEQ ID NO:17178}, TCGGGTCGGAGTTGTTATCGGGCGTTC {SEQ ID NO:17179}, GTGGGCGTTCGGGAAATTCGGAGTTGT {SEQ ID NO:17180}, GGGTCGGAGTTGTTATCGGGCGTTCGT {SEQ ID NO:17181}, GTCGGGTCGGAGTTGTTATCGGGCGTT {SEQ ID NO:17182}, CGGAGTTCGTTCGGGGATTATTTGCGC {SEQ ID NO:17183}, CGGTTCGGCGGTTCGTTCGGAGTTC {SEQ ID NO:17184}, ACGGTTCGGCGGTTCGTTCGGAGTTC {SEQ ID NO:17185}, ACGGTTCGGCGGTTCGTTCGGAGTT {SEQ ID NO:17186}, CGGTTCGGCGGTTCGTTCGGAGTT {SEQ ID NO:17187} |
| Target1816 | chr22:19753253-19753377 | GAGGTCGGGTGGTTTAGGTTGTAGGGT {SEQ ID NO:17188}, CGTAGAGGAGGGGTAGACGTGGATTGGT {SEQ ID NO:17189}, CGTAGAGGAGGGGTAGACGTGGATTGG {SEQ ID NO:17190}, TCGTAGAGGAGGGGTAGACGTGGATTGGT {SEQ ID NO:17191}, TCGTAGAGGAGGGGTAGACGTGGATTGG {SEQ ID NO:17192}, TGCGTGATTTGTAGGGAGGTGGGTGTG {SEQ ID NO:17193}, TGCGTGATTTGTAGGGAGGTGGGTGTGA {SEQ ID NO:17194}, GCGTGATTTGTAGGGAGGTGGGTGTGA {SEQ ID NO:17195}, TTGCGTGATTTGTAGGGAGGTGGGTGT {SEQ ID NO:17196}, AGTTGCGTGATTTGTAGGGAGGTGGG {SEQ ID NO:17197} |
| Target1817 | chr22:19753383-19753518 | CGTAGGTTTCGGAATTATCGGTTCGGCG {SEQ ID NO:17198}, CGTAGGTTTCGGAATTATCGGTTCGGCGT {SEQ ID NO:17199}, TCGTAGGTTTCGGAATTATCGGTTCGGCG {SEQ ID NO:17200}, TCGTAGGTTTCGGAATTATCGGTTCGGCGT {SEQ ID NO:17201}, AGGTTTCGGAATTATCGGTTCGGCGTA {SEQ ID NO:17202}, TGTCGTTGGGTTGCGTCGGGGAAGTTA {SEQ ID NO:17203}, TTTTTCGTGTCGTTGGGTTGCGTCGGG {SEQ ID NO:17204}, GTCGTTGGGTTGCGTCGGGGAAGTTAC {SEQ ID NO:17205}, AAAGTTTGGAGCGTTTCGGGGGCGTAG {SEQ ID NO:17206}, GAAAGTTTGGAGCGTTTCGGGGGCGTA {SEQ ID NO:17207} |
| Target1818 | chr22:19754574-19754610 | TTCGATCGGGCGTTTTGGTATTGGCGG {SEQ ID NO:17208}, CGTTTTGGTATTGGCGGGCGGGGATTT {SEQ ID NO:17209}, TTTCGATCGGGCGTTTTGGTATTGGCGG {SEQ ID NO:17210}, CGTTTTGGTATTGGCGGGCGGGGATT {SEQ ID NO:17211}, CGTTTTGGTATTGGCGGGCGGGGATTTT {SEQ ID NO:17212} |
| Target1819 | chr22:19754646-19754757 | TCGAGGGTTAAGGGGGTTTTCGTTCGT {SEQ ID NO:17213}, CGTTAGTGTTAAAGCGTTCGGTCGGAGGC {SEQ ID NO:17214}, TTAGTGTTAAAGCGTTCGGTCGGAGGC {SEQ ID NO:17215}, CGAGGGTTAAGGGGGTTTTCGTTCGTT {SEQ ID NO:17216}, TTCGAGGGTTAAGGGGGTTTTCGTTCG {SEQ ID NO:17217}, TTCGATCGGGCGTTTTGGTATTGGCGG {SEQ ID NO:17218}, CGTTTGTAGGCGGGGTTTTCGGGTTGT {SEQ ID NO:17219}, TCGTTTGTAGGCGGGGTTTTCGGGTTG {SEQ ID NO:17220}, TTTCGATCGGGCGTTTTGGTATTGGCGG {SEQ ID NO:17221}, ATCGTTTGTAGGCGGGGTTTTCGGGTT {SEQ ID NO:17222} |
| Target1820 | chr22:19754775-19754845 | TTAGTGTTAAAGCGTTCGGTCGGAGGC {SEQ ID NO:17223}, GTTAGTGTTAAAGCGTTCGGTCGGAGGC {SEQ ID NO:17224}, GCGGTTCGGTCGGTAGTTGTAGTGTAG {SEQ ID NO:17225}, GCGGTTCGGTCGGTAGTTGTAGTGTAGA {SEQ ID NO:17226}, GGTCGGAGGCGGAAGGAAGTGATATTT {SEQ ID NO:17227}, GGATTGGGGTTGGGGAGGTTTTGAGGG {SEQ ID NO:17228}, GGGATTGGGGTTGGGGAGGTTTTGAGG {SEQ ID NO:17229}, AGGGATTGGGGTTGGGGAGGTTTTGAGG {SEQ ID NO:17230}, GGATTGGGGTTGGGGAGGTTTTGAGGGT {SEQ ID NO:17231}, GATTGGGGTTGGGGAGGTTTTGAGGGT {SEQ ID NO:17232} |
| Target1821 | chr22:19754860-19754896 | GAGAGTTTCGTTTGTAGGCGGTGTAGATATATGT {SEQ ID NO:17233}, GAGAGTTTCGTTTGTAGGCGGTGTAGATATATGTAG {SEQ ID NO:17234}, CGGTAGGGATTGGGGTTGGGGAGGTTT {SEQ ID NO:17235}, TCGGTAGGGATTGGGGTTGGGGAGGTT {SEQ ID NO:17236}, AGTCGGTAGGGATTGGGGTTGGGGAGG {SEQ ID NO:17237}, GGATTGGGGTTGGGGAGGTTTTGAGGG {SEQ ID NO:17238}, GGGATTGGGGTTGGGGAGGTTTTGAGG {SEQ ID NO:17239} |
| Target1822 | chr22:19754970-19754999 | GCGTTGGGAATTTTCGGGATAGCGAGT {SEQ ID NO:17240}, GCGTTGGGAATTTTCGGGATAGCGAGTT {SEQ ID NO:17241}, GCGTTGGGAATTTTCGGGATAGCGAGTTC {SEQ ID NO:17242}, GCGTTGGGAATTTTCGGGATAGCGAG {SEQ ID NO:17243}, CGTTGGGAATTTTCGGGATAGCGAGTTC |

FIGURE 5 CONTINUED

|  |  |  |
|---|---|---|
|  |  | (SEQ ID NO:17244), ACGGTGGGAAGGTGGGGGGAGTGTATA (SEQ ID NO:17245), CGGAGAGGGGAGGGGTAGTGGGAGTTT (SEQ ID NO:17246), GGTAGAGGGTAGGAGGCGTGGCGGATA (SEQ ID NO:17247), TTATGGGGCGGGTAGAGGGTAGGAGGC (SEQ ID NO:17248), CGGTGGGAAGGTGGGGGGAGTGTATAG (SEQ ID NO:17249) |
| Target1823 | chr22:20267833-20267867 | TGGTATTTTGTTGGACGGAGAGAGGAGGT (SEQ ID NO:17250), GGTATTTTGTTGGACGGAGAGAGGAGGT (SEQ ID NO:17251), TGGTATTTTGTTGGACGGAGAGAGGAGG (SEQ ID NO:17252), TTGGTATTTTGTTGGACGGAGAGAGGAGGT (SEQ ID NO:17253), TTGGTATTTTGTTGGACGGAGAGAGGAGG (SEQ ID NO:17254), GGCGGGGGGTAGTCGGGATGGTTGTTT (SEQ ID NO:17255), GGGCGGGGGGTAGTCGGGATGGTTGTTT (SEQ ID NO:17256), GGCGGGGGGTAGTCGGGATGGTTGTT (SEQ ID NO:17257), CGTCGGTTCGGTTTTTTGTGTTTACGCG (SEQ ID NO:17258), GGGCGGGGGGTAGTCGGGATGGTTGTT (SEQ ID NO:17259) |
| Target1824 | chr22:20267909-20267971 | CGCGTGGGTATAAAGGGTCGGGTCGG (SEQ ID NO:17260), GCGTGGGTATAAAGGGTCGGGTCGGC (SEQ ID NO:17261), CGTTTCGGTTCGTTAGGAGAGGAGGGA (SEQ ID NO:17262), TCGTTTCGGTTCGTTAGGAGAGGAGGG (SEQ ID NO:17263), TCGTTTCGGTTCGTTAGGAGAGGAGGGA (SEQ ID NO:17264), CGTCGGTTCGGTTTTTTGTGTTTACGCG (SEQ ID NO:17265), CGTCGGTTCGGTTTTTTGTGTTTACGCGT (SEQ ID NO:17266), TCGTCGGTTCGGTTTTTTGTGTTTACGCG (SEQ ID NO:17267), TCGGTTCGGTTTTTTGTGTTTACGCGT (SEQ ID NO:17268), TCGTCGGTTCGGTTTTTTGTGTTTACGCGT (SEQ ID NO:17269) |
| Target1825 | chr22:20792505-20792517 | GGACGGGAAGGCGGATCGGGGATAC (SEQ ID NO:17270), GGGACGGGAAGGCGGATCGGGGATAC (SEQ ID NO:17271), GGACGGGAAGGCGGATCGGGGATA (SEQ ID NO:17272), GGGACGGGAAGGCGGATCGGGGATA (SEQ ID NO:17273), GCGTTATTGCGTAGGTTAGGTTCGGG (SEQ ID NO:17274), GCGGTGGGGTGTTGTGGAGTTGGTTTT (SEQ ID NO:17275), ATTTCGCGGTGGGGTGTTGTGGAGTTG (SEQ ID NO:17276), GATTTCGCGGTGGGGTGTTGTGGAGTT (SEQ ID NO:17277), AAGGATTTCGCGGTGGGGTGTTGTGGA (SEQ ID NO:17278), AGGATTTCGCGGTGGGGTGTTGTGGAG (SEQ ID NO:17279) |
| Target1826 | chr22:20792557-20792586 | CGGAATCGGTTAAGGGAGTGGGGTTCGT (SEQ ID NO:17280), CGGAATCGGTTAAGGGAGTGGGGTTCG (SEQ ID NO:17281), GGAATCGGTTAAGGGAGTGGGGTTCGT (SEQ ID NO:17282), GGACGGGAAGGCGGATCGGGGATAC (SEQ ID NO:17283), CGGAATCGGTTAAGGGAGTGGGGTTCGTA (SEQ ID NO:17284), GCGGTGGGGTGTTGTGGAGTTGGTTTT (SEQ ID NO:17285), ATTTCGCGGTGGGGTGTTGTGGAGTTG (SEQ ID NO:17286), GATTTCGCGGTGGGGTGTTGTGGAGTT (SEQ ID NO:17287), AAGGATTTCGCGGTGGGGTGTTGTGGA (SEQ ID NO:17288), AGGATTTCGCGGTGGGGTGTTGTGGAG (SEQ ID NO:17289) |
| Target1827 | chr22:20792611-20792651 | CGGAATCGGTTAAGGGAGTGGGGTTCGT (SEQ ID NO:17290), CGGAATCGGTTAAGGGAGTGGGGTTCG (SEQ ID NO:17291), GGAATCGGTTAAGGGAGTGGGGTTCGT (SEQ ID NO:17292), AGTTTTTGTAGTGTTGGGGTGTGCGGT (SEQ ID NO:17293), CGGAATCGGTTAAGGGAGTGGGGTTCGTA (SEQ ID NO:17294), TTGCGAGTTTTGAGTGCGTAGGAGTGC (SEQ ID NO:17295), CGTAGGAGTGCGTAGGGGGAGTTGATT (SEQ ID NO:17296), TTTGCGAGTTTTGAGTGCGTAGGAGTGC (SEQ ID NO:17297), TGCGAGTTTTGAGTGCGTAGGAGTGC (SEQ ID NO:17298), CGTAGGAGTGCGTAGGGGGAGTTGAT (SEQ ID NO:17299) |
| Target1828 | chr22:22006370-22006414 | AGCGTTGCGTTTATTGGTCGGCGTTGG (SEQ ID NO:17300), TCGTTGATAGTCGGAGGGGTCGGGTTT (SEQ ID NO:17301), TTCGTTGATAGTCGGAGGGGTCGGGTT (SEQ ID NO:17302), TAGCGTTGCGTTTATTGGTCGGCGTTGG (SEQ ID NO:17303), ATTCGTTGATAGTCGGAGGGGTCGGGT (SEQ ID NO:17304) |
| Target1829 | chr22:22006416-22006433 | TCGTTGATAGTCGGAGGGGTCGGGTTT (SEQ ID NO:17305), TTCGTTGATAGTCGGAGGGGTCGGGTT (SEQ ID NO:17306), ATTCGTTGATAGTCGGAGGGGTCGGGT (SEQ ID NO:17307), CGTTGATAGTCGGAGGGGTCGGGTTTT (SEQ ID NO:17308), TCGTTGATAGTCGGAGGGGTCGGGTTTT (SEQ ID NO:17309) |
| Target1830 | chr22:22006558-22006586 | GTTTGGACGGGGATTCGGGGGTAGACG (SEQ ID NO:17310), AAAGATGGAGTCGGTAGGCGAGGGGTC (SEQ ID NO:17311), AAGATGGAGTCGGTAGGCGAGGGGTCG (SEQ ID NO:17312), GCGGGTTAAAGATGGAGTCGGTAGGCG (SEQ ID NO:17313), TTTGGACGGGGATTCGGGGGTAGACG (SEQ ID NO:17314), TCGTTTAGGGTTCGGTTAGGACGCGGA (SEQ ID NO:17315), CGTTTAGGGTTCGGTTAGGACGCGGAG (SEQ ID NO:17316), GTTTAGGGTTCGGTTAGGACGCGGAGG (SEQ ID NO:17317), TCGTTTAGGGTTCGGTTAGGACGCGGAG (SEQ ID NO:17318), TTCGTTTAGGGTTCGGTTAGGACGCGG (SEQ ID NO:17319) |
| Target1831 | chr22:22006620-22006679 | GGGATTTTGGGTTGGGTTGGGCGGTTT (SEQ ID NO:17320), TGATCGGGTTTTTGGGCGGAAGGGATGT (SEQ ID NO:17321), TGGGTTGGGTTGGGCGGTTTTATTCGG (SEQ ID NO:17322), TCGGGTTTTTGGGCGGAAGGGATGTTTG (SEQ ID NO:17323), GTTTGGACGGGGATTCGGGGGTAGACG (SEQ ID NO:17324), AAAGAGGGTTTTCGGGATTTCGGTCGC (SEQ ID NO:17325), CGGTCGCGTTTTTTCGTTTGATTCGTCG (SEQ ID NO:17326), CGGTCGCGTTTTTTCGTTTGATTCGTCGA (SEQ ID NO:17327), TCGGTCGCGTTTTTTCGTTTGATTCGTCG (SEQ ID NO:17328), TCGGTCGCGTTTTTTCGTTTGATTCGT (SEQ ID NO:17329) |
| Target1832 | chr22:26446381-26446571 | TGGTGTTGGGTGGAGGGTTGTTAGGGA (SEQ ID NO:17330), TTGGTGTTGGGTGGAGGGTTGTTAGGG (SEQ ID NO:17331), TGGTGTTGGGTGGAGGGTTGTTAGGGAA (SEQ ID NO:17332), TTGGTGTTGGGTGGAGGGTTGTTAGGGA (SEQ ID NO:17333), GGTGTTGGGTGGAGGGTTGTTAGGGAA (SEQ ID NO:17334) |

FIGURE 5 CONTINUED

| | | |
|---|---|---|
| Target1833 | chr22:26716017-26716542 | AGGGTTAAGTGTCGTGGGGTTTGGGGA (SEQ ID NO:17335), GGGTTAAGTGTCGTGGGGTTTGGGGAGT (SEQ ID NO:17336), GGGTTAAGTGTCGTGGGGTTTGGGGAG (SEQ ID NO:17337), AGGGTTAAGTGTCGTGGGGTTTGGGGAG (SEQ ID NO:17338), AAGTGTCGTGGGGTTTGGGGAGTTTGT (SEQ ID NO:17339), TGGTTTTTCGGGGGCGGGGTTGTATTT (SEQ ID NO:17340), TCGGGGGCGGGGTTGTATTTGTTTTGT (SEQ ID NO:17341), ATGGTTTTTCGGGGGCGGGGTTGTATT (SEQ ID NO:17342), AATATGGTTTTTCGGGGGCGGGGTTGT (SEQ ID NO:17343), GGTTTTTCGGGGGCGGGGTTGTATTTGT (SEQ ID NO:17344) |
| Target1834 | chr22:28195692-28196145 | AGGAGGCGGTTCGGTTAGGGTTTTGGT (SEQ ID NO:17345), GTGGAAGGAGGCGGTTCGGTTAGGGTT (SEQ ID NO:17346), AGTTCGGGGAGGTTTTTCGGTCGTTGCG (SEQ ID NO:17347), TGGAAGGAGGCGGTTCGGTTAGGGTTT (SEQ ID NO:17348), GTTCGGGGAGGTTTTTCGGTCGTTGCGG (SEQ ID NO:17349), CGGGTCGTTAGGTTTTTGGGGGCGTTT (SEQ ID NO:17350), GTTTTTGGGGGCGTTTTTTCGGGCGTT (SEQ ID NO:17351), GTAGCGGGTCGTTAGGTTTTTGGGGGC (SEQ ID NO:17352), GGGGCGTTTTTTCGGGCGTTTCGGTTA (SEQ ID NO:17353), TTTTGGGGGCGTTTTTTCGGGCGTTTC (SEQ ID NO:17354) |
| Target1835 | chr22:30662647-30662734 | CGTGGGTAGATTTAGTAGGCGGGTTTTGGC (SEQ ID NO:17355), TGGGTAGATTTAGTAGGCGGGTTTTGGC (SEQ ID NO:17356), TCGTGGGTAGATTTAGTAGGCGGGTTTTGGC (SEQ ID NO:17357), GTGGGTAGATTTAGTAGGCGGGTTTTGGC (SEQ ID NO:17358), CGTGGGTAGATTTAGTAGGCGGGTTTTGG (SEQ ID NO:17359), GGGTGTCGGTGGGGAGTAGAGGTATTT (SEQ ID NO:17360), GGGTGTCGGTGGGGAGTAGAGGTATTTT (SEQ ID NO:17361), GTCGAGAGGTGTTATTTTTAGCGGGCG (SEQ ID NO:17362), AGTCGAGAGGTGTTATTTTTAGCGGGCG (SEQ ID NO:17363), GGGTGTCGGTGGGGAGTAGAGGTATT (SEQ ID NO:17364) |
| Target1836 | chr22:30662972-30663077 | GGGAGGGGGGGAGGGTAGGTTTTTTGGG (SEQ ID NO:17365), TGGGGAGGGGGGAGGGTAGGTTTTTTG (SEQ ID NO:17366), TGGGGAGGGGGGAGGGTAGGTTTTTTG (SEQ ID NO:17367), GGAGGGGGGGAGGGTAGGTTTTTTGGA (SEQ ID NO:17368), GGATGGGGAGGGGGGAGGGTAGGTTTT (SEQ ID NO:17369), TCGAAGAAAATAGGAGGAGGAGCGGGT (SEQ ID NO:17370), TCGAAGAAAATAGGAGGAGGAGCGGGTA (SEQ ID NO:17371), CGAAGAAAATAGGAGGAGGAGCGGGT (SEQ ID NO:17372), TCGAAGAAAATAGGAGGAGGAGCGGGTAT (SEQ ID NO:17373), TCGAAGAAAATAGGAGGAGGAGCGGGTATA (SEQ ID NO:17374) |
| Target1837 | chr22:46403726-46403769 | AGGTTGAGGTTTGTATTATTTCGGTCGGGA (SEQ ID NO:17375), AGGTTGAGGTTTGTATTATTTCGGTCGGGAG (SEQ ID NO:17376), GGTTGAGGTTTGTATTATTTCGGTCGGGAGA (SEQ ID NO:17377), AGGTTGAGGTTTGTATTATTTCGGTCGGGAGA (SEQ ID NO:17378), TAGGTTGAGGTTTGTATTATTTCGGTCGGGAG (SEQ ID NO:17379), GTTTTTCGGGAAGATGGTTGTCGTGGT (SEQ ID NO:17380), AGTTTTTCGGGAAGATGGTTGTCGTGGT (SEQ ID NO:17381), GTTTTTCGGGAAGATGGTTGTCGTGGTT (SEQ ID NO:17382), AGTTTTTCGGGAAGATGGTTGTCGTGGTT (SEQ ID NO:17383), GGAGGAGGTTATTGGGAAACGTTGTTGGT (SEQ ID NO:17384) |
| Target1838 | chr22:46403792-46404057 | TTTGGGAGTGGGAGTGGGGAGAGTTGC (SEQ ID NO:17385), CGGAGTTTTTGGGAGTGGGAGTGGGGA (SEQ ID NO:17386), GCGTCGGGTAGGTAGGGTAGGGAGGTT (SEQ ID NO:17387), GGAGTGGGAGTGGGGAGAGTTGCGTTA (SEQ ID NO:17388), TGCGGAGTTTTTGGGAGTGGGAGTGGG (SEQ ID NO:17389), TGGTAGTTGGTCGGTTATGGGTCGTGT (SEQ ID NO:17390), TGGTATCGAGGTTGTTAGGAGGGCGTT (SEQ ID NO:17391), TTGGTATCGAGGTTGTTAGGAGGGCGT (SEQ ID NO:17392), TGGTATCGAGGTTGTTAGGAGGGCGTTG (SEQ ID NO:17393), GGTATCGAGGTTGTTAGGAGGGCGTTG (SEQ ID NO:17394) |
| Target1839 | chr22:46404082-46404141 | GTTAGCGTTTCGGGGTGATCGGGTTGG (SEQ ID NO:17395), TTCGGGGGTGATCGGGTTGGGTTGTAGT (SEQ ID NO:17396), TTAGCGTTTCGGGGTGATCGGGTTGGG (SEQ ID NO:17397), TGTTAGCGTTTCGGGGTGATCGGGTTG (SEQ ID NO:17398), CGTTTCGGGGTGATCGGGTTGGGTTGT (SEQ ID NO:17399), TGTTGGGAGGAGGGTTGGTTTGAGGGG (SEQ ID NO:17400), TGAGGTTTGGGATTGCGGGGTTAGGGT (SEQ ID NO:17401), GTTGGGAGGAGGGTTGGTTTGAGGGGA (SEQ ID NO:17402), TGGGAGGAGGGTTGGTTTGAGGGGAAA (SEQ ID NO:17403), TTGGGAGGAGGGTTGGTTTGAGGGGAA (SEQ ID NO:17404) |
| Target1840 | chr22:46849338-46849888 | GTGTTGATCGGAAGCGGGTGAGAGAGT (SEQ ID NO:17405), AGTGTTGATCGGAAGCGGGTGAGAGAGT (SEQ ID NO:17406), AGTGTTGATCGGAAGCGGGTGAGAGAG (SEQ ID NO:17407), AAGTGTTGATCGGAAGCGGGTGAGAGA (SEQ ID NO:17408), TGAAAGTGTTGATCGGAAGCGGGTGAG (SEQ ID NO:17409), TATCGGCGTTGTGGTGGGGGTTTGGTA (SEQ ID NO:17410), GGCGTTGTGGTGGGGGTTTGGTAGTTT (SEQ ID NO:17411), ATTATCGGCGTTGTGGTGGGGGTTTGG (SEQ ID NO:17412), TTATCGGCGTTGTGGTGGGGGTTTGGT (SEQ ID NO:17413), GGTTTGTTAGGGTTGGGTGTGGTGGGG (SEQ ID NO:17414) |
| Target1841 | chr22:46921700-46922017 | TTCGGGTAGTTGGTGTTGAGGTGGGCG (SEQ ID NO:17415), CGGGTAGTTGGTGTTGAGGTGGGCGTT (SEQ ID NO:17416), GGGTAGTTGGTGTTGAGGTGGGCGTTT (SEQ ID NO:17417), TTTCGGGTAGTTGGTGTTGAGGTGGGC (SEQ ID NO:17418), TCGGGTAGTTGGTGTTGAGGTGGGCG (SEQ ID NO:17419), GGTAGGAGGGGCGGTGTTGGTTACGTT (SEQ ID NO:17420), GTAGGAGGCGGACGGGAAAAAGGGGTT (SEQ ID NO:17421), GGAGGGAATGGAGGAGTAGGAGGCGGA (SEQ ID NO:17422), GGAGCGGGTTTATGTTGTTGGGCGTGT (SEQ ID NO:17423), TGGAGCGGGTTTATGTTGTTGGGCGTG (SEQ ID NO:17424) |

FIGURE 5 CONTINUED

| Target1842 | chr22:49578179-49578201 | AGACGAGGTGAATGTTATTTTTGTTTTGGGGTT (SEQ ID NO:17425), ACGAGGTGAATGTTATTTTTGTTTTGGGGTTAGG (SEQ ID NO:17426), CGAGGTGAATGTTATTTTTGTTTTGGGGTTAGGA (SEQ ID NO:17427), ACGAGGTGAATGTTATTTTTGTTTTGGGGTTAGGA (SEQ ID NO:17428), GACGAGGTGAATGTTATTTTTGTTTTGGGGTTAGG (SEQ ID NO:17429), TGGTTTGCGTGGGGTTTGTGAGTTCGT (SEQ ID NO:17430), TGGTTTGCGTGGGGTTTGTGAGTTCGTT (SEQ ID NO:17431), GGTTTGCGTGGGGTTTGTGAGTTCGTT (SEQ ID NO:17432), ATGGTTTGCGTGGGGTTTGTGAGTTCGT (SEQ ID NO:17433), ATGGTTTGCGTGGGGTTTGTGAGTTCG (SEQ ID NO:17434) |
|---|---|---|
| Target1843 | chr22:50987093-50987454 | TTTTGTAGAGGTTCGGGGGTTGGGGGG (SEQ ID NO:17435), GGATTTTTAAGGGGGAGGCGTCGGGGGA (SEQ ID NO:17436), ATTTTTAAGGGGGAGGCGTCGGGGGAGG (SEQ ID NO:17437), GGCGGCGGTTGGATTTGGGTAGTTGTT (SEQ ID NO:17438), TCGGGGGATTTTTAAGGGGGAGGCGTCG (SEQ ID NO:17439), TAGGGTTCGGGAGTTGGGTTTTCGGGG (SEQ ID NO:17440), TCGGTCGGTTCGTAGGTTGAGGATGCG (SEQ ID NO:17441), CGGTTCGTAGGTTGAGGATGCGTTCGC (SEQ ID NO:17442), CGGTCGGTTCGTAGGTTGAGGATGCGT (SEQ ID NO:17443), GTGGCGGGTTTTAGGGTTCGGGAGTTG (SEQ ID NO:17444) |
| Target1844 | chr22:50987623-50987637 | GCGAGGAGTTTTTTGCGGCGGTTTTTG (SEQ ID NO:17445), GCGAGGAGTTTTTTGCGGCGGTTTTTGT (SEQ ID NO:17446), GCGAGGAGTTTTTTGCGGCGGTTTTTGTG (SEQ ID NO:17447), CGAGGAGTTTTTTGCGGCGGTTTTTGT (SEQ ID NO:17448), CGAGGAGTTTTTTGCGGCGGTTTTTGTG (SEQ ID NO:17449), GTTGGAGTAGACGGTTTTGGTATCGGAGT (SEQ ID NO:17450), AGTAGACGGTTTTGGTATCGGAGTTACGG (SEQ ID NO:17451), GTAGACGGTTTTGGTATCGGAGTTACGGA (SEQ ID NO:17452), GGAGTAGACGGTTTTGGTATCGGAGTTACGG (SEQ ID NO:17453), AGTAGACGGTTTTGGTATCGGAGTTACGGA (SEQ ID NO:17454) |
| Target1845 | chr22:51016271-51016307 | TTGTTTACGTTTTGGGAGAAGTATTTGTGCGT (SEQ ID NO:17455), AGGTAGACGTGTTTTAGGGTTTTTCGATTGAGT (SEQ ID NO:17456), TTTGTTTACGTTTTGGGAGAAGTATTTGTGCGT (SEQ ID NO:17457), GGTAGACGTGTTTTAGGGTTTTTCGATTGAGTC (SEQ ID NO:17458), ACGTTTTGGGAGAAGTATTTGTGCGTATTTTGA (SEQ ID NO:17459), GGATGGCGGAAGTTTATTAGGTCGTGGT (SEQ ID NO:17460), AGGATGGCGGAAGTTTATTAGGTCGTGGT (SEQ ID NO:17461), AGGATGGCGGAAGTTTATTAGGTCGTGG (SEQ ID NO:17462), GGATGGCGGAAGTTTATTAGGTCGTGGTT (SEQ ID NO:17463), AGGATGGCGGAAGTTTATTAGGTCGTGGTT (SEQ ID NO:17464) |
| Target1846 | chr22:51016392-51016493 | GGGGTTGGTCGGTATTTAGGACGGGGG (SEQ ID NO:17465), GGGGGTTGGTCGGTATTTAGGACGGGG (SEQ ID NO:17466), ATTTAGGACGGGGGTAGATGGGTGCGC (SEQ ID NO:17467), GGGTTGGTCGGTATTTAGGACGGGGGT (SEQ ID NO:17468), TGGGGGTTGGTCGGTATTTAGGACGGG (SEQ ID NO:17469), ATTCGGAAGGTTGGCGCGAGGATTTGG (SEQ ID NO:17470), TGTTTATTCGGAAGGTTGGCGCGAGGA (SEQ ID NO:17471), TTCGGAAGGTTGGCGCGAGGATTTGG (SEQ ID NO:17472), TGTGTTTATTCGGAAGGTTGGCGCGAGG (SEQ ID NO:17473), GTGTTTATTCGGAAGGTTGGCGCGAGG (SEQ ID NO:17474) |
| Target1847 | chr22:51016494-51016605 | GCGGGCGCGTTTAGGTCGGTTTC (SEQ ID NO:17475), CGGGTGGGTATAGTTATTGTGGTGTAGGGG (SEQ ID NO:17476), CGGGTGGGTATAGTTATTGTGGTGTAGGGGA (SEQ ID NO:17477), TCGGGTGGGTATAGTTATTGTGGTGTAGGGG (SEQ ID NO:17478), CGGGTGGGTATAGTTATTGTGGTGTAGGG (SEQ ID NO:17479), ATTCGGAAGGTTGGCGCGAGGATTTGG (SEQ ID NO:17480), GGTGGGGAAGGGCGGGTTTTCGAATTT (SEQ ID NO:17481), GGGTGGGGAAGGGCGGGTTTTCGAATT (SEQ ID NO:17482), GGTGGGGAAGGGCGGGTTTTCGAATTTT (SEQ ID NO:17483), TGTTTATTCGGAAGGTTGGCGCGAGGA (SEQ ID NO:17484) |
| Target1848 | chr22:51016632-51016682 | AAGGGTAGTTTGGAGTTGGGGGGCGTT (SEQ ID NO:17485), GAAGGGTAGTTTGGAGTTGGGGGGCGT (SEQ ID NO:17486), CGGGTAGGGGAGAGAGGCGTTTTTGGA (SEQ ID NO:17487), ACGGCGAAGGGTAGTTTGGAGTTGGGG (SEQ ID NO:17488), GGCGAAGGGTAGTTTGGAGTTGGGGGG (SEQ ID NO:17489), CGGTTCGCGGGGGTTTGGGTTTTTAGT (SEQ ID NO:17490), GGTGGGGAAGGGCGGGTTTTCGAATTT (SEQ ID NO:17491), GGGTGGGGAAGGGCGGGTTTTCGAATT (SEQ ID NO:17492), CGGTTCGCGGGGGTTTGGGTTTTTAGTT (SEQ ID NO:17493), GGTGGGGAAGGGCGGGTTTTCGAATTTT (SEQ ID NO:17494) |
| Target1849 | chr22:51016703-51016753 | AAGGGTAGTTTGGAGTTGGGGGGCGTT (SEQ ID NO:17495), GAAGGGTAGTTTGGAGTTGGGGGGCGT (SEQ ID NO:17496), CGGGTAGGGGAGAGAGGCGTTTTTGGA (SEQ ID NO:17497), ACGGCGAAGGGTAGTTTGGAGTTGGGG (SEQ ID NO:17498), GGCGAAGGGTAGTTTGGAGTTGGGGGG (SEQ ID NO:17499), TGTGAGTAGGGGTCGGTATAGGGCGGT (SEQ ID NO:17500), CGGTTCGCGGGGGTTTGGGTTTTTAGT (SEQ ID NO:17501), GAGTAGGGGTCGGTATAGGGCGGTTCG (SEQ ID NO:17502), TGTGAGTAGGGGTCGGTATAGGGCGGTT (SEQ ID NO:17503), TTGTGAGTAGGGGTCGGTATAGGGCGGT (SEQ ID NO:17504) |

FIGURE 5 CONTINUED

COMPOSITIONS AND METHODS FOR CANCER AND NEOPLASIA ASSESSMENT

RELATED APPLICATIONS

This application is a U.S. national phase filing of International Patent Application No. PCT/US2019/026395, entitled "COMPOSITIONS AND METHODS FOR CANCER OR NEOPLASIA ASSESSMENT." filed on Apr. 8, 2019, which PCT application claims priority to U.S. provisional patent application No. 62/656,820, filed on Apr. 12, 2018. In some aspects, the present disclosure relates to U.S. provisional application Ser. No. 62/487,422, filed on Apr. 19, 2017 and U.S. provisional application Ser. No. 62/487,423, filed on Apr. 19, 2017. The contents of all of the above-described applications are incorporated by reference in their entireties for all purposes.

SEQUENCE LISTING ON ASCII TEXT

This patent or application file contains a Sequence Listing submitted in computer readable ASCII text format (file name: 4552-2000430_SeqList_ST25.txt, date recorded: Oct. 8, 2020, size: 3,287,136 bytes). The content of the Sequence Listing file is incorporated herein by reference in its entirety.

TECHNICAL FIELD

The present disclosure relates to certain compositions, kits, devices, systems and methods, e.g., compositions, kits, devices, systems and methods for assessing cancer or neoplasia in a subject. In particular aspects, provided herein are compositions, kits, devices, systems and methods for assessing cancer or neoplasia in a subject based on assessing methylation status of selected target polynucleotide sequences, e.g., target genomic DNA sequences, from the subject.

BACKGROUND

Various reagents, kits and methods for assessing cancer or neoplasia in a subject are known. However, there is a need for improved compositions, kits, devices, systems and methods for assessing cancer or neoplasia in a subject, e.g., tests with better sensitivity, specificity and/or providing more information. The present disclosure addresses this and other related needs.

BRIEF SUMMARY

The summary is not intended to be used to limit the scope of the claimed subject matter. Other features, details, utilities, and advantages of the claimed subject matter will be apparent from the detailed description including those aspects disclosed in the accompanying drawings and in the appended claims.

In one aspect, provided herein is a panel of isolated polynucleotides comprising, consisting of, or consisting essentially of at least two isolated polynucleotides, each of said isolated polynucleotides having a polynucleotide sequence of any of Target 1 to Target 1849 listed in Table 1, or a complementary sequence thereof. A kit, device, system or an article of manufacture that comprises any of the above panels is also provided.

In another aspect, a kit, device, system or an article of manufacture that is configured for assessing methylation status of at least two of Target 1 to Target 1849 listed in Table 1 is provided. In some embodiments, the present kit, device, system or an article of manufacture is configured for assessing cancer or neoplasia in a subject.

In still another aspect, provided herein is a method for assessing cancer or neoplasia in a subject, which method comprises: a) providing a sample from a subject containing at least two target polynucleotides of said subject, said at least two target polynucleotides having polynucleotide sequences of at least two of Target 1 to Target 1849 listed in Table 1, or a complementary sequence thereof; b) assessing methylation status of said at least two target polynucleotides; and c) assessing cancer or neoplasia in said subject based on assessment of methylation status of said at least two target polynucleotides. In some embodiments, the present methods are used for diagnosis, prognosis, stratification, risk assessment, or treatment monitoring of cancer or neoplasia in a subject.

BRIEF DESCRIPTION OF THE DRAWINGS

FIG. 2 illustrates detection of cancer in colon tissue as described in Example 1.

FIGS. 3a and 3b illustrate detection of lung cancer in plasma as described in Example 2.

FIG. 4 illustrates detection of pan-cancer in plasma as described in Example 3.

FIG. 5 (Table 1) shows exemplary target regions and primers.

DETAILED DESCRIPTION

Figure 1:
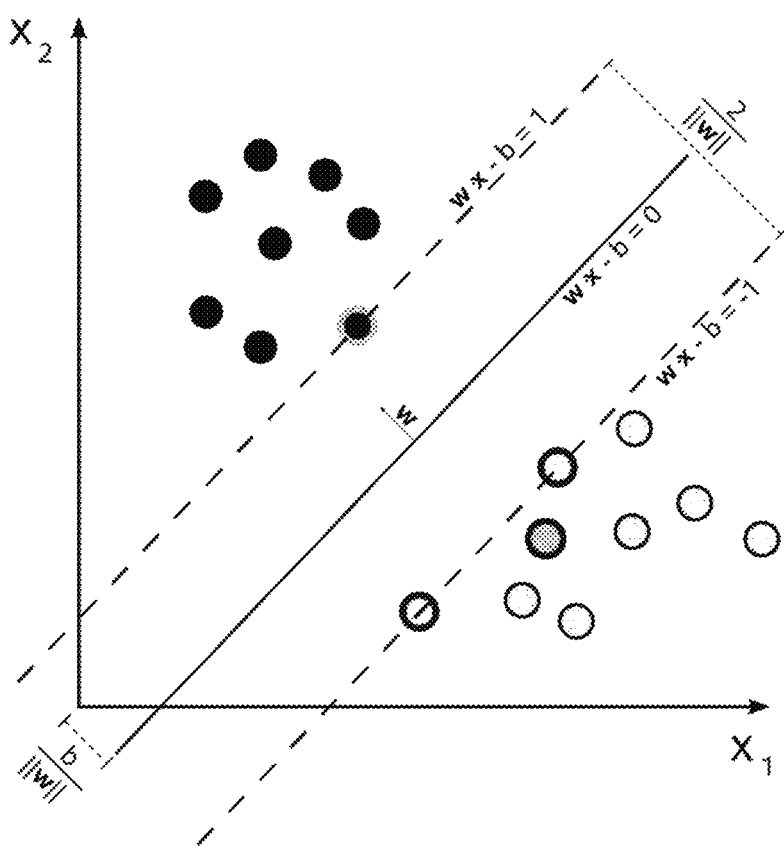
FIG. 1 illustrates an exemplary support vector machines analysis. Image of FIG. 1 is taken from Wikipedia: https://en.wikipedia.org/wiki/Support_vector_machine), and does not represent any DNA methylation status analysis or cancer assessment.

Numerous specific details are set forth in the following description in order to provide a thorough understanding of the present disclosure. These details are provided for the purpose of example and the claimed subject matter may be practiced according to the claims without some or all of these specific details. It is to be understood that other embodiments can be used and structural changes can be made without departing from the scope of the claimed subject matter. It should be understood that the various features and functionality described in one or more of the individual embodiments are not limited in their applicability to the particular embodiment with which they are described. They instead can, be applied, alone or in some combination, to one or more of the other embodiments of the disclosure, whether or not such embodiments are described, and whether or not such features are presented as being a part of a described embodiment. For the purpose of clarity, technical material that is known in the technical fields related to the claimed subject matter has not been described in detail so that the claimed subject matter is not unnecessarily obscured.

All publications, including patent documents, scientific articles and databases, referred to in this application are incorporated by reference in their entireties for all purposes to the same extent as if each individual publication were individually incorporated by reference. Citation of the publications or documents is not intended as an admission that any of them is pertinent prior art, nor does it constitute any admission as to the contents or date of these publications or documents.

All headings are for the convenience of the reader and should not be used to limit the meaning of the text that follows the heading, unless so specified.

The practice of the provided embodiments will employ, unless otherwise indicated, conventional techniques and descriptions of organic chemistry, polymer technology, molecular biology (including recombinant techniques), cell biology, biochemistry, and sequencing technology, which are within the skill of those who practice in the art. Such conventional techniques include polypeptide and protein synthesis and modification, polynucleotide synthesis and modification, polymer array synthesis, hybridization and ligation of polynucleotides, detection of hybridization, and nucleotide sequencing. Specific illustrations of suitable techniques can be had by reference to the examples herein. However, other equivalent conventional procedures can, of course, also be used. Such conventional techniques and descriptions can be found in standard laboratory manuals such as Green, et al., Eds., *Genome Analysis: A Laboratory Manual Series* (Vols. I-IV) (1999); Weiner, Gabriel, Stephens, Eds., *Genetic Variation: A Laboratory Manual* (2007); Dieffenbach, Dveksler, Eds., *PCR Primer: A Laboratory Manual* (2003); Bowtell and Sambrook, *DNA Microarrays: A Molecular Cloning Manual* (2003); Mount, *Bioinformatics: Sequence and Genome Analysis* (2004); Sambrook and Russell, *Condensed Protocols from Molecular Cloning: A Laboratory Manual* (2006); and Sambrook and Russell, *Molecular Cloning: A Laboratory Manual* (2002) (all from Cold Spring Harbor Laboratory Press); Ausubel et al. eds., *Current Protocols in Molecular Biology* (1987); T. Brown ed., *Essential Molecular Biology* (1991), IRL Press; Goeddel ed., *Gene Expression Technology* (1991), Academic Press; A. Bothwell et al. eds., *Methods for Cloning and Analysis of Eukaryotic Genes* (1990), Bartlett Publ.; M. Kriegler, *Gene Transfer and Expression* (1990), Stockton Press; R. Wu et al. eds., *Recombinant DNA Methodology* (1989), Academic Press; M. McPherson et al., *PCR: A Practical Approach* (1991), IRL Press at Oxford University Press; Stryer, *Biochemistry* (4th Ed.) (1995), W. H. Freeman, New York N.Y.; Gait, *Oligonucleotide Synthesis: A Practical Approach* (2002), IRL Press, London; Nelson and Cox, *Lehninger, Principles of Biochemistry* (2000) 3rd Ed., W. H. Freeman Pub., New York, N.Y.; Berg, et al., *Biochemistry* (2002) 5th Ed., W. H. Freeman Pub., New York, N.Y., all of which are herein incorporated in their entireties by reference for all purposes.

A. Definitions

Unless defined otherwise, all technical and scientific terms used herein have the same meaning as is commonly understood by one of ordinary skill in the art to which the present disclosure belongs. If a definition set forth in this section is contrary to or otherwise inconsistent with a definition set forth in the patents, applications, published applications and other publications that are herein incorporated by reference, the definition set forth in this section prevails over the definition that is incorporated herein by reference.

As used herein, "a" or "an" means "at least one" or "one or more." As used herein, the singular forms "a," "an," and "the" include the plural reference unless the context clearly dictates otherwise.

Throughout this disclosure, various aspects of the claimed subject matter are presented in a range format. It should be understood that the description in range format is merely for convenience and brevity and should not be construed as an inflexible limitation on the scope of the claimed subject matter. Accordingly, the description of a range should be considered to have specifically disclosed all the possible sub-ranges as well as individual numerical values within that range. For example, where a range of values is provided, it is understood that each intervening value, between the upper and lower limit of that range and any other stated or intervening value in that stated range is encompassed within the claimed subject matter. The upper and lower limits of these smaller ranges may independently be included in the smaller ranges, and are also encompassed within the claimed subject matter, subject to any specifically excluded limit in the stated range. Where the stated range includes one or both of the limits, ranges excluding either or both of those included limits are also included in the claimed subject matter. This applies regardless of the breadth of the range.

Reference to "about" a value or parameter herein includes (and describes) variations that are directed to that value or parameter per se. For example, description referring to "about X" includes description of "X". Additionally, use of "about" preceding any series of numbers includes "about" each of the recited numbers in that series. For example, description referring to "about X, Y, or Z" is intended to describe "about X, about Y, or about Z."

The term "average" as used herein refers to either a mean or a median, or any value used to approximate the mean or the median, unless the context clearly indicates otherwise.

A "subject" as used herein refers to an organism, or a part or component of the organism, to which the provided compositions, methods, kits, devices, and systems can be administered or applied. For example, the subject can be a mammal or a cell, a tissue, an organ, or a part of the mammal. As used herein, "mammal" refers to any of the mammalian class of species, preferably human (including humans, human subjects, or human patients). Subjects and mammals include, but are not limited to, farm animals, sport animals, pets, primates, horses, dogs, cats, and rodents such as mice and rats.

As used herein the term "sample" refers to anything which may contain a target molecule for which analysis is desired, including a biological sample. As used herein, a "biological sample" can refer to any sample obtained from a living or viral (or prion) source or other source of macromolecules and biomolecules, and includes any cell type or tissue of a subject from which nucleic acid, protein and/or other macromolecule can be obtained. The biological sample can be a sample obtained directly from a biological source or a sample that is processed. For example, isolated nucleic acids that are amplified constitute a biological sample. Biological samples include, but are not limited to, body fluids, such as blood, plasma, serum, cerebrospinal fluid, synovial fluid, urine, sweat, semen, stool, sputum, tears, mucus, amniotic fluid or the like, an effusion, a bone marrow sample, ascitic fluid, pelvic wash fluid, pleural fluid, spinal fluid, lymph, ocular fluid, extract of nasal, throat or genital swab, cell suspension from digested tissue, or extract of fecal material, and tissue and organ samples from humans, animals, e.g., non-human mammals, and plants and processed samples derived therefrom.

The terms "polynucleotide," "oligonucleotide," "nucleic acid" and "nucleic acid molecule" are used interchangeably herein to refer to a polymeric form of nucleotides of any length, and comprise ribonucleotides, deoxyribonucleotides, and analogs or mixtures thereof. The terms include triple-, double- and single-stranded deoxyribonucleic acid ("DNA"), as well as triple-, double- and single-stranded ribonucleic acid ("RNA"). It also includes modified, for example by alkylation, and/or by capping, and unmodified forms of the polynucleotide. More particularly, the terms "polynucleotide," "oligonucleotide," "nucleic acid," and "nucleic acid molecule" include polydeoxyribonucleotides (containing 2-deoxy-D-ribose), polyribonucleotides (containing D-ribose), including tRNA, rRNA, hRNA, and mRNA, whether spliced or unspliced, any other type of polynucleotide which is an N- or C-glycoside of a purine or pyrimidine base, and other polymers containing nonnucleotidic backbones, for example, polyamide (e.g., peptide nucleic acids ("PNAs")) and polymorpholino (commercially available from the Anti-Virals, Inc., Corvallis, OR, as Neugene) polymers, and other synthetic sequence-specific nucleic acid polymers providing that the polymers contain nucleobases in a configuration which allows for base pairing and base stacking, such as is found in DNA and RNA. Thus, these terms include, for example, 3'-deoxy-2',5'-DNA, oligodeoxyribonucleotide N3' to P5' phosphoramidates, 2'-O-alkyl-substituted RNA, hybrids between DNA and RNA or between PNAs and DNA or RNA, and also include known types of modifications, for example, labels, alkylation, "caps," substitution of one or more of the nucleotides with an analog, inter-nucleotide modifications such as, for example, those with uncharged linkages (e.g., methyl phosphonates, phosphotriesters, phosphoramidates, carbamates, etc.), with negatively charged linkages (e.g., phosphorothioates, phosphorodithioates, etc.), and with positively charged linkages (e.g., aminoalkylphosphoramidates, aminoalkylphosphotriesters), those containing pendant moieties, such as, for example, proteins (including enzymes (e.g. nucleases), toxins, antibodies, signal peptides, poly-L-lysine, etc.), those with intercalators (e.g., acridine, psoralen, etc.), those containing chelates (of, e.g., metals, radioactive metals, boron, oxidative metals, etc.), those containing alkylators, those with modified linkages (e.g., alpha anomeric nucleic acids, etc.), as well as unmodified forms of the polynucleotide or oligonucleotide. A nucleic acid generally will contain phosphodiester bonds, although in some cases nucleic acid analogs may be included that have alternative backbones such as phosphoramidite, phosphorodithioate, or methylphophoroamidite linkages; or peptide nucleic acid backbones and linkages. Other analog nucleic acids include those with bicyclic structures including locked nucleic acids, positive backbones, non-ionic backbones and non-ribose backbones. Modifications of the ribose-phosphate backbone may be done to increase the stability of the molecules; for example, PNA:DNA hybrids can exhibit higher stability in some environments. The terms "polynucleotide," "oligonucleotide," "nucleic acid" and "nucleic acid molecule" can comprise any suitable length, such as at least 5, 6, 7, 8, 9, 10, 20, 30, 40, 50, 100, 200, 300, 400, 500, 1,000, 2,000, 3,000, 4,000, 5,000, 6,000, 7,000, 8,000, 9,000, 10,000, or more nucleotides.

It will be appreciated that, as used herein, the terms "nucleoside" and "nucleotide" include those moieties which contain not only the known purine and pyrimidine bases, but also other heterocyclic bases which have been modified. Such modifications include methylated purines or pyrimidines, acylated purines or pyrimidines, or other heterocycles. Modified nucleosides or nucleotides can also include modifications on the sugar moiety, e.g., wherein one or more of the hydroxyl groups are replaced with halogen, aliphatic groups, or are functionalized as ethers, amines, or the like. The term "nucleotidic unit" is intended to encompass nucleosides and nucleotides.

The terms "complementary" and "substantially complementary" include the hybridization or base pairing or the formation of a duplex between nucleotides or nucleic acids, for instance, between the two strands of a double-stranded DNA molecule or between an oligonucleotide primer and a primer binding site on a single-stranded nucleic acid. Complementary nucleotides are, generally, A and T (or A and U), or C and G. Two single-stranded RNA or DNA molecules are said to be substantially complementary when the nucleotides of one strand, optimally aligned and compared and with appropriate nucleotide insertions or deletions, pair with at least about 80% of the other strand, usually at least about 90% to about 95%, and even about 98% to about 100%. In one aspect, two complementary sequences of nucleotides are capable of hybridizing, preferably with less than 25%, more preferably with less than 15%, even more preferably with less than 5%, most preferably with no mismatches between opposed nucleotides. Preferably the two molecules will hybridize under conditions of high stringency.

As used herein, for a reference sequence, the reverse complementary sequence is the complementary sequence of the reference sequence in the reverse order. For example, for 5'-ATCG-3', the complementary sequence is 3'-TAGC-5', and the reverse-complementary sequence is 5'-CGAT-3'.

"Hybridization" as used herein may refer to the process in which two single-stranded polynucleotides bind non-covalently to form a stable double-stranded polynucleotide. In one aspect, the resulting double-stranded polynucleotide can be a "hybrid" or "duplex." "Hybridization conditions" typically include salt concentrations of approximately less than 1 M, often less than about 500 mM and may be less than about 200 mM. A "hybridization buffer" includes a buffered salt solution such as 5% SSPE, or other such buffers known in the art. Hybridization temperatures can be as low as 5° C., but are typically greater than 22° C., and more typically greater than about 30° C., and typically in excess of 37° C. Hybridizations are often performed under stringent conditions, i.e., conditions under which a sequence will hybridize to its target sequence but will not hybridize to other, non-complementary sequences. Stringent conditions are sequence-dependent and are different in different circumstances. For example, longer fragments may require higher hybridization temperatures for specific hybridization than short fragments. As other factors may affect the stringency of hybridization, including base composition and length of the complementary strands, presence of organic solvents, and the extent of base mismatching, the combination of parameters is more important than the absolute measure of any one parameter alone. Generally stringent conditions are selected to be about 5° C. lower than the $T_m$ for the specific sequence at a defined ionic strength and pH. The melting temperature $T_m$ can be the temperature at which a population of double-stranded nucleic acid molecules becomes half dissociated into single strands. Several equations for calculating the $T_m$ of nucleic acids are well known in the art. As indicated by standard references, a simple estimate of the $T_m$ value may be calculated by the equation, $T_m = 81.5 + 0.41$ (% G+C), when a nucleic acid is in aqueous solution at 1 M NaCl (see e.g., Anderson, M. L. M. and Young, B. D. 1985, Quantitative filter hybridization. In: Nucleic acid hybridization: a practical approach, 73-111. B. D. Hames and S. J. Higgins (eds.). IRL Press Limited, Oxford.). Other references (e.g., Allawi and SantaLucia, Jr., *Biochemistry*, 36:10581-94 (1997)) include alternative methods of computation which take structural and environmental, as well as sequence characteristics into account for the calculation of $T_m$.

In general, the stability of a hybrid is a function of the ion concentration and temperature. Typically, a hybridization reaction is performed under conditions of lower stringency, followed by washes of varying, but higher, stringency. Exemplary stringent conditions include a salt concentration of at least 0.01 M to no more than 1 M sodium ion concentration (or other salt) at a pH of about 7.0 to about 8.3 and a temperature of at least 25° C. For example, conditions of 5×SSPE (750 mM NaCl, 50 mM sodium phosphate, 5 mM EDTA at pH 7.4) and a temperature of approximately 30° C. are suitable for allele-specific hybridizations, though a suitable temperature depends on the length and/or GC content of the region hybridized. In one aspect, "stringency of hybridization" in determining percentage mismatch can be as follows: 1) high stringency: 0.1×SSPE, 0.1% SDS, 65° C.; 2) medium stringency: 0.2×SSPE, 0.1% SDS, 50° C. (also referred to as moderate stringency); and 3) low stringency: 1.0×SSPE, 0.1% SDS, 50° C. It is understood that equivalent stringencies may be achieved using alternative buffers, salts and temperatures. For example, moderately stringent hybridization can refer to conditions that permit a nucleic acid molecule such as a probe to bind a complementary nucleic acid molecule. The hybridized nucleic acid molecules generally have at least 60% identity, including for example at least any of 70%, 75%, 80%, 85%, 90%, or 95% identity. Moderately stringent conditions can be conditions equivalent to hybridization in 50% formamide, 5×Denhardt's solution, 5×SSPE, 0.2% SDS at 42° C., followed by washing in 0.2×SSPE, 0.2% SDS, at 42° C. High stringency conditions can be provided, for example, by hybridization in 50% formamide, 5×Denhardt's solution, 5×SSPE, 0.2% SDS at 42° C., followed by washing in 0.1×SSPE, and 0.1% SDS at 65° C. Low stringency hybridization can refer to conditions equivalent to hybridization in 10% formamide, 5×Denhardt's solution, 6×SSPE, 0.2% SDS at 22° C., followed by washing in 1×SSPE, 0.2% SDS, at 37° C. Denhardt's solution contains 1% Ficoll, 1% polyvinylpyrolidone, and 1% bovine serum albumin (BSA). 20×SSPE (sodium chloride, sodium phosphate, EDTA) contains 3 M sodium chloride, 0.2 M sodium phosphate, and 0.025 M EDTA. Other suitable moderate stringency and high stringency hybridization buffers and conditions are well known to those of skill in the art and are described, for example, in Sambrook et al., Molecular Cloning: A Laboratory Manual, 2nd ed., Cold Spring Harbor Press, Plainview, N.Y. (1989); and Ausubel et al., Short Protocols in Molecular Biology, 4th ed., John Wiley & Sons (1999).

Alternatively, substantial complementarity exists when an RNA or DNA strand will hybridize under selective hybridization conditions to its complement. Typically, selective hybridization will occur when there is at least about 65% complementary over a stretch of at least 14 to 25 nucleotides, preferably at least about 75%, more preferably at least about 90% complementary. See M. Kanehisa, *Nucleic Acids Res.* 12:203 (1984).

A "primer" used herein can be an oligonucleotide, either natural or synthetic, that is capable, upon forming a duplex with a polynucleotide template, of acting as a point of initiation of nucleic acid synthesis and being extended from its 3' end along the template so that an extended duplex is formed. The sequence of nucleotides added during the extension process is determined by the sequence of the template polynucleotide. Primers usually are extended by a polymerase, for example, a DNA polymerase.

"Ligation" may refer to the formation of a covalent bond or linkage between the termini of two or more nucleic acids, e.g., oligonucleotides and/or polynucleotides, in a template-driven reaction. The nature of the bond or linkage may vary widely and the ligation may be carried out enzymatically. As used herein, ligations are usually carried out enzymatically to form a phosphodiester linkage between a 5' carbon terminal nucleotide of one oligonucleotide with a 3' carbon of another nucleotide.

"Amplification," as used herein, generally refers to the process of producing multiple copies of a desired sequence. "Multiple copies" means at least 2 copies. A "copy" does not necessarily mean perfect sequence complementarity or identity to the template sequence. For example, copies can include nucleotide analogs such as deoxyinosine, intentional sequence alterations (such as sequence alterations introduced through a primer comprising a sequence that is hybridizable, but not complementary, to the template), and/or sequence errors that occur during amplification.

"Sequence determination" and the like include determination of information relating to the nucleotide base sequence of a nucleic acid. Such information may include the identification or determination of partial as well as full sequence information of the nucleic acid. Sequence information may be determined with varying degrees of statistical reliability or confidence. In one aspect, the term includes the determination of the identity and ordering of a plurality of contiguous nucleotides in a nucleic acid.

The term "Sequencing," "High throughput sequencing," or "next generation sequencing" includes sequence determination using methods that determine many (typically thousands to billions) of nucleic acid sequences in an intrinsically parallel manner, i.e. where DNA templates are prepared for sequencing not one at a time, but in a bulk process, and where many sequences are read out preferably in parallel, or alternatively using an ultra-high throughput serial process that itself may be parallelized. Such methods include but are not limited to pyrosequencing (for example, as commercialized by 454 Life Sciences, Inc., Branford, CT); sequencing by ligation (for example, as commercialized in the SOLiD™ technology, Life Technologies, Inc., Carlsbad, CA); sequencing by synthesis using modified nucleotides (such as commercialized in TruSeq™ and HiSeq™ technology by Illumina, Inc., San Diego, CA; HeliScope™ by Helicos Biosciences Corporation, Cambridge, MA; and PacBio RS by Pacific Biosciences of California, Inc., Menlo Park, CA), sequencing by ion detection technologies (such as Ion Torrent™ technology, Life Technologies, Carlsbad, CA); sequencing of DNA nanoballs (Complete Genomics, Inc., Mountain View, CA); nanopore-based sequencing technologies (for example, as developed by Oxford Nanopore Technologies, LTD, Oxford, UK), and like highly parallelized sequencing methods.

"SNP" or "single nucleotide polymorphism" may include a genetic variation between individuals; e.g., a single nitrogenous base position in the DNA of organisms that is variable. SNPs are found across the genome; much of the genetic variation between individuals is due to variation at SNP loci, and often this genetic variation results in phenotypic variation between individuals. SNPs for use in the present disclosure and their respective alleles may be derived from any number of sources, such as public databases (U.C. Santa Cruz Human Genome Browser Gateway (genome.ucsc.edu/ cgi-bin/hgGateway) or the NCBI dbSNP website (ncbi.nlm-.nih gov/SNP/), or may be experimentally determined as described in U.S. Pat. No. 6,969,589; and US Pub. No. 2006/0188875 entitled "Human Genomic Polymorphisms." Although the use of SNPs is described in some of the embodiments presented herein, it will be understood that other biallelic or multi-allelic genetic markers may also be used. A biallelic genetic marker is one that has two polymorphic forms, or alleles. As mentioned above, for a biallelic genetic marker that is associated with a trait, the allele that is more abundant in the genetic composition of a case group as compared to a control group is termed the "associated allele," and the other allele may be referred to as the "unassociated allele." Thus, for each biallelic polymorphism that is associated with a given trait (e.g., a disease or drug response), there is a corresponding associated allele. Other biallelic polymorphisms that may be used with the methods presented herein include, but are not limited to multinucleotide changes, insertions, deletions, and translocations.

It will be further appreciated that references to DNA herein may include genomic DNA, mitochondrial DNA, episomal DNA, and/or derivatives of DNA such as amplicons, RNA transcripts, cDNA, DNA analogs, etc. The polymorphic loci that are screened in an association study may be in a diploid or a haploid state and, ideally, would be from sites across the genome. Sequencing technologies are available for SNP sequencing, such as the BeadArray platform (GOLDENGATE™ assay) (Illumina, Inc., San Diego, CA) (see Fan, et al., *Cold Spring Symp. Quant. Biol.,* 68:69-78 (2003)), may be employed.

In some embodiments, the term "methylation state" or "methylation status" refers to the presence or absence of 5-methylcytosine ("5-mC" or "5-mCyt") at one or a plurality of CpG dinucleotides within a DNA sequence. Methylation states at one or more particular CpG methylation sites (each having two CpG dinucleotide sequences) within a DNA sequence include "unmethylated," "fully-methylated," and "hemi-methylated." The term "hemi-methylation" or "hemimethylation" refers to the methylation state of a double stranded DNA wherein only one strand thereof is methylated. The term "hypermethylation" refers to the average methylation state corresponding to an increased presence of 5-mCyt at one or a plurality of CpG dinucleotides within a DNA sequence of a test DNA sample, relative to the amount of 5-mCyt found at corresponding CpG dinucleotides within a normal control DNA sample. The term "hypomethylation" refers to the average methylation state corresponding to a decreased presence of 5-mCyt at one or a plurality of CpG dinucleotides within a DNA sequence of a test DNA sample, relative to the amount of 5-mCyt found at corresponding CpG dinucleotides within a normal control DNA sample.

"Multiplexing" or "multiplex assay" herein may refer to an assay or other analytical method in which the presence, amount and/or methylation state (or methylation status) of multiple targets, e.g., multiple nucleic acid sequences, can be assayed simultaneously by using more than one markers, each of which has at least one different detection characteristic, e.g., fluorescence characteristic (for example excitation wavelength, emission wavelength, emission intensity, FWHM (full width at half maximum peak height), or fluorescence lifetime) or a unique nucleic acid or protein sequence characteristic.

As used herein, "disease or disorder" refers to a pathological condition in an organism resulting from, e.g., infection or genetic defect, and characterized by identifiable symptoms.

B. Panels of Isolated Polynucleotides and Related Compositions

In one aspect, provided herein is a panel of isolated polynucleotides comprising, consisting of, or consisting essentially of at least two isolated polynucleotides, each of said isolated polynucleotides having a polynucleotide sequence of any of Target 1 to Target 1849 listed in Table 1 (shown in FIG. 5), or a complementary or substantially complementary sequence thereof.

The present panel can comprise, consist of, or consist essentially of any suitable number of the above isolated polynucleotides. For example, the present panel can comprise, consist of, or consist essentially of at least 2, 3, 4, 5, 6, 7, 8, 9, 10, 20, 30, 40, 50, 60, 70, 80, 90, 100, 200, 300, 400, 500, 600, 700, 800, 900, 1,000, 1,100, 1,200, 1,300, 1,400, 1,500, 1,600, 1,700, 1,800, more of the isolated polynucleotides, or the isolated polynucleotides corresponding to all of Target 1 to Target 1849 listed in Table 1, or a numerical range or subrange thereof.

In one embodiment, the present panel can comprise at least 2, 3, 4, 5, 6, 7, 8, 9, 10, 20, 30, 40, 50, 60, 70, 80, 90, 100, 200, 300, 400, 500, 600, 700, 800, 900, 1,000, 1,100, 1,200, 1,300, 1,400, 1,500, 1,600, 1,700, 1,800, more of the isolated polynucleotides, or the isolated polynucleotides corresponding to all of Target 1 to Target 1849 listed in Table 1, or a numerical range or subrange thereof. In another embodiment, the present panel can consist of at least 2, 3, 4, 5, 6, 7, 8, 9, 10, 20, 30, 40, 50, 60, 70, 80, 90, 100, 200, 300, 400, 500, 600, 700, 800, 900, 1,000, 1,100, 1,200, 1,300, 1,400, 1,500, 1,600, 1,700, 1,800, more of the isolated polynucleotides, or the isolated polynucleotides corresponding to all of Target 1 to Target 1849 listed in Table 1, or a numerical range or subrange thereof. In still another embodiment, the present panel can consist essentially of at least 2, 3, 4, 5, 6, 7, 8, 9, 10, 20, 30, 40, 50, 60, 70, 80, 90, 100, 200, 300, 400, 500, 600, 700, 800, 900, 1,000, 1,100, 1,200, 1,300, 1,400, 1,500, 1,600, 1,700, 1,800, more of the isolated polynucleotides, or the isolated polynucleotides corresponding to all of Target 1 to Target 1849 listed in Table 1, or a numerical range or subrange thereof.

The isolated polynucleotides in the present panel can be any suitable type(s) of polynucleotides. For example, the isolated polynucleotides can be DNA molecules, RNA molecules, or a combination thereof. In some embodiments, the DNA molecules can be genomic DNA molecules or fragments thereof.

The isolated polynucleotides can be immobilized on a substrate. The isolated polynucleotides can be immobilized on any suitable substrate. For example, the substrate can comprise a solid surface, a porous surface, or a combination thereof. In some embodiments, the substrate can be a part of a bead, a tube, a microtiter plate, a membrane, a gel, or a glass slide. In other embodiments, the isolated polynucleotide molecules can be immobilized spatially apart from each other on a substrate so that each of the isolated polynucleotide molecules can be assessed or analyzed individually.

Kits, devices, systems or articles of manufacture that comprise any of the above panel(s) are also provided.

The present kits, devices, systems or articles of manufacture can be configured for any suitable use or purpose. For example, the present kits, devices, systems or articles of manufacture can be configured for assessing methylation status of at least two of Target 1 to Target 1849 listed in Table 1. In some embodiments, the present kits, devices, systems or articles of manufacture can be configured for assessing methylation status of at least 2, 3, 4, 5, 6, 7, 8, 9, 10, 20, 30, 40, 50, 60, 70, 80, 90, 100, 200, 300, 400, 500, 600, 700, 800, 900, 1,000, 1,100, 1,200, 1,300, 1,400, 1,500, 1,600, 1,700, 1,800, more of the isolated polynucleotides, or the isolated polynucleotides corresponding to all of Target 1 to Target 1849 listed in Table 1, or a numerical range or subrange thereof. In other embodiments, the isolated polynucleotides in the present kits, devices, systems or articles of manufacture can be configured as control polynucleotides.

The isolated polynucleotides in the present kits, devices, systems or articles of manufacture can have any suitable level of concentration. For example, the isolated polynucleotides can have a level of concentration from about 1 femtomolar to about 100 millimolar, e.g., at about 1 femtomolar (fM), 10 fM, 100 fM, 1 picomolar (pM), 10 pM, 100 pM, 1 nanomolar (nM), 10 nM, 100 nM, 1 micromolar (µM), 10 µM, 100 µM, 1 millimolar (mM), 10 mM, 100 mM, or a subrange thereof.

The present kits, devices, systems or articles of manufacture can be configured for any suitable use or purpose. For example, the kits, devices, systems or articles of manufacture can be configured for assessing cancer or neoplasia in a subject, e.g., for assessing lung cancer or colorectal cancer in a subject, or for pan-cancer analysis or profiling in a subject.

C. Kits, Systems and Related Compositions for Assessing Methylation

In another aspect, a kit, device, system or an article of manufacture that is configured for assessing methylation status of at least two of Target 1 to Target 1849 listed in Table 1 is provided.

The present kits, devices, systems or articles of manufacture can comprise reagents for assessing methylation status of any suitable number of the Targets listed in Table 1. For example, the present kits, devices, systems or articles of manufacture can comprise reagents for assessing methylation status of at least 2, 3, 4, 5, 6, 7, 8, 9, 10, 20, 30, 40, 50, 60, 70, 80, 90, 100, 200, 300, 400, 500, 600, 700, 800, 900, 1,000, 1,100, 1,200, 1,300, 1,400, 1,500, 1,600, 1,700, 1,800, more of the isolated polynucleotides, or the isolated polynucleotides corresponding to all of Target 1 to Target 1849 listed in Table 1, or a numerical range or subrange thereof.

In some embodiments, the present kits, devices, systems or articles of manufacture can comprise reagents for assessing methylation status of any subgroup of the Targets listed in Table 1. For example, the present kits, devices, systems or articles of manufacture can comprise reagents for assessing methylation status of Targets 1-100 listed in Table 1. In other embodiments, the present kits, devices, systems or articles of manufacture can comprise reagents for assessing methylation status of all of the Targets listed in Table 1, excluding one or more Targets listed in Table 1. For example, the present kits, devices, systems or articles of manufacture can comprise reagents for assessing methylation status of Targets 1-1848 listed in Table 1, but do not comprise reagent(s) for assessing methylation status of Target 1849 listed in Table 1, etc.

The present kits, devices, systems or articles of manufacture can comprise any suitable reagents for assessing methylation status of the target polynucleotides. For example, the reagents can comprise, consist essentially of, or consist of a probe or primer configured for hybridizing with each of the targets whose methylation status is to be assessed. In some embodiments, the reagents comprise, consist essentially of, or consist of a single probe or primer configured for hybridizing with each of the targets whose methylation status is to be assessed. In other embodiments, the reagents comprise, consist essentially of, or consist of multiple probes or primers configured for hybridizing with each of the targets whose methylation status is to be assessed.

In some embodiments, the one or more primers in the present kits, devices, systems or articles of manufacture comprise, consist essentially of, or consist of a sequence set forth in SEQ ID NOs: 1-17504 listed in Table 1, a complementary or substantially complementary sequence thereof, or any combination thereof. For each Target listed in Table 1, the present kits, devices, systems or articles of manufacture can comprise, consist essentially of, or consist of one ore more corresponding primers for that Target. For example, for Target 1 listed in Table 1, the present kits, devices, systems or articles of manufacture can comprise, consist essentially of, or consist of any of a sequence set forth in SEQ ID NOs: 1-10 listed in Table 1, e.g., 1, 2, 3, 4, 5, 6, 7, 8, 9 or 10 primers comprising, consisting essentially of, or consisting of sequence(s) set forth in SEQ ID NOs: 1-10, a complementary or substantially complementary sequence thereof, or any combination thereof. Similarly, for Target 2 listed in Table 1, the present kits, devices, systems or articles of manufacture can comprise, consist essentially of, or consist of any of a sequence set forth in SEQ ID NOs: 11-20 listed in Table 1, e.g., 1, 2, 3, 4, 5, 6, 7, 8, 9 or 10 primers comprising, consisting essentially of, or consisting of sequence(s) set forth in SEQ ID NOs: 11-20, a complementary or substantially complementary sequence thereof, or any combination thereof. For any of Targets 3-1849 listed in Table 1, the present kits, devices, systems or articles of manufacture can comprise, consist essentially of, or consist of any of the corresponding sequence(s) listed in Table 1, a complementary or substantially complementary sequence thereof, or any combination thereof, as illustrated for Target 1 or 2 listed in Table 1 above.

In some embodiments, the present kits, devices, systems or articles of manufacture can comprise a common primer, e.g., a common primer for amplifying each of the targets whose methylation status is to be assessed. An exemplary common primer can comprise, consist essentially of, or consist of a sequence set forth in SEQ ID NO:17505 CACTCTTTCCCTACACGACGC), or a complementary or substantially complementary sequence thereof.

The present kits, devices, systems or articles of manufacture can further comprise any other suitable reagents. In some embodiments, the present kits, devices, systems or articles of manufacture can further comprise any other suitable reagents disclosed and/or claimed in U.S. provisional application Ser. No. 62/487,422, filed on Apr. 19, 2017 and U.S. provisional application Ser. No. 62/487,423, filed on Apr. 19, 2017.

For example, the present kits, devices, systems or articles of manufacture can further comprise an agent for isolating the targets from a sample.

In another example, the present kits, devices, systems or articles of manufacture can further comprise a reagent for preparing a library of the targets. Any suitable reagents for preparing a library of the targets can be included. In some embodiments, the reagent for preparing a library of the targets can comprise an enzyme, e.g., a ligase or a single-stranded DNA (ssDNA) ligase. Any suitable ssDNA ligase can be included, e.g., a *Thermus* bacteriophage RNA ligase such as a bacteriophage TS2126 RNA ligase (e.g., CircLigase™ and CircLigase II™), or an archaebacterium RNA ligase such as *Methanobacterium* thermoautotrophicum RNA ligase 1.

In still another example, the present kits, devices, systems or articles of manufacture can further comprise a reagent for amplifying the targets or a library of the targets. Any suitable reagents for amplifying the targets or a library of the targets can be included. In some embodiments, the reagent for amplifying the targets or a library of the targets can comprise an enzyme, e.g., an enzyme to be used in a polynucleotide amplification reaction. Exemplary polynucleotide amplification reactions include polymerase chain reaction (PCR), strand displacement amplification (SDA), transcription mediated amplification (TMA), ligase chain reaction (LCR), nucleic acid sequence based amplification (NASBA), primer extension, rolling circle amplification (RCA), self sustained sequence replication (3SR), and loop-mediated isothermal amplification (LAMP).

In yet another example, the present kits, devices, systems or articles of manufacture can further comprise an agent for purifying the targets, a library of the targets, amplified targets or a library of amplified targets.

In yet another example, the present kits, devices, systems or articles of manufacture can further comprise a reagent for assessing methylation status of the targets. Any suitable reagents for assessing methylation status of the targets can be included. In some embodiments, the reagent for assessing methylation status of the targets can be a reagent to be used in a polynucleotide methylation, e.g., DNA methylation, detecting method. Exemplary polynucleotide methylation or DNA methylation detecting methods include mass spectrometry, methylation-specific PCR (MSP), bisulphite sequencing, the HpaII tiny fragment Enrichment by ligation-mediated PCR assay (HELP Assay), GlaI hydrolysis and ligation adapter dependent PCR assay (GLAD-PCR assay), restriction landmark genomic scanning (RLGS), methylated DNA immunoprecipitation (MeDIP or mDIP), pyrosequencing, molecular break light assay for DNA adenine methyltransferase activity, methyl sensitive Southern blotting and high resolution Melt (HRM) analysis.

The reagent for assessing methylation status of the targets can be a chemical agent, e.g., bisulfite or sodium bisulfite. The reagent for assessing methylation status of the targets can also be a biological agent, e.g., a polypeptide or an enzyme.

Any suitable enzyme can be included. In some embodiments, the enzyme can be a methylation-sensitive restriction enzyme (MSRE). The MSRE can selectively cleave at a residue when it is unmethylated. The MSRE can also selectively cleave at the residue when it is methylated. Exemplary MSRE can be selected from the group consisting of HpaII, SalI, SalI-HF®, ScrFI, BbeI, NotI, SmaI, XmaI, MboI, BstBI, ClaI, MluI, NaeI, NarI, PvuI, SacII, HhaI, and a combination thereof.

In some embodiments, the enzyme can be a polynucleotide polymerase. The polynucleotide polymerase is configured to be used in polynucleotide amplification reaction, e.g., PCR. Any suitable polynucleotide polymerase can be included. For example, the polynucleotide polymerase can be a DNA polymerase, e.g., a DNA polymerase without a 3' to 5' exonuclease activity.

In yet another example, the present kits, devices, systems or articles of manufacture can further comprise a denaturing reagent for denaturing a double-stranded polynucleotide from a sample to obtain the single-stranded polynucleotide.

In yet another example, the present kits, devices, systems or articles of manufacture can further comprise a crowding agent for the ligation reaction. In one aspect, the crowding agent comprises a polyethylene glycol (PEG), such as PEG 4000 or PEG 6000, Dextran, and/or Ficoll.

In yet another example, the present kits, devices, systems or articles of manufacture can further comprise a set of primers each comprising a sequence that is reverse-complement to the adaptor and/or hybridizable to the adaptor, for converting the single-stranded polynucleotide to a double-stranded polynucleotide.

In yet another example, the present kits, devices, systems or articles of manufacture can further comprise a reagent for removing primer dimer and/or primer-adaptor duplex.

In yet another example, the present kits, devices, systems or articles of manufacture can further comprise a primer comprising a sequence specific for a target sequence (e.g., an EGFR gene sequence), for obtaining an amplified linear, double-stranded ligation product comprising sequence information of the target sequence. In a further aspect, the kit can further comprise a sequencing adapter and/or a sample-specific barcode, for sequencing the amplified linear, double-stranded ligation product.

In yet another example, the present kits, devices, systems or articles of manufacture can further comprise a panel of isolated polynucleotides described in the above Section B.

In yet another example, the present kits, devices, systems or articles of manufacture can further comprise a reference sample and/or information of a control locus.

In yet another example, the present kits, devices, systems or articles of manufacture can further comprise separate containers, e.g., vials, for one or more components and/or instructions for using the kits, devices, systems or articles of manufacture.

In yet another example, the present kits, devices, systems or articles of manufacture can further comprise a computer readable medium containing executable instructions for obtaining a methylation metric of a sample based on the methylation status assessment. The computer readable medium can be configured for obtaining a methylation metric in any suitable form, e.g., in the form of average methylation frequency, methylation haplotype load, unmethylation haplotype load, percent discordant reads, or a combination thereof.

In yet another example, the present kits, devices, systems or articles of manufacture can further comprise a computer readable medium containing executable instructions for classification using the methylation metric(s). Exemplary classification algorithm can be linear discriminant analysis, logistic regression, naïve bayes classification, perceptron classification, quadratic classification, k-nearest neighbors, boosting, decision tree, random forest, neural network, learning vector quantization, or support vector machines, or a combination thereof.

The present kits, devices, systems or articles of manufacture can be configured for any suitable use or purpose. For example, the present kits, devices, systems or articles of manufacture can be configured for assessing cancer or neoplasia in a subject, e.g., for assessing lung cancer or colorectal cancer in a subject, or for pan-cancer analysis or profiling in a subject.

In some embodiments, the kit may additionally comprise reagents for detecting presence of polypeptides. Such reagents may be antibodies or other binding molecules that specifically bind to a polypeptide. In some embodiments, such antibodies or binding molecules may be capable of distinguishing a structural variation to the polypeptide as a result of polymorphism, and thus may be used for genotyping. The antibodies or binding molecules may be labeled with a detectable marker, such as, for example, a radioisotope, fluorescent compound, bioluminescent compound, a chemiluminescent compound, metal chelator or enzyme. Other reagents for performing binding assays, such as ELISA, may be included in the kit.

In some embodiments, the kits comprise reagents for genotyping at least two, at least three, at least five, at least ten, or more markers. The markers may be a polynucleotide marker (such as a cancer-associated mutation or SNP) or a polypeptide marker (such as overexpression or a post-translational modification, including hyper- or hypo-phosphorylation, of a protein) or any combination thereof. In some embodiments, the kits may further comprise a surface or substrate (such as a microarray) for capture probes for detecting of amplified nucleic acids.

The kits may further comprise a carrier means being compartmentalized to receive in close confinement one or more container means such as vials, tubes, and the like, each of the container means comprising one of the separate elements to be used in the method. For example, one of the container means may comprise a probe that is or can be detectably labeled. Such probe may be a polynucleotide specific for a biomarker. The kit may also have containers containing nucleotide(s) for amplification of the target nucleic acid sequence and/or a container comprising a reporter-means bound to a reporter molecule, such as an enzymatic, florescent, or radioisotope label.

The kit typically comprises the container(s) described above and one or more other containers comprising materials desirable from a commercial and user standpoint, including buffers, diluents, filters, needles, syringes, and package inserts with instructions for use. A label may be present on the container to indicate that the composition is used for a specific therapy or non-therapeutic application, and may also indicate directions for either in vivo or in vitro use, such as those described above.

The kit can further comprise a set of instructions and materials for preparing a tissue or cell or body fluid sample and preparing nucleic acids (such as ctDNA) from the sample.

D. Methods for Assessing Cancer or Neoplasia in a Subject

In still another aspect, provided herein is a method for assessing cancer or neoplasia in a subject, which method comprises: a) providing a sample from a subject containing at least two target polynucleotides of said subject, said at least two target polynucleotides having polynucleotide sequences of at least two of Target 1 to Target 1849 listed in Table 1, or a complementary or substantially complementary sequence thereof; b) assessing methylation status of said at least two target polynucleotides; and c) assessing cancer or neoplasia in said subject based on assessment of methylation status of said at least two target polynucleotides.

The present methods can be used on any suitable sample, e.g., any suitable sample obtained or derived from a subject whose cancer or neoplasia status is to be assessed. For example, the sample can comprise circulating cell-free or tumor DNA (ctDNA). In another example, the sample can be a blood, serum, plasma, or body fluid sample, or any combination thereof.

The target or template polynucleotides can be target DNA molecules, RNA molecules, or a complex or a combination thereof. DNA can include be regular genomic DNA, chromosomal DNA, extrachromosomal DNA (such as mitochondrial DNA), or a fragment thereof. In other embodiments, the target or template DNA is a processed DNA, for example, one that has undergone enzyme digestion, cross-linking, chemical or physical shearing, bisulfite conversion, and/or degradation.

In some embodiments, the target nucleic acid molecule of interest disclosed herein is a cell-free DNA, such as cell-free fetal DNA (also referred to as "cfDNA") or ctDNA. cfDNA circulates in the body, such as in the blood, of a pregnant mother, and represents the fetal genome, while ctDNA circulates in the body, such as in the blood, of a cancer patient, and is generally pre-fragmented. In other embodiments, the target nucleic acid molecule of interest disclosed herein is an ancient and/or damaged DNA, for example, due to storage under damaging conditions such as in formalin-fixed samples, or partially digested samples.

As cancer cells die, they release DNA into the bloodstream. This DNA, known as circulating tumor DNA (ctDNA), is highly fragmented, with an average length of approximately 150 base pairs. Once the white blood cells are removed, ctDNA generally comprises a very small fraction of the remaining plasma DNA, for example, ctDNA may constitute less than about 10% of the plasma DNA. Generally, this percentage is less than about 1%, for example, less than about 0.5% or less than about 0.01%. Additionally, the total amount of plasma DNA is generally very low, for example, at about 10 ng/mL of plasma.

The variants in the ctDNA can be interrogated using various methods, including next generation sequencing. Due to the low ratio of ctDNA to plasma DNA, it is difficult to call a variant with high confidence due to PCR and sequencing errors. Unique molecular identifiers (UMIs) can be used to tag original molecules such that any variant seen can be compared to a consensus sequence. This is an effective manner to separate true from false positives. If the variant is matched to a consensus, it is a true positive. Otherwise, it is removed from analysis. Furthermore, it is essential that a high percentage of original molecules are turned into sequencing libraries so that the sensitivity remains high, i.e., variants are not missed due to dropout. Thus, ligation efficiency can be important during library construction.

In one aspect, a technique to improve ligation efficiency while still targeting selected regions of the genome, as disclosed and/or claimed in U.S. provisional application Ser. No. 62/487,423, filed on Apr. 19, 2017, can be used to prepare target polynucleotides to be analyzed in the present methods. In one embodiment, polynucleotides to be detected by sequencing, such as ctDNA, are first dephosphorylated to remove 5' phosphates to prevent ligation of ctDNA to itself. The ctDNA is then denatured such that all DNA is single stranded. Circligase™, a single stranded DNA ligase, is used to ligate an adapter to the 3' end of the ctDNA. In one aspect, the adapter contains 2 specific bases on the 5' end to optimize ligation efficiency, followed by a UMI. In one aspect, the 3' end of the adapter contains a carbon spacer to prevent self-ligation of the adapters. In another aspect, the ligation reaction is further optimized using a crowding agent, such as PEG 4000. In one aspect, following ligation, molecules are double-stranded using a primer that is reverse complement to the adapter. This allows efficient removal of excess unligated adapters without removed usable DNA by a standard purification.

In one aspect, the DNA is then amplified using a semi-targeted PCR. One primer is reverse complement to the adapter, while the other (e.g., as one primer in a primer pool) anneals to specific, targeted regions of the genome. The specific primers were designed to minimize primer-dimer interactions and off-target annealing. In one aspect, the target-specific primers are further optimized to land in close proximity to specific variants due to the small DNA size. Following another cleanup, a PCR adds the full-length sequencing adapters and barcodes. The final library is then sequenced, for example, on an Illumina machine.

In one aspect, the semi-targeted PCR results in enrichments of >about 40,000 fold of the original molecule set despite having a relatively small target region of ~30,000 bp. In one aspect, the overall conversion rates of the present method are at least 60%, implying that at least ~3 times more of the original molecules are converted into sequenceable material when compared to standard library construction and hybridization capture. In other embodiments, the overall conversion rates are between about 60% and about 70%, between about 70% and about 80%, between about 80% and about 90%, or over 90%. In one aspect, the present method thus is able to accurately call genetic or genomic variants, such as SNVs, indels, CNVs, and fusions at extremely low mutant allele fractions, for example, as low as 0.01%. In other aspects, the allele fraction of the genetic or genomic variant is about 0.05%, about 0.1%, about 0.5%, about 1%, or about 2%.

The present methods can be used for assessing cancer or neoplasia in any suitable subject. For example, the present methods can be used for assessing cancer or neoplasia in a mammal. The mammal can be a non-human mammal, e.g., a pet, a farm animal, a companion animal or an experimental animal. Preferably, the mammal is a human. For example, a subject can be a human that needs to be screened for cancer or neoplasia risks, a human in a high-risk group, a human that has been diagnosed as having cancer or neoplasia but needs further stratification, a human that has been diagnosed as having cancer or neoplasia and under active treatment, or a human having cancer or neoplasia and is in remission.

The present methods can comprise assessing methylation status of any suitable number of the Targets listed in Table 1. For example, the methods can comprise assessing methylation status of at least 2, 3, 4, 5, 6, 7, 8, 9, 10, 20, 30, 40, 50, 60, 70, 80, 90, 100, 200, 300, 400, 500, 600, 700, 800, 900, 1,000, 1,100, 1,200, 1,300, 1,400, 1,500, 1,600, 1,700, 1,800, more of the isolated polynucleotides, or the isolated polynucleotides corresponding to all of Target 1 to Target 1849 listed in Table 1, or a numerical range or subrange thereof.

The methylation status of target polynucleotides can be assessed using any suitable methods or reagents. For example, the methylation status of target polynucleotides can be assessed using a probe or primer configured for hybridizing with each of the target polynucleotides. In some embodiments, the methylation status of a target polynucleotide can be assessed using a single probe or primer configured for hybridizing with the target polynucleotide. In other embodiments, the methylation status of a target polynucleotide can be assessed using multiple probes or primers configured for hybridizing with the target polynucleotide.

In some embodiments, the one or more primers used in the present methods can comprise, consist essentially of, or consist of a sequence set forth in any of SEQ ID NOs: 1-17504 listed in Table 1, a complementary or substantially complementary sequence thereof, or any combination thereof. For each Target listed in Table 1, the one or more primers used in the present methods can comprise, consist essentially of, or consist of one or more corresponding primers for that Target. For example, for Target 1 listed in Table 1, the one or more primers used in the present methods can comprise, consist essentially of, or consist of any of a sequence set forth in SEQ ID NOs: 1-10 listed in Table 1, e.g., 1, 2, 3, 4, 5, 6, 7, 8, 9 or 10 primers comprising, consisting essentially of, or consisting of sequence(s) set forth in SEQ ID NOs: 1-10, a complementary or substantially complementary sequence thereof, or any combination thereof. Similarly, for Target 2 listed in Table 1, the one or more primers used in the present methods can comprise, consist essentially of, or consist of any of a sequence set forth in SEQ ID NOs: 11-20 listed in Table 1, e.g., 1, 2, 3, 4, 5, 6, 7, 8, 9 or 10 primers comprising, consisting essentially of, or consisting of sequence(s) set forth in SEQ ID NOs: 11-20, a complementary or substantially complementary sequence thereof, or any combination thereof. For any of Targets 3-1849 listed in Table 1, the one or more primers used in the present methods can comprise, consist essentially of, or consist of any of the corresponding sequence(s) listed in Table 1, a complementary or substantially complementary sequence thereof, or any combination thereof, as illustrated for Target 1 or 2 listed in Table 1 above.

The present methods can further comprise using a common primer for amplifying each of the target polynucleotide whose methylation status is to be assessed. An exemplary common primer can comprise, consist essentially of, or consist of a sequence set forth in SEQ ID NO:17505 CACTCTTTCCCTACACGACGC), or a complementary or substantially complementary sequence thereof.

The present methods can further comprise any other suitable steps. In some embodiments, the present methods can further comprise any other suitable steps disclosed and/or claimed in U.S. provisional application Ser. No. 62/487,422, filed on Apr. 19, 2017 and U.S. provisional application Ser. No. 62/487,423, filed on Apr. 19, 2017. For example, techniques and steps for constructing single-stranded polynucleotide, conversion of single-stranded polynucleotide library to double-stranded polynucleotide library, semi-targeted amplification of double-stranded polynucleotide library, and construction of sequence library and analysis of sequencing reads disclosed and/or claimed in U.S. provisional application Ser. No. 62/487,423, filed on Apr. 19, 2017 can be used to obtain and/or prepare target polynucleotides to be analyzed.

For example, the present methods can further comprise isolating the target polynucleotides from a sample.

In another example, the present methods can further comprise preparing a library of the target polynucleotides. Any suitable reagents for preparing a library of the targets can be used. In some embodiments, the reagent for preparing a library of the targets can comprise an enzyme, e.g., a ligase or a single-stranded DNA (ssDNA) ligase. Any suitable ssDNA ligase can be included, e.g., a *Thermus* bacteriophage RNA ligase such as a bacteriophage TS2126 RNA ligase (e.g., CircLigase™ and CircLigase II™), or an archaebacterium RNA ligase such as *Methanobacterium thermoautotrophicum* RNA ligase 1.

In still another example, the present methods can further comprise amplifying the target polynucleotides. Any suitable reagents for amplifying the targets or a library of the targets can be used. In some embodiments, the reagent for amplifying the targets or a library of the targets can comprise an enzyme, e.g., an enzyme to be used in a polynucleotide amplification reaction. Exemplary polynucleotide amplification reactions include polymerase chain reaction (PCR), strand displacement amplification (SDA), transcription mediated amplification (TMA), ligase chain reaction (LCR), nucleic acid sequence based amplification (NASBA), primer extension, rolling circle amplification (RCA), self-sustained sequence replication (3SR), and loop-mediated isothermal amplification (LAMP).

In yet another example, the present methods can further comprise purifying the target polynucleotides, a library of the target polynucleotides, amplified target polynucleotides or a library of amplified target polynucleotides.

The methylation status of target polynucleotides can be assessed using any suitable methods and/or regents. In some embodiments, the methylation status of target polynucleotides can be assessed using mass spectrometry, methylation-specific PCR (MSP), methylation-sensitive sequencing, e.g., bisulphite sequencing, the HpaII tiny fragment Enrichment by ligation-mediated PCR assay (HELP Assay), Glal hydrolysis and ligation adapter dependent PCR assay (GLAD-PCR assay), restriction landmark genomic scanning (RLGS), methylated DNA immunoprecipitation (MeDIP or mDIP), pyrosequencing, molecular break light assay for DNA adenine methyltransferase activity, methyl sensitive Southern blotting or high resolution Melt (HRM) analysis.

In other embodiments, the methylation status of target polynucleotides can be assessed using a chemical agent, e.g., bisulfite or sodium bisulfite. In still other embodiments, the methylation status of target polynucleotides can be assessed using a biological agent, e.g., a polypeptide or an enzyme.

Any suitable enzyme can be used. In some embodiments, the enzyme can be a methylation-sensitive restriction enzyme (MSRE). The MSRE can selectively cleave at a residue when it is unmethylated. The MSRE can also selectively cleave at the residue when it is methylated. Exemplary MSRE can be selected from the group consisting of HpaII, SalI, SalI-HF®, ScrFI, BbeI, NotI, SmaI, XmaI, MboI, BstBI, ClaI, MluI, NaeI, NarI, PvuI, SacII, HhaI, and a combination thereof.

In some embodiments, the enzyme can be a polynucleotide polymerase. The polynucleotide polymerase can be used in polynucleotide amplification reaction, e.g., PCR. Any suitable polynucleotide polymerase can be used. For example, the polynucleotide polymerase can be a DNA polymerase, e.g., a DNA polymerase without a 3' to 5' exonuclease activity.

In some embodiments, the methylation status of target polynucleotides can be assessed using methylation-sensitive sequencing, e.g., bisulphite sequencing. Bisulfite conversion is a method that uses bisulfite to determine the methylation pattern of DNA. DNA methylation is a biochemical process involving the addition of a methyl group to the cytosine or adenine DNA nucleotides. DNA methylation stably alters the expression of genes in cells as cells divide and differentiate from embryonic stem cells into specific tissues. In bisulfite conversion, target nucleic acids are first treated with bisulfite reagents that specifically convert un-methylated cytosines to uracils while having no impact of methylated cytosine. One consequence of bisulfite conversion is that the double-stranded conformation of the original target is disrupted due to loss of sequence complementarity. The target sequences exist as two separate single-stranded DNAs during sample preparation and analytical or diagnostic testing. Target nucleic acid sequences frequently also exist at very low concentrations. This is an especially important consideration for circulating tumor DNA (also referred to as "cell-free tumor DNA," or "ctDNA") due to its often low concentration in circulation and the very low variant allele fraction.

Any suitable format of methylation-sensitive sequencing can be used. For example, the methylation-sensitive sequencing can be conducted with a format selected from the group consisting of Maxam-Gilbert sequencing, a chain-termination method, shotgun sequencing, bridge PCR, single-molecule real-time sequencing, ion semiconductor (ion torrent sequencing), sequencing by synthesis, sequencing by ligation (SOLiD sequencing), chain termination (Sanger sequencing), massively parallel signature sequencing (MPSS), polony sequencing, 454 pyrosequencing, Illumina (Solexa) sequencing, DNA nanoball sequencing, heliscope single molecule sequencing, single molecule real time (SMRT) sequencing, nanopore DNA sequencing, tunnelling currents DNA sequencing, sequencing by hybridization, sequencing with mass spectrometry, microfluidic Sanger sequencing, a microscopy-based technique, RNAP sequencing, and in vitro virus high-throughput sequencing.

In some embodiments, the present methods can further comprise, prior to the methylation-sensitive sequencing, e.g., bisulphite sequencing, obtaining a library of linear, single-stranded ligation products, each of the linear, single-stranded ligation products comprises of a linear, single-stranded target polynucleotide linked to an adaptor comprising a unique molecular identifier (UMI) sequence that earmarks the single-stranded target polynucleotide to which the adaptor is ligated. The sequencing reads from the target polynucleotides can be first adapter trimmed to remove any adapter sequence originating from the library construction process to obtain trimmed sequencing reads. The trimmed sequencing reads can be mapped to a reference genome, e.g., a human reference genome, using an alignment program to obtain an aligned read file. The aligned read file can be grouped into sets corresponding to each target region from Target 1 to Target 1849 listed in Table 1, or a complementary or substantially complementary sequence thereof, that can be used for methylation status assessment.

Methylation status of one, more or each of the target polynucleotides can be assessed. In some embodiments, the methylation status of each of the target polynucleotides can be assessed to obtain a methylation metric, e.g., in the form of average methylation frequency, methylation haplotype load, unmethylation haplotype load, percent discordant reads, or a combination thereof.

Methylation status of a sample can be assessed using the methylation metrics from each of the target polynucleotides. The methylation metrics can be analyzed or used in any suitable manner. For example, the methylation metric for each of the target polynucleotides can be compared to a threshold or reference value to assess methylation status of a sample.

In another example, a numerical methylation matrix can be computed using the methylation metrics from each of the target polynucleotides to assess methylation status of a sample. The numerical methylation matrix can be in any suitable format. In some embodiments, the numerical methylation matrix from a sample can comprise a single numerical number or value. In other embodiments, the numerical methylation matrix from a sample can comprise multiple numerical numbers or values. The numerical methylation matrix can be obtained or computed using any suitable formulae or algorithm. In some embodiments, the numerical methylation matrix can be computed using a classification algorithm, e.g., linear discriminant analysis, logistic regression, naïve bayes classification, perceptron classification, quadratic classification, k-nearest neighbors, boosting, decision tree, random forest, neural network, learning vector quantization, or support vector machines, or a combination thereof.

The methylation matrix can be used in any suitable manner in assess methylation status of a sample. For example, the methylation matrix can be compared to a threshold or reference value to assess methylation status of a sample.

The methylation status of at least two target polynucleotides from multiple samples, e.g., multiple samples from multiple subjects, can be assessed sequentially or simultaneously. In some embodiments, the methylation status of at least two target polynucleotides from multiple samples, e.g., multiple samples from multiple subjects, can be assessed sequentially. For example, methylation status of at least 2, 3, 4, 5, 6, 7, 8, 9, 10, 20, 30, 40, 50, 60, 70, 80, 90, 100, 200, 300, 400, 500, 600, 700, 800, 900, 1,000, 1,100, 1,200, 1,300, 1,400, 1,500, 1,600, 1,700, 1,800, more of the iso-lated polynucleotides, or the isolated polynucleotides corresponding to all of Target 1 to Target 1849 listed in Table 1, or a numerical range or subrange thereof, can be assessed sequentially. In other embodiments, the methylation status of at least two target polynucleotides from multiple samples, e.g., multiple samples from multiple subjects, can be assessed simultaneously. For example, methylation status of at least 2, 3, 4, 5, 6, 7, 8, 9, 10, 20, 30, 40, 50, 60, 70, 80, 90, 100, 200, 300, 400, 500, 600, 700, 800, 900, 1,000, 1,100, 1,200, 1,300, 1,400, 1,500, 1,600, 1,700, 1,800, more of the isolated polynucleotides, or the isolated polynucleotides corresponding to all of Target 1 to Target 1849 listed in Table 1, or a numerical range or subrange thereof, can be assessed simultaneously.

In some embodiments, the methylation metric for each of the target polynucleotides is obtained using a computer. In other embodiments, the methylation matrix of a sample is obtained using a computer based on the methylation metrics from each of the target polynucleotides.

The present methods can be used for any suitable purpose. For example, the present methods can be used for diagnosis, prognosis, stratification, risk assessment, or treatment monitoring of cancer or neoplasia in a subject.

The present methods can be used for assessing any suitable type of cancer or neoplasia in a subject. For example, the present methods can be used for assessing a lymphoma, a leukemia, a brain cancer, a multiple myeloma, a pancreatic cancer, a liver cancer, a stomach cancer, a breast cancer, a kidney cancer, a lung cancer, a colorectal cancer, a colon cancer, a prostate cancer, an ovarian cancer, a cervical cancer, a skin cancer, an esophagus cancer, or a head and neck cancer in a subject.

In some embodiments, the present methods can be used for diagnosis, prognosis, stratification, risk assessment, or treatment monitoring of lung cancer in a subject. The lung cancer can be non-small-cell lung carcinoma or small-cell lung carcinoma. Exemplary non-small-cell lung carcinoma can be adenocarcinoma of the lung (also known as pulmonary adenocarcinoma), squamous-cell carcinoma (SCC) of the lung or large-cell carcinoma (LCC).

In other embodiments, the present methods can be used for diagnosis, prognosis, stratification, risk assessment, or treatment monitoring of colorectal cancer in a subject. In still other embodiments, the present methods can be used for diagnosis, prognosis, stratification, risk assessment, or treatment monitoring of pan-cancer analysis or profiling in a subject.

The cancer or neoplasia in multiple subjects can be assessed sequentially or simultaneously. In some embodiments, the cancer or neoplasia in multiple subjects can be assessed sequentially. For example, the cancer or neoplasia in at least 2, 3, 4, 5, 6, 7, 8, 9, 10, 20, 30, 40, 50, 60, 70, 80, 90, 100, 200, 300, 400, 500, 600, 700, 800, 900, 1,000, 1,100, 1,200, 1,300, 1,400, 1,500, 1,600, 1,700, 1,800, 1,900, 2,000, 3,000, 4,000, 5,000, 6,000, 7,000, 8,000, 9,000, 10,000 or more subjects can be assessed sequentially. In other embodiments, the cancer or neoplasia in multiple subjects can be assessed simultaneously. For example, the cancer or neoplasia in at least 2, 3, 4, 5, 6, 7, 8, 9, 10, 20, 30, 40, 50, 60, 70, 80, 90, 100, 200, 300, 400, 500, 600, 700, 800, 900, 1,000, 1,100, 1,200, 1,300, 1,400, 1,500, 1,600, 1,700, 1,800, 1,900, 2,000, 3,000, 4,000, 5,000, 6,000, 7,000, 8,000, 9,000, 10,000 or more subjects can be assessed simultaneously.

The present tests can have any suitable sensitivity. For example, the present tests can have a sensitivity of at least 10%, 20%, 30%, 40%, 50%, 60%, 70%, 80%, 90%, 91%, 92%, 93%, 94%, 95%, 96%, 97%, 98%, 99%, 99.9%, 99.999%, 99.9999%, or 100%.

The present tests can have any suitable specificity. For example, the present tests can have a specificity of at least 10%, 20%, 30%, 40%, 50%, 60%, 70%, 80%, 90%, 91%, 92%, 93%, 94%, 95%, 96%, 97%, 98%, 99%, 99.9%, 99.999%, 99.9999%, or 100%.

The present methods can further comprise treating a subject or altering treatment of a subject based on the assessment of cancer or neoplasia in the subject. For example, the present methods can further comprise treating a human patient or altering treatment of a human patient based on the assessment of cancer or neoplasia in the human patient. Exemplary treatment can be chemotherapy, radiotherapy, immunotherapy, cell therapy, surgery, treatment with a drug, e.g., a small molecule drug or a large molecule drug such an antibody drug.

The present methods can further comprise subjecting a subject to further tests, e.g., gold-standard diagnostic or prognostic test(s), based on the assessment of cancer or neoplasia in the subject. For example, the present methods can further comprise subjecting a human patient to further tests, e.g., gold-standard diagnostic or prognostic test(s), based on the assessment of cancer or neoplasia in the human patient. Exemplary test can be any suitable type of tests, e.g., in vivo test, in vitro test, tests on molecules such as DNA, RNA, protein, peptide, a complex or combination thereof, immunotest, molecular test, cellular test, tissue test, organ test or whole-body test, etc.

E. Exemplary Data Analysis Methods

Preprocessing

In some embodiments, sequencing reads are first adapter trimmed (to remove any synthetic adapter sequence originating from the sequencing library construction process) using a trimming program such as Cutadapt (http://journal-.embnet.org/index.php/embnetjournal/article/view/200/479) or Trimmomatic (https://www.ncbi.nlm.nih.gov/pubmed/24695404). Trimmed reads are then mapped to the human reference genome using an alignment program such as Bowtie (http://bowtie-bio.sourceforge.net/index.shtml), Bowtie2 (http://bowtie-bio.sourceforge.net/bowtie2/index.shtml), or BWA (http://bio-bwa.sourceforge.net). The resultant aligned read file is then sorted and indexed using a suitable tool, e.g., Samtools (https://github.com/samtools/samtools). Reads are then grouped into sets corresponding to each target region that can be used for methylation metric computation.

Methylation Metric Computation

In some embodiments, for each target, a "methylation metric" representing that individual region's methylation state is computed using the aligned reads. Four metrics that can be used are Average Methylation Frequency (AMF), Methylation Haplotype Load (MHL), UnMethylation Haplotype Load (UMHL), and Percent Discordant Reads (PDR).

Average Methylation Frequency is computed by summing the number of cytosine bases observed at CpG sites within the target region and dividing by the number of cytosine and thymine bases observed at CpG sites within the target region:

$$AMF = \frac{\sum_{i=1}^{N} C_i}{\sum_{i=1}^{N} C_i + T_i}$$

Where N is the number of reads within the target region, i is the ith read in the target region, $C_i$ is the number of cytosines observed in the ith read, and $T_i$ is the number of thymines observed in the ith read.

Methylation Haplotype Load is computed by taking all possible substrings of adjacent CpG sites within a target region and calculating a weighted sum of the fraction of reads showing full methylation within each substring:

$$MHL = \frac{\sum_{L_i=1}^{n} L_i \frac{C_i}{N_i}}{\sum_{L_i=1}^{n} L_i}$$

Where n is the number of CpG sites within the target region, $L_i$ is the length of the current substring, $C_i$ is the number of reads containing all cytosines at CpG sites within substrings of length $L_i$, and $N_i$ is the number of reads containing a substring of length $L_i$.

Unmethylation Haplotype Load is computed by taking all possible substrings of adjacent CpG sites within a target region and calculating a weighted sum of the fraction of reads showing no methylation within each substring:

$$UMHL = \frac{\sum_{L_i=1}^{n} L_i \frac{T_i}{L_i}}{\sum_{L_i=1}^{n} L_i}$$

Where n is the number of CpG sites within the target region, $L_i$ is the length of the current substring, $T_i$ is the number of reads containing all thymines at CpG sites within substrings of length $L_i$, and $N_i$ is the number of reads containing a substring of length $L_i$.

Percent Discordant Reads is computed by taking one hundred minus the percent of reads within each region showing all cytosines or all thymines at CpG sites within the target region:

$$PDR = 100\left(1 - \frac{C_i + T_i}{N_i}\right)$$

Where $N_i$ is the number of reads within the target region, $C_i$ is the number of reads containing cytosines at all covered CpG sites, and $T_i$ is the number of reads containing thymines at all covered CpG sites.

Classification

In some embodiments, using the methylation metrics for each target region, a numerical matrix is computed (with one row for each target region, one column for each sample, and values representing the methylation metric for that region and sample). Samples are then classified using a classification algorithm such as linear discriminant analysis, logistic regression, naïve bayes classification, perceptron classification, quadratic classification, k-nearest neighbors, boosting, decision tree, random forest, neural network, learning vector quantization, or support vector machines, or a combination thereof.

logistic regression, k-nearest neighbors, random forest, or support vector machines.

Logistic Regression classification involves curve-fitting an equation for the probability of a sample being cancerous to the weighted sum of methylation metric values using a set of known samples. Using a least-squares regression on data from samples with known categories, the parameters for the below equation are estimated:

$$\log\left(\frac{p}{1-p}\right) = \beta_0 + \sum_{i}^{n} \beta_i M_i$$

Where n is the set of target regions, i is the current target region, $M_i$ is the methylation metric value for the ith target region, $\beta_i$ is the least-square parameter for the ith target region, and p is the probability that the sample is a cancer sample. Once the parameters for this equation are derived using known samples, an unknown sample can be classified as cancer or healthy by computing the weighted sum of methylation metric values, computing the probability using the derived equation, and comparing to a threshold.

K-nearest neighbor algorithm classifies an unknown sample using the distance of methylation metric values between the unknown sample and its k closest neighbors with known categories. First, the distances (in this case Euclidean distances) between the methylation metric values of the current sample and all other samples are computed:

$$E_1 = \sqrt{\sum_{i}^{N} \sum_{j}^{n} (M_j - m_{ij})^2}$$

Where N is the set of known samples, i is the current known sample, n is the set of target regions, j is the current target region, $M_j$ is the methylation metric value of the unknown sample in the jth target region, $m_{ij}$ is the methylation metric value of the ith known sample in the jth target region, and $E_i$ is the Euclidean distance between the current sample and the ith known sample. The categories of the k known samples with the lowest Euclidean distance are used to determine the category of the unknown sample; the category with the highest occurrence is assigned to the unknown sample.

In K-Nearest Neighbors, an unknown sample is classified as either normal or cancer by identifying the k known samples that it is most similar to (where k is any number of our choice). If an unknown sample is more similar to known normal samples, we classify it as normal; if it is more similar to cancer samples, we classify it as cancer. The following is a hypothetical example that illustrates how K-Nearest Neighbors analysis may be conducted.

Suppose we are looking at 2 target regions and using the MHL methylation metric for our assay, and we want to use a K nearest neighbors approach with k=3. We would first run some samples that we know are healthy and some samples that we know are cancer, and compute the MHL values for each target in each sample. Suppose we ran 4 known samples of each type, and obtained the matrix shown in Table 2 below.

TABLE 2

|  | Normal 1 | Normal 2 | Normal 3 | Normal 4 | Cancer 1 | Cancer 2 | Cancer 3 | Cancer 4 |
|---|---|---|---|---|---|---|---|---|
| Target 1 | 1 | 0.9 | 0.93 | 0.85 | 0.1 | 0 | 0.05 | 0.08 |
| Target 2 | 0.05 | 0 | 0.1 | 0.2 | 0.98 | 0.7 | 1.0 | 0.6 |

We could then process an unknown sample. Suppose we ran an unknown sample, and obtained the values shown in Table 3 below.

TABLE 3

|  | UNKNOWN |
|---|---|
| Target 1 | 0.2 |
| Target 2 | 0.8 |

Based on the values we observed, we identify the k=3 samples that are most similar to our unknown sample shown in Table 4 below.

TABLE 4

|  | UNKNOWN | Cancer 1 | Cancer 2 | Cancer 4 |
|---|---|---|---|---|
| Target 1 | 0.2 | 0.1 | 0 | 0.08 |
| Target 2 | 0.8 | 0.98 | 0.7 | 0.6 |

Because a majority of these 3 Nearest Neighbors are CANCER, we classify the UNKNOWN sample as CANCER.

Random Forest classification involves creating multiple decision trees using a randomly chosen subset of samples with known categories and a subset of target regions; the methylation metric values of an unknown sample are then subjected to each individual decision tree, and the majority vote is used for classification. For example, using known data, the following three decision trees might be constructed:

$$MHL_1 \begin{cases} \geq 0.5\text{:Cancer} \\ < 0.5\text{:Healthy} \end{cases}$$

$$MHL_2 \begin{cases} \geq 0.1\text{:Cancer} \\ < 0.1\text{:Healthy} \end{cases}$$

$$MHL_3 \begin{cases} \geq 0.2\text{:Cancer} \\ < 0.2\text{:Healthy} \end{cases}$$

An unknown sample containing the MHL values ($MHL_1$: 0.6, $MHL_2$: 0.2, $MHL_3$: 0.6) would then be classified as Cancer, as it would have two votes for cancer and one vote for healthy.

Support Vector Machines construct a hyperplane between known samples of different categories that maximizes the distance between each known sample and the hyperplane.

This plane is then used as a "divider" to classify unknown samples, with samples falling on different sides of the plane being categorized differently. To illustrate an example using 2 target regions, the methylation metric values of known samples are plotted in space, and a hyperplane is drawn between the different groups (see FIG. 1), where $X_1$ is the methylation metric value of the first target region, $X_2$ is the methylation metric value of the second target region, known cancer samples are drawn in black, known healthy samples are drawn in white, and the black line represents the hyperplane. To classify an unknown sample (shown in orange), the methylation metric values are compared to the hyperplane; if the sample falls on the same side as the healthy known samples (as it does here), the sample is classified as healthy. Image of FIG. 1 is taken from Wikipedia: https://en.wikipedia.org/wiki/Support vector machine) for illustration purpose only, and does not represent any DNA methylation status analysis or cancer assessment.

F. Exemplary Polynucleotide Fragment Analysis by Library Construction and Polynucleotide Sequencing In one aspect, the target (or template) polynucleotide of the present method is a fragmented polynucleotide, for example, ranging from about 100 residues to about 1000 residues, and in some embodiments, ranging from about 150 residues to about 400 residues.

The target or template DNA can include be regular genomic DNA, chromosomal DNA, extrachromosomal DNA (such as mitochondrial DNA), or a fragment thereof. In other embodiments, the target or template DNA is a processed DNA, for example, one that has undergone enzyme digestion, cross-linking, chemical or physical shearing, bisulfite conversion, and/or degradation.

Bisulfite conversion is a method that uses bisulfite to determine the methylation pattern of DNA. DNA methylation is a biochemical process involving the addition of a methyl group to the cytosine or adenine DNA nucleotides. DNA methylation stably alters the expression of genes in cells as cells divide and differentiate from embryonic stem cells into specific tissues. In bisulfite conversion, target nucleic acids are first treated with bisulfite reagents that specifically convert un-methylated cytosines to uracils while having no impact of methylated cytosine. One consequence of bisulfite conversion is that the double-stranded conformation of the original target is disrupted due to loss of sequence complementarity. The target sequences exist as two separate single-stranded DNAs during sample preparation and analytical or diagnostic testing. Target nucleic acid sequences frequently also exist at very low concentrations. This is an especially important consideration for circulating tumor DNA (also referred to as "cell-free tumor DNA," or "ctDNA") due to its often low concentration in circulation and the very low variant allele fraction.

In some embodiments, the nucleic acid molecule of interest disclosed herein is a cell-free DNA, such as cell-free fetal DNA (also referred to as "cfDNA") or ctDNA. cfDNA circulates in the body, such as in the blood, of a pregnant mother, and represents the fetal genome, while ctDNA circulates in the body, such as in the blood, of a cancer patient, and is generally pre-fragmented. In other embodiments, the nucleic acid molecule of interest disclosed herein is an ancient and/or damaged DNA, for example, due to storage under damaging conditions such as in formalin-fixed samples, or partially digested samples.

As cancer cells die, they release DNA into the bloodstream. This DNA, known as circulating tumor DNA (ctDNA), is highly fragmented, with an average length of approximately 150 base pairs. Once the white blood cells are removed, ctDNA generally comprises a very small fraction of the remaining plasma DNA, for example, ctDNA may constitute less than about 10% of the plasma DNA. Generally, this percentage is less than about 1%, for example, less than about 0.5% or less than about 0.01%. Additionally, the total amount of plasma DNA is generally very low, for example, at about 10 ng/mL of plasma.

The variants in the ctDNA can be interrogated using various methods, including next generation sequencing. Due to the low ratio of ctDNA to plasma DNA, it is difficult to call a variant with high confidence due to PCR and sequencing errors. Unique molecular identifiers (UMIs) are generally used to tag original molecules such that any variant seen can be compared to a consensus sequence. This is an effective manner to separate true from false positives. If the variant is matched to a consensus, it is a true positive. Otherwise, it is removed from analysis. Furthermore, it is essential that a high percentage of original molecules are turned into sequencing libraries so that the sensitivity remains high, i.e., variants are not missed due to dropout. Thus, ligation efficiency is extremely important during library construction.

In one aspect, provided herein is a technique to vastly improve ligation efficiency while still targeting selected regions of the genome. In one embodiment, polynucleotides to be detected by sequencing, such as ctDNA, are first dephosphorylated to remove 5' phosphates to prevent ligation of ctDNA to itself. The ctDNA is then denatured such that all DNA is single stranded. Circligase™, a single stranded DNA ligase, is used to ligate an adapter to the 3' end of the ctDNA. In one aspect, the adapter contains 2 specific bases on the 5' end to optimize ligation efficiency, followed by a UMI. In one aspect, the 3' end of the adapter contains a carbon spacer to prevent self-ligation of the adapters. In another aspect, the ligation reaction is further optimized using a crowding agent, such as PEG 4000. In one aspect, following ligation, molecules are double-stranded using a primer that is reverse complement to the adapter. This allows efficient removal of excess unligated adapters without removed usable DNA by a standard purification.

In one aspect, the DNA is then amplified using a semi-targeted PCR. One primer is reverse complement to the adapter, while the other (e.g., as one primer in a primer pool) anneals to specific, targeted regions of the genome. The specific primers were designed to minimize primer-dimer interactions and off-target annealing. In one aspect, the target-specific primers are further optimized to land in close proximity to specific variants due to the small DNA size. Following another cleanup, a PCR adds the full-length sequencing adapters and barcodes. The final library is then sequenced, for example, on an Illumina machine.

In one aspect, the semi-targeted PCR results in enrichments of >about 40,000 fold of the original molecule set despite having a relatively small target region of ~30,000 bp. In one aspect, the overall conversion rates of the present method are at least 60%, implying that at least ~3 times more of the original molecules are converted into sequenceable material when compared to standard library construction and hybridization capture. In other embodiments, the overall conversion rates are between about 60% and about 70%, between about 70% and about 80%, between about 80% and about 90%, or over 90%. In one aspect, the present method thus is able to accurately call genetic or genomic variants, such as SNVs, indels, CNVs, and fusions at extremely low mutant allele fractions, for example, as low as 0.01%. In other aspects, the allele fraction of the genetic or genomic variant is about 0.05%, about 0.1%, about 0.5%, about 1%, or about 2%.

The following sections describe certain steps of the present method in greater detail.

Single-Stranded Polynucleotide Libraries and Method of Constructing the Same

Library construction for next generation sequencing, for example, for ctDNA, generally consists of several steps, including end repair, A-tailing, and a double stranded ligation of an adapter molecule. These ligated molecules can then be enriched 1000-2000 times at certain genomic regions using hybridization capture. Despite several improvements in library construction over the last several years, the process remains inefficient, resulting in many original molecules lost during the various steps. Double stranded ligation efficiency remains low, with ~20-30% of the molecules being properly ligated. Additionally, many molecules are lost during the purification and hybridization capture steps, so that the final conversion rate approximates 10-20%. Sensitivity remains low when interrogating low allele fraction variants found in ctDNA. This limits the accuracy when calling low allele fraction mutants, since the low efficiency will result in sensitivity loss when looking at libraries with low allele fractions.

In addition, the small size of certain polynucleotides, such as ctDNA, prevents the use of tagmentation-based library construction. For example, the polynucleotides are first tagged (e.g., with biotin) to generate a targeted library, and then enriched by capturing the tags (e.g., by streptavidin). This way, the library for the regions of interest can be enriched by about 1000-2000 fold. Finally, a PCR is performed to amplify and index the molecules for sequencing. However, PCR based methods prove difficult to add UMIs to original molecules and result in high error rates.

In one aspect, the compositions, kits, and methods described herein addressed the above problems. In some embodiments, the compositions, kits, and methods are useful in sequencing nucleic acid molecules, including but not limited to construction of various libraries, various amplification reactions (such as by PCR and/or primer extension), purification of the constructed libraries, and analysis of sequencing reads.

In certain aspects, a sequencing library can be prepared, for example, from a sample containing fragmented polynucleotides, such as fragment DNA. In one aspect, the sample is obtained a naturally occurring sample, for example, directly from a subject, such as tissue fluid or body fluid, including but not limited to blood, plasma, serum, cerebrospinal fluid, synovial fluid, urine, sweat, semen, sputum, tear, mucus, or amniotic fluid. In other aspects, a sequencing library can be prepared by forming fragments of DNA (for example, by shearing the DNA), and attaching the adapters herein to the DNA fragments. In particular embodiments, the fragmented polynucleotides and the adapters are single-stranded.

The fragments (for example, the ctDNA or fragments formed by fragmenting longer DNA strands) are sometimes referred to as "inserts," as they can be "inserted" or ligated adjacent to an adapter such as a single-stranded adaptor disclosed herein. RNA molecules can also be sequenced, for example by reverse transcribing the RNA molecules to form DNA molecules, which are attached to the adapters.

In one aspect, a method comprising ligating a set of adaptors to a library of single-stranded polynucleotides is provided, and in the method, the ligation is catalyzed by a single-stranded DNA (ssDNA) ligase. As used herein, a ssDNA ligase is capable of ligating ends of ssDNA in the absence of a complementary sequence. For example, CircLigase™ ssDNA Ligase and CircLigase™ II ssDNA Ligase are both thermostable ligases that are typically used to catalyze intramolecular ligation (i.e., circularization) of ssDNA templates having a 5'-phosphate and a 3'-hydroxyl group. In contrast to T4 DNA Ligase and Ampligase® DNA Ligase, which ligate DNA ends that are annealed adjacent to each other on a complementary DNA sequence, a ssDNA ligase ligates ends of ssDNA in the absence of a complementary sequence. The enzyme is therefore useful for making circular ssDNA molecules from linear ssDNA. Circular ssDNA molecules can be used as substrates for rolling-circle replication or rolling-circle transcription. In addition to its activity on ssDNA, a CircLigase enzyme also has activity in ligating a single-stranded nucleic acid having a 3'-hydroxyl ribonucleotide and a 5'-phosphorylated ribonucleotide or deoxyribonucleotide.

Either CircLigase™ ssDNA Ligase or CircLigase™ II ssDNA Ligase can be used in the present disclosure. The two enzymes are different in that CircLigase I is far less adenylated than CircLigase II and requires ATP for best activity. CircLigase I recircularizes ssDNA in the presence of ATP. CircLigase II is nearly 100% adenylated, therefore it is not necessary to add ATP to the reaction buffer. CircLigase II works as a stoichiometric reaction, where the enzyme bonds the 5'-end of an oligo that is adenylated in the enzyme active site, and then ligates the oligo and stops. Since the reaction doesn't contain ATP, CircLigase II works in a 1:1 enzyme:oligo configuration. Once the circularization is complete, the circular ssDNA is released from the active site and the reaction stops.

In one aspect, each single-stranded polynucleotide is blocked at the 5' end to prevent ligation at the 5' end, each adaptor comprises a unique molecular identifier (UMI) sequence that earmarks the single-stranded polynucleotide to which the adaptor is ligated, each adaptor is blocked at the 3' end to prevent ligation at the 3' end, and the 5' end of the adaptor is ligated to the 3' end of the single-stranded polynucleotide by the ssDNA ligase to form a linear ligation product, thereby obtaining a library of linear, single-stranded ligation products. Template-independent circularization of single-stranded DNA is described in WO2010/094040 A1, the disclosure of which is incorporated herein in its entirety. WO2010/094040 A1, however, only discloses intramolecular ligation (e.g., circularization) of single-stranded polynucleotides.

Figure 6:
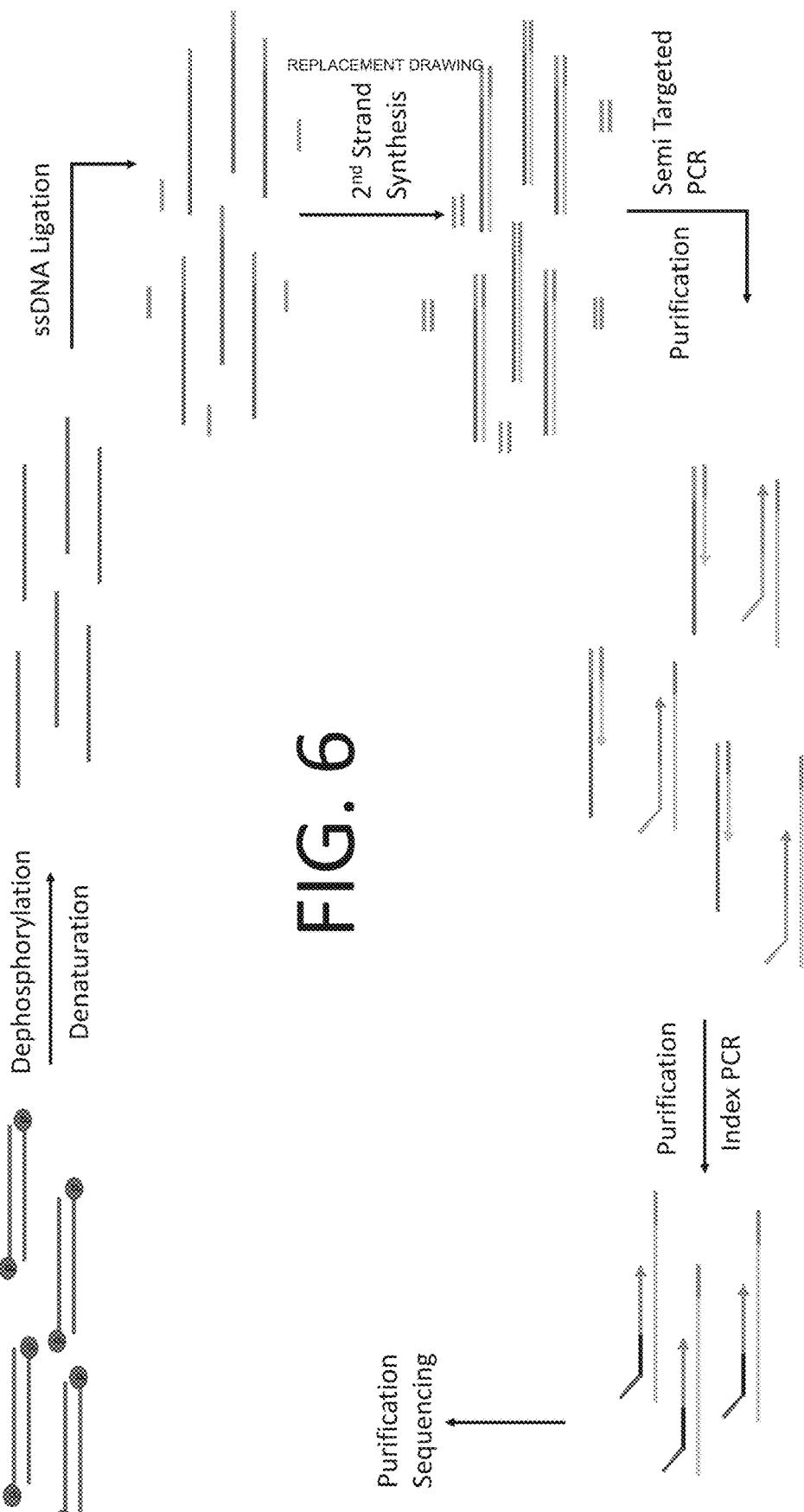
FIG. 6 illustrates steps for constructing a single-stranded polynucleotide library and performing sequencing analysis using the library, according to one aspect of the present disclosure.

Thus, the present method uses a ssDNA ligase, such as CircLigase or CircLigase II, in an unconventional manner. Instead of circularization, the present ligation method aims to generate a linear ligation product between the single-stranded target polynucleotide and an adaptor molecule. In one aspect, the present disclosure uses a ssDNA ligase to carry out intramolecular ligate, e.g., for ligating an adaptor to single-stranded polynucleotides. In order to do, in one aspect, the single-stranded polynucleotide is blocked at the 5' end to prevent circularization. This way, intramolecular ligation of the 3' end of an ssDNA to its own 5' end, as well as intermolecular ligation of the 3' end of one ssDNA to the 5' end of another ssDNA within the same library, is prevented. Thus, in one aspect, both circularization of the single-stranded polynucleotide and formation of linear concatemers (containing the single-stranded polynucleotides and/or the adaptors) are prevented during the ligation reaction. As shown in FIG. 6, the blocking of each single-stranded polynucleotide can comprise dephosphorylation at its 5' end to prevent ligation at that end.

In another aspect, each adaptor is blocked at the 3' end to prevent ligation at the 3' end. This way, intramolecular ligation of the 3' end of an adaptor to its own 5' end, as well as intermolecular ligation of the 3' end of one adaptor molecule to the 5' end of another adaptor molecule, is prevented. The blocking of each adaptor can comprise a carbon spacer, ddCTP, ddATP, ddTTP, ddGTP, hexanediol, triethylene glycol (TEG), and/or hexaethylene glycol, to prevent ligation at its 3' end. Thus, in one aspect, both circularization of the single-stranded adaptor and formation of linear concatemers (containing the single-stranded polynucleotides and/or the adaptors) are prevented during the ligation reaction.

The adaptor may comprise one or more copies of one or more spacers, in any suitable combination. For example, Gansauge and Meyer disclosed an adaptor that comprises ten copies of a C3Spacer and a biotinylated TEG spacer. Gansauge and Meyer (2013), "Single-stranded DNA library preparation for the sequencing of ancient or damaged DNA," *Nature Protocols,* 8(4): 737-48, which is incorporated herein by reference in its entirety. This reference, however, requires capturing the ligated ssDNA, via biotin-streptavidin interaction, immediately after ligation. This step may cause a significant loss of the ssDNA molecules in the library. The reference then converts the captured ssDNA to dsDNA while the ssDNA remains captured on a bead.

As shown in FIG. 6, the present disclosure does not require capturing the ligated ssDNA immediately after ligation. Instead, the ligated ssDNA remains in the ligation reaction volume when it is converted into dsDNA.

In one aspect, the ligation efficiency of the ssDNA in the library is high, for example, at least about 40%, at least about 50%, at least about 60%, at least about 70%, at least about 80%, at least about 85%, at least about 90%, at least about 95%, or at least about 99% of the single-stranded polynucleotides in the sample are ligated to an adaptor. In particular embodiments, the ligation efficiency is about 80%. With this vastly improved ligation efficiency, the presently claimed method is still capable of targeting selected regions of the genome, as explained below.

In one aspect, the adaptor has the following structure: /5'Phos/$N_1N_2 \ldots N_i$-UMI-$M_1M_2 \ldots M_j$-Blocker, wherein "5'Phos" represents a 5' phosphate group, "$N_1 N_2 \ldots N_i$" represents the sequence 5' to the UMI sequence, "$M_1M_2 \ldots M_j$" represents the sequence 3' to the UMI sequence, and "Blocker" indicates that the 3' end of the adaptor is blocked to prevent ligation thereto. Both i and j are integers, wherein i can be 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or greater than 30; and j can be 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or greater than 50. In specific embodiments, i can be 2. In some embodiments, the dinucleotide sequence $N_1N_2$ at the 5' end of $N_1N_2 \ldots N_i$ can be GA (5' to 3'), GG (5' to 3'), AA (5' to 3'), or AG (5' to 3'), in order to enhance the ligation efficiency.

In one aspect, a portion or all of the $M_1M_2 \ldots M_j$ sequence is used in later steps for designing a reverse-complement sequence that is used as a primer to convert the ligated single-stranded polynucleotide into a double-stranded polynucleotide, and/or for the semi-targeted PCR to amplify a selected target sequence (the other primer of the primer pair being the target-specific primer). In one aspect, the $M_1M_2 \ldots M_j$ sequence comprises AGATCG-GAAGAGCGTCGTGTAGGGAAAGAGTG (SEQ ID NO:17506) or a portion thereof that comprises between about 18 and 22 nucleotide residues.

In another aspect, the "Blocker" comprises a carbon spacer, ddCTP, ddATP, ddTTP, ddGTP, hexanediol, triethylene glycol (TEG), and/or hexaethylene glycol, in one or more copies of one or more blocker groups in any suitable combination and order in the 5' to 3' direction.

In one aspect, use of the UMI facilitates the determination, selection, and/or isolation of error-free sequencing reads of a target sequence, and the sequencing reads can be selected with high accuracy and high throughput. Such validated, error-free sequencing reads are useful in any technique that requires sequence fidelity, including the construction of larger molecules of known sequence, polymorphism and/or mutation screening, massively parallel sequencing, and quantification methods to preclude bias in the methodologies.

In one aspect, the Unique Molecular Identifier is associated with and uniquely identifies a ligated construct comprising a single-stranded target polynucleotide and an adaptor. In other words, two single-stranded target polynucleotides having the same sequence may be ligated to two different adaptors which differ from each other at their UMI sequences; the resultant ligation products are different, and each ligation product (rather than the target polynucleotides having the same sequence) is uniquely identified by the UMI. In another aspect, when the single-stranded ligation products are converted into double-stranded polynucleotides and amplified, amplification errors may be introduced during repeated copying even though very high fidelity polymerases are available. As a result, even a low error rate can have a significant impact, particularly in the construction of large libraries. Although massively parallel sequencing has advantages in cost and throughput, the accuracy of the reads can be comprised by the limitations of the amplification and/or detection technologies.

By using the UMI, the present method is capable of identifying error-free amplification products and/or sequencing reads, and excluding those with technical errors from analysis. The amplification products and/or sequencing reads having the same UMI can be confirmed as related (identical by descent), and thus sequence differences between molecules with the same UMI can be identified as technical errors rather than real differences in the sequence (e.g., sequence differences between a wild-type sequence and a cancer-related mutant sequence). In other words, since each single-stranded ligation product is unique identifiable by its UMI, all of its descendants (due to amplification and/or sequencing) should have the same target sequence if no technical error is introduced. If, however, an error such as a single-nucleotide insertion is introduced into the target sequence during amplification and/or sequencing, some amplification products and/or sequencing reads identical by descent (e.g., sharing the same UMI) will have the insertion while the others will not. The exact ratio between the products having the insertion and those that do not have the insert will vary, depending on when the error occurs during the amplification and/or sequencing process. In general, when very high fidelity polymerases are used, the products without errors will be in the majority. In another aspect, because amplification products and/or sequencing reads that are identical by descent can be identified, a consensus sequence can be determined using data from multiple molecules, thereby achieving a high accuracy for high throughput sequencing.

In one aspect, the UMI is a degenerate nucleic acid sequence, and the number of nucleotides in the UMI is designed such that the number of potential and actual sequences represented by the UMI sequences is greater than the total number of target single-stranded target polynucleotide in the initial library. In one aspect, UMI sequence diversity (or "uniqueness" with regard to each single UMI sequence) can be provided by using a degenerate collection of sequences randomly generated by synthesizing with a mixture of all four bases at each position. Alternatively, a diverse but pre-defined set of sequences can be synthesized and ligated to the initial single-stranded polynucleotide library. The diversity of the UMI set needs to be sufficient so that molecules that are not related by descent won't be mistaken as such. In one aspect, a "unique" molecular identifier need not be absolutely unique, and may be used on different target single-stranded polynucleotides provided it is clear that they are different and not mistaken for a molecule that is identical by descent. The large number of UMI sequences that can be generated from the random assembly of nucleotides provides a high probability that each individual ligation product can be uniquely identified. For example, if the UMI comprises a 12-mer synthesized with a mixture of A, C, G and T at each position, there are $4^{12}$ possible sequences. If the UMI comprises a 20-mer synthesized with a mixture of A, C, G and T at each position, there are $4^{20}$ (about $10^{12}$) possible sequences. The use of such random identifiers allows a large library with single-stranded target polynucleotides that can be individually distinguished from each other.

In particular aspects, the UMI is a 5-mer, 6-mer, 7-mer, 8-mer, 9-mer, 10-mer, 11-mer, 12-mer, 13-mer, 14-mer, 15-mer, 16-mer, 17-mer, 18-mer, 19-mer, 20-mer, 21-mer, 22-mer, 23-mer, 24-mer, 25-mer, or even longer degenerate sequence. In one aspect, the adaptor has the following structure: /5'Phos/GANNNNNNNNNNNNNAGATCG-GAAGAGCGTCGTGTAGGGAAAGAGTG/3SpC3/, wherein "NNNNNNNNNNNN" represents a 12-mer UMI sequence, and "3SpC3" represents a 3' carbon spacer. The sequence of GANNNNNNNNNNNNNAGATCG-GAAGAGCGTCGTGTAGGGAAAGAGTG is SEQ ID NO:17507.

The concentration of DNA can be artificially increased by adding condensing agents such as cobalt hexamine and biogenic polyamines such as spermidine, or by using crowding agents such as polyethylene glycol (PEG) which also increase the effective concentration of enzymes. In one aspect, additives such as cobalt hexamine can produce exclusively intermolecular reaction, resulting in linear ligation products rather than circular products. Thus, in case the 5' ends of the single-stranded target polynucleotides and the 3' ends of the single-stranded adaptor may not be completely blocked to prevent ligation, additives such as cobalt hexamine may be used to enhance intermolecular reaction and further prevent circularization of the single-stranded target polynucleotide and/or the adaptor.

In some embodiments, more than one configurations of the adaptor can be used in the same ligation reaction. For example, two configurations of the adaptor may be used:

Configuration No. 1: /5'Phos/$N_1N_2$ . . . $N_i$-$UMI_1$-$M_1M_2$ . . . $M_j$-$Blocker_1$, and Configuration No. 2: /5'Phos/$P_1P_2$ . . . $P_k$-$UMI_2$-$Q_1Q_2$ . . . $Q_l$-$Blocker_2$.

$N_1N_2$ . . . $N_i$ and $P_1P_2$ . . . $P_k$ can be the same or different, $UMI_1$ and $UMI_2$ can be the same or different, $M_1M_2$ . . . $M_j$ and $Q_1Q_2$ . . . $Q_l$, can be the same or different, and $Blocker_1$ and $Blocker_2$ can be the same or different. In one embodiment, $UMI_1$ is different from $UMI_2$ (for example, $UMI_1$ is a 12-mer degenerate sequence while $UMI_2$ is a 13-mer degenerate sequence), while the other features of the adaptors are the same. In another embodiment, $N_1N_2$ . . . $N_i$ is different from $P_1P_2$ . . . $P_k$ (for example, one is AG while the other is GA), while the other features of the adaptors are the same. In yet another embodiment, $M_1M_2$ . . . $M_j$ is different from $Q_1Q_2$ . . . $Q_l$, while the other features of the adaptors are the same. In still another embodiment, $Blocker_1$ and $Blocker_2$ are different, while the other features of the adaptors are the same.

After the ligation reaction, the single-stranded ligation products, without any need for purification (e.g., separation of the ligation products from the excess, unligated adaptor molecules), can be immediately subject to conversion into double-stranded ligation products. In addition, neither the single-stranded target polynucleotide nor the adaptor needs to be captured on a solid support (e.g., by biotin-streptavidin mediated binding to a bead) in order for the subsequent conversion of the ligation product into a double-stranded polynucleotide and/or amplification step. Thus, the present method avoids and/or reduces loss of the already small allele fraction of the mutant in a DNA sample, such as ctDNA, due to the purification or isolation of the single-stranded ligation products. Instead, in one aspect, the single-stranded ligation products remain in the solution which is directed subject to primer extension.

Conversion of Single-Stranded Polynucleotide Library to Double-Stranded Polynucleotide Library In one aspect as shown in FIG. 6, following construction of the library containing the single-stranded ligation products, the method can further comprise converting the library of linear, single-stranded ligation products into a library of linear, double-stranded ligation products. In one aspect, the conversion uses a primer or a set of primers each comprising a sequence that is reverse-complement to the adaptor and/or hybridizable to the adaptor.

For an adaptor having the following structure: /5'Phos/$N_1N_2$ . . . $N_i$-UMI-$M_1M_2$ . . . $M_j$-Blocker, the primer can comprise a sequence that is reverse-complement and/or hybridizable to $M_1M_2$ . . . $M_j$. In this example, when the primer hybridizes to the ligated product having the structure ssDNA-$N_1N_2$ . . . $N_i$-UMI-$M_1M_2$ . . . $M_j$-Blocker, the primer extension reaction can convert the ssDNA-$N_1N_2$ . . . $N_i$-UMI sequence (and optionally, all or a portion of the $M_1M_2$ . . . $M_j$ sequence) into double-stranded polynucleotides. In one specific example, a reverse-complement primer comprises the sequence set forth in SEQ ID NO:17505:

CACTCTTTCCCTACACGACGC (5' to 3').

In some embodiments, the primer may not be a perfect reverse-complement of $M_1M_2$ . . . $M_j$ or a portion therefore; nonetheless, the primer is hybridizable to $M_1M_2$ . . . $M_j$ (and thus the ssDNA ligated to the adaptor) under stringent conditions.

In any of the preceding embodiments, the method can further comprise amplifying and/or purifying the library of linear, double-stranded ligation products. In one aspect, the double-stranded ligation products are purified and size selected to remove unbound adaptor molecules and/or unbound primers, and/or complexes formed between an adaptor and its reverse-complement primer. Any suitable methods can be used to remove these fragments which are generally shorter than the desired double-stranded ligation products. For example, using PCR purification column from Qiagen could help to eliminate the smaller fragments from the samples and running the column-purified samples on 2% certified low range ultra agarose gel can help to select the desired fragment size. The beads-based DNA purification including AMPure method is also helpful to remove the smaller fragments. In some embodiments, the desired double-stranded ligation products size is from about 100 bps to about 600 bps, such as from about 100 bps to about 400 bps, from about 150 bps to about 200 bps, from about 200 bps to about 250 bps, and from about 250 bps to about 300 bps. In one embodiment, dsDNA (>150 bps and <400 bps) is purified and collected, for example, by eluting beads suspended in a Tri-EDTA buffer.

In one aspect, the purification is bead-based. In another aspect, the purification is based on size selection, for example, the purification step selectively purifies polynucleotides between about 50 nucleotides and about 1000 nucleotides in lengths, for example, adaptors of about 40 nucleotides in length (and primer dimers and/or primer-adaptor duplexes of about 40 bp) are removed. In one aspect, the purification is column-based, for example, by using a dsDNA or ssDNA purification column, such as those from Zymo or Qiagen.

In another aspect, the purification does not comprise using a specific binding pair (such as biotin/streptavidin), one of which is attached to the linear, double-stranded ligation product and the other is attached to a solid support (such as a bead).

In any of the preceding embodiments, the method herein can further comprise amplifying the library of linear, double-stranded ligation products, e.g., by a polymerase chain reaction (PCR), to obtain an amplified library of linear, double-stranded ligation products comprising sequence information of a target sequence. This amplification can be an unbiased amplification, for example, by ligating a universal adaptor pair to the ends of the double-stranded ligation products, and amplifying all the tagged double-stranded ligation products with a universal primer pair. In other embodiments, a semi-targeted amplification is conducted in lieu of or in addition to the unbiased amplification. The semi-targeted amplification can be performed before or after the unbiased amplification.

Semi-Targeted Amplification of Double-Stranded Polynucleotide Library

In one aspect, as shown in FIG. 6, a semi-targeted amplification of the double-stranded ligation product library comprises using a primer comprising a sequence that is reverse-complement and/or hybridizable to the adaptor, and a primer hybridizable to a target sequence (e.g., an EGFR gene sequence) or primers hybridizable to the same target sequence or multiple target sequences.

For an adaptor having the following structure: /5'Phos/$N_1N_2$ . . . $N_i$-UMI-$M_1M_2$ . . . $M_j$-Blocker, the primer can comprise a sequence that is reverse-complement and/or hybridizable to $M_1M_2$ . . . $M_j$. This way, when the primer hybridizes to one strand of the dsDNA and the target-specific primer hybridizes to the other strand of the dsDNA, the PCR product will contain a target sequence as well as the $N_1N_2$ . . . $N_i$-UMI sequence (and optionally, all or a portion of the $M_1M_2 \ldots M_j$ sequence). In one specific example, a reverse-complement primer comprises the sequence set forth in SEQ ID NO:17505: CACTCTTTCCCTA-CACGACGC (5' to 3').

In one aspect, a plurality of target-specific primers can be used, each comprising a sequence specific for the same or a different target sequence. In other words, the primers can have the same or different target sequences. In some embodiments, the pool of target-specific primers comprises about 5, about 10, about 25, about 50, about 100, about 150, about 200, about 250, about 300, about 400, about 500, about 600, about 700, about 800, about 900, about 1000, or more than about 1000 different primers, such as about $10^4$, about 105, about $10^6$, or more primers. In other embodiments, the pool comprises between about 20 and about 60, between about 60 and about 100, between about 100 and about 140, between about 140 and about 180, between about 180 and about 220, between about 220 and about 260, between about 260 and about 300, between about 300 and about 350, or between about 350 and about 400 different primers. In one aspect, the pool of target-specific primers are used together with one common reverse-complement primer, wherein the common reverse-complement primer forms a primer pair with each individual target-specific primer in the pool to amplify the target sequence in and/or between the primers in a semi-targeted fashion. Thus, in this aspect, the semi-targeted amplification is not a whole genome amplification.

Since ctDNA fragments randomly, in one aspect, the primer position of the target-specific primer may be important. For example, if the primer landing spans a break point, it may result in lower conversion rates. A larger target-specific primer pool and/or using multiple partially overlapping primers for the same target sequence may solve the problem.

In one aspect, the sequence information of the target sequence can comprise a mutation, a single nucleotide polymorphism (SNP), a copy number variation (CNV), or an epigenetic change. In one aspect, the mutation comprises a point mutation, an insertion, a deletion, an inversion, a truncation, a fusion, an amplification, or any combination thereof.

In some embodiments, the amplified library of linear, double-stranded ligation products can be a library other than a whole genome library, for example, a semi-targeted genome library.

In some embodiments, the method can further comprise purifying the amplified library of linear, double-stranded ligation products. Any suitable methods can be used to remove smaller fragments including primer dimers. For example, using PCR purification column from Qiagen could help to eliminate the smaller fragments from the samples and running the column-purified samples on 2% certified low range ultra agarose gel can help to select the desired fragment size. The beads-based DNA purification including AMPure method is also helpful to remove the smaller fragments. In some embodiments, the amplification product size is from about 100 bps to about 600 bps, such as from about 100 bps to about 400 bps, from about 150 bps to about 200 bps, from about 200 bps to about 250 bps, and from about 250 bps to about 300 bps. In one embodiment, dsDNA (>150 bps and <400 bps) is purified and collected, for example, by eluting beads suspended in a Tri-EDTA buffer.

In one aspect, the purification is bead-based. In another aspect, the purification is based on size selection, for example, the purification step selectively purifies polynucleotides greater about 150 nucleotides in lengths. In another aspect, the purification does not comprise using a specific binding pair (such as biotin/streptavidin), one of which is attached to the linear, double-stranded ligation product and the other is attached to a solid support (such as a bead). In one aspect, the purification is column-based, for example, by using a dsDNA or ssDNA purification column, such as those from Zymo or Qiagen.

Construction of Sequence Library and Analysis of Sequencing Reads

In one aspect, the method further comprises sequencing the purified amplified library of linear, double-stranded ligation products. In one aspect, the sequencing step comprises attaching a sequencing adapter and/or a sample-specific barcode to each linear, double-stranded ligation product. In one particular aspect, the attaching step is performed using a polymerase chain reaction (PCR).

Figure 7:
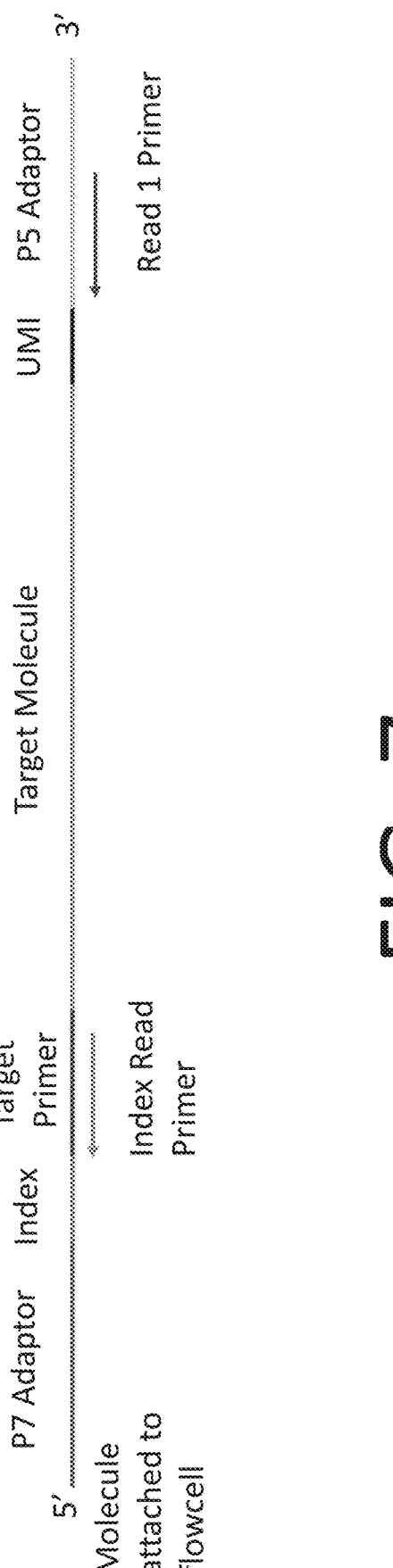
FIG. 7 illustrates a construct comprising a target molecule for sequencing, according to one aspect of the present disclosure.

FIG. 7 shows an exemplary configuration of a construct comprising a target molecule for sequencing. For Illumina sequencing, on each end, these constructs have flow cell binding sites, P5 and P7, which allow the library fragment to attach to the flow cell surface. The P5 and P7 regions of single-stranded library fragments anneal to their complementary oligos on the flowcell surface. The flow cell oligos act as primers and a strand complementary to the library fragment is synthesized. Then, the original strand is washed away, leaving behind fragment copies that are covalently bonded to the flowcell surface in a mixture of orientations. Copies of each fragment are then generated by bridge amplification, creating clusters. Then, the P5 region is cleaved, resulting in clusters containing only fragments which are attached by the P7 region. This ensures that all copies are sequenced in the same direction. The sequencing primer anneals to the P5 end of the fragment, and begins the sequencing by synthesis process. Index reads are performed when a sample is barcoded. When Read 1 is finished, everything from Read 1 is removed and an index primer is added, which anneals at the P7 end of the fragment and sequences the barcode. Then, everything is stripped from the template, which forms clusters by bridge amplification as in Read 1. This leaves behind fragment copies that are covalently bonded to the flowcell surface in a mixture of orientations. This time, P7 is cut instead of P5, resulting in clusters containing only fragments which are attached by the P5 region. This ensures that all copies are sequenced in the same direction (opposite Read 1). The sequencing primer anneals to the P7 region and sequences the other end of the template.

Next-generation sequencing platforms, such as MiSeq (Illumina Inc., San Diego, CA), can be used for highly multiplexed assay readout. A variety of statistical tools, such as the Proportion test, multiple comparison corrections based on False Discovery Rates (see Benjamini and Hochberg, 1995, *Journal of the Royal Statistical Society* Series B (Methodological) 57, 289-300), and Bonferroni corrections for multiple testing, can be used to analyze assay results. In addition, approaches developed for the analysis of differential expression from RNA-Seq data can be used to reduce variance for each target sequence and increase overall power in the analysis. See Smyth, 2004, Stat. Appl. Genet. Mol. Biol. 3, Article 3.

Overall, in some embodiments, the conversion rate of the present method is at least about 40%, at least about 50%, at least about 60%, at least about 70%, at least about 80%, at least about 90%, or at least about 95%. In one aspect, the conversion rate is the percentage of targeted single-stranded polynucleotides in the initial library that give rise to sequencing reads.

In any of the preceding embodiments, the method can be used for the diagnosis and/or prognosis of a disease or condition in a subject, predicting the responsiveness of a subject to a treatment, identifying a pharmacogenetics marker for the disease/condition or treatment, and/or screening a population for a genetic information. In one aspect, the disease or condition is a cancer or neoplasia, and the treatment is a cancer or neoplasia treatment.

Mutant DNA molecules offer unique advantages over cancer-associated biomarkers because they are so specific. Though mutations occur in individual normal cells at a low rate (about $10^{-9}$ to $10^{-10}$ mutations/bp/generation), such mutations represent such a tiny fraction of the total normal DNA that they are orders of magnitude below the detection limit of certain art methods. Several studies have shown that mutant DNA can be detected in stool, urine, and blood of CRC patients (Osborn and Ahlquist, Stool screening for colorectal cancer: molecular approaches, *Gastroenterology* 2005; 128:192-206).

Based on the sequencing results herein, detection of circulating tumor DNA in the patient can be made, and diagnosis of cancer and predictions regarding tumor recurrence can be made. Based on the predictions, treatment and surveillance decisions can be made. For example, circulating tumor DNA which indicates a future recurrence, can lead to additional or more aggressive therapies as well as additional or more sophisticated imaging and monitoring. Circulating DNA refers to DNA that is ectopic to a tumor.

Samples which can be monitored for ctDNA include blood and stool. Blood samples may be for example a fraction of blood, such as serum or plasma. Similarly stool can be fractionated to purify DNA from other components. Tumor samples are used to identify a somatically mutated gene in the tumor that can be used as a marker of tumor in other locations in the body. Thus, as an example, a particular somatic mutation in a tumor can be identified by any standard means known in the art. Typical means include direct sequencing of tumor DNA, using allele-specific probes, allele-specific amplification, primer extension, etc. Once the somatic mutation is identified, it can be used in other compartments of the body to distinguish tumor derived DNA from DNA derived from other cells of the body. Somatic mutations are confirmed by determining that they do not occur in normal tissues of the body of the same patient. Types of tumors which can be diagnosed and/or monitored in this fashion are virtually unlimited. Any tumor which sheds cells and/or DNA into the blood or stool or other bodily fluid can be used. Such tumors include, in addition to colorectal tumors, tumors of the breast, lung, kidney, liver, pancreas, stomach, brain, head and neck, lymphatics, ovaries, uterus, bone, blood, etc.

In one aspect, the method disclosed herein can be used to construct a library for use in sequencing and/or in determining an epigenetic status/state of one or more regions of the target sequence. DNA methylation was first the discovered epigenetic mark. Epigenetics is the study of changes in gene expression or cellular phenotype caused by mechanisms other than changes in the underlying DNA sequence. Methylation predominately involves the addition of a methyl group to the carbon-5 position of cytosine residues of the dinucleotide CpG and is associated with repression or inhibition of transcriptional activity.

Bisulfite conversion is the use of bisulfite reagents to treat DNA to determine its pattern of methylation. The treatment of DNA with bisulfite converts cytosine residues to uracil but leaves 5-methylcytosine residues unaffected. Thus, bisulfite treatment introduces specific changes in the DNA sequence that depend on the methylation status of the individual cytosine residues. Various analyses can be performed on the altered sequence to retrieve this information, for example, in order to differentiate between single nucleotide polymorphisms (SNP) resulting from the bisulfite conversion. U.S. Pat. Nos. 7,620,386, 9,365,902, and U.S. Patent Application Publication 2006/0134643, all of which are incorporated herein by reference, exemplify methods known to one of ordinary skill in the art with regard to detecting sequences altered due to bisulfite conversion.

As discussed above, one consequence of bisulfite conversion is that the double-stranded conformation of the original target is disrupted due to loss of sequence complementarity. While this may cause problem for traditional methods for constructing double-stranded libraries, in one aspect the present method is uniquely suited to construct single-stranded libraries from bisulfite conversion sample for sequencing analysis.

In another aspect, the present method can be used in combination with a method for determining a methylation state/status, for example, as described in U.S. Provisional application Ser. No. 62/487,422, entitled "Compositions and Methods for Detection of Genomic Variance and DNA Methylation Status," filed Apr. 19, 2017, which is incorporated herein by reference in its entirety for all purposes. In one embodiment, a sample is contacted with a methylation-sensitive restriction enzyme (MSRE) before the dephosphorylation and/or the denaturing step, and methylation profiles are then be analyzed by constructing a single-stranded library by ligation as disclosed herein.

Further Exemplary Embodiments

In any of the preceding embodiments, the ssDNA ligase can be a *Thermus* bacteriophage RNA ligase such as a bacteriophage TS2126 RNA ligase (e.g., CircLigase™ and CircLigase II™), or an archaebacterium RNA ligase such as *Methanobacterium* thermoautotrophicum RNA ligase 1. In other aspects, the ssDNA ligase is an RNA ligase, such as a T4 RNA ligase, e.g., T4 RNA ligase I, e.g., New England Biosciences, M0204S, T4 RNA ligase 2, e.g., New England Biosciences, M0239S, T4 RNA ligase 2 truncated, e.g., New England Biosciences, M0242S, T4 RNA ligase 2 truncated KQ, e.g., M0373S, or T4 RNA ligase 2 truncated K227Q, e.g., New England Biosciences, M0351S. In any of the preceding embodiments, the kit can also comprise a thermostable 5' App DNA/RNA ligase, e.g., New England Biosciences, M0319S, or T4 DNA ligase, e.g., New England Biosciences, M0202S.

In some embodiments, the present methods comprise ligating a set of adaptors to a library of single-stranded polynucleotides using a single-stranded DNA (ssDNA) ligase. Any suitable ssDNA ligase, including the ones disclosed herein, can be used. The adaptors can be used at any suitable level or concentration, e.g., from about 1 μM to about 100 μM such as about 1 μM, 10 μM, 20 μM, 30 μM, 40 μM, 50 μM, 60 μM, 70 μM, 80 μM, 90 μM, or 100 μM, or any subrange thereof. The adapter can comprise or begin with any suitable sequences or bases. For example, the adapter sequence can begin with all 2 bp combinations of bases.

In some embodiments, the ligation reaction can be conducted in the presence of a crowding agent. In one aspect, the crowding agent comprises a polyethylene glycol (PEG), such as PEG 4000, PEG 6000, or PEG 8000, Dextran, and/or Ficoll. The crowding agent, e.g., PEG, can be used at any suitable level or concentration. For example, the crowding agent, e.g., PEG, can be used at a level or concentration from about 0% (w/v) to about 25% (w/v), e.g., at about 0% (w/v), 1% (w/v), 2% (w/v), 3% (w/v), 4% (w/v), 5% (w/v), 6% (w/v), 7% (w/v), 8% (w/v), 9% (w/v), 10% (w/v), 11% (w/v), 12% (w/v), 13% (w/v), 14% (w/v), 15% (w/v), 16% (w/v), 17% (w/v), 18% (w/v), 19% (w/v), 20% (w/v), 21% (w/v), 22% (w/v), 23% (w/v), 24% (w/v), or 25% (w/v), or any subrange thereof.

In some embodiments, the ligation reaction can be conducted for any suitable length of time. For example, the ligation reaction can be conducted for a time from about 2 to about 16 hours, %, e.g., for about 2 hours, 3 hours, 4 hours, 5 hours, 6 hours, 7 hours, 8 hours, 9 hours, 10 hours, 11 hours, 12 hours, 13 hours, 14 hours, 15 hours, or 16 hours, or any subrange thereof.

In some embodiments, the ssDNA ligase in the ligation reaction can be used in any suitable volume. For example, the ssDNA ligase in the ligation reaction can be used at a volume from about 0.5 μl to about 2 μl, %, e.g., at about 0.5 μl, 0.6 μl, 0.7 μl, 0.8 μl, 0.9 μl 1 μl, 1.1 μl, 1.2 μl, 1.3 μl, 1.4 μl, 1.5 μl, 1.6 μl, 1.7 μl, 1.8 μl, 1.9 μl, or 2 μl, or any subrange thereof.

In some embodiments, the ligation reaction can be conducted in the presence of a ligation enhancer, e.g., betaine. The ligation enhancer, e.g., betaine, can be used at any suitable volume, e.g., from about 0 ul to about 1 μl, e.g., at about 0 μl, 0.1 μl, 0.2 μl, 0.3 μl, 0.4 μl, 0.5 μl, 0.6 μl, 0.7 μl, 0.8 μl, 0.9 μl, 1 μl, or any subrange thereof.

In some embodiments, the ligation reaction can be conducted using a T4 RNA ligase I, e.g., the T4 RNA ligase I from New England Biosciences, M0204S, in the following exemplary reaction mix (20 μl): 1× Reaction Buffer (50 mM Tris-HCl, pH 7.5, 10 mM MgCl2, 1 mM DTT), 25% (wt/vol) PEG 8000, 1 mM hexamine cobalt chloride (optional), 1 μl (10 units) T4 RNA Ligase, and 1 mM ATP. The reaction can be incubated at 25° C. for 16 hours. The reaction can be stopped by adding 40 μl of 10 mM Tris-HCl pH 8.0, 2.5 mM EDTA.

In some embodiments, the ligation reaction can be conducted using a Thermostable 5' App DNA/RNA ligase, e.g., the Thermostable 5' App DNA/RNA ligase from New England Biosciences, M0319S, in the following exemplary reaction mix (20 μl): ssDNA/RNA Substrate 20 μmol (1 μmol/ul), 5' App DNA Oligonucleotide 40 μmol (2 μmol/μl), 10×NEBuffer 1 (2 μl), 50 mM MnCl2 (for ssDNA ligation only) (2 μl), Thermostable 5' App DNA/RNA Ligase (2 μl (40 μmol)), and Nuclease-free Water (to 20 μl). The reaction can be incubated at 65° C. for 1 hour. The reaction can be stopped by heating at 90° C. for 3 minutes.

In some embodiments, the ligation reaction can be conducted using a T4 RNA ligase 2, e.g., the T4 RNA ligase 2 from New England Biosciences, M0239S, in the following exemplary reaction mix (20 μl): T4 RNA ligase buffer (2 μl), enzyme (1 μl), PEG (10 μl), DNA (1 μl), Adapter (2 μl), and water (4 μl). The reaction can be incubated at 25° C. for 16 hours. The reaction can be stopped by heating at 65° C. for 20 minutes.

In some embodiments, the ligation reaction can be conducted using a T4 RNA ligase 2 Truncated, e.g., the T4 RNA ligase 2 Truncated from New England Biosciences, M0242S, in the following exemplary reaction mix (20 μl): T4 RNA ligase buffer (2 μl), enzyme (1 μl), PEG (10 μl), DNA (1 μl), Adapter (2 μl), and water (4 μl). The reaction can be incubated at 25° C. for 16 hours. The reaction can be stopped by heating at 65° C. for 20 minutes.

In some embodiments, the ligation reaction can be conducted using a T4 RNA ligase 2 Truncated K227Q, e.g., the T4 RNA ligase 2 Truncated K227Q from New England Biosciences, M0351S, in the following exemplary reaction mix (20 μl): T4 RNA ligase buffer (2 μl), enzyme (1 μl), PEG (10 μl), DNA (1 μl), Adenylated Adapter (0.72 μl), and water (5.28 μl). The reaction can be incubated at 25° C. for 16 hours. The reaction can be stopped by heating at 65° C. for 20 minutes.

In some embodiments, the ligation reaction can be conducted using a T4 RNA ligase 2 Truncated KQ, e.g., the T4 RNA ligase 2 Truncated KQ from New England Biosciences, M0373S, in the following exemplary reaction mix (20 μl): T4 RNA ligase buffer (2 μl), enzyme (1 μl), PEG (10 μl), DNA (1 μl), Adenylated Adapter (0.72 μl), and water (5.28 μl). The reaction can be incubated at 25° C. for 16 hours. The reaction can be stopped by heating at 65° C. for 20 minutes.

In some embodiments, the ligation reaction can be conducted using a T4 DNA ligase, e.g., the T4 DNA ligase from New England Biosciences, M0202S, in the following exemplary reaction mix (20 μl): T4 RNA ligase buffer (2 μl), enzyme (1 μl), PEG (10 μl), DNA (1 μl), Adenylated Adapter (0.72 μl), and water (5.28 μl). The reaction can be incubated at 16° C. for 16 hours. The reaction can be stopped by heating at 65° C. for 10 minutes.

The second strand synthesis step can be conducted using any suitable enzyme. For example, the second strand synthesis step can be conducted using Bst polymerase, e.g., New England Biosciences, M0275S or Klenow fragment (3'->5' exo-), e.g., New England Biosciences, M0212S.

In some embodiments, the second strand synthesis step can be conducted using Bst polymerase, e.g., New England Biosciences, M0275S, in the following exemplary reaction mix (10 μl): water (1.5 μl), primer (0.5 μl), dNTP (1 μl), ThermoPol Reaction buffer (5 μl), and Bst (2 μl). The reaction can be incubated at 62° C. for 2 minutes and at 65° C. for 30 minutes. After the reaction, the double stranded DNA molecules are further purified.

In some embodiments, the second strand synthesis step can be conducted using Klenow fragment (3'->5' exo-), e.g., New England Biosciences, M0212S, in the following exemplary reaction mix (10 μl): water (0.5 μl), primer (0.5 μl), dNTP (1 μl), NEB buffer (2 μl), and exo- (3 μl). The reaction can be incubated at 37° C. for 5 minutes and at 75° C. for 20 minutes. After the reaction, the double stranded DNA molecules are further purified.

After the second strand synthesis, but before the first or semi-targeted PCR, the double stranded DNA can be purified. The double stranded DNA can be purified using any suitable technique or procedure. For example, the double stranded DNA can be purified using any of the following kits: Zymo clean and concentrator, Zymo research, D4103; Qiaquick, Qiagen, 28104; Zymo ssDNA purification kit, Zymo Research, D7010; Zymo Oligo purification kit, Zymo Research, D4060; and AmpureXP beads, Beckman Coulter, A63882: 1.2×-4× bead ratio.

The first or semi-targeted PCR can be conducted using any suitable enzyme or reaction conditions. For example, the polynucleotides or DNA strands can be annealed at a temperature ranging from about 52° C. to about 72° C., e.g., at about 52° C., 53° C., 54° C., 55° C., 56° C., 57° C., 58° C., 59° C., 60° C., 61° C., 62° C., 63° C., 64° C., 65° C., 66° C., 67° C., 68° C., 69° C., 70° C., 71° C., or 72° C., or any subrange thereof. The first or semi-targeted PCR can be conducted for any suitable rounds of cycles. For example, the first or semi-targeted PCR can be conducted for 10-40 cycles, e.g., for 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 cycles. The primer pool can be used at any suitable concentration. For example, the primer pool can be used at a concentration ranging from about 5 nm to about 200 nM, e.g., at about 5 nm, 6 nm, 7 nm, 8 nm, 9 nm, 10 nm, 20 nm, 30 nm, 40 nm, 50 nm, 60 nm, 70 nm, 80 nm, 90 nm, 100 nm, 110 nm, 120 nm, 130 nm, 140 nm, 150 nm, 160 nm, 170 nm, 180 nm, 190 nm, or 200 nm, or any subrange thereof.

The first or semi-targeted PCR can be conducted using any suitable temperature cycle conditions. For example, the first or semi-targeted PCR can be conducted using any of the following cycle conditions: 95° C. 3 minutes, (95° C. 15 seconds, 62° C. 30 seconds, 72° C. 90 seconds)×3 or ×5; or (95° C. 15 seconds, 72° C. 90 seconds)×23 or ×21, 72 C 1 minute, 4° C. forever.

In some embodiments, the first or semi-targeted PCR can be conducted using KAPA SYBR FAST, e.g., KAPA biosciences, KK4600, in the following exemplary reaction mix (50 µl): DNA (2 µl), KAPASYBR (25 µl), Primer Pool (26 nM each) (10 µl), Aprimer (100 uM) (0.4 µl), and water (12.6 µl). The first or semi-targeted PCR can be conducted using any of the following cycle conditions: 95° C. 30 seconds, (95° C. 10 seconds, 50-56° C. 45 seconds, 72° C. 35 seconds)×40.

In some embodiments, the first or semi-targeted PCR can be conducted using KAPA HiFi, e.g., KAPA Biosciences, KK2601, in the following exemplary reaction mix (50 µl): DNA (15 µl), KAPAHiFi (25 µl), Primer Pool (26 nM each) (10 µl), and Aprimer (100 uM) (0.4 µl). The first or semi-targeted PCR can be conducted using any of the following cycle conditions: 95° C. 3 min, (98° C. 20 seconds, 53-54° C. 15 seconds, 72° C. 35 seconds)×15, 72° C. 2 minutes, 4° C. forever.

Bisulfite conversion can be conducted using any suitable techniques, procedures or reagents. In some embodiments, bisulfite conversion can be conducted using any of the following kits and procedures provided in the kit: EpiMark Bisulfite Conversion Kit, New England Biosciences, E3318S; EZ DNA Methylation Kit, Zymo Research, D5001; MethylCode Bisulfite Conversion Kit, Thermo Fisher Scientific, MECOV50; EZ DNA Methylation Gold Kit, Zymo Research, D5005; EZ DNA Methylation Direct Kit, Zymo Research, D5020; EZ DNA Methylation Lightning Kit, Zymo Research, D5030T; EpiJET Bisulfite Conversion Kit, Thermo Fisher Scientific, K1461; or EpiTect Bisulfite Kit, Qiagen, 59104.

In some embodiments, DNA molecules can be prepared using the procedures illustrated in Example 4, including the steps for constructing single-stranded polynucleotide, conversion of single-stranded polynucleotide library to double-stranded polynucleotide library, semi-targeted amplification of double-stranded polynucleotide library, and construction of sequence library. Such DNA molecules can further be analyzed for methylation status using any suitable methods or procedures.

G. Examples

Example 1. Detection of Cancer in Colon Tissue

In this example, methylation status of 10 Target Regions listed in Table 1: Target30, Target369, Target677, Target1558, Target1628, Target1691, Target1725, Target1795, Target1823, Target1841 was analyzed. Methylation metric is computed as unmethylation haplotype load (uMHL). The classification method used in the analysis is support vector machines.

An experimental panel interrogating the 10 target regions listed above was developed. Eight (8) healthy colon and 40 colon cancer tissue samples were processed using the experimental panel, and the uMHL metric was computed for each target region to create a data matrix. In order to develop a SVM-based classifier, a subset of 4 healthy colon and 20 colon cancer tissue samples were selected as the "training" set. The training set samples were used to fit an SVM-based classifier in Python (using the scikit-learn library) (FIG. 2). The SVM-based classifier was then used to predict the categories for the remaining 24 "test" set samples. The classifier was able to achieve 100% accuracy in the test set and correctly identify if a colon tissue sample was cancerous.

Example 2. Detection of Lung Cancer in Plasma

In this example, methylation status of 95 Target Regions listed in Table 1: Target35, Target36, Target102, Target115, Target117, Target118, Target120, Target136, Target141, Target154, Target155, Target166, Target207, Target226, Target241, Target243, Target252, Target253, Target267, Target284, Target338, Target397, Target398, Target422, Target423, Target432, Target439, Target440, Target445, Target460, Target461, Target504, Target514, Target574, Target575, Target589, Target596, Target625, Target626, Target637, Target640, Target650, Target674, Target691, Target693, Target710, Target736, Target840, Target852, Target867, Target868, Target884, Target903, Target911, Target916, Target926, Target936, Target940, Target941, Target1005, Target1041, Target1048, Target1085, Target1093, Target1113, Target1139, Target1181, Target1182, Target1183, Target1216, Target1229, Target1240, Target1311, Target1324, Target1333, Target1340, Target1342, Target1356, Target1357, Target1385, Target1392, Target1403, Target1408, Target1489, Target1521, Target1566, Target1584, Target1609, Target1616, Target1626, Target1630, Target1635, Target1655, and Target1656 was analyzed. Methylation metric is computed as percent discordant reads (PDR). The classification method used in the analysis is K-Nearest Neighbors.

An experimental panel interrogating the 95 target regions listed above was developed. Forty (40) lung cancer tissue samples, 10 healthy plasma samples, and 4 lung cancer plasma samples were processed using the experimental panel, and the PDR metric was computed for each target region to create a data matrix. In order to develop a K-Nearest Neighbor-based classifier, a subset of 10 healthy plasma and 40 lung cancer tissue samples were selected as the "training" set. For the remaining test set samples, the Euclidean distance to all training set samples was computed in Python (using the seaborn.clustermap function) (FIG. 3a). Each sample was assigned to the category of its nearest training set neighbor; this led to a sensitivity of 75.00% and a specificity of 100.00% in the plasma samples.

The test or analytic results are shown in FIG. 3b. Each vertical line represents a single sample. Purple samples are KNOWN CANCER SAMPLES. Green samples are KNOWN NORMAL SAMPLES. Red samples are UNKNOWN SAMPLES (for which the truth is that they are CANCER samples). Blue samples are UNKNOWN SAMPLES (for which the truth is that they are NORMAL samples). In this analysis, all five blue samples were most similar to green samples, so they were all called normal (for a specificity of 100%). Three out of four red samples were most similar to purple samples, so three out of four were called cancer (for a sensitivity of 75%). One red sample was most similar to the green samples, so it was miscalled as normal.

Example 3. Pan-Cancer Detection in Plasma

In this example, methylation status of 86 Target Regions listed in Table 1: Target11, Target35, Target36, Target102, Target115, Target141, Target154, Target155, Target168, Target184, Target209, Target210, Target211, Target226, Target241, Target284, Target323, Target333, Target338, Target397, Target432, Target439, Target440, Target460, Target472, Target482, Target485, Target570, Target574, Target589, Target596, Target616, Target637, Target660, Target661, Target674, Target692, Target693, Target710, Target728, Target840, Target852, Target867, Target868, Target903, Target911, Target916, Target940, Target941, Target942, Target1048, Target1055, Target1061, Target1085, Target1093, Target1116, Target1122, Target1129, Target1139, Target1142, Target1190, Target1191, Target1212, Target1213, Target1216, Target1229, Target1247, Target1248, Target1296, Target1297, Target1311, Target1322, Target1324, Target1340, Target1342, Target1343, Target1356, Target1378, Target1392, Target1403, Target1447, Target1522, Target1535, Target1543, Target1566, Target1616 was analyzed. Methylation metric is computed as average methylation frequency (AMF). The classification method used in the analysis is logistic regression.

An experimental panel interrogating the 86 target regions listed above was developed. Twenty (20) healthy plasma samples, 5 lung cancer plasma samples, 4 liver cancer plasma samples, 1 breast cancer plasma sample, 1 ovarian cancer plasma sample, and 2 esophageal cancer plasma samples were processed using the experimental panel, and the AMF metric was computed for each target region to create a data matrix. In order to develop a Logistic Regression-based classifier, a subset of 10 healthy plasma and 6 cancer plasma samples were selected as the "training" set. A Logistic Regression model was fit to the sum of the average methylation values across all target regions in Python (using the sklearn module) (FIG. 4). The cancer status of the remaining test set samples was then predicted; this led to a sensitivity of 85.71% and a specificity of 80.00% in the plasma samples.

Example 4

In this example, the templates (e.g., polynucleotides to be sequenced) are short DNA fragments less than about 200 bp long. These DNA fragments can include extracted DNA from plasma, enzyme-treated (e.g., by a fragmentase) genomic DNA, or physically sheared DNA. The physically sheared DNA may be end repaired. In particular aspects, the template has a 3' hydroxyl group for ligation.

Typically, 10-30 ng of the properly prepared template DNA was dephosphorylated, for example, using 1 U FastAP Thermosensitive Alkaline Phosphatase (Thermo Scientific) in 100 mM MOPS (pH 7.5), 20 mM KCl, 10 mM MgCl$_2$, 2 mM DTT, and 5 mM MnCl$_2$ at 37° C. for 10 minutes. The DNA was then denatured, for example, at 95° C. for 2 minutes and put on ice for 1 minute.

A single-stranded adapter was synthesized from IDT with a 5' phosphate group and a 3' carbon spacer. The 5' end contains GA following by a 12-mer unique molecular identifier (UMI) sequence. A typical single-stranded adapter has the following sequence:

/5Phos/GANNNNNNNNNNNNNAGATCGGAAGAGCGTCGTGTAGGGAAAGA GTG/3SpC3/

("5Phos" represents a 5' phosphate group, "NNNNNNNNNNNN" represents a 12-mer UMI sequence, and "3SpC3" represents a 3' carbon spacer.

A ligation reaction was then performed using the dephosphorylated, single-stranded DNA as template. The following final concentrations were used in the ligation reaction: 50 mM MOPS (pH 7.5), 10 mM KCl, 5 mM MgCl$_2$, 1 mM DTT, and 2.5 mM MnCl$_2$, 50% PEG 4000, 0.5 μM adapter, 125 μM ATP, and 200 U Epicentre Circligase™. The reaction was incubated at 60° C. for 2 hours, 80° C. for 10 minutes, 85° C. for 2 minutes, and held at 4° C.

The DNA was then double-stranded by adding the previous reaction volume to the following: 10 mM Tris-HCl (pH 8.3), 50 mM KCl, 1.5 mM MgCl$_2$, 1.25 U Taq DNA Polymerase (NEB), 1 μM reverse-complement primer (a primer that is reverse-complement to the adpator), and 200 μM dNTP mix. The reaction was incubated at 95° C. for 30 seconds, 62° C. for 2 minutes, 68° C. for 10 minutes, and held at 4° C. A typical reverse-complement primer comprises the sequence set forth in SEQ ID NO:17505: CACTCTTTCCCTACACGACGC (5' to 3'). The following is an alignment between the adaptor and the reverse-complement primer:

```
Adaptor
/5Phos/GANNNNNNNNNNNNNAGATCGGAAGA

GCGTCGTGTAGGGAAAGAGTG/3SpC3/
::::::::::::::::::::::
CGCAGCACATCCCTTTCTCAC
Primer
```

The reaction was then purified using 1.6 (bead ratio)× AmPure® XP beads. The beads were added and incubated for 10 minutes. The mixtures were then transferred to a magnet for 5 minutes. The supernatant was then removed. The beads were washed 2× with 150 μL 80% ethanol for 30 seconds each. All residual ethanol was then removed and the beads were dried for 3 minutes at room temperature off of the magnet. 15 μl of Low TE buffer (Thermo Fisher) was added to the beads and incubated for 2 minutes. The beads were then returned to the magnet for 1 minute. The supernatant was removed and stored for the next reaction. In one aspect, the bead ratio causes size selectivity in the purification process, and a bead ratio (such as 1.6×) can be selected that removes molecules shorter than about 100 bp.

A set of PCR primers were designed to minimize primer-primer interactions and off-target annealing. The primers were further optimized to land within close proximity to specific variants. Once designed, the primers were synthesized by IDT. The primers were mixed in equal volume ratios into a primer pool. A semi-targeted PCR reaction was performed with the following reagents: all purified DNA from previous reaction, 1×KAPA 2G multiplex master mix, 66 nM of each primer from pool, and 800 nM reverse-complement primer. The reaction underwent the following thermo-cycling program: 95° C. 3 minutes, (95° C. 15 seconds, 72° C. 90 seconds)×20, 72° C. 1 minute, and held at 4° C.

The reaction was then purified using 1.6 (bead ratio)× AmPure® XP beads. The beads were added and incubated for 10 minutes. The mixtures were then transferred to a magnet for 5 minutes. The supernatant was then removed. The beads were washed 2× with 150 µL 80% ethanol for 30 seconds each. All residual ethanol was then removed and the beads were dried for 3 minutes at room temperature off of the magnet. 20 µl of Low TE buffer (Thermo Fisher) was added to the beads and incubated for 2 minutes. The beads were then returned to the magnet for 1 minute. The supernatant is removed and stored for the next reaction. A bead ratio (such as 1.6×) can be selected that removes molecules shorter than about 100 bp, including free adaptor molecules, free primer molecules, and/or adaptor/primer dimers.

Another PCR reaction was then completed to add full length sequencing adapters and sample specific barcodes. The PCR reaction contained the following: 2 µL purified DNA from previous reaction, 1×NEB ultra Q5 II master mix, 400 nM universal primer, and 400 nM barcode specific primer. The reaction underwent the following thermo-cycling program: 95° C. 3 minutes, (98° C. 10 seconds, 65° C. 75 seconds)×10, 65° C. 2 minute, and held at 4° C.

The reaction was then purified using 0.8 (bead ratio)× AmPure® XP beads. The beads were added and incubated for 10 minutes. The mixtures were then transferred to a magnet for 5 minutes. The supernatant was then removed. The beads were washed 2× with 150 µL 80% ethanol for 30 seconds each. All residual ethanol was then removed and the beads were dried for 3 minutes at room temperature off of the magnet. 25 µl of Low TE buffer (Thermo Fisher) is added to the beads and incubated for 2 minutes. The beads were then returned to the magnet for 1 minute. The supernatant is removed and is ready for sequencing. A bead ratio (such as 0.8×) can be selected that removes a majority of molecules shorter than about 200 bp said polynucleotide sequence of said Target 192 comprises at least 10 consecutive nucleotides in a polynucleotide sequence that is set forth in, that is complementary with or that hybridizes under stringent conditions to, one or more of polynucleotide sequence(s) set forth in SEQ ID NOs: 1824-1833, said polynucleotide sequence of said Target 248 comprises at least 10 consecutive nucleotides in a polynucleotide sequence that is set forth in, that is complementary with or that hybridizes under stringent conditions to, one or more of polynucleotide sequence(s) set forth in SEQ ID NOs: 2353-2362, said polynucleotide sequence of said Target 916 comprises at least 10 consecutive nucleotides in a polynucleotide sequence that is set forth in, that is complementary with or that hybridizes under stringent conditions to, one or more of polynucleotide sequence(s) forth set in SEQ ID NOs: 8667-8676, said polynucleotide sequence of said Target 936 comprises at least 10 consecutive nucleotides in a polynucleotide sequence that is set forth in, that is complementary with or that hybridizes under stringent conditions to, one or more of polynucleotide sequence(s) set forth in SEQ ID NOs: 8854-8863, said polynucleotide sequence of said Target 1349 comprises at least 10 consecutive nucleotides in a polynucleotide sequence that is set forth in, that is complementary with or that hybridizes under stringent conditions to, one or more of polynucleotide sequence(s) set forth in SEQ ID NOs: 12722-12731, said polynucleotide sequence of said Target 1374 comprises at least 10 consecutive nucleotides in a polynucleotide sequence that is set forth in, that is complementary with or that hybridizes under stringent conditions to, one or more of polynucleotide sequence(s) set forth in SEQ ID NOs: 12966-12975, said polynucleotide sequence of said Target 1392 comprises at least 10 consecutive nucleotides in a poly-

---

SEQUENCE LISTING (17507 sequences)

SEQ ID NO: 1 - DNA, 27 bp, Artificial Sequences
  Synthetic
tagggggaggcggttttttgtaggggg

SEQ ID NO: 2 - DNA, 27 bp, Artificial Sequences
  Synthetic
aatttgtcggggtaggtaagggcgggt

SEQ ID NO: 3 - DNA, 27 bp, Artificial Sequences
  Synthetic
gcgtagggggaggcggttttttgtagg

SEQ ID NO: 4 - DNA, 27 bp, Artificial Sequences
  Synthetic
ggcgtagggggaggcggttttttgtag

SEQ ID NO: 5 - DNA, 27 bp, Artificial Sequences
  Synthetic
ggggaggcggttttttgtaggggggtt

SEQ ID NO: 6 - DNA, 27 bp, Artificial Sequences
  Synthetic
ttttttggacgttggttaggttggcga

SEQ ID NO: 7 - DNA, 28 bp, Artificial Sequences
  Synthetic
ttttttggacgttggttaggttggcgat

SEQ ID NO: 8 - DNA, 29 bp, Artificial Sequences
  Synthetic
tttttggacgttggttaggttggcgatag

SEQ ID NO: 9 - DNA, 30 bp, Artificial Sequences
  Synthetic
ttttttggacgttggttaggttggcgatag

SEQ ID NO: 10 - DNA, 35 bp, Artificial Sequences
  Synthetic
aggattcgttttagtttgtgtttgtagtgatcgga

SEQ ID NO: 11 - DNA, 27 bp, Artificial Sequences
  Synthetic
aagggtttggtcgggtgcgaggatgat

SEQ ID NO: 12 - DNA, 27 bp, Artificial Sequences
  Synthetic
gggttttggagtttgcggtgggaaggg

SEQ ID NO: 13 - DNA, 27 bp, Artificial Sequences
  Synthetic
aggtcggtcgagtttatgggcggtgag

SEQ ID NO: 14 - DNA, 27 bp, Artificial Sequences
  Synthetic
agaggtcggtcgagtttatgggcggtg

SEQ ID NO: 15 - DNA, 27 bp, Artificial Sequences
  Synthetic
gaggtcggtcgagtttatgggcggtga

SEQ ID NO: 16 - DNA, 27 bp, Artificial Sequences
  Synthetic
gcgcggggtttgggaatcggttttagt

SEQ ID NO: 17 - DNA, 27 bp, Artificial Sequences
  Synthetic
agcgcggggtttgggaatcggttttag

SEQ ID NO: 18 - DNA, 27 bp, Artificial Sequences
  Synthetic
aggacggcggtggttgtttttggagag

SEQ ID NO: 19 - DNA, 27 bp, Artificial Sequences
  Synthetic
ggacggcggtggttgtttttggagaga

SEQ ID NO: 20 - DNA, 27 bp, Artificial Sequences
  Synthetic
atagcgcggggtttgggaatcggtttt

SEQ ID NO: 21 - DNA, 27 bp, Artificial Sequences
  Synthetic
tggtagtttttaagggtggaaggcggt

SEQ ID NO: 22 - DNA, 28 bp, Artificial Sequences
  Synthetic
tggtagtttttaagggtggaaggcggtt

SEQ ID NO: 23 - DNA, 28 bp, Artificial Sequences
  Synthetic
ttggtagtttttaagggtggaaggcggt

SEQ ID NO: 24 - DNA, 29 bp, Artificial Sequences
  Synthetic
tggtagtttttaagggtggaaggcggttc

SEQ ID NO: 25 - DNA, 28 bp, Artificial Sequences
  Synthetic
ggtagtttttaagggtggaaggcggttc

SEQ ID NO: 26 - DNA, 27 bp, Artificial Sequences
  Synthetic
ggtttattcggggcgcgggggaattag

SEQ ID NO: 27 - DNA, 27 bp, Artificial Sequences
  Synthetic
ttcggggcgcgggggaattagttttac

SEQ ID NO: 28 - DNA, 27 bp, Artificial Sequences
  Synthetic
gggtttattcggggcgcgggggaatta

SEQ ID NO: 29 - DNA, 27 bp, Artificial Sequences
  Synthetic
cgtgagcgtatatgtgtggcggggttt

SEQ ID NO: 30 - DNA, 27 bp, Artificial Sequences
  Synthetic
tcggggcgcgggggaattagttttacg

SEQ ID NO: 31 - DNA, 27 bp, Artificial Sequences
  Synthetic
gcggtttgcgtggggttggttttttcg

SEQ ID NO: 32 - DNA, 26 bp, Artificial Sequences
  Synthetic
gcggtttgcgtggggttggttttttc

SEQ ID NO: 33 - DNA, 26 bp, Artificial Sequences
  Synthetic
cggtttgcgtggggttggttttttcg

SEQ ID NO: 34 - DNA, 27 bp, Artificial Sequences
  Synthetic
tggtagtttttaagggtggaaggcggt

SEQ ID NO: 35 - DNA, 25 bp, Artificial Sequences
  Synthetic
gcggtttgcgtggggttggtttttt

SEQ ID NO: 36 - DNA, 27 bp, Artificial Sequences
  Synthetic
cgtgagcgtatatgtgtggcggggttt

SEQ ID NO: 37 - DNA, 27 bp, Artificial Sequences
  Synthetic
atatgtgtggcggggtttattcggggc

SEQ ID NO: 38 - DNA, 27 bp, Artificial Sequences
  Synthetic
tatgtgtggcggggtttattcggggcg

SEQ ID NO: 39 - DNA, 28 bp, Artificial Sequences
  Synthetic
atatgtgtggcggggtttattcggggcg

SEQ ID NO: 40 - DNA, 26 bp, Artificial Sequences
  Synthetic
tatgtgtggcggggtttattcggggc

SEQ ID NO: 41 - DNA, 27 bp, Artificial Sequences
  Synthetic
gcggtttgcgtggggttggttttttcg

SEQ ID NO: 42 - DNA, 27 bp, Artificial Sequences
  Synthetic
cggttttcgtttcgtaggtgcgggagg

SEQ ID NO: 43 - DNA, 27 bp, Artificial Sequences
  Synthetic
ggttttcgtttcgtaggtgcgggagga

SEQ ID NO: 44 - DNA, 27 bp, Artificial Sequences
  Synthetic
cgtaggtgcgggaggatgtagttgtgg

SEQ ID NO: 45 - DNA, 28 bp, Artificial Sequences
  Synthetic
cggttttcgtttcgtaggtgcgggagga

SEQ ID NO: 46 - DNA, 27 bp, Artificial Sequences
  Synthetic
tgtggtcggtgagtttataatcggcgt

SEQ ID NO: 47 - DNA, 27 bp, Artificial Sequences
  Synthetic
cgtttcgtttcgttcgttttttggcgt

SEQ ID NO: 48 - DNA, 28 bp, Artificial Sequences
  Synthetic
tcgtttcgtttcgttcgttttttggcgt

SEQ ID NO: 49 - DNA, 27 bp, Artificial Sequences
  Synthetic
tcgtttcgtttcgttcgttttttggcg

SEQ ID NO: 50 - DNA, 28 bp, Artificial Sequences
  Synthetic
tgtggtcggtgagtttataatcggcgtc

SEQ ID NO: 51 - DNA, 25 bp, Artificial Sequences
  Synthetic
gtagggggtgtggtgcgggcggtac

SEQ ID NO: 52 - DNA, 26 bp, Artificial Sequences
  Synthetic
ggtagggggtgtggtgcgggcggtac

SEQ ID NO: 53 - DNA, 24 bp, Artificial Sequences
  Synthetic
tagggggtgtggtgcgggcggtac

SEQ ID NO: 54 - DNA, 24 bp, Artificial Sequences
  Synthetic
gtagggggtgtggtgcgggcggta

SEQ ID NO: 55 - DNA, 27 bp, Artificial Sequences
  Synthetic
gggtagggggtgtggtgcgggcggtac

SEQ ID NO: 56 - DNA, 27 bp, Artificial Sequences
  Synthetic
cgggttcgggttggggtttcggttttc

SEQ ID NO: 57 - DNA, 27 bp, Artificial Sequences
  Synthetic
cggtatcgtttcgttagttcgggcggt

SEQ ID NO: 58 - DNA, 26 bp, Artificial Sequences
  Synthetic
cgggttcgggttggggtttcggtttt

SEQ ID NO: 59 - DNA, 28 bp, Artificial Sequences
  Synthetic
cggtatcgtttcgttagttcgggcggtt

SEQ ID NO: 60 - DNA, 25 bp, Artificial Sequences
  Synthetic
cgggttcgggttggggtttcggttt

SEQ ID NO: 61 - DNA, 25 bp, Artificial Sequences
  Synthetic
tcgttcgagttggcggggcgatgtc

SEQ ID NO: 62 - DNA, 24 bp, Artificial Sequences
  Synthetic
cgttcgagttggcggggcgatgtc

SEQ ID NO: 63 - DNA, 24 bp, Artificial Sequences
  Synthetic
tcgttcgagttggcggggcgatgt

SEQ ID NO: 64 - DNA, 23 bp, Artificial Sequences
  Synthetic
cgttcgagttggcggggcgatgt

SEQ ID NO: 65 - DNA, 23 bp, Artificial Sequences
  Synthetic
tcgttcgagttggcggggcgatg

SEQ ID NO: 66 - DNA, 27 bp, Artificial Sequences
  Synthetic
cgggttcgggttggggtttcggttttc

SEQ ID NO: 67 - DNA, 26 bp, Artificial Sequences
  Synthetic
cgggttcgggttggggtttcggtttt

SEQ ID NO: 68 - DNA, 25 bp, Artificial Sequences
  Synthetic
cgggttcgggttggggtttcggttt

SEQ ID NO: 69 - DNA, 26 bp, Artificial Sequences
  Synthetic
gggttcgggttggggtttcggttttc

SEQ ID NO: 70 - DNA, 24 bp, Artificial Sequences
  Synthetic
cgggttcgggttggggtttcggtt

SEQ ID NO: 71 - DNA, 27 bp, Artificial Sequences
  Synthetic
tcggattgcggttcggtcgatggaagt

SEQ ID NO: 72 - DNA, 27 bp, Artificial Sequences
  Synthetic
ttcggattgcggttcggtcgatggaag

SEQ ID NO: 73 - DNA, 27 bp, Artificial Sequences
  Synthetic
tttcggattgcggttcggtcgatggaa

SEQ ID NO: 74 - DNA, 27 bp, Artificial Sequences
  Synthetic
ttttcggattgcggttcggtcgatgga

SEQ ID NO: 75 - DNA, 28 bp, Artificial Sequences
  Synthetic
ttcggattgcggttcggtcgatggaagt

SEQ ID NO: 76 - DNA, 27 bp, Artificial Sequences
  Synthetic
tggggtcgttgttttttgcgggttttt

SEQ ID NO: 77 - DNA, 27 bp, Artificial Sequences
  Synthetic
aggaatgaacggaggtagtggttggtg

SEQ ID NO: 78 - DNA, 27 bp, Artificial Sequences
  Synthetic
ggaatgaacggaggtagtggttggtga

SEQ ID NO: 79 - DNA, 28 bp, Artificial Sequences
  Synthetic
aggaatgaacggaggtagtggttggtga

SEQ ID NO: 80 - DNA, 28 bp, Artificial Sequences
  Synthetic
tggggtcgttgttttttgcgggtttttt

SEQ ID NO: 81 - DNA, 27 bp, Artificial Sequences
  Synthetic
tcggattgcggttcggtcgatggaagt

SEQ ID NO: 82 - DNA, 27 bp, Artificial Sequences
  Synthetic
ttcggattgcggttcggtcgatggaag

SEQ ID NO: 83 - DNA, 27 bp, Artificial Sequences
  Synthetic
tttcggattgcggttcggtcgatggaa

SEQ ID NO: 84 - DNA, 27 bp, Artificial Sequences
  Synthetic
ttttcggattgcggttcggtcgatgga

SEQ ID NO: 85 - DNA, 28 bp, Artificial Sequences
  Synthetic
ttcggattgcggttcggtcgatggaagt

SEQ ID NO: 86 - DNA, 27 bp, Artificial Sequences
  Synthetic
cgtaggaggggtgaggattcgttcggg

SEQ ID NO: 87 - DNA, 27 bp, Artificial Sequences
  Synthetic
gagcgtagggtcggagggaggtcgtag

SEQ ID NO: 88 - DNA, 27 bp, Artificial Sequences
  Synthetic
acgtaggaggggtgaggattcgttcgg

SEQ ID NO: 89 - DNA, 27 bp, Artificial Sequences
  Synthetic
cgttggggtcgttgttttttgcgggtt

SEQ ID NO: 90 - DNA, 27 bp, Artificial Sequences
  Synthetic
aggaggggtgaggattcgttcgggtac

SEQ ID NO: 91 - DNA, 24 bp, Artificial Sequences
  Synthetic
ttttttgcgtggtggggtcgttcg

SEQ ID NO: 92 - DNA, 23 bp, Artificial Sequences
  Synthetic
tttttgcgtggtggggtcgttcg

SEQ ID NO: 93 - DNA, 22 bp, Artificial Sequences
  Synthetic
ttttgcgtggtggggtcgttcg

SEQ ID NO: 94 - DNA, 21 bp, Artificial Sequences
  Synthetic
tttgcgtggtggggtcgttcg

SEQ ID NO: 95 - DNA, 27 bp, Artificial Sequences
  Synthetic
gcgggaggaggttcgtgggatgttgta

SEQ ID NO: 96 - DNA, 27 bp, Artificial Sequences
  Synthetic
gttgttgttggtggtgttgcgggagga

SEQ ID NO: 97 - DNA, 27 bp, Artificial Sequences
  Synthetic
ggttgttgttggtggtgttgcgggagg

SEQ ID NO: 98 - DNA, 27 bp, Artificial Sequences
  Synthetic
gggttgttgttggtggtgttgcgggag

SEQ ID NO: 99 - DNA, 27 bp, Artificial Sequences
  Synthetic
ttgttggtggtgttgcgggaggaggtt

SEQ ID NO: 100 - DNA, 27 bp, Artificial Sequences
  Synthetic
tggtggggtcgttcgtttttgcggttt

SEQ ID NO: 101 - DNA, 27 bp, Artificial Sequences
  Synthetic
gtggtggggtcgttcgtttttgcggtt

SEQ ID NO: 102 - DNA, 27 bp, Artificial Sequences
  Synthetic
ttgcgtggtggggtcgttcgtttttgc

SEQ ID NO: 103 - DNA, 27 bp, Artificial Sequences
  Synthetic
ggtggggtcgttcgtttttgcggtttt

SEQ ID NO: 104 - DNA, 28 bp, Artificial Sequences
  Synthetic
tggtggggtcgttcgtttttgcggtttt

SEQ ID NO: 105 - DNA, 27 bp, Artificial Sequences
  Synthetic
gcgggaggaggttcgtgggatgttgta

SEQ ID NO: 106 - DNA, 27 bp, Artificial Sequences
  Synthetic
gtttgtaggttgcggttcgaggaggcg

SEQ ID NO: 107 - DNA, 27 bp, Artificial Sequences
  Synthetic
cgtttgtaggttgcggttcgaggaggc

SEQ ID NO: 108 - DNA, 27 bp, Artificial Sequences
  Synthetic
taggttgcggttcgaggaggcgttgtt

SEQ ID NO: 109 - DNA, 27 bp, Artificial Sequences
  Synthetic
ttgtaggttgcggttcgaggaggcgtt

SEQ ID NO: 110 - DNA, 27 bp, Artificial Sequences
  Synthetic
tggtggggtcgttcgtttttgcggttt

SEQ ID NO: 111 - DNA, 27 bp, Artificial Sequences
  Synthetic
gtggtggggtcgttcgtttttgcggtt

SEQ ID NO: 112 - DNA, 27 bp, Artificial Sequences
  Synthetic
ggttcggcgcgtggagatcgttgtagt

SEQ ID NO: 113 - DNA, 27 bp, Artificial Sequences
  Synthetic
ttgcgtggtggggtcgttcgtttttgc

SEQ ID NO: 114 - DNA, 27 bp, Artificial Sequences
  Synthetic
ggtggggtcgttcgtttttgcggtttt

SEQ ID NO: 115 - DNA, 27 bp, Artificial Sequences
  Synthetic
gcgggaggaggttcgtgggatgttgta

SEQ ID NO: 116 - DNA, 27 bp, Artificial Sequences
  Synthetic
gtttgtaggttgcggttcgaggaggcg

SEQ ID NO: 117 - DNA, 27 bp, Artificial Sequences
  Synthetic
cgtttgtaggttgcggttcgaggaggc

SEQ ID NO: 118 - DNA, 27 bp, Artificial Sequences
  Synthetic
taggttgcggttcgaggaggcgttgtt

SEQ ID NO: 119 - DNA, 27 bp, Artificial Sequences
  Synthetic
ttgtaggttgcggttcgaggaggcgtt

SEQ ID NO: 120 - DNA, 27 bp, Artificial Sequences
  Synthetic
ggttcggcgcgtggagatcgttgtagt

SEQ ID NO: 121 - DNA, 28 bp, Artificial Sequences
  Synthetic
ggttcggcgcgtggagatcgttgtagta

SEQ ID NO: 122 - DNA, 27 bp, Artificial Sequences
  Synthetic
gttcggcgcgtggagatcgttgtagta

SEQ ID NO: 123 - DNA, 27 bp, Artificial Sequences
  Synthetic
cggttcggcgcgtggagatcgttgtag

SEQ ID NO: 124 - DNA, 26 bp, Artificial Sequences
  Synthetic
ggttcggcgcgtggagatcgttgtag

SEQ ID NO: 125 - DNA, 27 bp, Artificial Sequences
  Synthetic
acggtagtggagtagggggcgtcgtat

SEQ ID NO: 126 - DNA, 27 bp, Artificial Sequences
  Synthetic
tagacggtagtggagtagggggcgtcg

SEQ ID NO: 127 - DNA, 27 bp, Artificial Sequences
  Synthetic
gtttgtaggttgcggttcgaggaggcg

SEQ ID NO: 128 - DNA, 27 bp, Artificial Sequences
  Synthetic
cgtttgtaggttgcggttcgaggaggc

SEQ ID NO: 129 - DNA, 27 bp, Artificial Sequences
  Synthetic
taggttgcggttcgaggaggcgttgtt

SEQ ID NO: 130 - DNA, 27 bp, Artificial Sequences
  Synthetic
ttcgggtcgtagtttgtaggcggtgat

SEQ ID NO: 131 - DNA, 27 bp, Artificial Sequences
  Synthetic
tcgggtcgtagtttgtaggcggtgata

SEQ ID NO: 132 - DNA, 26 bp, Artificial Sequences
  Synthetic
tcgggtcgtagtttgtaggcggtgat

SEQ ID NO: 133 - DNA, 27 bp, Artificial Sequences
  Synthetic
cgggtcgtagtttgtaggcggtgatat

SEQ ID NO: 134 - DNA, 28 bp, Artificial Sequences
  Synthetic
tcgggtcgtagtttgtaggcggtgatat

SEQ ID NO: 135 - DNA, 27 bp, Artificial Sequences
  Synthetic
acggtagtggagtagggggcgtcgtat

SEQ ID NO: 136 - DNA, 27 bp, Artificial Sequences
  Synthetic
tagacggtagtggagtagggggcgtcg

SEQ ID NO: 137 - DNA, 27 bp, Artificial Sequences
  Synthetic
gacggtagtggagtagggggcgtcgta

SEQ ID NO: 138 - DNA, 27 bp, Artificial Sequences
  Synthetic
cggtagtggagtagggggcgtcgtatt

SEQ ID NO: 139 - DNA, 26 bp, Artificial Sequences
  Synthetic
acggtagtggagtagggggcgtcgta

SEQ ID NO: 140 - DNA, 27 bp, Artificial Sequences
  Synthetic
tttcgggtcgtagtttgtaggcggtga

SEQ ID NO: 141 - DNA, 27 bp, Artificial Sequences
  Synthetic
gcgtatatagtttttcgggtgcggcgt

SEQ ID NO: 142 - DNA, 27 bp, Artificial Sequences
  Synthetic
ttcgggtcgtagtttgtaggcggtgat

SEQ ID NO: 143 - DNA, 27 bp, Artificial Sequences
  Synthetic
agtttttcgggtgcggcgttttttgtt

SEQ ID NO: 144 - DNA, 27 bp, Artificial Sequences
  Synthetic
ttttcgggtcgtagtttgtaggcggtg

SEQ ID NO: 145 - DNA, 27 bp, Artificial Sequences
  Synthetic
ggattttgcgggggatcgtgtagggga

SEQ ID NO: 146 - DNA, 27 bp, Artificial Sequences
  Synthetic
aggattttgcgggggatcgtgtagggg

SEQ ID NO: 147 - DNA, 28 bp, Artificial Sequences
  Synthetic
ggattttgcgggggatcgtgtaggggat

SEQ ID NO: 148 - DNA, 28 bp, Artificial Sequences
  Synthetic
tgaggattttgcgggggatcgtgtaggg

SEQ ID NO: 149 - DNA, 27 bp, Artificial Sequences
  Synthetic
gaggattttgcgggggatcgtgtaggg

SEQ ID NO: 150 - DNA, 27 bp, Artificial Sequences
  Synthetic
gcgtagagttaggagaggtgcgcggtt

SEQ ID NO: 151 - DNA, 27 bp, Artificial Sequences
  Synthetic
ggagaggtgcgcggttttttgtacggt

SEQ ID NO: 152 - DNA, 27 bp, Artificial Sequences
  Synthetic
aggagaggtgcgcggttttttgtacgg

SEQ ID NO: 153 - DNA, 26 bp, Artificial Sequences
  Synthetic
gcgtagagttaggagaggtgcgcggt

SEQ ID NO: 154 - DNA, 28 bp, Artificial Sequences
  Synthetic
gcgtagagttaggagaggtgcgcggttt

SEQ ID NO: 155 - DNA, 27 bp, Artificial Sequences
  Synthetic
ggattttgcgggggatcgtgtagggga

SEQ ID NO: 156 - DNA, 27 bp, Artificial Sequences
  Synthetic
aggattttgcgggggatcgtgtagggg

SEQ ID NO: 157 - DNA, 27 bp, Artificial Sequences
  Synthetic
gtgtttgttgttggtaggggacgcggc

SEQ ID NO: 158 - DNA, 27 bp, Artificial Sequences
  Synthetic
agtgtttgttgttggtaggggacgcgg

SEQ ID NO: 159 - DNA, 28 bp, Artificial Sequences
  Synthetic
ggattttgcgggggatcgtgtaggggat

SEQ ID NO: 160 - DNA, 27 bp, Artificial Sequences
  Synthetic
cgtgcgggtcgtagtaggcgttcgtat

SEQ ID NO: 161 - DNA, 27 bp, Artificial Sequences
  Synthetic
gcgtagagttaggagaggtgcgcggtt

SEQ ID NO: 162 - DNA, 27 bp, Artificial Sequences
  Synthetic
ggagaggtgcgcggttttttgtacggt

SEQ ID NO: 163 - DNA, 27 bp, Artificial Sequences
  Synthetic
ttcgtagggtttttagggcgtgcgggt

SEQ ID NO: 164 - DNA, 27 bp, Artificial Sequences
  Synthetic
tagggtttttagggcgtgcgggtcgta

SEQ ID NO: 165 - DNA, 27 bp, Artificial Sequences
  Synthetic
gtgtttgttgttggtaggggacgcggc

SEQ ID NO: 166 - DNA, 27 bp, Artificial Sequences
  Synthetic
agtgtttgttgttggtaggggacgcgg

SEQ ID NO: 167 - DNA, 26 bp, Artificial Sequences
  Synthetic
tgtttgttgttggtaggggacgcggc

SEQ ID NO: 168 - DNA, 27 bp, Artificial Sequences
  Synthetic
ttcgggttatgtgcgagcgtttgttgc

SEQ ID NO: 169 - DNA, 28 bp, Artificial Sequences
  Synthetic
cgagtgtttgttgttggtaggggacgcg

SEQ ID NO: 170 - DNA, 27 bp, Artificial Sequences
  Synthetic
cgtgcgggtcgtagtaggcgttcgtat

SEQ ID NO: 171 - DNA, 27 bp, Artificial Sequences
  Synthetic
gcgtagagttaggagaggtgcgcggtt

SEQ ID NO: 172 - DNA, 27 bp, Artificial Sequences
  Synthetic
ggtattcggcgaggcgggtttttagcg

SEQ ID NO: 173 - DNA, 27 bp, Artificial Sequences
  Synthetic
ggcgttcgtatatggttcgggcgttcg

SEQ ID NO: 174 - DNA, 27 bp, Artificial Sequences
  Synthetic
ggagaggtgcgcggttttttgtacggt

SEQ ID NO: 175 - DNA, 27 bp, Artificial Sequences
  Synthetic
gtgtttgttgttggtaggggacgcggt

SEQ ID NO: 176 - DNA, 27 bp, Artificial Sequences
  Synthetic
agtgtttgttgttggtaggggacgcgg

SEQ ID NO: 177 - DNA, 28 bp, Artificial Sequences
  Synthetic
cgagtgtttgttgttggtaggggacgcg

SEQ ID NO: 178 - DNA, 28 bp, Artificial Sequences
  Synthetic
agtgtttgttgttggtaggggacgcggt

SEQ ID NO: 179 - DNA, 28 bp, Artificial Sequences
  Synthetic
gagtgtttgttgttggtaggggacgcgg

SEQ ID NO: 180 - DNA, 27 bp, Artificial Sequences
  Synthetic
cgtgcgggtcgtagtaggcgttcgtat

SEQ ID NO: 181 - DNA, 27 bp, Artificial Sequences
  Synthetic
ggtattcggcgaggcgggtttttagcg

SEQ ID NO: 182 - DNA, 27 bp, Artificial Sequences
  Synthetic
ggcgttcgtatatggttcgggcgttcg

SEQ ID NO: 183 - DNA, 27 bp, Artificial Sequences
  Synthetic
tagggtttttagggcgtgcgggtcgta

SEQ ID NO: 184 - DNA, 27 bp, Artificial Sequences
  Synthetic
ttttagggcgtgcgggtcgtagtaggc

SEQ ID NO: 185 - DNA, 28 bp, Artificial Sequences
  Synthetic
cgagttgttggtttcggtaattcgcgcg

SEQ ID NO: 186 - DNA, 27 bp, Artificial Sequences
  Synthetic
agttgttggtttcggtaattcgcgcgt

SEQ ID NO: 187 - DNA, 29 bp, Artificial Sequences
  Synthetic
cgagttgttggtttcggtaattcgcgcgt

SEQ ID NO: 188 - DNA, 28 bp, Artificial Sequences
  Synthetic
gagttgttggtttcggtaattcgcgcgt

SEQ ID NO: 189 - DNA, 27 bp, Artificial Sequences
  Synthetic
gagttgttggtttcggtaattcgcgcg

SEQ ID NO: 190 - DNA, 27 bp, Artificial Sequences
  Synthetic
cgtgcgggtcgtagtaggcgttcgtat

SEQ ID NO: 191 - DNA, 27 bp, Artificial Sequences
  Synthetic
ggtattcggcgaggcgggtttttagcg

SEQ ID NO: 192 - DNA, 27 bp, Artificial Sequences
  Synthetic
ggcgttcgtatatggttcgggcgttcg

SEQ ID NO: 193 - DNA, 27 bp, Artificial Sequences
  Synthetic
gcgttcgtatatggttcgggcgttcgt

SEQ ID NO: 194 - DNA, 27 bp, Artificial Sequences
  Synthetic
aggtattcggcgaggcgggtttttagc

SEQ ID NO: 195 - DNA, 28 bp, Artificial Sequences
  Synthetic
cgagttgttggtttcggtaattcgcgcg

SEQ ID NO: 196 - DNA, 27 bp, Artificial Sequences
  Synthetic
agttgttggtttcggtaattcgcgcgt

SEQ ID NO: 197 - DNA, 29 bp, Artificial Sequences
  Synthetic
cgagttgttggtttcggtaattcgcgcgt

SEQ ID NO: 198 - DNA, 28 bp, Artificial Sequences
  Synthetic
gagttgttggtttcggtaattcgcgcgt

SEQ ID NO: 199 - DNA, 27 bp, Artificial Sequences
  Synthetic
gagttgttggtttcggtaattcgcgcg

SEQ ID NO: 200 - DNA, 27 bp, Artificial Sequences
  Synthetic
ggtattcggcgaggcgggtttttagcg

SEQ ID NO: 201 - DNA, 27 bp, Artificial Sequences
  Synthetic
ggcgttcgtatatggttcgggcgttcg

SEQ ID NO: 202 - DNA, 27 bp, Artificial Sequences
  Synthetic
gcgttcgtatatggttcgggcgttcgt

SEQ ID NO: 203 - DNA, 27 bp, Artificial Sequences
  Synthetic
aggtattcggcgaggcgggtttttagc

SEQ ID NO: 204 - DNA, 27 bp, Artificial Sequences
  Synthetic
aggcgttcgtatatggttcgggcgttc

SEQ ID NO: 205 - DNA, 27 bp, Artificial Sequences
  Synthetic
gcgttcgggtttaggcgtaggaggtcg

SEQ ID NO: 206 - DNA, 26 bp, Artificial Sequences
  Synthetic
gcgttcgggtttaggcgtaggaggtc

SEQ ID NO: 207 - DNA, 26 bp, Artificial Sequences
  Synthetic
cgttcgggtttaggcgtaggaggtcg

SEQ ID NO: 208 - DNA, 27 bp, Artificial Sequences
  Synthetic
tcgttcgtttttaggaagtcgtgcgga

SEQ ID NO: 209 - DNA, 25 bp, Artificial Sequences
  Synthetic
gcgttcgggtttaggcgtaggaggt

SEQ ID NO: 210 - DNA, 27 bp, Artificial Sequences
  Synthetic
ggtattcggcgaggcgggtttttagcg

SEQ ID NO: 211 - DNA, 27 bp, Artificial Sequences
  Synthetic
aggtattcggcgaggcgggtttttagc

SEQ ID NO: 212 - DNA, 27 bp, Artificial Sequences
  Synthetic
agtagtaggtattcggcgaggcgggtt

SEQ ID NO: 213 - DNA, 27 bp, Artificial Sequences
  Synthetic
tcgcggagtttagggtggtttcgtacg

SEQ ID NO: 214 - DNA, 27 bp, Artificial Sequences
  Synthetic
agtaggtattcggcgaggcgggttttt

SEQ ID NO: 215 - DNA, 27 bp, Artificial Sequences
  Synthetic
ttggggcgcggaggtagttttaggtcg

SEQ ID NO: 216 - DNA, 27 bp, Artificial Sequences
  Synthetic
gcgttcgggtttaggcgtaggaggtcg

SEQ ID NO: 217 - DNA, 27 bp, Artificial Sequences
  Synthetic
ggggcgcggaggtagttttaggtcgtg

SEQ ID NO: 218 - DNA, 27 bp, Artificial Sequences
  Synthetic
tttggggcgcggaggtagttttaggtc

SEQ ID NO: 219 - DNA, 26 bp, Artificial Sequences
  Synthetic
tggggcgcggaggtagttttaggtcg

SEQ ID NO: 220 - DNA, 27 bp, Artificial Sequences
  Synthetic
cgcggagtttagggtggtttcgtacgg

SEQ ID NO: 221 - DNA, 28 bp, Artificial Sequences
  Synthetic
tcgcggagtttagggtggtttcgtacgg

SEQ ID NO: 222 - DNA, 27 bp, Artificial Sequences
  Synthetic
gcggagtttagggtggtttcgtacggt

SEQ ID NO: 223 - DNA, 28 bp, Artificial Sequences
  Synthetic
cgcggagtttagggtggtttcgtacggt

SEQ ID NO: 224 - DNA, 27 bp, Artificial Sequences
  Synthetic
tcgcggagtttagggtggtttcgtacg

SEQ ID NO: 225 - DNA, 27 bp, Artificial Sequences
  Synthetic
cgttcgggtttaggcgtaggaggtcgt

SEQ ID NO: 226 - DNA, 27 bp, Artificial Sequences
  Synthetic
gggcgcggaggtagttttaggtcgtgt

SEQ ID NO: 227 - DNA, 27 bp, Artificial Sequences
  Synthetic
ttggggcgcggaggtagttttaggtcg

SEQ ID NO: 228 - DNA, 27 bp, Artificial Sequences
  Synthetic
gcgttcgggtttaggcgtaggaggtcg

SEQ ID NO: 229 - DNA, 27 bp, Artificial Sequences
  Synthetic
ggggcgcggaggtagttttaggtcgtg

SEQ ID NO: 230 - DNA, 29 bp, Artificial Sequences
  Synthetic
ggcgttgtagttagggtggattttgcggg

SEQ ID NO: 231 - DNA, 27 bp, Artificial Sequences
  Synthetic
agggtggattttgcgggttggatgttt

SEQ ID NO: 232 - DNA, 27 bp, Artificial Sequences
  Synthetic
gggtggattttgcgggttggatgtttg

SEQ ID NO: 233 - DNA, 28 bp, Artificial Sequences
  Synthetic
gcgttgtagttagggtggattttgcggg

SEQ ID NO: 234 - DNA, 28 bp, Artificial Sequences
  Synthetic
ggcgttgtagttagggtggattttgcgg

SEQ ID NO: 235 - DNA, 28 bp, Artificial Sequences
  Synthetic
ggtgtcgttgggtatgcgttagggaggt

SEQ ID NO: 236 - DNA, 27 bp, Artificial Sequences
  Synthetic
ggtgtcgttgggtatgcgttagggagg

SEQ ID NO: 237 - DNA, 28 bp, Artificial Sequences
  Synthetic
aggtgtcgttgggtatgcgttagggagg

SEQ ID NO: 238 - DNA, 27 bp, Artificial Sequences
  Synthetic
gtgtcgttgggtatgcgttagggaggt

SEQ ID NO: 239 - DNA, 27 bp, Artificial Sequences
  Synthetic
aggtgtcgttgggtatgcgttagggag

SEQ ID NO: 240 - DNA, 27 bp, Artificial Sequences
  Synthetic
agggtggattttgcgggttggatgttt

SEQ ID NO: 241 - DNA, 27 bp, Artificial Sequences
  Synthetic
ggattggtttgaggtttgggtaggcgt

SEQ ID NO: 242 - DNA, 27 bp, Artificial Sequences
  Synthetic
gggtggattttgcgggttggatgtttg

SEQ ID NO: 243 - DNA, 28 bp, Artificial Sequences
  Synthetic
aggattggtttgaggtttgggtaggcgt

SEQ ID NO: 244 - DNA, 27 bp, Artificial Sequences
  Synthetic
ttggtttgaggtttgggtaggcgttgt

SEQ ID NO: 245 - DNA, 29 bp, Artificial Sequences
  Synthetic
cgtttggttgcgttgaattggtggtgacg

SEQ ID NO: 246 - DNA, 27 bp, Artificial Sequences
  Synthetic
tttggttgcgttgaattggtggtgacg

SEQ ID NO: 247 - DNA, 27 bp, Artificial Sequences
  Synthetic
cgtttggttgcgttgaattggtggtga

SEQ ID NO: 248 - DNA, 27 bp, Artificial Sequences
  Synthetic
tcgtttggttgcgttgaattggtggtg

SEQ ID NO: 249 - DNA, 28 bp, Artificial Sequences
  Synthetic
tcgtttggttgcgttgaattggtggtga

SEQ ID NO: 250 - DNA, 27 bp, Artificial Sequences
  Synthetic
tggatgttgagttgttttgcggcggtt

SEQ ID NO: 251 - DNA, 27 bp, Artificial Sequences
  Synthetic
atggatgttgagttgttttgcggcggt

SEQ ID NO: 252 - DNA, 28 bp, Artificial Sequences
  Synthetic
ggatggatgttgagttgttttgcggcgg

SEQ ID NO: 253 - DNA, 29 bp, Artificial Sequences
  Synthetic
tggatggatgttgagttgttttgcggcgg

SEQ ID NO: 254 - DNA, 28 bp, Artificial Sequences
  Synthetic
gatggatgttgagttgttttgcggcggt

SEQ ID NO: 255 - DNA, 27 bp, Artificial Sequences
  Synthetic
gggtattggggggagtgggtgtttggt

SEQ ID NO: 256 - DNA, 27 bp, Artificial Sequences
  Synthetic
gtttcgtggaagtggcggggtattggg

SEQ ID NO: 257 - DNA, 27 bp, Artificial Sequences
  Synthetic
tggggggagtgggtgtttggttgagaa

SEQ ID NO: 258 - DNA, 27 bp, Artificial Sequences
  Synthetic
ttggggggagtgggtgtttggttgaga

SEQ ID NO: 259 - DNA, 27 bp, Artificial Sequences
  Synthetic
ggggtattggggggagtgggtgtttgg

SEQ ID NO: 260 - DNA, 27 bp, Artificial Sequences
  Synthetic
cgtggttgggttgtagggtcgtagggt

SEQ ID NO: 261 - DNA, 27 bp, Artificial Sequences
  Synthetic
acgtggttgggttgtagggtcgtaggg

SEQ ID NO: 262 - DNA, 27 bp, Artificial Sequences
  Synthetic
tgggttgtagggtcgtagggttgtggt

SEQ ID NO: 263 - DNA, 28 bp, Artificial Sequences
  Synthetic
gacgtggttgggttgtagggtcgtaggg

SEQ ID NO: 264 - DNA, 28 bp, Artificial Sequences
  Synthetic
cgtggttgggttgtagggtcgtagggtt

SEQ ID NO: 265 - DNA, 31 bp, Artificial Sequences
  Synthetic
gggattataggcgtgagttatcgtgtttggt

SEQ ID NO: 266 - DNA, 31 bp, Artificial Sequences
  Synthetic
tgggattataggcgtgagttatcgtgtttgg

SEQ ID NO: 267 - DNA, 31 bp, Artificial Sequences
  Synthetic
gtgttgggattataggcgtgagttatcgtgt

SEQ ID NO: 268 - DNA, 32 bp, Artificial Sequences
  Synthetic
tgggattataggcgtgagttatcgtgtttggt

SEQ ID NO: 269 - DNA, 31 bp, Artificial Sequences
  Synthetic
agtgttgggattataggcgtgagttatcgtg

SEQ ID NO: 270 - DNA, 30 bp, Artificial Sequences
  Synthetic
cggagcgaatggtgtgttaaggaagtaaga

SEQ ID NO: 271 - DNA, 31 bp, Artificial Sequences
  Synthetic
cggagcgaatggtgtgttaaggaagtaagaa

SEQ ID NO: 272 - DNA, 32 bp, Artificial Sequences
  Synthetic
cggagcgaatggtgtgttaaggaagtaagaaa

SEQ ID NO: 273 - DNA, 33 bp, Artificial Sequences
  Synthetic
cggagcgaatggtgtgttaaggaagtaagaaat

SEQ ID NO: 274 - DNA, 34 bp, Artificial Sequences
  Synthetic
cggagcgaatggtgtgttaaggaagtaagaaatt

SEQ ID NO: 275 - DNA, 27 bp, Artificial Sequences
  Synthetic
agattggcgggtcgttttggtgggagt

SEQ ID NO: 276 - DNA, 27 bp, Artificial Sequences
  Synthetic
gattggcgggtcgttttggtgggagtt

SEQ ID NO: 277 - DNA, 27 bp, Artificial Sequences
  Synthetic
tggcgggtcgttttggtgggagttttt

SEQ ID NO: 278 - DNA, 27 bp, Artificial Sequences
  Synthetic
ttggcgggtcgttttggtgggagtttt

SEQ ID NO: 279 - DNA, 27 bp, Artificial Sequences
  Synthetic
attggcgggtcgttttggtgggagttt

SEQ ID NO: 280 - DNA, 27 bp, Artificial Sequences
  Synthetic
tgtattcgtggtggaggatttgggggt

SEQ ID NO: 281 - DNA, 29 bp, Artificial Sequences
  Synthetic
cggttgtattcgtggtggaggatttgggg

SEQ ID NO: 282 - DNA, 29 bp, Artificial Sequences
  Synthetic
ggttgtattcgtggtggaggatttggggg

SEQ ID NO: 283 - DNA, 30 bp, Artificial Sequences
  Synthetic
ggttgtattcgtggtggaggatttgggggt

SEQ ID NO: 284 - DNA, 28 bp, Artificial Sequences
  Synthetic
ttgtattcgtggtggaggatttgggggt

SEQ ID NO: 285 - DNA, 27 bp, Artificial Sequences
  Synthetic
gggaaggtgggtgtgggtattcggagg

SEQ ID NO: 286 - DNA, 27 bp, Artificial Sequences
  Synthetic
ggggaaggtgggtgtgggtattcggag

SEQ ID NO: 287 - DNA, 27 bp, Artificial Sequences
  Synthetic
gtgggggaaggtgggtgtgggtattcg

SEQ ID NO: 288 - DNA, 27 bp, Artificial Sequences
  Synthetic
agtgggggaaggtgggtgtgggtattc

SEQ ID NO: 289 - DNA, 27 bp, Artificial Sequences
  Synthetic
ggaaggtgggtgtgggtattcggaggt

SEQ ID NO: 290 - DNA, 27 bp, Artificial Sequences
  Synthetic
agtaagggaggcgtgggtgggtagaga

SEQ ID NO: 291 - DNA, 27 bp, Artificial Sequences
  Synthetic
aagggaggcgtgggtgggtagagattt

SEQ ID NO: 292 - DNA, 27 bp, Artificial Sequences
  Synthetic
gcgtgggtgggtagagatttaagcggg

SEQ ID NO: 293 - DNA, 27 bp, Artificial Sequences
  Synthetic
ggcgtgggtgggtagagatttaagcgg

SEQ ID NO: 294 - DNA, 27 bp, Artificial Sequences
  Synthetic
gtaagggaggcgtgggtgggtagagat

SEQ ID NO: 295 - DNA, 29 bp, Artificial Sequences
  Synthetic
tgcggatagatagggaatggggatagcgt

SEQ ID NO: 296 - DNA, 28 bp, Artificial Sequences
  Synthetic
gcggatagatagggaatggggatagcgt

SEQ ID NO: 297 - DNA, 28 bp, Artificial Sequences
  Synthetic
tgcggatagatagggaatggggatagcg

SEQ ID NO: 298 - DNA, 27 bp, Artificial Sequences
  Synthetic
gcggatagatagggaatggggatagcg

SEQ ID NO: 299 - DNA, 29 bp, Artificial Sequences
  Synthetic
gcggatagatagggaatggggatagcgtt

SEQ ID NO: 300 - DNA, 27 bp, Artificial Sequences
  Synthetic
tgggagtggaggaaggagggtggtttt

SEQ ID NO: 301 - DNA, 27 bp, Artificial Sequences
  Synthetic
ttgggagtggaggaaggagggtggttt

SEQ ID NO: 302 - DNA, 27 bp, Artificial Sequences
  Synthetic
tttgggagtggaggaaggagggtggtt

SEQ ID NO: 303 - DNA, 27 bp, Artificial Sequences
  Synthetic
atttgggagtggaggaaggagggtggt

SEQ ID NO: 304 - DNA, 27 bp, Artificial Sequences
  Synthetic
ggaatatggtaggggggtttcgtgggc

SEQ ID NO: 305 - DNA, 32 bp, Artificial Sequences
  Synthetic
tgatttagatgtgtgaaaataggggcgttcgt

SEQ ID NO: 306 - DNA, 33 bp, Artificial Sequences
  Synthetic
atgatttagatgtgtgaaaataggggcgttcgt

SEQ ID NO: 307 - DNA, 33 bp, Artificial Sequences
  Synthetic
tgatttagatgtgtgaaaataggggcgttcgta

SEQ ID NO: 308 - DNA, 33 bp, Artificial Sequences
  Synthetic
gatgatttagatgtgtgaaaataggggcgttcg

SEQ ID NO: 309 - DNA, 34 bp, Artificial Sequences
  Synthetic
gatgatttagatgtgtgaaaataggggcgttcgt

SEQ ID NO: 310 - DNA, 27 bp, Artificial Sequences
  Synthetic
ataagggcgtttgggttcggggaggag

SEQ ID NO: 311 - DNA, 27 bp, Artificial Sequences
  Synthetic
tattttgtgggagcgtaggggagggcg

SEQ ID NO: 312 - DNA, 27 bp, Artificial Sequences
  Synthetic
agcgtaggggagggcggaggattgata

SEQ ID NO: 313 - DNA, 27 bp, Artificial Sequences
  Synthetic
ggcgtttgggttcggggaggagtagat

SEQ ID NO: 314 - DNA, 27 bp, Artificial Sequences
  Synthetic
aataagggcgtttgggttcggggagga

SEQ ID NO: 315 - DNA, 27 bp, Artificial Sequences
  Synthetic
gcgtcgttttagtgtatggtcgcgggt

SEQ ID NO: 316 - DNA, 28 bp, Artificial Sequences
  Synthetic
gcgtcgttttagtgtatggtcgcgggta

SEQ ID NO: 317 - DNA, 25 bp, Artificial Sequences
  Synthetic
cgggagcggtgattttggttggggg

SEQ ID NO: 318 - DNA, 25 bp, Artificial Sequences
  Synthetic
gggagcggtgattttggttgggggc

SEQ ID NO: 319 - DNA, 25 bp, Artificial Sequences
  Synthetic
ggagcggtgattttggttgggggcg

SEQ ID NO: 320 - DNA, 29 bp, Artificial Sequences
  Synthetic
gcgtagagtagagttaggggagggtcggg

SEQ ID NO: 321 - DNA, 27 bp, Artificial Sequences
  Synthetic
agagtagagttaggggagggtcgggac

SEQ ID NO: 322 - DNA, 28 bp, Artificial Sequences
  Synthetic
gcgtagagtagagttaggggagggtcgg

SEQ ID NO: 323 - DNA, 29 bp, Artificial Sequences
  Synthetic
agcgtagagtagagttaggggagggtcgg

SEQ ID NO: 324 - DNA, 28 bp, Artificial Sequences
  Synthetic
cgtagagtagagttaggggagggtcggg

SEQ ID NO: 325 - DNA, 27 bp, Artificial Sequences
  Synthetic
ttatgttcgcgcggtgtagtagggacg

SEQ ID NO: 326 - DNA, 28 bp, Artificial Sequences
  Synthetic
tttatgttcgcgcggtgtagtagggacg

SEQ ID NO: 327 - DNA, 26 bp, Artificial Sequences
  Synthetic
tatgttcgcgcggtgtagtagggacg

SEQ ID NO: 328 - DNA, 27 bp, Artificial Sequences
  Synthetic
tttatgttcgcgcggtgtagtagggac

SEQ ID NO: 329 - DNA, 25 bp, Artificial Sequences
  Synthetic
atgttcgcgcggtgtagtagggacg

SEQ ID NO: 330 - DNA, 27 bp, Artificial Sequences
  Synthetic
gagagtgagggggttaggggcgtttcg

SEQ ID NO: 331 - DNA, 27 bp, Artificial Sequences
  Synthetic
agggaagagagtgagggggttaggggc

SEQ ID NO: 332 - DNA, 27 bp, Artificial Sequences
  Synthetic
agagagtgagggggttaggggcgtttc

SEQ ID NO: 333 - DNA, 27 bp, Artificial Sequences
  Synthetic
gaagagagtgagggggttaggggcgtt

SEQ ID NO: 334 - DNA, 27 bp, Artificial Sequences
  Synthetic
ggaagagagtgagggggttaggggcgt

SEQ ID NO: 335 - DNA, 27 bp, Artificial Sequences
  Synthetic
gttcgcgcggtgtagtagggacggtta

SEQ ID NO: 336 - DNA, 27 bp, Artificial Sequences
  Synthetic
tatgttcgcgcggtgtagtagggacgg

SEQ ID NO: 337 - DNA, 27 bp, Artificial Sequences
  Synthetic
tcgcgcggtgtagtagggacggttaaa

SEQ ID NO: 338 - DNA, 27 bp, Artificial Sequences
  Synthetic
ttcgcgcggtgtagtagggacggttaa

SEQ ID NO: 339 - DNA, 28 bp, Artificial Sequences
  Synthetic
ttatgttcgcgcggtgtagtagggacgg

SEQ ID NO: 340 - DNA, 27 bp, Artificial Sequences
  Synthetic
gagagtgagggggttaggggcgtttcg

SEQ ID NO: 341 - DNA, 27 bp, Artificial Sequences
  Synthetic
agcgtcggtggttgatgtgtcgtacgt

SEQ ID NO: 342 - DNA, 27 bp, Artificial Sequences
  Synthetic
aggaagcgtcggtggttgatgtgtcgt

SEQ ID NO: 343 - DNA, 27 bp, Artificial Sequences
  Synthetic
agggaagagagtgagggggttaggggc

SEQ ID NO: 344 - DNA, 27 bp, Artificial Sequences
  Synthetic
agcgggaaagtggttaggaagcgtcgg

SEQ ID NO: 345 - DNA, 27 bp, Artificial Sequences
  Synthetic
gttcgcgcggtgtagtagggacggtta

SEQ ID NO: 346 - DNA, 27 bp, Artificial Sequences
  Synthetic
tatgttcgcgcggtgtagtagggacgg

SEQ ID NO: 347 - DNA, 27 bp, Artificial Sequences
  Synthetic
cgttgtgtgttttaggtttcgcgcggc

SEQ ID NO: 348 - DNA, 27 bp, Artificial Sequences
  Synthetic
tcgcgcggtgtagtagggacggttaaa

SEQ ID NO: 349 - DNA, 27 bp, Artificial Sequences
  Synthetic
ttcgcgcggtgtagtagggacggttaa

SEQ ID NO: 350 - DNA, 27 bp, Artificial Sequences
  Synthetic
gcggtataggttttgttcggcgcggtt

SEQ ID NO: 351 - DNA, 27 bp, Artificial Sequences
  Synthetic
agcgtcggtggttgatgtgtcgtacgt

SEQ ID NO: 352 - DNA, 27 bp, Artificial Sequences
  Synthetic
aggaagcgtcggtggttgatgtgtcgt

SEQ ID NO: 353 - DNA, 27 bp, Artificial Sequences
  Synthetic
agcgggaaagtggttaggaagcgtcgg

SEQ ID NO: 354 - DNA, 27 bp, Artificial Sequences
  Synthetic
gcgtcggtggttgatgtgtcgtacgtt

SEQ ID NO: 355 - DNA, 27 bp, Artificial Sequences
  Synthetic
cgttgtgtgttttaggtttcgcgcggc

SEQ ID NO: 356 - DNA, 27 bp, Artificial Sequences
  Synthetic
tcgttgtgtgttttaggtttcgcgcgg

SEQ ID NO: 357 - DNA, 28 bp, Artificial Sequences
  Synthetic
tcgttgtgtgttttaggtttcgcgcggc

SEQ ID NO: 358 - DNA, 28 bp, Artificial Sequences
  Synthetic
atcgttgtgtgttttaggtttcgcgcgg

SEQ ID NO: 359 - DNA, 29 bp, Artificial Sequences
  Synthetic
atcgttgtgtgttttaggtttcgcgcggc

SEQ ID NO: 360 - DNA, 25 bp, Artificial Sequences
  Synthetic
cgagggtgaggtttcggcgtttttc

SEQ ID NO: 361 - DNA, 24 bp, Artificial Sequences
  Synthetic
cgagggtgaggtttcggcgttttt

SEQ ID NO: 362 - DNA, 23 bp, Artificial Sequences
  Synthetic
cgagggtgaggtttcggcgtttt

SEQ ID NO: 363 - DNA, 35 bp, Artificial Sequences
  Synthetic
tcggcgtttattagttgatttttgacgatgagttt

SEQ ID NO: 364 - DNA, 35 bp, Artificial Sequences
  Synthetic
ttcggcgtttattagttgatttttgacgatgagtt

SEQ ID NO: 365 - DNA, 27 bp, Artificial Sequences
  Synthetic
tgtttagtaggagttgtggcgcggggt

SEQ ID NO: 366 - DNA, 27 bp, Artificial Sequences
  Synthetic
aggagttgtggcgcggggttttttagg

SEQ ID NO: 367 - DNA, 27 bp, Artificial Sequences
  Synthetic
ggagttgtggcgcggggttttttagga

SEQ ID NO: 368 - DNA, 27 bp, Artificial Sequences
  Synthetic
agttgtggcgcggggttttttaggagt

SEQ ID NO: 369 - DNA, 27 bp, Artificial Sequences
  Synthetic
agtaggagttgtggcgcggggtttttt

SEQ ID NO: 370 - DNA, 27 bp, Artificial Sequences
  Synthetic
agggagttgagggtaggggttcggtga

SEQ ID NO: 371 - DNA, 27 bp, Artificial Sequences
  Synthetic
agagggagttgagggtaggggttcggt

SEQ ID NO: 372 - DNA, 27 bp, Artificial Sequences
  Synthetic
gagggtaggggttcggtgaggtttggc

SEQ ID NO: 373 - DNA, 27 bp, Artificial Sequences
  Synthetic
aggggttcggtgaggtttggcgttttc

SEQ ID NO: 374 - DNA, 27 bp, Artificial Sequences
  Synthetic
ggagttgagggtaggggttcggtgagg

SEQ ID NO: 375 - DNA, 27 bp, Artificial Sequences
  Synthetic
tgtgttgtgttttgcgggtggaggtgg

SEQ ID NO: 376 - DNA, 27 bp, Artificial Sequences
  Synthetic
gtggaggtggattggagggaagcggag

SEQ ID NO: 377 - DNA, 27 bp, Artificial Sequences
  Synthetic
gtgttgtgttttgcgggtggaggtgga

SEQ ID NO: 378 - DNA, 27 bp, Artificial Sequences
  Synthetic
gttttgcgggtggaggtggattggagg

SEQ ID NO: 379 - DNA, 27 bp, Artificial Sequences
  Synthetic
tgtgttttgcgggtggaggtggattgg

SEQ ID NO: 380 - DNA, 30 bp, Artificial Sequences
  Synthetic
agttcgggggattagataggtaggtttcgt

SEQ ID NO: 381 - DNA, 30 bp, Artificial Sequences
  Synthetic
aggttaagttggtttaaggtagttcggggg

SEQ ID NO: 382 - DNA, 30 bp, Artificial Sequences
  Synthetic
ggttaagttggtttaaggtagttcggggga

SEQ ID NO: 383 - DNA, 31 bp, Artificial Sequences
  Synthetic
aggttaagttggtttaaggtagttcggggga

SEQ ID NO: 384 - DNA, 31 bp, Artificial Sequences
  Synthetic
agttcgggggattagataggtaggtttcgtt

SEQ ID NO: 385 - DNA, 27 bp, Artificial Sequences
  Synthetic
cgacgtgggttggggtaaaggggagaa

SEQ ID NO: 386 - DNA, 27 bp, Artificial Sequences
  Synthetic
cgtgggttggggtaaaggggagaaggg

SEQ ID NO: 387 - DNA, 27 bp, Artificial Sequences
  Synthetic
cggcggtcgttcggttattttgtgggt

SEQ ID NO: 388 - DNA, 27 bp, Artificial Sequences
  Synthetic
atcgacgtgggttggggtaaaggggag

SEQ ID NO: 389 - DNA, 27 bp, Artificial Sequences
  Synthetic
acgtgggttggggtaaaggggagaagg

SEQ ID NO: 390 - DNA, 32 bp, Artificial Sequences
  Synthetic
gaggttcgaggtttggtgaatgtgtttattgt

SEQ ID NO: 391 - DNA, 33 bp, Artificial Sequences
  Synthetic
gaggttcgaggtttggtgaatgtgtttattgtt

SEQ ID NO: 392 - DNA, 33 bp, Artificial Sequences
  Synthetic
ggtttggtgaatgtgtttattgttttttcgggg

SEQ ID NO: 393 - DNA, 34 bp, Artificial Sequences
  Synthetic
ggtttggtgaatgtgtttattgttttttcggggt

SEQ ID NO: 394 - DNA, 33 bp, Artificial Sequences
  Synthetic
aggttcgaggtttggtgaatgtgtttattgttt

SEQ ID NO: 395 - DNA, 27 bp, Artificial Sequences
  Synthetic
ttggttagtttcgtgggtgcggtcgtc

SEQ ID NO: 396 - DNA, 27 bp, Artificial Sequences
  Synthetic
tttggttagtttcgtgggtgcggtcgt

SEQ ID NO: 397 - DNA, 28 bp, Artificial Sequences
  Synthetic
tttggttagtttcgtgggtgcggtcgtc

SEQ ID NO: 398 - DNA, 26 bp, Artificial Sequences
  Synthetic
tggttagtttcgtgggtgcggtcgtc

SEQ ID NO: 399 - DNA, 28 bp, Artificial Sequences
  Synthetic
ttttggttagtttcgtgggtgcggtcgt

SEQ ID NO: 400 - DNA, 27 bp, Artificial Sequences
  Synthetic
tggatgaagtcggagtgtagcgggaat

SEQ ID NO: 401 - DNA, 27 bp, Artificial Sequences
  Synthetic
atggatgaagtcggagtgtagcgggaa

SEQ ID NO: 402 - DNA, 27 bp, Artificial Sequences
  Synthetic
aatggatgaagtcggagtgtagcggga

SEQ ID NO: 403 - DNA, 28 bp, Artificial Sequences
  Synthetic
tggatgaagtcggagtgtagcgggaatc

SEQ ID NO: 404 - DNA, 27 bp, Artificial Sequences
  Synthetic
ggatgaagtcggagtgtagcgggaatc

SEQ ID NO: 405 - DNA, 27 bp, Artificial Sequences
  Synthetic
cggcggttgttttgttcggaggttcgt

SEQ ID NO: 406 - DNA, 27 bp, Artificial Sequences
  Synthetic
ggtcggcggttgttttgttcggaggtt

SEQ ID NO: 407 - DNA, 27 bp, Artificial Sequences
  Synthetic
tcggcggttgttttgttcggaggttcg

SEQ ID NO: 408 - DNA, 27 bp, Artificial Sequences
  Synthetic
gaggggttcgttggtgagtgggaggtt

SEQ ID NO: 409 - DNA, 27 bp, Artificial Sequences
  Synthetic
ttgaggggttcgttggtgagtgggagg

SEQ ID NO: 410 - DNA, 27 bp, Artificial Sequences
  Synthetic
tggatgaagtcggagtgtagcgggaat

SEQ ID NO: 411 - DNA, 27 bp, Artificial Sequences
  Synthetic
atggatgaagtcggagtgtagcgggaa

SEQ ID NO: 412 - DNA, 27 bp, Artificial Sequences
  Synthetic
aatggatgaagtcggagtgtagcggga

SEQ ID NO: 413 - DNA, 28 bp, Artificial Sequences
  Synthetic
tggatgaagtcggagtgtagcgggaatc

SEQ ID NO: 414 - DNA, 27 bp, Artificial Sequences
  Synthetic
ggatgaagtcggagtgtagcgggaatc

SEQ ID NO: 415 - DNA, 27 bp, Artificial Sequences
  Synthetic
gttcggtcggcggttgttttgttcgga

SEQ ID NO: 416 - DNA, 27 bp, Artificial Sequences
  Synthetic
cggcggttgttttgttcggaggttcgt

SEQ ID NO: 417 - DNA, 27 bp, Artificial Sequences
  Synthetic
ggtcggcggttgttttgttcggaggtt

SEQ ID NO: 418 - DNA, 27 bp, Artificial Sequences
  Synthetic
tcggcggttgttttgttcggaggttcg

SEQ ID NO: 419 - DNA, 27 bp, Artificial Sequences
  Synthetic
ttcggtcggcggttgttttgttcggag

SEQ ID NO: 420 - DNA, 27 bp, Artificial Sequences
  Synthetic
ggggatgggggtagtttcgcgggtaaa

SEQ ID NO: 421 - DNA, 26 bp, Artificial Sequences
  Synthetic
ggggatgggggtagtttcgcgggtaa

SEQ ID NO: 422 - DNA, 27 bp, Artificial Sequences
  Synthetic
gggatgggggtagtttcgcgggtaaag

SEQ ID NO: 423 - DNA, 28 bp, Artificial Sequences
  Synthetic
gggatgggggtagtttcgcgggtaaaga

SEQ ID NO: 424 - DNA, 28 bp, Artificial Sequences
  Synthetic
ggggatgggggtagtttcgcgggtaaag

SEQ ID NO: 425 - DNA, 36 bp, Artificial Sequences
  Synthetic
gtttaggttgttgggtacggtattttttgtttaggt

SEQ ID NO: 426 - DNA, 36 bp, Artificial Sequences
  Synthetic
tgtttaggttgttgggtacggtattttttgtttagg

SEQ ID NO: 427 - DNA, 27 bp, Artificial Sequences
  Synthetic
attttgggtgcggtggggtagaggacg

SEQ ID NO: 428 - DNA, 28 bp, Artificial Sequences
  Synthetic
tattttgggtgcggtggggtagaggacg

SEQ ID NO: 429 - DNA, 26 bp, Artificial Sequences
  Synthetic
ttttgggtgcggtggggtagaggacg

SEQ ID NO: 430 - DNA, 27 bp, Artificial Sequences
  Synthetic
gaggacggggatgaggcggtcggaatc

SEQ ID NO: 431 - DNA, 27 bp, Artificial Sequences
  Synthetic
tattttgggtgcggtggggtagaggac

SEQ ID NO: 432 - DNA, 27 bp, Artificial Sequences
  Synthetic
ggcgggagaaagcgtgcggaagttttt

SEQ ID NO: 433 - DNA, 27 bp, Artificial Sequences
  Synthetic
gcgggagaaagcgtgcggaagtttttg

SEQ ID NO: 434 - DNA, 27 bp, Artificial Sequences
  Synthetic
cgggagaaagcgtgcggaagtttttgg

SEQ ID NO: 435 - DNA, 27 bp, Artificial Sequences
  Synthetic
aggcgggagaaagcgtgcggaagtttt

SEQ ID NO: 436 - DNA, 27 bp, Artificial Sequences
  Synthetic
gggagaaagcgtgcggaagtttttggg

SEQ ID NO: 437 - DNA, 27 bp, Artificial Sequences
  Synthetic
agcgcgatgagatgaaagtgggggaga

SEQ ID NO: 438 - DNA, 27 bp, Artificial Sequences
  Synthetic
gagcgcgatgagatgaaagtgggggag

SEQ ID NO: 439 - DNA, 28 bp, Artificial Sequences
  Synthetic
gagcgcgatgagatgaaagtgggggaga

SEQ ID NO: 440 - DNA, 27 bp, Artificial Sequences
  Synthetic
gcgcgatgagatgaaagtgggggagaa

SEQ ID NO: 441 - DNA, 28 bp, Artificial Sequences
  Synthetic
agcgcgatgagatgaaagtgggggagaa

SEQ ID NO: 442 - DNA, 27 bp, Artificial Sequences
  Synthetic
gcggagtaggttaggcgtagggggttg

SEQ ID NO: 443 - DNA, 27 bp, Artificial Sequences
  Synthetic
gttaggcgtagggggttgaggtcgagc

SEQ ID NO: 444 - DNA, 27 bp, Artificial Sequences
  Synthetic
aggttaggcgtagggggttgaggtcga

SEQ ID NO: 445 - DNA, 27 bp, Artificial Sequences
  Synthetic
aggcgtagtttatgggtgggcggaagt

SEQ ID NO: 446 - DNA, 27 bp, Artificial Sequences
  Synthetic
ggttaggcgtagggggttgaggtcgag

SEQ ID NO: 447 - DNA, 27 bp, Artificial Sequences
  Synthetic
tggggcgttgggttcgttgagtagtcg

SEQ ID NO: 448 - DNA, 27 bp, Artificial Sequences
  Synthetic
cgtttggggcgttgggttcgttgagta

SEQ ID NO: 449 - DNA, 27 bp, Artificial Sequences
  Synthetic
ggggtttggcggtcggtttgggttttg

SEQ ID NO: 450 - DNA, 27 bp, Artificial Sequences
  Synthetic
gggcgttgggttcgttgagtagtcgtt

SEQ ID NO: 451 - DNA, 26 bp, Artificial Sequences
  Synthetic
cgtttggggcgttgggttcgttgagt

SEQ ID NO: 452 - DNA, 27 bp, Artificial Sequences
  Synthetic
cgggtttcgtttgtagcggcgtaggta

SEQ ID NO: 453 - DNA, 28 bp, Artificial Sequences
  Synthetic
gcgtcggttagtaagggtttgtggtgcg

SEQ ID NO: 454 - DNA, 27 bp, Artificial Sequences
  Synthetic
tagtaagggtttgtggtgcggaggtgc

SEQ ID NO: 455 - DNA, 28 bp, Artificial Sequences
  Synthetic
ggcgtcggttagtaagggtttgtggtgc

SEQ ID NO: 456 - DNA, 27 bp, Artificial Sequences
  Synthetic
ggcgttatggcgtcggttagtaagggt

SEQ ID NO: 457 - DNA, 27 bp, Artificial Sequences
  Synthetic
tattatcgtgggggtttggcggtcggt

SEQ ID NO: 458 - DNA, 27 bp, Artificial Sequences
  Synthetic
ggtcggtttgggttttgcggcgttttt

SEQ ID NO: 459 - DNA, 27 bp, Artificial Sequences
  Synthetic
attatcgtgggggtttggcggtcggtt

SEQ ID NO: 460 - DNA, 27 bp, Artificial Sequences
  Synthetic
ttatcgtgggggtttggcggtcggttt

SEQ ID NO: 461 - DNA, 27 bp, Artificial Sequences
  Synthetic
ggggtttggcggtcggtttgggttttg

SEQ ID NO: 462 - DNA, 27 bp, Artificial Sequences
  Synthetic
cgggtttcgtttgtagcggcgtaggta

SEQ ID NO: 463 - DNA, 28 bp, Artificial Sequences
  Synthetic
gcgtcggttagtaagggtttgtggtgcg

SEQ ID NO: 464 - DNA, 27 bp, Artificial Sequences
  Synthetic
tagtaagggtttgtggtgcggaggtgc

SEQ ID NO: 465 - DNA, 28 bp, Artificial Sequences
  Synthetic
ggcgtcggttagtaagggtttgtggtgc

SEQ ID NO: 466 - DNA, 28 bp, Artificial Sequences
  Synthetic
cgtcggttagtaagggtttgtggtgcgg

SEQ ID NO: 467 - DNA, 27 bp, Artificial Sequences
  Synthetic
tattatcgtgggggtttggcggtcggt

SEQ ID NO: 468 - DNA, 27 bp, Artificial Sequences
  Synthetic
ggtcggtttgggttttgcggcgttttt

SEQ ID NO: 469 - DNA, 27 bp, Artificial Sequences
  Synthetic
attatcgtgggggtttggcggtcggtt

SEQ ID NO: 470 - DNA, 27 bp, Artificial Sequences
  Synthetic
ttatcgtgggggtttggcggtcggttt

SEQ ID NO: 471 - DNA, 27 bp, Artificial Sequences
  Synthetic
ggggtttggcggtcggtttgggttttg

SEQ ID NO: 472 - DNA, 27 bp, Artificial Sequences
  Synthetic
gcggttttatttgggggcgtcgtaggg

SEQ ID NO: 473 - DNA, 27 bp, Artificial Sequences
  Synthetic
tttgggggcgtcgtagggtttaggtcg

SEQ ID NO: 474 - DNA, 27 bp, Artificial Sequences
  Synthetic
cggttttatttgggggcgtcgtagggt

SEQ ID NO: 475 - DNA, 26 bp, Artificial Sequences
  Synthetic
ttgggggcgtcgtagggtttaggtcg

SEQ ID NO: 476 - DNA, 28 bp, Artificial Sequences
  Synthetic
atttgggggcgtcgtagggtttaggtcg

SEQ ID NO: 477 - DNA, 27 bp, Artificial Sequences
  Synthetic
ggcgaggcgttttggagttggtgttgt

SEQ ID NO: 478 - DNA, 27 bp, Artificial Sequences
  Synthetic
tattatcgtgggggtttggcggtcggt

SEQ ID NO: 479 - DNA, 27 bp, Artificial Sequences
  Synthetic
ggtcggtttgggttttgcggcgttttt

SEQ ID NO: 480 - DNA, 27 bp, Artificial Sequences
  Synthetic
attatcgtgggggtttggcggtcggtt

SEQ ID NO: 481 - DNA, 27 bp, Artificial Sequences
  Synthetic
ttggagttggtgttgtagggttgcggc

SEQ ID NO: 482 - DNA, 27 bp, Artificial Sequences
  Synthetic
ggcgtcgtagggtttaggtcggtcgtt

SEQ ID NO: 483 - DNA, 27 bp, Artificial Sequences
  Synthetic
gcggttttatttgggggcgtcgtaggg

SEQ ID NO: 484 - DNA, 27 bp, Artificial Sequences
  Synthetic
ggcggttttatttgggggcgtcgtagg

SEQ ID NO: 485 - DNA, 27 bp, Artificial Sequences
  Synthetic
tttgggggcgtcgtagggtttaggtcg

SEQ ID NO: 486 - DNA, 27 bp, Artificial Sequences
  Synthetic
cggttttatttgggggcgtcgtagggt

SEQ ID NO: 487 - DNA, 27 bp, Artificial Sequences
  Synthetic
tagggttgggcggaggttcgggtttac

SEQ ID NO: 488 - DNA, 27 bp, Artificial Sequences
  Synthetic
ttgggcggaggttcgggtttacggtag

SEQ ID NO: 489 - DNA, 27 bp, Artificial Sequences
  Synthetic
ggcgaggcgttttggagttggtgttgt

SEQ ID NO: 490 - DNA, 27 bp, Artificial Sequences
  Synthetic
gttgggcggaggttcgggtttacggta

SEQ ID NO: 491 - DNA, 27 bp, Artificial Sequences
  Synthetic
ttggagttggtgttgtagggttgcggc

SEQ ID NO: 492 - DNA, 27 bp, Artificial Sequences
  Synthetic
cgtcggtggtttgggaatacgcgtgtt

SEQ ID NO: 493 - DNA, 27 bp, Artificial Sequences
  Synthetic
tcgtcggtggtttgggaatacgcgtgt

SEQ ID NO: 494 - DNA, 27 bp, Artificial Sequences
  Synthetic
ttcgtcggtggtttgggaatacgcgtg

SEQ ID NO: 495 - DNA, 27 bp, Artificial Sequences
  Synthetic
tttcgtcggtggtttgggaatacgcgt

SEQ ID NO: 496 - DNA, 28 bp, Artificial Sequences
  Synthetic
cgtttcgtcggtggtttgggaatacgcg

SEQ ID NO: 497 - DNA, 27 bp, Artificial Sequences
  Synthetic
tagggttgggcggaggttcgggtttac

SEQ ID NO: 498 - DNA, 27 bp, Artificial Sequences
  Synthetic
taaagaagagggtgaggtcgcgtcggc

SEQ ID NO: 499 - DNA, 27 bp, Artificial Sequences
  Synthetic
gttgggcggaggttcgggtttacggta

SEQ ID NO: 500 - DNA, 27 bp, Artificial Sequences
  Synthetic
ggaggttcgggtttacggtagcggacg

SEQ ID NO: 501 - DNA, 27 bp, Artificial Sequences
  Synthetic
cggaggttcgggtttacggtagcggac

SEQ ID NO: 502 - DNA, 27 bp, Artificial Sequences
  Synthetic
cgtcggtggtttgggaatacgcgtgtt

SEQ ID NO: 503 - DNA, 27 bp, Artificial Sequences
  Synthetic
tcgtcggtggtttgggaatacgcgtgt

SEQ ID NO: 504 - DNA, 27 bp, Artificial Sequences
  Synthetic
ttcgtcggtggtttgggaatacgcgtg

SEQ ID NO: 505 - DNA, 27 bp, Artificial Sequences
  Synthetic
tttcgtcggtggtttgggaatacgcgt

SEQ ID NO: 506 - DNA, 28 bp, Artificial Sequences
  Synthetic
cgtttcgtcggtggtttgggaatacgcg

SEQ ID NO: 507 - DNA, 27 bp, Artificial Sequences
  Synthetic
tttaggtagcgttggttttggcggcgg

SEQ ID NO: 508 - DNA, 27 bp, Artificial Sequences
  Synthetic
taaagaagagggtgaggtcgcgtcggt

SEQ ID NO: 509 - DNA, 27 bp, Artificial Sequences
  Synthetic
gtttaggtagcgttggttttggcggcg

SEQ ID NO: 510 - DNA, 28 bp, Artificial Sequences
  Synthetic
tgtttaggtagcgttggttttggcggcg

SEQ ID NO: 511 - DNA, 26 bp, Artificial Sequences
  Synthetic
ttaggtagcgttggttttggcggcgg

SEQ ID NO: 512 - DNA, 31 bp, Artificial Sequences
  Synthetic
tcggatttagagtttagagggttagcggagt

SEQ ID NO: 513 - DNA, 31 bp, Artificial Sequences
  Synthetic
cggatttagagtttagagggttagcggagtt

SEQ ID NO: 514 - DNA, 32 bp, Artificial Sequences
  Synthetic
tcggatttagagtttagagggttagcggagtt

SEQ ID NO: 515 - DNA, 32 bp, Artificial Sequences
  Synthetic
atcggatttagagtttagagggttagcggagt

SEQ ID NO: 516 - DNA, 32 bp, Artificial Sequences
  Synthetic
cggatttagagtttagagggttagcggagttc

SEQ ID NO: 517 - DNA, 27 bp, Artificial Sequences
  Synthetic
tttaggtagcgttggttttggcggcgg

SEQ ID NO: 518 - DNA, 27 bp, Artificial Sequences
  Synthetic
aggtgcggttcggtttaggttcggaga

SEQ ID NO: 519 - DNA, 27 bp, Artificial Sequences
  Synthetic
agaggtgcggttcggtttaggttcgga

SEQ ID NO: 520 - DNA, 27 bp, Artificial Sequences
  Synthetic
gaggtgcggttcggtttaggttcggag

SEQ ID NO: 521 - DNA, 27 bp, Artificial Sequences
  Synthetic
gtttaggtagcgttggttttggcggcg

SEQ ID NO: 522 - DNA, 27 bp, Artificial Sequences
  Synthetic
tgagtcgggtcgtatttttggggacga

SEQ ID NO: 523 - DNA, 27 bp, Artificial Sequences
  Synthetic
ttgagtcgggtcgtatttttggggacg

SEQ ID NO: 524 - DNA, 28 bp, Artificial Sequences
  Synthetic
ttgagtcgggtcgtatttttggggacga

SEQ ID NO: 525 - DNA, 27 bp, Artificial Sequences
  Synthetic
ttttttggaggttcgagttaggggcga

SEQ ID NO: 526 - DNA, 28 bp, Artificial Sequences
  Synthetic
tttgagtcgggtcgtatttttggggacg

SEQ ID NO: 527 - DNA, 27 bp, Artificial Sequences
  Synthetic
aggtgcggttcggtttaggttcggaga

SEQ ID NO: 528 - DNA, 27 bp, Artificial Sequences
  Synthetic
agaggtgcggttcggtttaggttcgga

SEQ ID NO: 529 - DNA, 27 bp, Artificial Sequences
  Synthetic
gaggtgcggttcggtttaggttcggag

SEQ ID NO: 530 - DNA, 28 bp, Artificial Sequences
  Synthetic
agaggtgcggttcggtttaggttcggag

SEQ ID NO: 531 - DNA, 28 bp, Artificial Sequences
  Synthetic
gaggtgcggttcggtttaggttcggaga

SEQ ID NO: 532 - DNA, 27 bp, Artificial Sequences
  Synthetic
tgagtcgggtcgtatttttggggacga

SEQ ID NO: 533 - DNA, 27 bp, Artificial Sequences
  Synthetic
ttgagtcgggtcgtatttttggggacg

SEQ ID NO: 534 - DNA, 28 bp, Artificial Sequences
  Synthetic
ttgagtcgggtcgtatttttggggacga

SEQ ID NO: 535 - DNA, 27 bp, Artificial Sequences
  Synthetic
ttttttggaggttcgagttaggggcga

SEQ ID NO: 536 - DNA, 28 bp, Artificial Sequences
  Synthetic
tttgagtcgggtcgtatttttggggacg

SEQ ID NO: 537 - DNA, 27 bp, Artificial Sequences
  Synthetic
acgttgttgtaggtaggtcgttcgggt

SEQ ID NO: 538 - DNA, 27 bp, Artificial Sequences
  Synthetic
aggtaggtcgttcgggtagttcgttgt

SEQ ID NO: 539 - DNA, 28 bp, Artificial Sequences
  Synthetic
gacgttgttgtaggtaggtcgttcgggt

SEQ ID NO: 540 - DNA, 27 bp, Artificial Sequences
  Synthetic
gacgttgttgtaggtaggtcgttcggg

SEQ ID NO: 541 - DNA, 27 bp, Artificial Sequences
  Synthetic
ggtaggtcgttcgggtagttcgttgtc

SEQ ID NO: 542 - DNA, 27 bp, Artificial Sequences
  Synthetic
tgagtcgggtcgtatttttggggacga

SEQ ID NO: 543 - DNA, 27 bp, Artificial Sequences
  Synthetic
ttgagtcgggtcgtatttttggggacg

SEQ ID NO: 544 - DNA, 28 bp, Artificial Sequences
  Synthetic
ttgagtcgggtcgtatttttggggacga

SEQ ID NO: 545 - DNA, 28 bp, Artificial Sequences
  Synthetic
tttgagtcgggtcgtatttttggggacg

SEQ ID NO: 546 - DNA, 29 bp, Artificial Sequences
  Synthetic
tttgagtcgggtcgtatttttggggacga

SEQ ID NO: 547 - DNA, 27 bp, Artificial Sequences
  Synthetic
acgttgttgtaggtaggtcgttcgggt

SEQ ID NO: 548 - DNA, 27 bp, Artificial Sequences
  Synthetic
aggtaggtcgttcgggtagttcgttgt

SEQ ID NO: 549 - DNA, 28 bp, Artificial Sequences
  Synthetic
gacgttgttgtaggtaggtcgttcgggt

SEQ ID NO: 550 - DNA, 27 bp, Artificial Sequences
  Synthetic
gacgttgttgtaggtaggtcgttcggg

SEQ ID NO: 551 - DNA, 27 bp, Artificial Sequences
  Synthetic
ggtaggtcgttcgggtagttcgttgtc

SEQ ID NO: 552 - DNA, 27 bp, Artificial Sequences
  Synthetic
tagcgggttgttcgggcggtttgtttg

SEQ ID NO: 553 - DNA, 27 bp, Artificial Sequences
  Synthetic
gtagcgggttgttcgggcggtttgttt

SEQ ID NO: 554 - DNA, 27 bp, Artificial Sequences
  Synthetic
gcgggttgttcgggcggtttgtttgta

SEQ ID NO: 555 - DNA, 26 bp, Artificial Sequences
  Synthetic
gtagcgggttgttcgggcggtttgtt

SEQ ID NO: 556 - DNA, 27 bp, Artificial Sequences
  Synthetic
cgggttgttcgggcggtttgtttgtag

SEQ ID NO: 557 - DNA, 27 bp, Artificial Sequences
  Synthetic
agggttgtggggttgagggagaggaaa

SEQ ID NO: 558 - DNA, 27 bp, Artificial Sequences
  Synthetic
aagggttgtggggttgagggagaggaa

SEQ ID NO: 559 - DNA, 27 bp, Artificial Sequences
  Synthetic
taagggttgtggggttgagggagagga

SEQ ID NO: 560 - DNA, 28 bp, Artificial Sequences
  Synthetic
aagggttgtggggttgagggagaggaaa

SEQ ID NO: 561 - DNA, 27 bp, Artificial Sequences
  Synthetic
gggttgtggggttgagggagaggaaat

SEQ ID NO: 562 - DNA, 27 bp, Artificial Sequences
  Synthetic
gggtcgtggtagagggagggtaggagg

SEQ ID NO: 563 - DNA, 27 bp, Artificial Sequences
  Synthetic
ggtcgtggtagagggagggtaggaggt

SEQ ID NO: 564 - DNA, 27 bp, Artificial Sequences
  Synthetic
tgggtcgtggtagagggagggtaggag

SEQ ID NO: 565 - DNA, 27 bp, Artificial Sequences
  Synthetic
aggttgggtcgtggtagagggagggta

SEQ ID NO: 566 - DNA, 27 bp, Artificial Sequences
  Synthetic
taggttgggtcgtggtagagggagggt

SEQ ID NO: 567 - DNA, 27 bp, Artificial Sequences
  Synthetic
ggttttggtggttgggttcgcgtggat

SEQ ID NO: 568 - DNA, 27 bp, Artificial Sequences
  Synthetic
tgcgcgtcggaggatggtggttatagg

SEQ ID NO: 569 - DNA, 27 bp, Artificial Sequences
  Synthetic
agtatgtgtggatgcgcgtcggaggat

SEQ ID NO: 570 - DNA, 27 bp, Artificial Sequences
  Synthetic
ttgtcgcggttttggtggttgggttcg

SEQ ID NO: 571 - DNA, 27 bp, Artificial Sequences
  Synthetic
cgcgtcggaggatggtggttatagggt

SEQ ID NO: 572 - DNA, 29 bp, Artificial Sequences
  Synthetic
cgggtttagttattaaggtcgcggtaggg

SEQ ID NO: 573 - DNA, 30 bp, Artificial Sequences
  Synthetic
cgggtttagttattaaggtcgcggtagggt

SEQ ID NO: 574 - DNA, 29 bp, Artificial Sequences
  Synthetic
gggtttagttattaaggtcgcggtagggt

SEQ ID NO: 575 - DNA, 31 bp, Artificial Sequences
  Synthetic
cgggtttagttattaaggtcgcggtagggtt

SEQ ID NO: 576 - DNA, 30 bp, Artificial Sequences
  Synthetic
gggtttagttattaaggtcgcggtagggtt

SEQ ID NO: 577 - DNA, 27 bp, Artificial Sequences
  Synthetic
ggttttggtggttgggttcgcgtggat

SEQ ID NO: 578 - DNA, 27 bp, Artificial Sequences
  Synthetic
ttgtcgcggttttggtggttgggttcg

SEQ ID NO: 579 - DNA, 27 bp, Artificial Sequences
  Synthetic
ggttttgtcgcggttttggtggttggg

SEQ ID NO: 580 - DNA, 27 bp, Artificial Sequences
  Synthetic
cgttggttttgtcgcggttttggtggt

SEQ ID NO: 581 - DNA, 26 bp, Artificial Sequences
  Synthetic
ggttttggtggttgggttcgcgtgga

SEQ ID NO: 582 - DNA, 27 bp, Artificial Sequences
  Synthetic
tagttcggcgatgagtggttttgcggg

SEQ ID NO: 583 - DNA, 27 bp, Artificial Sequences
  Synthetic
ttcggcgatgagtggttttgcggggat

SEQ ID NO: 584 - DNA, 27 bp, Artificial Sequences
  Synthetic
tcggcgatgagtggttttgcggggatc

SEQ ID NO: 585 - DNA, 26 bp, Artificial Sequences
  Synthetic
agttcggcgatgagtggttttgcggg

SEQ ID NO: 586 - DNA, 27 bp, Artificial Sequences
  Synthetic
acgcgtcgggtcggtggaatttagttt

SEQ ID NO: 587 - DNA, 28 bp, Artificial Sequences
  Synthetic
cgaggtaagaaggaaatggggtcgtcgg

SEQ ID NO: 588 - DNA, 29 bp, Artificial Sequences
  Synthetic
cgaggtaagaaggaaatggggtcgtcggt

SEQ ID NO: 589 - DNA, 27 bp, Artificial Sequences
  Synthetic
aggtaagaaggaaatggggtcgtcggt

SEQ ID NO: 590 - DNA, 27 bp, Artificial Sequences
  Synthetic
ggggagtttcgggtttgtagttgtcgt

SEQ ID NO: 591 - DNA, 27 bp, Artificial Sequences
  Synthetic
cgaggtaagaaggaaatggggtcgtcg

SEQ ID NO: 592 - DNA, 27 bp, Artificial Sequences
  Synthetic
tagggacggttagaggggcgtgtgaga

SEQ ID NO: 593 - DNA, 27 bp, Artificial Sequences
  Synthetic
taggtagggacggttagaggggcgtgt

SEQ ID NO: 594 - DNA, 27 bp, Artificial Sequences
  Synthetic
gggacggttagaggggcgtgtgagatt

SEQ ID NO: 595 - DNA, 27 bp, Artificial Sequences
  Synthetic
gtagggacggttagaggggcgtgtgag

SEQ ID NO: 596 - DNA, 27 bp, Artificial Sequences
  Synthetic
agggacggttagaggggcgtgtgagat

SEQ ID NO: 597 - DNA, 33 bp, Artificial Sequences
  Synthetic
tttggtcgtttttgtttgggatatcgagttgaa

SEQ ID NO: 598 - DNA, 33 bp, Artificial Sequences
  Synthetic
ttttggtcgtttttgtttgggatatcgagttga

SEQ ID NO: 599 - DNA, 34 bp, Artificial Sequences
  Synthetic
ttttggtcgtttttgtttgggatatcgagttgaa

SEQ ID NO: 600 - DNA, 34 bp, Artificial Sequences
  Synthetic
tggtcgtttttgtttgggatatcgagttgaattt

SEQ ID NO: 601 - DNA, 34 bp, Artificial Sequences
  Synthetic
ttggtcgtttttgtttgggatatcgagttgaatt

SEQ ID NO: 602 - DNA, 27 bp, Artificial Sequences
  Synthetic
tagggacggttagaggggcgtgtgaga

SEQ ID NO: 603 - DNA, 27 bp, Artificial Sequences
  Synthetic
taggtagggacggttagaggggcgtgt

SEQ ID NO: 604 - DNA, 27 bp, Artificial Sequences
  Synthetic
gggacggttagaggggcgtgtgagatt

SEQ ID NO: 605 - DNA, 27 bp, Artificial Sequences
  Synthetic
gtagggacggttagaggggcgtgtgag

SEQ ID NO: 606 - DNA, 27 bp, Artificial Sequences
  Synthetic
agggacggttagaggggcgtgtgagat

SEQ ID NO: 607 - DNA, 27 bp, Artificial Sequences
  Synthetic
gcggttgcggtaattcgaggaggagga

SEQ ID NO: 608 - DNA, 27 bp, Artificial Sequences
  Synthetic
aggaggaggaggaagaggaggacgacg

SEQ ID NO: 609 - DNA, 27 bp, Artificial Sequences
  Synthetic
cgaggaggaggaggaagaggaggacga

SEQ ID NO: 610 - DNA, 27 bp, Artificial Sequences
  Synthetic
tcgaggaggaggaggaagaggaggacg

SEQ ID NO: 611 - DNA, 27 bp, Artificial Sequences
  Synthetic
aggcggcgggaagttacgttaaagtcg

SEQ ID NO: 612 - DNA, 27 bp, Artificial Sequences
  Synthetic
gttgtgggtagatttcggtagcggcgg

SEQ ID NO: 613 - DNA, 27 bp, Artificial Sequences
  Synthetic
ggttgtgggtagatttcggtagcggcg

SEQ ID NO: 614 - DNA, 28 bp, Artificial Sequences
  Synthetic
aggttgtgggtagatttcggtagcggcg

SEQ ID NO: 615 - DNA, 27 bp, Artificial Sequences
  Synthetic
aggttgtgggtagatttcggtagcggc

SEQ ID NO: 616 - DNA, 28 bp, Artificial Sequences
  Synthetic
cgttgtcgttcggtgttaggttgtgggt

SEQ ID NO: 617 - DNA, 27 bp, Artificial Sequences
  Synthetic
gcggttgcggtaattcgaggaggagga

SEQ ID NO: 618 - DNA, 27 bp, Artificial Sequences
  Synthetic
ggaggaggaggaagaggaggacgacga

SEQ ID NO: 619 - DNA, 27 bp, Artificial Sequences
  Synthetic
aggaggaggaagaggaggacgacgaga

SEQ ID NO: 620 - DNA, 28 bp, Artificial Sequences
  Synthetic
cggttgcggtaattcgaggaggaggagg

SEQ ID NO: 621 - DNA, 28 bp, Artificial Sequences
  Synthetic
ggaggaggaggaagaggaggacgacgag

SEQ ID NO: 622 - DNA, 27 bp, Artificial Sequences
  Synthetic
gagcggcggtagtggtcgtgacgttac

SEQ ID NO: 623 - DNA, 26 bp, Artificial Sequences
  Synthetic
gagcggcggtagtggtcgtgacgtta

SEQ ID NO: 624 - DNA, 26 bp, Artificial Sequences
  Synthetic
agcggcggtagtggtcgtgacgttac

SEQ ID NO: 625 - DNA, 27 bp, Artificial Sequences
  Synthetic
ggagcggcggtagtggtcgtgacgtta

SEQ ID NO: 626 - DNA, 25 bp, Artificial Sequences
  Synthetic
agcggcggtagtggtcgtgacgtta

SEQ ID NO: 627 - DNA, 27 bp, Artificial Sequences
  Synthetic
gcggttgcggtaattcgaggaggagga

SEQ ID NO: 628 - DNA, 28 bp, Artificial Sequences
  Synthetic
cggttgcggtaattcgaggaggaggagg

SEQ ID NO: 629 - DNA, 27 bp, Artificial Sequences
  Synthetic
cggttgcggtaattcgaggaggaggag

SEQ ID NO: 630 - DNA, 28 bp, Artificial Sequences
  Synthetic
gcggttgcggtaattcgaggaggaggag

SEQ ID NO: 631 - DNA, 27 bp, Artificial Sequences
  Synthetic
ggttgcggtaattcgaggaggaggagg

SEQ ID NO: 632 - DNA, 27 bp, Artificial Sequences
  Synthetic
gagcggcggtagtggtcgtgacgttac

SEQ ID NO: 633 - DNA, 26 bp, Artificial Sequences
  Synthetic
gagcggcggtagtggtcgtgacgtta

SEQ ID NO: 634 - DNA, 26 bp, Artificial Sequences
  Synthetic
agcggcggtagtggtcgtgacgttac

SEQ ID NO: 635 - DNA, 27 bp, Artificial Sequences
  Synthetic
ggagcggcggtagtggtcgtgacgtta

SEQ ID NO: 636 - DNA, 25 bp, Artificial Sequences
  Synthetic
agcggcggtagtggtcgtgacgtta

SEQ ID NO: 637 - DNA, 29 bp, Artificial Sequences
  Synthetic
cgcgttcgtttgtaattcggttgttggcg

SEQ ID NO: 638 - DNA, 29 bp, Artificial Sequences
  Synthetic
gcgttcgtttgtaattcggttgttggcgg

SEQ ID NO: 639 - DNA, 29 bp, Artificial Sequences
  Synthetic
cgttcgtttgtaattcggttgttggcggg

SEQ ID NO: 640 - DNA, 28 bp, Artificial Sequences
  Synthetic
gcgttcgtttgtaattcggttgttggcg

SEQ ID NO: 641 - DNA, 28 bp, Artificial Sequences
  Synthetic
cgcgttcgtttgtaattcggttgttggc

SEQ ID NO: 642 - DNA, 23 bp, Artificial Sequences
  Synthetic
gcggttaataggggcgcggggtc

SEQ ID NO: 643 - DNA, 29 bp, Artificial Sequences
  Synthetic
tgcgtttattggttttttggtacgtcggc

SEQ ID NO: 644 - DNA, 28 bp, Artificial Sequences
  Synthetic
gcgtttattggttttttggtacgtcggc

SEQ ID NO: 645 - DNA, 28 bp, Artificial Sequences
  Synthetic
cgagcgttgcgtttattggttttttggt

SEQ ID NO: 646 - DNA, 22 bp, Artificial Sequences
  Synthetic
gcggttaataggggcgcggggt

SEQ ID NO: 647 - DNA, 27 bp, Artificial Sequences
  Synthetic
cgtttgtaattcggttgttggcgggcg

SEQ ID NO: 648 - DNA, 27 bp, Artificial Sequences
  Synthetic
gtttgtaattcggttgttggcgggcgg

SEQ ID NO: 649 - DNA, 28 bp, Artificial Sequences
  Synthetic
tcgtttgtaattcggttgttggcgggcg

SEQ ID NO: 650 - DNA, 27 bp, Artificial Sequences
  Synthetic
tcgtttgtaattcggttgttggcgggc

SEQ ID NO: 651 - DNA, 28 bp, Artificial Sequences
  Synthetic
cgtttgtaattcggttgttggcgggcgg

SEQ ID NO: 652 - DNA, 27 bp, Artificial Sequences
  Synthetic
gttgcgggtttagggatgtgcgggttt

SEQ ID NO: 653 - DNA, 27 bp, Artificial Sequences
  Synthetic
tagggttgcgggtttagggatgtgcgg

SEQ ID NO: 654 - DNA, 27 bp, Artificial Sequences
  Synthetic
tgcgggtttagggatgtgcgggttttt

SEQ ID NO: 655 - DNA, 27 bp, Artificial Sequences
  Synthetic
ttgcgggtttagggatgtgcgggtttt

SEQ ID NO: 656 - DNA, 27 bp, Artificial Sequences
  Synthetic
ttagggttgcgggtttagggatgtgcg

SEQ ID NO: 657 - DNA, 27 bp, Artificial Sequences
  Synthetic
tgggatttaggtgggttggggggttgg

SEQ ID NO: 658 - DNA, 27 bp, Artificial Sequences
  Synthetic
gggttggggggttgggggaatgtagat

SEQ ID NO: 659 - DNA, 27 bp, Artificial Sequences
  Synthetic
gtgggttggggggttgggggaatgtag

SEQ ID NO: 660 - DNA, 27 bp, Artificial Sequences
  Synthetic
gatttaggtgggttggggggttggggg

SEQ ID NO: 661 - DNA, 27 bp, Artificial Sequences
  Synthetic
ggatttaggtgggttggggggttgggg

SEQ ID NO: 662 - DNA, 30 bp, Artificial Sequences
  Synthetic
gtggggtttgagtgttgtagagtaggaagt

SEQ ID NO: 663 - DNA, 31 bp, Artificial Sequences
  Synthetic
agtggggtttgagtgttgtagagtaggaagt

SEQ ID NO: 664 - DNA, 31 bp, Artificial Sequences
  Synthetic
gtggggtttgagtgttgtagagtaggaagtt

SEQ ID NO: 665 - DNA, 32 bp, Artificial Sequences
  Synthetic
agtggggtttgagtgttgtagagtaggaagtt

SEQ ID NO: 666 - DNA, 32 bp, Artificial Sequences
  Synthetic
tagtggggtttgagtgttgtagagtaggaagt

SEQ ID NO: 667 - DNA, 30 bp, Artificial Sequences
  Synthetic
gcgcggggaagttaagattgttagaagggc

SEQ ID NO: 668 - DNA, 30 bp, Artificial Sequences
  Synthetic
cgcggggaagttaagattgttagaagggcg

SEQ ID NO: 669 - DNA, 30 bp, Artificial Sequences
  Synthetic
gcggggaagttaagattgttagaagggcgg

SEQ ID NO: 670 - DNA, 31 bp, Artificial Sequences
  Synthetic
gcggggaagttaagattgttagaagggcggt

SEQ ID NO: 671 - DNA, 31 bp, Artificial Sequences
  Synthetic
agcgcggggaagttaagattgttagaagggc

SEQ ID NO: 672 - DNA, 27 bp, Artificial Sequences
  Synthetic
ggtcggttggggattgcggtttggttt

SEQ ID NO: 673 - DNA, 27 bp, Artificial Sequences
  Synthetic
cggttggggattgcggtttggttttgg

SEQ ID NO: 674 - DNA, 26 bp, Artificial Sequences
  Synthetic
ggtcggttggggattgcggtttggtt

SEQ ID NO: 675 - DNA, 28 bp, Artificial Sequences
  Synthetic
tcggttggggattgcggtttggttttgg

SEQ ID NO: 676 - DNA, 28 bp, Artificial Sequences
  Synthetic
ggtcggttggggattgcggtttggtttt

SEQ ID NO: 677 - DNA, 27 bp, Artificial Sequences
  Synthetic
aggttaggttcggggaggagagacggg

SEQ ID NO: 678 - DNA, 27 bp, Artificial Sequences
  Synthetic
ggttaggttcggggaggagagacgggt

SEQ ID NO: 679 - DNA, 27 bp, Artificial Sequences
  Synthetic
gttaggttcggggaggagagacgggtt

SEQ ID NO: 680 - DNA, 27 bp, Artificial Sequences
  Synthetic
aggttcggggaggagagacgggttaag

SEQ ID NO: 681 - DNA, 27 bp, Artificial Sequences
  Synthetic
aaggttaggttcggggaggagagacgg

SEQ ID NO: 682 - DNA, 28 bp, Artificial Sequences
  Synthetic
gtttagattcggtcgagggttgtggagt

SEQ ID NO: 683 - DNA, 29 bp, Artificial Sequences
  Synthetic
agtttagattcggtcgagggttgtggagt

SEQ ID NO: 684 - DNA, 28 bp, Artificial Sequences
  Synthetic
agtttagattcggtcgagggttgtggag

SEQ ID NO: 685 - DNA, 28 bp, Artificial Sequences
  Synthetic
tttagattcggtcgagggttgtggagtt

SEQ ID NO: 686 - DNA, 28 bp, Artificial Sequences
  Synthetic
aagtttagattcggtcgagggttgtgga

SEQ ID NO: 687 - DNA, 27 bp, Artificial Sequences
  Synthetic
cggtcgggtttgggttttagggtaggt

SEQ ID NO: 688 - DNA, 28 bp, Artificial Sequences
  Synthetic
tcggtcgggtttgggttttagggtaggt

SEQ ID NO: 689 - DNA, 27 bp, Artificial Sequences
  Synthetic
tcggtcgggtttgggttttagggtagg

SEQ ID NO: 690 - DNA, 28 bp, Artificial Sequences
  Synthetic
cggtcgggtttgggttttagggtaggtg

SEQ ID NO: 691 - DNA, 29 bp, Artificial Sequences
  Synthetic
ggtcgggtttgggttttagggtaggtggt

SEQ ID NO: 692 - DNA, 27 bp, Artificial Sequences
  Synthetic
agtgtggggcgggagggtgaattatcg

SEQ ID NO: 693 - DNA, 27 bp, Artificial Sequences
  Synthetic
tgtggggcgggagggtgaattatcgtt

SEQ ID NO: 694 - DNA, 27 bp, Artificial Sequences
  Synthetic
ggttagtgtggggcgggagggtgaatt

SEQ ID NO: 695 - DNA, 27 bp, Artificial Sequences
  Synthetic
ggtaaaggttagtgtggggcgggaggg

SEQ ID NO: 696 - DNA, 27 bp, Artificial Sequences
  Synthetic
gaatggaaggcgggaggtcgagggaag

SEQ ID NO: 697 - DNA, 27 bp, Artificial Sequences
  Synthetic
agtgtggggcgggagggtgaattatcg

SEQ ID NO: 698 - DNA, 27 bp, Artificial Sequences
  Synthetic
tgtggggcgggagggtgaattatcgtt

SEQ ID NO: 699 - DNA, 27 bp, Artificial Sequences
  Synthetic
ggttagtgtggggcgggagggtgaatt

SEQ ID NO: 700 - DNA, 27 bp, Artificial Sequences
  Synthetic
ggtaaaggttagtgtggggcgggaggg

SEQ ID NO: 701 - DNA, 27 bp, Artificial Sequences
  Synthetic
gtgtggggcgggagggtgaattatcgt

SEQ ID NO: 702 - DNA, 27 bp, Artificial Sequences
  Synthetic
tggtttttgtttggttcgggttagcgt

SEQ ID NO: 703 - DNA, 28 bp, Artificial Sequences
  Synthetic
tggtttttgtttggttcgggttagcgtt

SEQ ID NO: 704 - DNA, 28 bp, Artificial Sequences
  Synthetic
ttggtttttgtttggttcgggttagcgt

SEQ ID NO: 705 - DNA, 28 bp, Artificial Sequences
  Synthetic
tgtttggttcgggttagcgttaattcgg

SEQ ID NO: 706 - DNA, 29 bp, Artificial Sequences
  Synthetic
ttggtttttgtttggttcgggttagcgtt

SEQ ID NO: 707 - DNA, 23 bp, Artificial Sequences
  Synthetic
ggaagtcgggttggcgttggttt

SEQ ID NO: 708 - DNA, 22 bp, Artificial Sequences
  Synthetic
ggaagtcgggttggcgttggtt

SEQ ID NO: 709 - DNA, 27 bp, Artificial Sequences
  Synthetic
tggtttttgtttggttcgggttagcgt

SEQ ID NO: 710 - DNA, 28 bp, Artificial Sequences
  Synthetic
tggtttttgtttggttcgggttagcgtt

SEQ ID NO: 711 - DNA, 28 bp, Artificial Sequences
  Synthetic
ttggtttttgtttggttcgggttagcgt

SEQ ID NO: 712 - DNA, 28 bp, Artificial Sequences
  Synthetic
tgtttggttcgggttagcgttaattcgg

SEQ ID NO: 713 - DNA, 24 bp, Artificial Sequences
  Synthetic
cggttttcgtggaagtcgtggcga

SEQ ID NO: 714 - DNA, 27 bp, Artificial Sequences
  Synthetic
tgggttttcgtttggggaggatttggt

SEQ ID NO: 715 - DNA, 29 bp, Artificial Sequences
  Synthetic
gggttttcgtttggggaggatttggttgg

SEQ ID NO: 716 - DNA, 30 bp, Artificial Sequences
  Synthetic
gggttttcgtttggggaggatttggttggt

SEQ ID NO: 717 - DNA, 30 bp, Artificial Sequences
  Synthetic
tgggttttcgtttggggaggatttggttgg

SEQ ID NO: 718 - DNA, 28 bp, Artificial Sequences
  Synthetic
tgggttttcgtttggggaggatttggtt

SEQ ID NO: 719 - DNA, 27 bp, Artificial Sequences
  Synthetic
tacggttttggcggagggggaatcgaa

SEQ ID NO: 720 - DNA, 27 bp, Artificial Sequences
  Synthetic
atacggttttggcggagggggaatcga

SEQ ID NO: 721 - DNA, 27 bp, Artificial Sequences
  Synthetic
gcggagggggaatcgaagttggggaat

SEQ ID NO: 722 - DNA, 27 bp, Artificial Sequences
  Synthetic
tttggcggagggggaatcgaagttggg

SEQ ID NO: 723 - DNA, 27 bp, Artificial Sequences
  Synthetic
ggttttggcggagggggaatcgaagtt

SEQ ID NO: 724 - DNA, 35 bp, Artificial Sequences
  Synthetic
tggttggagatagagataaggagagttagaaagcg

SEQ ID NO: 725 - DNA, 35 bp, Artificial Sequences
  Synthetic
ggttggagatagagataaggagagttagaaagcga

SEQ ID NO: 726 - DNA, 36 bp, Artificial Sequences
  Synthetic
tggttggagatagagataaggagagttagaaagcga

SEQ ID NO: 727 - DNA, 36 bp, Artificial Sequences
  Synthetic
atggttggagatagagataaggagagttagaaagcg

SEQ ID NO: 728 - DNA, 36 bp, Artificial Sequences
  Synthetic
ggttggagatagagataaggagagttagaaagcgat

SEQ ID NO: 729 - DNA, 27 bp, Artificial Sequences
  Synthetic
ttatacggttttggcggagggggaatt

SEQ ID NO: 730 - DNA, 27 bp, Artificial Sequences
  Synthetic
attatacggttttggcggagggggaat

SEQ ID NO: 731 - DNA, 28 bp, Artificial Sequences
  Synthetic
attatacggttttggcggagggggaatt

SEQ ID NO: 732 - DNA, 28 bp, Artificial Sequences
  Synthetic
tcggggtaggaggtaagtttttaggggt

SEQ ID NO: 733 - DNA, 26 bp, Artificial Sequences
  Synthetic
tatacggttttggcggagggggaatt

SEQ ID NO: 734 - DNA, 27 bp, Artificial Sequences
  Synthetic
gcggtagtggcggcggtttttagtttt

SEQ ID NO: 735 - DNA, 26 bp, Artificial Sequences
  Synthetic
cggggattgcggagggagggtttagg

SEQ ID NO: 736 - DNA, 26 bp, Artificial Sequences
  Synthetic
ggggattgcggagggagggtttaggc

SEQ ID NO: 737 - DNA, 26 bp, Artificial Sequences
  Synthetic
gggattgcggagggagggtttaggcg

SEQ ID NO: 738 - DNA, 26 bp, Artificial Sequences
  Synthetic
gcggggattgcggagggagggtttag

SEQ ID NO: 739 - DNA, 27 bp, Artificial Sequences
  Synthetic
ttagggcgttcggaggtatagggtgcg

SEQ ID NO: 740 - DNA, 27 bp, Artificial Sequences
  Synthetic
cggggagattagggcgttcggaggtat

SEQ ID NO: 741 - DNA, 27 bp, Artificial Sequences
  Synthetic
gcggggagattagggcgttcggaggta

SEQ ID NO: 742 - DNA, 28 bp, Artificial Sequences
  Synthetic
attagggcgttcggaggtatagggtgcg

SEQ ID NO: 743 - DNA, 26 bp, Artificial Sequences
  Synthetic
tagggcgttcggaggtatagggtgcg

SEQ ID NO: 744 - DNA, 27 bp, Artificial Sequences
  Synthetic
tgacgtcgtttttggttgtttggtcgt

SEQ ID NO: 745 - DNA, 28 bp, Artificial Sequences
  Synthetic
tgacgtcgtttttggttgtttggtcgtt

SEQ ID NO: 746 - DNA, 28 bp, Artificial Sequences
  Synthetic
atgacgtcgtttttggttgtttggtcgt

SEQ ID NO: 747 - DNA, 29 bp, Artificial Sequences
  Synthetic
tgacgtcgtttttggttgtttggtcgttt

SEQ ID NO: 748 - DNA, 29 bp, Artificial Sequences
  Synthetic
atgacgtcgtttttggttgtttggtcgtt

SEQ ID NO: 749 - DNA, 27 bp, Artificial Sequences
  Synthetic
tcgtaggttgtgtgggtgtgaggtggt

SEQ ID NO: 750 - DNA, 27 bp, Artificial Sequences
  Synthetic
gtgggtgtgaggtggttttcggttcgt

SEQ ID NO: 751 - DNA, 27 bp, Artificial Sequences
  Synthetic
tgtgggtgtgaggtggttttcggttcg

SEQ ID NO: 752 - DNA, 28 bp, Artificial Sequences
  Synthetic
ggttgtgtgggtgtgaggtggttttcgg

SEQ ID NO: 753 - DNA, 27 bp, Artificial Sequences
  Synthetic
tgggtgtgaggtggttttcggttcgtt

SEQ ID NO: 754 - DNA, 27 bp, Artificial Sequences
  Synthetic
ataaggtgagggtagtttcgcgcgggg

SEQ ID NO: 755 - DNA, 27 bp, Artificial Sequences
  Synthetic
tcgggtggtttagggtaaggcggatcg

SEQ ID NO: 756 - DNA, 27 bp, Artificial Sequences
  Synthetic
gggtggtttagggtaaggcggatcggg

SEQ ID NO: 757 - DNA, 27 bp, Artificial Sequences
  Synthetic
ggtggtttagggtaaggcggatcggga

SEQ ID NO: 758 - DNA, 27 bp, Artificial Sequences
  Synthetic
cgggtggtttagggtaaggcggatcgg

SEQ ID NO: 759 - DNA, 28 bp, Artificial Sequences
  Synthetic
ggatattttttggcgaggggtcggagcg

SEQ ID NO: 760 - DNA, 28 bp, Artificial Sequences
  Synthetic
cggatattttttggcgaggggtcggagc

SEQ ID NO: 761 - DNA, 27 bp, Artificial Sequences
  Synthetic
atattttttggcgaggggtcggagcga

SEQ ID NO: 762 - DNA, 27 bp, Artificial Sequences
  Synthetic
tcggatattttttggcgaggggtcgga

SEQ ID NO: 763 - DNA, 27 bp, Artificial Sequences
  Synthetic
gatattttttggcgaggggtcggagcg

SEQ ID NO: 764 - DNA, 27 bp, Artificial Sequences
  Synthetic
ataaggtgagggtagtttcgcgcgggg

SEQ ID NO: 765 - DNA, 27 bp, Artificial Sequences
  Synthetic
cgataaggtgagggtagtttcgcgcgg

SEQ ID NO: 766 - DNA, 27 bp, Artificial Sequences
  Synthetic
gataaggtgagggtagtttcgcgcggg

SEQ ID NO: 767 - DNA, 27 bp, Artificial Sequences
  Synthetic
tattgagttgatgtgacggcgcggagg

SEQ ID NO: 768 - DNA, 28 bp, Artificial Sequences
  Synthetic
tcgataaggtgagggtagtttcgcgcgg

SEQ ID NO: 769 - DNA, 28 bp, Artificial Sequences
  Synthetic
ggatattttttggcgaggggtcggagcg

SEQ ID NO: 770 - DNA, 28 bp, Artificial Sequences
  Synthetic
cggatattttttggcgaggggtcggagc

SEQ ID NO: 771 - DNA, 27 bp, Artificial Sequences
  Synthetic
atattttttggcgaggggtcggagcga

SEQ ID NO: 772 - DNA, 27 bp, Artificial Sequences
  Synthetic
tcggatattttttggcgaggggtcgga

SEQ ID NO: 773 - DNA, 27 bp, Artificial Sequences
  Synthetic
gatattttttggcgaggggtcggagcg

SEQ ID NO: 774 - DNA, 27 bp, Artificial Sequences
  Synthetic
gggtttcgggtttttagggtttcgggt

SEQ ID NO: 775 - DNA, 28 bp, Artificial Sequences
  Synthetic
gggtttcgggtttttagggtttcgggtt

SEQ ID NO: 776 - DNA, 27 bp, Artificial Sequences
  Synthetic
agggtttcgggtttttaaggtttcgcg

SEQ ID NO: 777 - DNA, 27 bp, Artificial Sequences
  Synthetic
ggtttcgggtttttagggtttcgggtt

SEQ ID NO: 778 - DNA, 29 bp, Artificial Sequences
  Synthetic
gggtttcgggtttttagggtttcgggttt

SEQ ID NO: 779 - DNA, 27 bp, Artificial Sequences
  Synthetic
ttttcggttcggttttggaggcgtcgc

SEQ ID NO: 780 - DNA, 27 bp, Artificial Sequences
  Synthetic
cggtttttcggttcggttttggaggcg

SEQ ID NO: 781 - DNA, 28 bp, Artificial Sequences
  Synthetic
tcggtttttcggttcggttttggaggcg

SEQ ID NO: 782 - DNA, 28 bp, Artificial Sequences
  Synthetic
cggtttttcggttcggttttggaggcgt

SEQ ID NO: 783 - DNA, 26 bp, Artificial Sequences
  Synthetic
tttcggttcggttttggaggcgtcgc

SEQ ID NO: 784 - DNA, 26 bp, Artificial Sequences
  Synthetic
ggtggggttagcgcggagttttaggc

SEQ ID NO: 785 - DNA, 27 bp, Artificial Sequences
  Synthetic
gggtttcgggtttttagggtttcgggt

SEQ ID NO: 786 - DNA, 27 bp, Artificial Sequences
  Synthetic
gcggagttttaggcgcgagaataggaa

SEQ ID NO: 787 - DNA, 28 bp, Artificial Sequences
  Synthetic
gggtttcgggtttttagggtttcgggtt

SEQ ID NO: 788 - DNA, 27 bp, Artificial Sequences
  Synthetic
agggtttcgggtttttaaggtttcgcg

SEQ ID NO: 789 - DNA, 27 bp, Artificial Sequences
  Synthetic
ttttcggttcggttttggaggcgtcgc

SEQ ID NO: 790 - DNA, 27 bp, Artificial Sequences
  Synthetic
cggtttttcggttcggttttggaggcg

SEQ ID NO: 791 - DNA, 28 bp, Artificial Sequences
  Synthetic
tcggtttttcggttcggttttggaggcg

SEQ ID NO: 792 - DNA, 28 bp, Artificial Sequences
  Synthetic
cggtttttcggttcggttttggaggcgt

SEQ ID NO: 793 - DNA, 26 bp, Artificial Sequences
  Synthetic
tttcggttcggttttggaggcgtcgc

SEQ ID NO: 794 - DNA, 27 bp, Artificial Sequences
  Synthetic
tagttgagttgacgggtgcgtgcgaga

SEQ ID NO: 795 - DNA, 27 bp, Artificial Sequences
  Synthetic
agtagttgagttgacgggtgcgtgcga

SEQ ID NO: 796 - DNA, 27 bp, Artificial Sequences
  Synthetic
gttgagttgacgggtgcgtgcgagaat

SEQ ID NO: 797 - DNA, 27 bp, Artificial Sequences
  Synthetic
ttgagttgacgggtgcgtgcgagaatg

SEQ ID NO: 798 - DNA, 27 bp, Artificial Sequences
  Synthetic
gtagttgagttgacgggtgcgtgcgag

SEQ ID NO: 799 - DNA, 27 bp, Artificial Sequences
  Synthetic
tttagaggtttggggatgtggtggcgc

SEQ ID NO: 800 - DNA, 27 bp, Artificial Sequences
  Synthetic
ttagaggtttggggatgtggtggcgcg

SEQ ID NO: 801 - DNA, 28 bp, Artificial Sequences
  Synthetic
ttttagaggtttggggatgtggtggcgc

SEQ ID NO: 802 - DNA, 27 bp, Artificial Sequences
  Synthetic
gcgcgcgggtgggtatttagataggta

SEQ ID NO: 803 - DNA, 26 bp, Artificial Sequences
  Synthetic
tagaggtttggggatgtggtggcgcg

SEQ ID NO: 804 - DNA, 27 bp, Artificial Sequences
  Synthetic
aggggttgaggttcgagcgtagatggc

SEQ ID NO: 805 - DNA, 27 bp, Artificial Sequences
  Synthetic
gggtggagtaggggttgaggttcgagc

SEQ ID NO: 806 - DNA, 27 bp, Artificial Sequences
  Synthetic
ggtggagtaggggttgaggttcgagcg

SEQ ID NO: 807 - DNA, 27 bp, Artificial Sequences
  Synthetic
tcgggtggagtaggggttgaggttcga

SEQ ID NO: 808 - DNA, 27 bp, Artificial Sequences
  Synthetic
gttttgggagagggcgggggagagtag

SEQ ID NO: 809 - DNA, 27 bp, Artificial Sequences
  Synthetic
tcggcggcgttatttgcgttcggattt

SEQ ID NO: 810 - DNA, 27 bp, Artificial Sequences
  Synthetic
ttcggcggcgttatttgcgttcggatt

SEQ ID NO: 811 - DNA, 27 bp, Artificial Sequences
  Synthetic
gttcggcggcgttatttgcgttcggat

SEQ ID NO: 812 - DNA, 27 bp, Artificial Sequences
  Synthetic
cggcggcgttatttgcgttcggatttt

SEQ ID NO: 813 - DNA, 26 bp, Artificial Sequences
  Synthetic
tcggcggcgttatttgcgttcggatt

SEQ ID NO: 814 - DNA, 27 bp, Artificial Sequences
  Synthetic
ggcgggttttggggtttttcggggtta

SEQ ID NO: 815 - DNA, 27 bp, Artificial Sequences
  Synthetic
gttttgggagagggcgggggagagtag

SEQ ID NO: 816 - DNA, 27 bp, Artificial Sequences
  Synthetic
tgttttaagttgcgggtgttcgggcgt

SEQ ID NO: 817 - DNA, 27 bp, Artificial Sequences
  Synthetic
tttgttgttttgggagagggcggggga

SEQ ID NO: 818 - DNA, 27 bp, Artificial Sequences
  Synthetic
ttttgttgttttgggagagggcggggg

SEQ ID NO: 819 - DNA, 27 bp, Artificial Sequences
  Synthetic
gggggattagttcggtttgcgcgttgt

SEQ ID NO: 820 - DNA, 27 bp, Artificial Sequences
  Synthetic
cgggggattagttcggtttgcgcgttg

SEQ ID NO: 821 - DNA, 27 bp, Artificial Sequences
  Synthetic
taacgggggattagttcggtttgcgcg

SEQ ID NO: 822 - DNA, 27 bp, Artificial Sequences
  Synthetic
acgggggattagttcggtttgcgcgtt

SEQ ID NO: 823 - DNA, 27 bp, Artificial Sequences
  Synthetic
aacgggggattagttcggtttgcgcgt

SEQ ID NO: 824 - DNA, 27 bp, Artificial Sequences
  Synthetic
atttggggagttcggatggagaggcgt

SEQ ID NO: 825 - DNA, 27 bp, Artificial Sequences
  Synthetic
ggggagttcggatggagaggcgtagga

SEQ ID NO: 826 - DNA, 27 bp, Artificial Sequences
  Synthetic
ttggggagttcggatggagaggcgtag

SEQ ID NO: 827 - DNA, 27 bp, Artificial Sequences
  Synthetic
tggggagttcggatggagaggcgtagg

SEQ ID NO: 828 - DNA, 27 bp, Artificial Sequences
  Synthetic
tttggggagttcggatggagaggcgta

SEQ ID NO: 829 - DNA, 27 bp, Artificial Sequences
  Synthetic
agtcgttggggaaggaaattgcgggtt

SEQ ID NO: 830 - DNA, 27 bp, Artificial Sequences
  Synthetic
tagtcgttggggaaggaaattgcgggt

SEQ ID NO: 831 - DNA, 27 bp, Artificial Sequences
  Synthetic
gtcgttggggaaggaaattgcgggttt

SEQ ID NO: 832 - DNA, 28 bp, Artificial Sequences
  Synthetic
agtcgttggggaaggaaattgcgggttt

SEQ ID NO: 833 - DNA, 26 bp, Artificial Sequences
  Synthetic
agtcgttggggaaggaaattgcgggt

SEQ ID NO: 834 - DNA, 27 bp, Artificial Sequences
  Synthetic
ggggtaagaggagagcgaaaagggggg

SEQ ID NO: 835 - DNA, 27 bp, Artificial Sequences
  Synthetic
tggggtaagaggagagcgaaaaggggg

SEQ ID NO: 836 - DNA, 26 bp, Artificial Sequences
  Synthetic
gtcgtcgcggtgtggtcggtagagtc

SEQ ID NO: 837 - DNA, 28 bp, Artificial Sequences
  Synthetic
ttggggtaagaggagagcgaaaaggggg

SEQ ID NO: 838 - DNA, 28 bp, Artificial Sequences
  Synthetic
tggggtaagaggagagcgaaaagggggg

SEQ ID NO: 839 - DNA, 27 bp, Artificial Sequences
  Synthetic
tggggaaagagaagttgggtttggggg

SEQ ID NO: 840 - DNA, 28 bp, Artificial Sequences
  Synthetic
tggggaaagagaagttgggtttggggga

SEQ ID NO: 841 - DNA, 27 bp, Artificial Sequences
  Synthetic
ggggaaagagaagttgggtttggggga

SEQ ID NO: 842 - DNA, 28 bp, Artificial Sequences
  Synthetic
gtggggaaagagaagttgggtttggggg

SEQ ID NO: 843 - DNA, 29 bp, Artificial Sequences
  Synthetic
gtggggaaagagaagttgggtttggggga

SEQ ID NO: 844 - DNA, 27 bp, Artificial Sequences
  Synthetic
ttttgtgtggttaggtcggagcggtcg

SEQ ID NO: 845 - DNA, 28 bp, Artificial Sequences
  Synthetic
gttttgtgtggttaggtcggagcggtcg

SEQ ID NO: 846 - DNA, 26 bp, Artificial Sequences
  Synthetic
gtcgtcgcggtgtggtcggtagagtc

SEQ ID NO: 847 - DNA, 27 bp, Artificial Sequences
  Synthetic
agttttgtgtggttaggtcggagcggt

SEQ ID NO: 848 - DNA, 28 bp, Artificial Sequences
  Synthetic
ggagttttgtgtggttaggtcggagcgg

SEQ ID NO: 849 - DNA, 27 bp, Artificial Sequences
  Synthetic
tggaacggcgggcgtattttgtagtcg

SEQ ID NO: 850 - DNA, 27 bp, Artificial Sequences
  Synthetic
cggcgggcgtattttgtagtcgaaggt

SEQ ID NO: 851 - DNA, 27 bp, Artificial Sequences
  Synthetic
acggcgggcgtattttgtagtcgaagg

SEQ ID NO: 852 - DNA, 27 bp, Artificial Sequences
  Synthetic
ggaacggcgggcgtattttgtagtcga

SEQ ID NO: 853 - DNA, 28 bp, Artificial Sequences
  Synthetic
tggaacggcgggcgtattttgtagtcga

SEQ ID NO: 854 - DNA, 27 bp, Artificial Sequences
  Synthetic
ttttgtgtggttaggtcggagcggtcg

SEQ ID NO: 855 - DNA, 28 bp, Artificial Sequences
  Synthetic
gttttgtgtggttaggtcggagcggtcg

SEQ ID NO: 856 - DNA, 27 bp, Artificial Sequences
  Synthetic
agttttgtgtggttaggtcggagcggt

SEQ ID NO: 857 - DNA, 28 bp, Artificial Sequences
  Synthetic
ggagttttgtgtggttaggtcggagcgg

SEQ ID NO: 858 - DNA, 28 bp, Artificial Sequences
  Synthetic
gggagttttgtgtggttaggtcggagcg

SEQ ID NO: 859 - DNA, 27 bp, Artificial Sequences
  Synthetic
tggaacggcgggcgtattttgtagtcg

SEQ ID NO: 860 - DNA, 27 bp, Artificial Sequences
  Synthetic
cggcgggcgtattttgtagtcgaaggt

SEQ ID NO: 861 - DNA, 27 bp, Artificial Sequences
  Synthetic
acggcgggcgtattttgtagtcgaagg

SEQ ID NO: 862 - DNA, 27 bp, Artificial Sequences
  Synthetic
ggaacggcgggcgtattttgtagtcga

SEQ ID NO: 863 - DNA, 28 bp, Artificial Sequences
  Synthetic
gcgaaggtaggtaggatcggagttggcg

SEQ ID NO: 864 - DNA, 26 bp, Artificial Sequences
  Synthetic
tttgtgtggttaggtcggagcggtcg

SEQ ID NO: 865 - DNA, 25 bp, Artificial Sequences
  Synthetic
ttgtgtggttaggtcggagcggtcg

SEQ ID NO: 866 - DNA, 24 bp, Artificial Sequences
  Synthetic
tgtgtggttaggtcggagcggtcg

SEQ ID NO: 867 - DNA, 28 bp, Artificial Sequences
  Synthetic
gttcgtcgttttaggcgttagtttcggt

SEQ ID NO: 868 - DNA, 25 bp, Artificial Sequences
  Synthetic
tttgtgtggttaggtcggagcggtc

SEQ ID NO: 869 - DNA, 28 bp, Artificial Sequences
  Synthetic
gcgaaggtaggtaggatcggagttggcg

SEQ ID NO: 870 - DNA, 28 bp, Artificial Sequences
  Synthetic
tgcgaaggtaggtaggatcggagttggc

SEQ ID NO: 871 - DNA, 27 bp, Artificial Sequences
  Synthetic
gcgaaggtaggtaggatcggagttggc

SEQ ID NO: 872 - DNA, 28 bp, Artificial Sequences
  Synthetic
cgaaggtaggtaggatcggagttggcgt

SEQ ID NO: 873 - DNA, 27 bp, Artificial Sequences
  Synthetic
cgaaggtaggtaggatcggagttggcg

SEQ ID NO: 874 - DNA, 33 bp, Artificial Sequences
  Synthetic
cggaaggattgggggagatttagattatttggg

SEQ ID NO: 875 - DNA, 34 bp, Artificial Sequences
  Synthetic
cggaaggattgggggagatttagattatttggga

SEQ ID NO: 876 - DNA, 34 bp, Artificial Sequences
  Synthetic
tcggaaggattgggggagatttagattatttggg

SEQ ID NO: 877 - DNA, 35 bp, Artificial Sequences
  Synthetic
tcggaaggattgggggagatttagattatttggga

SEQ ID NO: 878 - DNA, 33 bp, Artificial Sequences
  Synthetic
tcggaaggattgggggagatttagattatttgg

SEQ ID NO: 879 - DNA, 33 bp, Artificial Sequences
  Synthetic
ggaaagcgtagtggggatagaggtaatttttgt

SEQ ID NO: 880 - DNA, 33 bp, Artificial Sequences
  Synthetic
aggaaagcgtagtggggatagaggtaatttttg

SEQ ID NO: 881 - DNA, 34 bp, Artificial Sequences
  Synthetic
aggaaagcgtagtggggatagaggtaatttttgt

SEQ ID NO: 882 - DNA, 33 bp, Artificial Sequences
  Synthetic
aaggaaagcgtagtggggatagaggtaattttt

SEQ ID NO: 883 - DNA, 34 bp, Artificial Sequences
  Synthetic
ggaaagcgtagtggggatagaggtaatttttgtt

SEQ ID NO: 884 - DNA, 28 bp, Artificial Sequences
  Synthetic
ggttagcggggtatagaggttagcgggt

SEQ ID NO: 885 - DNA, 27 bp, Artificial Sequences
  Synthetic
ggttagcggggtatagaggttagcggg

SEQ ID NO: 886 - DNA, 29 bp, Artificial Sequences
  Synthetic
aggttagcggggtatagaggttagcgggt

SEQ ID NO: 887 - DNA, 28 bp, Artificial Sequences
  Synthetic
aggttagcggggtatagaggttagcggg

SEQ ID NO: 888 - DNA, 27 bp, Artificial Sequences
  Synthetic
agcggggtatagaggttagcgggtttt

SEQ ID NO: 889 - DNA, 33 bp, Artificial Sequences; identical to SEQ ID NO: 879
  Synthetic

SEQ ID NO: 890 - DNA, 33 bp, Artificial Sequences; identical to SEQ ID NO: 880
  Synthetic

SEQ ID NO: 891 - DNA, 34 bp, Artificial Sequences; identical to SEQ ID NO: 881
  Synthetic

SEQ ID NO: 892 - DNA, 33 bp, Artificial Sequences; identical to SEQ ID NO: 882
  Synthetic

SEQ ID NO: 893 - DNA, 34 bp, Artificial Sequences; identical to SEQ ID NO: 883
  Synthetic

SEQ ID NO: 894 - DNA, 27 bp, Artificial Sequences
  Synthetic
gggtttgggagttttttgcggcggaag

SEQ ID NO: 895 - DNA, 27 bp, Artificial Sequences
  Synthetic
cgtagggtttgggagttttttgcggcg

SEQ ID NO: 896 - DNA, 28 bp, Artificial Sequences
  Synthetic
gggtttgggagttttttgcggcggaaga

SEQ ID NO: 897 - DNA, 28 bp, Artificial Sequences
  Synthetic
agggtttgggagttttttgcggcggaag

SEQ ID NO: 898 - DNA, 27 bp, Artificial Sequences
  Synthetic
gtagggtttgggagttttttgcggcgg

SEQ ID NO: 899 - DNA, 27 bp, Artificial Sequences
  Synthetic
aaggtcgttgggagttcggtgaggacg

SEQ ID NO: 900 - DNA, 27 bp, Artificial Sequences
  Synthetic
gagttcggtgaggacgtggcggttttt

SEQ ID NO: 901 - DNA, 27 bp, Artificial Sequences
  Synthetic
gtcgttgggagttcggtgaggacgtgg

SEQ ID NO: 902 - DNA, 27 bp, Artificial Sequences
  Synthetic
ggtcgttgggagttcggtgaggacgtg

SEQ ID NO: 903 - DNA, 27 bp, Artificial Sequences
  Synthetic
agttcggtgaggacgtggcggtttttt

SEQ ID NO: 904 - DNA, 35 bp, Artificial Sequences
  Synthetic
cgggtttgttggtaataatgttgtttttgtggtgt

SEQ ID NO: 905 - DNA, 36 bp, Artificial Sequences
  Synthetic
tcgggtttgttggtaataatgttgtttttgtggtgt

SEQ ID NO: 906 - DNA, 35 bp, Artificial Sequences
  Synthetic
aggtaaggttagatgtgtaggtgggaataattggt

SEQ ID NO: 907 - DNA, 36 bp, Artificial Sequences
  Synthetic
cgggtttgttggtaataatgttgtttttgtggtgtt

SEQ ID NO: 908 - DNA, 35 bp, Artificial Sequences
  Synthetic
tcggttttttggggaatgttttttggaaagttttt

SEQ ID NO: 909 - DNA, 27 bp, Artificial Sequences
  Synthetic
cggggagttggttggagagttattgcg

SEQ ID NO: 910 - DNA, 28 bp, Artificial Sequences
  Synthetic
cggggagttggttggagagttattgcga

SEQ ID NO: 911 - DNA, 28 bp, Artificial Sequences
  Synthetic
tcggggagttggttggagagttattgcg

SEQ ID NO: 912 - DNA, 29 bp, Artificial Sequences
  Synthetic
tcggggagttggttggagagttattgcga

SEQ ID NO: 913 - DNA, 27 bp, Artificial Sequences
  Synthetic
ggggagttggttggagagttattgcga

SEQ ID NO: 914 - DNA, 27 bp, Artificial Sequences
  Synthetic
gttcggggttttagtttttcgcgcggt

SEQ ID NO: 915 - DNA, 28 bp, Artificial Sequences
  Synthetic
agttcggggttttagtttttcgcgcggt

SEQ ID NO: 916 - DNA, 27 bp, Artificial Sequences
  Synthetic
agttcggggttttagtttttcgcgcgg

SEQ ID NO: 917 - DNA, 27 bp, Artificial Sequences
  Synthetic
aggcgtcgggatttttagttcggggtt

SEQ ID NO: 918 - DNA, 27 bp, Artificial Sequences
  Synthetic
ttcggggttttagtttttcgcgcggtt

SEQ ID NO: 919 - DNA, 27 bp, Artificial Sequences
  Synthetic
gcgttcggagttagtcgggagttgggt

SEQ ID NO: 920 - DNA, 27 bp, Artificial Sequences
  Synthetic
cgaggaggaagaagtagttgcggcggt

SEQ ID NO: 921 - DNA, 27 bp, Artificial Sequences
  Synthetic
tcgaggaggaagaagtagttgcggcgg

SEQ ID NO: 922 - DNA, 27 bp, Artificial Sequences
  Synthetic
agtcgggagttgggtagtagcggtcga

SEQ ID NO: 923 - DNA, 27 bp, Artificial Sequences
  Synthetic
gtcgggagttgggtagtagcggtcgag

SEQ ID NO: 924 - DNA, 28 bp, Artificial Sequences
  Synthetic
tgtttagttttcggttggtttcgggcgt

SEQ ID NO: 925 - DNA, 27 bp, Artificial Sequences
  Synthetic
gtttagttttcggttggtttcgggcgt

SEQ ID NO: 926 - DNA, 27 bp, Artificial Sequences
  Synthetic
tgtttagttttcggttggtttcgggcg

SEQ ID NO: 927 - DNA, 27 bp, Artificial Sequences
  Synthetic
tttagttttcggttggtttcgggcgtc

SEQ ID NO: 928 - DNA, 28 bp, Artificial Sequences
  Synthetic
gtttagttttcggttggtttcgggcgtc

SEQ ID NO: 929 - DNA, 27 bp, Artificial Sequences
  Synthetic
cgattttggttgttgttgtcgcgcgtt

SEQ ID NO: 930 - DNA, 28 bp, Artificial Sequences
  Synthetic
cgattttggttgttgttgtcgcgcgttt

SEQ ID NO: 931 - DNA, 26 bp, Artificial Sequences
  Synthetic
cgattttggttgttgttgtcgcgcgt

SEQ ID NO: 932 - DNA, 29 bp, Artificial Sequences
  Synthetic
cgattttggttgttgttgtcgcgcgtttc

SEQ ID NO: 933 - DNA, 27 bp, Artificial Sequences
  Synthetic
attttggttgttgttgtcgcgcgtttc

SEQ ID NO: 934 - DNA, 27 bp, Artificial Sequences
  Synthetic
tcggcggcggtagtaggattcgttgtt

SEQ ID NO: 935 - DNA, 27 bp, Artificial Sequences
  Synthetic
gtttgtcgtggggattgaggggttcgc

SEQ ID NO: 936 - DNA, 27 bp, Artificial Sequences
  Synthetic
cgtatcggcggcggtagtaggattcgt

SEQ ID NO: 937 - DNA, 27 bp, Artificial Sequences
  Synthetic
atcggcggcggtagtaggattcgttgt

SEQ ID NO: 938 - DNA, 27 bp, Artificial Sequences
  Synthetic
tttttcggttcggggtttgtcgtgggg

SEQ ID NO: 939 - DNA, 27 bp, Artificial Sequences
  Synthetic
aggtggtagaggtagtcgcggaggagg

SEQ ID NO: 940 - DNA, 27 bp, Artificial Sequences
  Synthetic
ggtggtagaggtagtcgcggaggaggt

SEQ ID NO: 941 - DNA, 27 bp, Artificial Sequences
  Synthetic
gcggagtaggtggtagaggtagtcgcg

SEQ ID NO: 942 - DNA, 27 bp, Artificial Sequences
  Synthetic
ggcggagtaggtggtagaggtagtcgc

SEQ ID NO: 943 - DNA, 27 bp, Artificial Sequences
  Synthetic
cggagtaggtggtagaggtagtcgcgg

SEQ ID NO: 944 - DNA, 27 bp, Artificial Sequences
  Synthetic
tggggaagttggaggaagagttgcggg

SEQ ID NO: 945 - DNA, 27 bp, Artificial Sequences
  Synthetic
ggggaagttggaggaagagttgcgggt

SEQ ID NO: 946 - DNA, 28 bp, Artificial Sequences
  Synthetic
ttggggaagttggaggaagagttgcggg

SEQ ID NO: 947 - DNA, 27 bp, Artificial Sequences
  Synthetic
ttggggaagttggaggaagagttgcgg

SEQ ID NO: 948 - DNA, 28 bp, Artificial Sequences
  Synthetic
ggggaagttggaggaagagttgcgggta

SEQ ID NO: 949 - DNA, 30 bp, Artificial Sequences
  Synthetic
cgtgttgtcgtaggttggttgtttttcggg

SEQ ID NO: 950 - DNA, 31 bp, Artificial Sequences
  Synthetic
cgtgttgtcgtaggttggttgtttttcgggt

SEQ ID NO: 951 - DNA, 29 bp, Artificial Sequences
  Synthetic
tgttgtcgtaggttggttgtttttcgggt

SEQ ID NO: 952 - DNA, 28 bp, Artificial Sequences
  Synthetic
gttgtcgtaggttggttgtttttcgggt

SEQ ID NO: 953 - DNA, 28 bp, Artificial Sequences
  Synthetic
tgttgtcgtaggttggttgtttttcggg

SEQ ID NO: 954 - DNA, 27 bp, Artificial Sequences
  Synthetic
agtggttgagttaagggttcgggaggt

SEQ ID NO: 955 - DNA, 27 bp, Artificial Sequences
  Synthetic
tgagcgggaagagttaggagatcggaa

SEQ ID NO: 956 - DNA, 27 bp, Artificial Sequences
  Synthetic
atgagcgggaagagttaggagatcgga

SEQ ID NO: 957 - DNA, 28 bp, Artificial Sequences
  Synthetic
aagtggttgagttaagggttcgggaggt

SEQ ID NO: 958 - DNA, 27 bp, Artificial Sequences
  Synthetic
aagtggttgagttaagggttcgggagg

SEQ ID NO: 959 - DNA, 27 bp, Artificial Sequences
  Synthetic
tacggtttgtcgggaagtgggtcggtt

SEQ ID NO: 960 - DNA, 27 bp, Artificial Sequences
  Synthetic
atacggtttgtcgggaagtgggtcggt

SEQ ID NO: 961 - DNA, 27 bp, Artificial Sequences
  Synthetic
acggtttgtcgggaagtgggtcggttg

SEQ ID NO: 962 - DNA, 26 bp, Artificial Sequences
  Synthetic
ggtttgtcgggaagtgggtcggttgc

SEQ ID NO: 963 - DNA, 26 bp, Artificial Sequences
  Synthetic
cggtttgtcgggaagtgggtcggttg

SEQ ID NO: 964 - DNA, 27 bp, Artificial Sequences
  Synthetic
tgagcggttaggttttcgtttcggcgg

SEQ ID NO: 965 - DNA, 27 bp, Artificial Sequences
  Synthetic
cggttaggttttcgtttcggcggcgtt

SEQ ID NO: 966 - DNA, 27 bp, Artificial Sequences
  Synthetic
gagcggttaggttttcgtttcggcggc

SEQ ID NO: 967 - DNA, 28 bp, Artificial Sequences
  Synthetic
ttgagcggttaggttttcgtttcggcgg

SEQ ID NO: 968 - DNA, 27 bp, Artificial Sequences
  Synthetic
ggttaggttttcgtttcggcggcgttt

SEQ ID NO: 969 - DNA, 32 bp, Artificial Sequences
  Synthetic
cgtcgttaatgtagatgcggttttttatcggt

SEQ ID NO: 970 - DNA, 32 bp, Artificial Sequences
  Synthetic
tcgtcgttaatgtagatgcggttttttatcgg

SEQ ID NO: 971 - DNA, 33 bp, Artificial Sequences
  Synthetic
tcgtcgttaatgtagatgcggttttttatcggt

SEQ ID NO: 972 - DNA, 33 bp, Artificial Sequences
  Synthetic
ttcgtcgttaatgtagatgcggttttttatcgg

SEQ ID NO: 973 - DNA, 33 bp, Artificial Sequences
  Synthetic
gatgagttcgtcgttaatgtagatgcggttttt

SEQ ID NO: 974 - DNA, 27 bp, Artificial Sequences
  Synthetic
cggcgtttgtagggttgggtttaggcg

SEQ ID NO: 975 - DNA, 27 bp, Artificial Sequences
  Synthetic
ggcggcgtttgtagggttgggtttagg

SEQ ID NO: 976 - DNA, 27 bp, Artificial Sequences
  Synthetic
gtcggaaaggcggcgtttgtagggttg

SEQ ID NO: 977 - DNA, 27 bp, Artificial Sequences
  Synthetic
gaaaggcggcgtttgtagggttgggtt

SEQ ID NO: 978 - DNA, 27 bp, Artificial Sequences
  Synthetic
gcggcgtttgtagggttgggtttaggc

SEQ ID NO: 979 - DNA, 31 bp, Artificial Sequences
  Synthetic
aggagggagttagaggagatgtgagttttga

SEQ ID NO: 980 - DNA, 31 bp, Artificial Sequences
  Synthetic
agaggagatgtgagttttgagtttcggagtt

SEQ ID NO: 981 - DNA, 32 bp, Artificial Sequences
  Synthetic
ggagggagttagaggagatgtgagttttgagt

SEQ ID NO: 982 - DNA, 32 bp, Artificial Sequences
  Synthetic
aggagggagttagaggagatgtgagttttgag

SEQ ID NO: 983 - DNA, 33 bp, Artificial Sequences
  Synthetic
aggagggagttagaggagatgtgagttttgagt

SEQ ID NO: 984 - DNA, 27 bp, Artificial Sequences
  Synthetic
cggcgtttgtagggttgggtttaggcg

SEQ ID NO: 985 - DNA, 27 bp, Artificial Sequences
  Synthetic
gggggtgagtagtggggttgggattcg

SEQ ID NO: 986 - DNA, 27 bp, Artificial Sequences
  Synthetic
ggcggcgtttgtagggttgggtttagg

SEQ ID NO: 987 - DNA, 27 bp, Artificial Sequences
  Synthetic
tgtagggggtgagtagtggggttggga

SEQ ID NO: 988 - DNA, 27 bp, Artificial Sequences
  Synthetic
gtcggaaaggcggcgtttgtagggttg

SEQ ID NO: 989 - DNA, 28 bp, Artificial Sequences
  Synthetic
ggcgtcgttttttcggttttggtttagc

SEQ ID NO: 990 - DNA, 29 bp, Artificial Sequences
  Synthetic
aggcgtcgttttttcggttttggtttagc

SEQ ID NO: 991 - DNA, 31 bp, Artificial Sequences
  Synthetic
gcggattttcggttttttggtgtttagggcg

SEQ ID NO: 992 - DNA, 30 bp, Artificial Sequences
  Synthetic
gcggattttcggttttttggtgtttagggc

SEQ ID NO: 993 - DNA, 32 bp, Artificial Sequences
  Synthetic
tgcggattttcggttttttggtgtttagggcg

SEQ ID NO: 994 - DNA, 27 bp, Artificial Sequences
  Synthetic
gggggtgagtagtggggttgggattcg

SEQ ID NO: 995 - DNA, 27 bp, Artificial Sequences
  Synthetic
cgggaggcggtggagagttttgtaggt

SEQ ID NO: 996 - DNA, 27 bp, Artificial Sequences
  Synthetic
ggcggcgtttgtagggttgggtttagg

SEQ ID NO: 997 - DNA, 27 bp, Artificial Sequences
  Synthetic
tgtagggggtgagtagtggggttggga

SEQ ID NO: 998 - DNA, 27 bp, Artificial Sequences
  Synthetic
gtcggaaaggcggcgtttgtagggttg

SEQ ID NO: 999 - DNA, 27 bp, Artificial Sequences
  Synthetic
tggttacgggtcggtagttgagtgggg

SEQ ID NO: 1000 - DNA, 27 bp, Artificial Sequences
  Synthetic
ggttacgggtcggtagttgagtgggga

SEQ ID NO: 1001 - DNA, 28 bp, Artificial Sequences
  Synthetic
tggttacgggtcggtagttgagtgggga

SEQ ID NO: 1002 - DNA, 27 bp, Artificial Sequences
  Synthetic
tggtgtttagggcgatggttacgggtc

SEQ ID NO: 1003 - DNA, 28 bp, Artificial Sequences
  Synthetic
atggttacgggtcggtagttgagtgggg

SEQ ID NO: 1004 - DNA, 27 bp, Artificial Sequences
  Synthetic
tcgggtagtgggtggggtaggaggatg

SEQ ID NO: 1005 - DNA, 27 bp, Artificial Sequences
  Synthetic
gtcgggtagtgggtggggtaggaggat

SEQ ID NO: 1006 - DNA, 27 bp, Artificial Sequences
  Synthetic
cgggtagtgggtggggtaggaggatgt

SEQ ID NO: 1007 - DNA, 27 bp, Artificial Sequences
  Synthetic
gggtggggtaggaggatgtttcgaggt

SEQ ID NO: 1008 - DNA, 27 bp, Artificial Sequences
  Synthetic
tgggtggggtaggaggatgtttcgagg

SEQ ID NO: 1009 - DNA, 27 bp, Artificial Sequences
  Synthetic
ggagcgagggttttaggggaaggtggt

SEQ ID NO: 1010 - DNA, 27 bp, Artificial Sequences
  Synthetic
cggagcgagggttttaggggaaggtgg

SEQ ID NO: 1011 - DNA, 28 bp, Artificial Sequences
  Synthetic
ggagcgagggttttaggggaaggtggtt

SEQ ID NO: 1012 - DNA, 27 bp, Artificial Sequences
  Synthetic
agtatggtattgggggagggagcggag

SEQ ID NO: 1013 - DNA, 27 bp, Artificial Sequences
  Synthetic
gagcgagggttttaggggaaggtggtt

SEQ ID NO: 1014 - DNA, 31 bp, Artificial Sequences
  Synthetic
ggagcgttttaaggagatgattaaggtcggg

SEQ ID NO: 1015 - DNA, 32 bp, Artificial Sequences
  Synthetic
tggagcgttttaaggagatgattaaggtcggg

SEQ ID NO: 1016 - DNA, 32 bp, Artificial Sequences
  Synthetic
ggagcgttttaaggagatgattaaggtcggga

SEQ ID NO: 1017 - DNA, 33 bp, Artificial Sequences
  Synthetic
tggagcgttttaaggagatgattaaggtcggga

SEQ ID NO: 1018 - DNA, 31 bp, Artificial Sequences
  Synthetic
tggagcgttttaaggagatgattaaggtcgg

SEQ ID NO: 1019 - DNA, 28 bp, Artificial Sequences
  Synthetic
ttttttggacggtggaaagggttgtgtt

SEQ ID NO: 1020 - DNA, 30 bp, Artificial Sequences
  Synthetic
tggacggtggaaagggttgtgttatagagt

SEQ ID NO: 1021 - DNA, 29 bp, Artificial Sequences
  Synthetic
ggacggtggaaagggttgtgttatagagt

SEQ ID NO: 1022 - DNA, 29 bp, Artificial Sequences
  Synthetic
tggacggtggaaagggttgtgttatagag

SEQ ID NO: 1023 - DNA, 29 bp, Artificial Sequences
  Synthetic
ttggacggtggaaagggttgtgttataga

SEQ ID NO: 1024 - DNA, 33 bp, Artificial Sequences
  Synthetic
gtttagaagggagaggtatcgaaaacgagttgt

SEQ ID NO: 1025 - DNA, 27 bp, Artificial Sequences
  Synthetic
ttgattcgggttgggggttagggcgaa

SEQ ID NO: 1026 - DNA, 27 bp, Artificial Sequences
  Synthetic
attgattcgggttgggggttagggcga

SEQ ID NO: 1027 - DNA, 27 bp, Artificial Sequences
  Synthetic
cgggttgggggttagggcgaaggttta

SEQ ID NO: 1028 - DNA, 27 bp, Artificial Sequences
  Synthetic
tgattcgggttgggggttagggcgaag

SEQ ID NO: 1029 - DNA, 27 bp, Artificial Sequences
  Synthetic
agtgtttggaatcggggggaggggtac

SEQ ID NO: 1030 - DNA, 27 bp, Artificial Sequences
  Synthetic
tgggtgttggaagggtagaaggtgggt

SEQ ID NO: 1031 - DNA, 28 bp, Artificial Sequences
  Synthetic
atgggtgttggaagggtagaaggtgggt

SEQ ID NO: 1032 - DNA, 27 bp, Artificial Sequences
  Synthetic
atgggtgttggaagggtagaaggtggg

SEQ ID NO: 1033 - DNA, 28 bp, Artificial Sequences
  Synthetic
tgggtgttggaagggtagaaggtgggta

SEQ ID NO: 1034 - DNA, 27 bp, Artificial Sequences
  Synthetic
gggtgttggaagggtagaaggtgggta

SEQ ID NO: 1035 - DNA, 27 bp, Artificial Sequences
  Synthetic
cgtagtgtttgggttcgcggcgttaag

SEQ ID NO: 1036 - DNA, 27 bp, Artificial Sequences
  Synthetic
gcgtgtgttttcggttgcgaggttttg

SEQ ID NO: 1037 - DNA, 28 bp, Artificial Sequences
  Synthetic
gcgtgtgttttcggttgcgaggttttgt

SEQ ID NO: 1038 - DNA, 27 bp, Artificial Sequences
  Synthetic
cgtgtgttttcggttgcgaggttttgt

SEQ ID NO: 1039 - DNA, 26 bp, Artificial Sequences
  Synthetic
cgtagtgtttgggttcgcggcgttaa

SEQ ID NO: 1040 - DNA, 25 bp, Artificial Sequences
  Synthetic
gttggggtttcgaacggttggcggg

SEQ ID NO: 1041 - DNA, 27 bp, Artificial Sequences
  Synthetic
ttggggtttcgaacggttggcggggag

SEQ ID NO: 1042 - DNA, 27 bp, Artificial Sequences
  Synthetic
gttggggtttcgaacggttggcgggga

SEQ ID NO: 1043 - DNA, 24 bp, Artificial Sequences
  Synthetic
ttggggtttcgaacggttggcggg

SEQ ID NO: 1044 - DNA, 24 bp, Artificial Sequences
  Synthetic
gggtttcgaacggttggcggggag

SEQ ID NO: 1045 - DNA, 27 bp, Artificial Sequences
  Synthetic
cgtagtgtttgggttcgcggcgttaag

SEQ ID NO: 1046 - DNA, 27 bp, Artificial Sequences
  Synthetic
gcgtgtgttttcggttgcgaggttttg

SEQ ID NO: 1047 - DNA, 28 bp, Artificial Sequences
  Synthetic
gcgtgtgttttcggttgcgaggttttgt

SEQ ID NO: 1048 - DNA, 27 bp, Artificial Sequences
  Synthetic
cgtgtgttttcggttgcgaggttttgt

SEQ ID NO: 1049 - DNA, 26 bp, Artificial Sequences
  Synthetic
cgtagtgtttgggttcgcggcgttaa

SEQ ID NO: 1050 - DNA, 25 bp, Artificial Sequences
  Synthetic
gttggggtttcgaacggttggcggg

SEQ ID NO: 1051 - DNA, 27 bp, Artificial Sequences
  Synthetic
ttggggtttcgaacggttggcggggag

SEQ ID NO: 1052 - DNA, 27 bp, Artificial Sequences
  Synthetic
gttggggtttcgaacggttggcgggga

SEQ ID NO: 1053 - DNA, 24 bp, Artificial Sequences
  Synthetic
ttggggtttcgaacggttggcggg

SEQ ID NO: 1054 - DNA, 24 bp, Artificial Sequences
  Synthetic
gggtttcgaacggttggcggggag

SEQ ID NO: 1055 - DNA, 27 bp, Artificial Sequences
  Synthetic
cgtagtgtttgggttcgcggcgttaag

SEQ ID NO: 1056 - DNA, 26 bp, Artificial Sequences
  Synthetic
cgtagtgtttgggttcgcggcgttaa

SEQ ID NO: 1057 - DNA, 27 bp, Artificial Sequences
  Synthetic
agtcgttcgggattttagtttggggga

SEQ ID NO: 1058 - DNA, 25 bp, Artificial Sequences
  Synthetic
cgtagtgtttgggttcgcggcgtta

SEQ ID NO: 1059 - DNA, 26 bp, Artificial Sequences
  Synthetic
gtagtgtttgggttcgcggcgttaag

SEQ ID NO: 1060 - DNA, 26 bp, Artificial Sequences
  Synthetic
agtttaggttgtcgcgtggagtttgc

SEQ ID NO: 1061 - DNA, 28 bp, Artificial Sequences
  Synthetic
ttagtttaggttgtcgcgtggagtttgc

SEQ ID NO: 1062 - DNA, 29 bp, Artificial Sequences
  Synthetic
tttagtttaggttgtcgcgtggagtttgc

SEQ ID NO: 1063 - DNA, 30 bp, Artificial Sequences
  Synthetic
ttttagtttaggttgtcgcgtggagtttgc

SEQ ID NO: 1064 - DNA, 31 bp, Artificial Sequences
  Synthetic
attttagtttaggttgtcgcgtggagtttgc

SEQ ID NO: 1065 - DNA, 27 bp, Artificial Sequences
  Synthetic
agaagtcggggagagcgggaagtttgg

SEQ ID NO: 1066 - DNA, 27 bp, Artificial Sequences
  Synthetic
gaagtcggggagagcgggaagtttggt

SEQ ID NO: 1067 - DNA, 27 bp, Artificial Sequences
  Synthetic
taggagaagtcggggagagcgggaagt

SEQ ID NO: 1068 - DNA, 27 bp, Artificial Sequences
  Synthetic
ggagaagtcggggagagcgggaagttt

SEQ ID NO: 1069 - DNA, 27 bp, Artificial Sequences
  Synthetic
aggagaagtcggggagagcgggaagtt

SEQ ID NO: 1070 - DNA, 31 bp, Artificial Sequences
  Synthetic
gggtacgggcgtttttggttaagtttttaga

SEQ ID NO: 1071 - DNA, 31 bp, Artificial Sequences
  Synthetic
cgggcgtttttggttaagtttttagagaggt

SEQ ID NO: 1072 - DNA, 31 bp, Artificial Sequences
  Synthetic
acgggcgtttttggttaagtttttagagagg

SEQ ID NO: 1073 - DNA, 32 bp, Artificial Sequences
  Synthetic
acgggcgtttttggttaagtttttagagaggt

SEQ ID NO: 1074 - DNA, 32 bp, Artificial Sequences
  Synthetic
gggtacgggcgtttttggttaagtttttagag

SEQ ID NO: 1075 - DNA, 29 bp, Artificial Sequences
  Synthetic
tcgtttttgttttcgtcgttgttgtcgga

SEQ ID NO: 1076 - DNA, 29 bp, Artificial Sequences
  Synthetic
cgtttttgttttcgtcgttgttgtcggag

SEQ ID NO: 1077 - DNA, 30 bp, Artificial Sequences
  Synthetic
cgtttttgttttcgtcgttgttgtcggagt

SEQ ID NO: 1078 - DNA, 31 bp, Artificial Sequences
  Synthetic
cgttcgtttttgttttcgtcgttgttgtcgg

SEQ ID NO: 1079 - DNA, 30 bp, Artificial Sequences
  Synthetic
tcgtttttgttttcgtcgttgttgtcggag

SEQ ID NO: 1080 - DNA, 27 bp, Artificial Sequences
  Synthetic
gcggcgagagtaaggacgagcgaagta

SEQ ID NO: 1081 - DNA, 27 bp, Artificial Sequences
  Synthetic
gttttcgttttttggtcgggagcgcgg

SEQ ID NO: 1082 - DNA, 27 bp, Artificial Sequences
  Synthetic
ttttttggtcgggagcgcggggttttc

SEQ ID NO: 1083 - DNA, 27 bp, Artificial Sequences
  Synthetic
ttttcgttttttggtcgggagcgcggg

SEQ ID NO: 1084 - DNA, 27 bp, Artificial Sequences
  Synthetic
gttttttggtcgggagcgcggggtttt

SEQ ID NO: 1085 - DNA, 27 bp, Artificial Sequences
  Synthetic
aaagggggttttgtgttgcgtcgggag

SEQ ID NO: 1086 - DNA, 27 bp, Artificial Sequences
  Synthetic
agaaagggggttttgtgttgcgtcggg

SEQ ID NO: 1087 - DNA, 27 bp, Artificial Sequences
  Synthetic
gaaagggggttttgtgttgcgtcggga

SEQ ID NO: 1088 - DNA, 27 bp, Artificial Sequences
  Synthetic
cggggggaagaaagggggttttgtgtt

SEQ ID NO: 1089 - DNA, 27 bp, Artificial Sequences
  Synthetic
ttcggaggagattttcggaggaggcga

SEQ ID NO: 1090 - DNA, 27 bp, Artificial Sequences
  Synthetic
tgcggtgttaggagtcgacgagttggg

SEQ ID NO: 1091 - DNA, 27 bp, Artificial Sequences
  Synthetic
gcggtgttaggagtcgacgagttgggt

SEQ ID NO: 1092 - DNA, 27 bp, Artificial Sequences
  Synthetic
tagggttggggttgggtcgcggtattg

SEQ ID NO: 1093 - DNA, 27 bp, Artificial Sequences
  Synthetic
ttagggttggggttgggtcgcggtatt

SEQ ID NO: 1094 - DNA, 27 bp, Artificial Sequences
  Synthetic
tttagggttggggttgggtcgcggtat

SEQ ID NO: 1095 - DNA, 27 bp, Artificial Sequences
  Synthetic
gggtcggggatagggagaagggagtgt

SEQ ID NO: 1096 - DNA, 27 bp, Artificial Sequences
  Synthetic
ggggtcggggatagggagaagggagtg

SEQ ID NO: 1097 - DNA, 27 bp, Artificial Sequences
  Synthetic
gtggggtcggggatagggagaagggag

SEQ ID NO: 1098 - DNA, 27 bp, Artificial Sequences
  Synthetic
gtcgtggggtcggggatagggagaagg

SEQ ID NO: 1099 - DNA, 26 bp, Artificial Sequences
  Synthetic
tggggtcggggatagggagaagggag

SEQ ID NO: 1100 - DNA, 27 bp, Artificial Sequences
  Synthetic
tgcggtgttaggagtcgacgagttggg

SEQ ID NO: 1101 - DNA, 27 bp, Artificial Sequences
  Synthetic
gcggtgttaggagtcgacgagttgggt

SEQ ID NO: 1102 - DNA, 27 bp, Artificial Sequences
  Synthetic
cgttgggataggagcgcgtagtaggga

SEQ ID NO: 1103 - DNA, 28 bp, Artificial Sequences
  Synthetic
ttgcggtgttaggagtcgacgagttggg

SEQ ID NO: 1104 - DNA, 27 bp, Artificial Sequences
  Synthetic
cgttgcggtgttaggagtcgacgagtt

SEQ ID NO: 1105 - DNA, 32 bp, Artificial Sequences
  Synthetic
gcggtttagtaaggttgtagtgggaatagagt

SEQ ID NO: 1106 - DNA, 32 bp, Artificial Sequences
  Synthetic
tgcggtttagtaaggttgtagtgggaatagag

SEQ ID NO: 1107 - DNA, 33 bp, Artificial Sequences
  Synthetic
tgcggtttagtaaggttgtagtgggaatagagt

SEQ ID NO: 1108 - DNA, 33 bp, Artificial Sequences
  Synthetic
gcggtttagtaaggttgtagtgggaatagagtt

SEQ ID NO: 1109 - DNA, 33 bp, Artificial Sequences
  Synthetic
ttgcggtttagtaaggttgtagtgggaatagag

SEQ ID NO: 1110 - DNA, 27 bp, Artificial Sequences
  Synthetic
gggaataggagagggagggtgaggcga

SEQ ID NO: 1111 - DNA, 27 bp, Artificial Sequences
  Synthetic
tgggaataggagagggagggtgaggcg

SEQ ID NO: 1112 - DNA, 27 bp, Artificial Sequences
  Synthetic
ggagagggagggtgaggcgatagggtt

SEQ ID NO: 1113 - DNA, 27 bp, Artificial Sequences
  Synthetic
taggagagggagggtgaggcgataggg

SEQ ID NO: 1114 - DNA, 27 bp, Artificial Sequences
  Synthetic
agggagggtgaggcgatagggttagga

SEQ ID NO: 1115 - DNA, 27 bp, Artificial Sequences
  Synthetic
tttggggatggggtggttgaggggatg

SEQ ID NO: 1116 - DNA, 27 bp, Artificial Sequences
  Synthetic
ttggggaaggggtagtggtttggggtt

SEQ ID NO: 1117 - DNA, 27 bp, Artificial Sequences
  Synthetic
tttggggaaggggtagtggtttggggt

SEQ ID NO: 1118 - DNA, 27 bp, Artificial Sequences
  Synthetic
gggatggggtggttgaggggatgagaa

SEQ ID NO: 1119 - DNA, 27 bp, Artificial Sequences
  Synthetic
ttggggatggggtggttgaggggatga

SEQ ID NO: 1120 - DNA, 31 bp, Artificial Sequences
  Synthetic
aggttggatcgggttgtagatgtttagtgtt

SEQ ID NO: 1121 - DNA, 32 bp, Artificial Sequences
  Synthetic
aggttggatcgggttgtagatgtttagtgttt

SEQ ID NO: 1122 - DNA, 33 bp, Artificial Sequences
  Synthetic
aggttggatcgggttgtagatgtttagtgtttt

SEQ ID NO: 1123 - DNA, 33 bp, Artificial Sequences
  Synthetic
ggtttgagtgttgtaggtgtttttgtaagtcgt

SEQ ID NO: 1124 - DNA, 33 bp, Artificial Sequences
  Synthetic
tggtttgagtgttgtaggtgtttttgtaagtcg

SEQ ID NO: 1125 - DNA, 27 bp, Artificial Sequences
  Synthetic
cgtaaaggagcgggtttttgggtgcga

SEQ ID NO: 1126 - DNA, 27 bp, Artificial Sequences
  Synthetic
aggagcgggtttttgggtgcgatttgt

SEQ ID NO: 1127 - DNA, 27 bp, Artificial Sequences
  Synthetic
gcgtaaaggagcgggtttttgggtgcg

SEQ ID NO: 1128 - DNA, 28 bp, Artificial Sequences
  Synthetic
cgtaaaggagcgggtttttgggtgcgat

SEQ ID NO: 1129 - DNA, 28 bp, Artificial Sequences
  Synthetic
aaggagcgggtttttgggtgcgatttgt

SEQ ID NO: 1130 - DNA, 27 bp, Artificial Sequences
  Synthetic
attgggggtggagggtggtttgggtaa

SEQ ID NO: 1131 - DNA, 27 bp, Artificial Sequences
  Synthetic
aattgggggtggagggtggtttgggta

SEQ ID NO: 1132 - DNA, 27 bp, Artificial Sequences
  Synthetic
taattgggggtggagggtggtttgggt

SEQ ID NO: 1133 - DNA, 26 bp, Artificial Sequences
  Synthetic
aattgggggtggagggtggtttgggt

SEQ ID NO: 1134 - DNA, 28 bp, Artificial Sequences
  Synthetic
aattgggggtggagggtggtttgggtaa

SEQ ID NO: 1135 - DNA, 27 bp, Artificial Sequences
  Synthetic
cgaggagggcgagtgttaggttgggtt

SEQ ID NO: 1136 - DNA, 27 bp, Artificial Sequences
  Synthetic
tttaaagttgagcggggcgaggagggc

SEQ ID NO: 1137 - DNA, 27 bp, Artificial Sequences
  Synthetic
ttttaaagttgagcggggcgaggaggg

SEQ ID NO: 1138 - DNA, 26 bp, Artificial Sequences
  Synthetic
cgaggagggcgagtgttaggttgggt

SEQ ID NO: 1139 - DNA, 27 bp, Artificial Sequences
  Synthetic
ggagggcgagtgttaggttgggttacg

SEQ ID NO: 1140 - DNA, 27 bp, Artificial Sequences
  Synthetic
tggtcgtatttgggtgcggtgtttggc

SEQ ID NO: 1141 - DNA, 27 bp, Artificial Sequences
  Synthetic
ttgttgtggtagggtaggtcgcggtcg

SEQ ID NO: 1142 - DNA, 27 bp, Artificial Sequences
  Synthetic
tcgtatttgggtgcggtgtttggcgtg

SEQ ID NO: 1143 - DNA, 27 bp, Artificial Sequences
  Synthetic
cggtaggacgggtcgcgggttagtttt

SEQ ID NO: 1144 - DNA, 27 bp, Artificial Sequences
  Synthetic
tttgtaggtgtcgggcggcgattaagc

SEQ ID NO: 1145 - DNA, 27 bp, Artificial Sequences
  Synthetic
gcggttgggtttttagtttcgcgcgtc

SEQ ID NO: 1146 - DNA, 27 bp, Artificial Sequences
  Synthetic
tcgcggttggtgagtcgtacgttaggt

SEQ ID NO: 1147 - DNA, 27 bp, Artificial Sequences
  Synthetic
acgggggtgtcggtcgtttttatggac

SEQ ID NO: 1148 - DNA, 27 bp, Artificial Sequences
  Synthetic
tattcgtatttgggtagcgcgcgggag

SEQ ID NO: 1149 - DNA, 27 bp, Artificial Sequences
  Synthetic
agaatttcgttacgggggtgtcggtcg

SEQ ID NO: 1150 - DNA, 29 bp, Artificial Sequences
  Synthetic
gcgtttcgtgattgttgtcgtttgttcgg

SEQ ID NO: 1151 - DNA, 28 bp, Artificial Sequences
  Synthetic
gcgtttcgtgattgttgtcgtttgttcg

SEQ ID NO: 1152 - DNA, 28 bp, Artificial Sequences
  Synthetic
ggagtcgttttggtagaagtcgttgtgc

SEQ ID NO: 1153 - DNA, 29 bp, Artificial Sequences
  Synthetic
aggagtcgttttggtagaagtcgttgtgc

SEQ ID NO: 1154 - DNA, 28 bp, Artificial Sequences
  Synthetic
cgtttcgtgattgttgtcgtttgttcgg

SEQ ID NO: 1155 - DNA, 27 bp, Artificial Sequences
  Synthetic
acgggggtgtcggtcgtttttatggac

SEQ ID NO: 1156 - DNA, 27 bp, Artificial Sequences
  Synthetic
agaatttcgttacgggggtgtcggtcg

SEQ ID NO: 1157 - DNA, 28 bp, Artificial Sequences
  Synthetic
aagaatttcgttacgggggtgtcggtcg

SEQ ID NO: 1158 - DNA, 26 bp, Artificial Sequences
  Synthetic
acgggggtgtcggtcgtttttatgga

SEQ ID NO: 1159 - DNA, 29 bp, Artificial Sequences
  Synthetic
gaagaatttcgttacgggggtgtcggtcg

SEQ ID NO: 1160 - DNA, 29 bp, Artificial Sequences
  Synthetic
gcgtttcgtgattgttgtcgtttgttcgg

SEQ ID NO: 1161 - DNA, 28 bp, Artificial Sequences
  Synthetic
gcgtttcgtgattgttgtcgtttgttcg

SEQ ID NO: 1162 - DNA, 28 bp, Artificial Sequences
  Synthetic
cgtttcgtgattgttgtcgtttgttcgg

SEQ ID NO: 1163 - DNA, 27 bp, Artificial Sequences
  Synthetic
tggagttttagggagggatcggtcgtt

SEQ ID NO: 1164 - DNA, 27 bp, Artificial Sequences
  Synthetic
ttggagttttagggagggatcggtcgt

SEQ ID NO: 1165 - DNA, 28 bp, Artificial Sequences
  Synthetic
tggagttttagggagggatcggtcgttt

SEQ ID NO: 1166 - DNA, 28 bp, Artificial Sequences
  Synthetic
ttggagttttagggagggatcggtcgtt

SEQ ID NO: 1167 - DNA, 28 bp, Artificial Sequences
  Synthetic
tttggagttttagggagggatcggtcgt

SEQ ID NO: 1168 - DNA, 27 bp, Artificial Sequences
  Synthetic
ggtgggtataggtcgaggcggggtttt

SEQ ID NO: 1169 - DNA, 27 bp, Artificial Sequences
  Synthetic
tttagcggtgggtataggtcgaggcgg

SEQ ID NO: 1170 - DNA, 27 bp, Artificial Sequences
  Synthetic
ttagcggtgggtataggtcgaggcggg

SEQ ID NO: 1171 - DNA, 28 bp, Artificial Sequences
  Synthetic
gtttagcggtgggtataggtcgaggcgg

SEQ ID NO: 1172 - DNA, 28 bp, Artificial Sequences
  Synthetic
ggtgggtataggtcgaggcggggttttt

SEQ ID NO: 1173 - DNA, 27 bp, Artificial Sequences
  Synthetic
cgtagggggttttggttcgcggtttgt

SEQ ID NO: 1174 - DNA, 27 bp, Artificial Sequences
  Synthetic
gtcgggtttggagcgtagggggttttg

SEQ ID NO: 1175 - DNA, 27 bp, Artificial Sequences
  Synthetic
tcgggtttggagcgtagggggttttgg

SEQ ID NO: 1176 - DNA, 27 bp, Artificial Sequences
  Synthetic
ggtcgggtttggagcgtagggggtttt

SEQ ID NO: 1177 - DNA, 27 bp, Artificial Sequences
  Synthetic
cggggagtttcgttgatgtagtcggcg

SEQ ID NO: 1178 - DNA, 27 bp, Artificial Sequences
  Synthetic
tgtaggtcgcggattagggttttttgc

SEQ ID NO: 1179 - DNA, 28 bp, Artificial Sequences
  Synthetic
ttgtaggtcgcggattagggttttttgc

SEQ ID NO: 1180 - DNA, 29 bp, Artificial Sequences
  Synthetic
gttgtaggtcgcggattagggttttttgc

SEQ ID NO: 1181 - DNA, 30 bp, Artificial Sequences
  Synthetic
tgttgtaggtcgcggattagggttttttgc

SEQ ID NO: 1182 - DNA, 31 bp, Artificial Sequences
  Synthetic
gtgttgtaggtcgcggattagggttttttgc

SEQ ID NO: 1183 - DNA, 28 bp, Artificial Sequences
  Synthetic
cggtgtcgggtgttttttgcggtttagg

SEQ ID NO: 1184 - DNA, 29 bp, Artificial Sequences
  Synthetic
cggtgtcgggtgttttttgcggtttaggt

SEQ ID NO: 1185 - DNA, 27 bp, Artificial Sequences
  Synthetic
cggtgtcgggtgttttttgcggtttag

SEQ ID NO: 1186 - DNA, 28 bp, Artificial Sequences
  Synthetic
ggtgtcgggtgttttttgcggtttaggt

SEQ ID NO: 1187 - DNA, 27 bp, Artificial Sequences
  Synthetic
ggtgtcgggtgttttttgcggtttagg

SEQ ID NO: 1188 - DNA, 27 bp, Artificial Sequences
  Synthetic
tgtaggtcgcggattagggttttttgc

SEQ ID NO: 1189 - DNA, 28 bp, Artificial Sequences
  Synthetic
ggtttgtgggtagtttggatcgtagggg

SEQ ID NO: 1190 - DNA, 29 bp, Artificial Sequences
  Synthetic
aggtttgtgggtagtttggatcgtagggg

SEQ ID NO: 1191 - DNA, 29 bp, Artificial Sequences
  Synthetic
ggtttgtgggtagtttggatcgtagggga

SEQ ID NO: 1192 - DNA, 29 bp, Artificial Sequences
  Synthetic
gggacgcggggtaggggatattttatagg

SEQ ID NO: 1193 - DNA, 27 bp, Artificial Sequences
  Synthetic
gtttttggagggttttggggacggggg

SEQ ID NO: 1194 - DNA, 27 bp, Artificial Sequences
  Synthetic
agtttttggagggttttggggacgggg

SEQ ID NO: 1195 - DNA, 27 bp, Artificial Sequences
  Synthetic
tttttggagggttttggggacgggggg

SEQ ID NO: 1196 - DNA, 26 bp, Artificial Sequences
  Synthetic
ggttttggggacggggggcgtttttt

SEQ ID NO: 1197 - DNA, 28 bp, Artificial Sequences
  Synthetic
gagtttttggagggttttggggacgggg

SEQ ID NO: 1198 - DNA, 28 bp, Artificial Sequences
  Synthetic
ggtttgtgggtagtttggatcgtagggg

SEQ ID NO: 1199 - DNA, 29 bp, Artificial Sequences
  Synthetic
aggtttgtgggtagtttggatcgtagggg

SEQ ID NO: 1200 - DNA, 29 bp, Artificial Sequences
  Synthetic
ggtttgtgggtagtttggatcgtagggga

SEQ ID NO: 1201 - DNA, 29 bp, Artificial Sequences
  Synthetic
gggacgcggggtaggggatattttatagg

SEQ ID NO: 1202 - DNA, 30 bp, Artificial Sequences
  Synthetic
gggacgcggggtaggggatattttataggt

SEQ ID NO: 1203 - DNA, 27 bp, Artificial Sequences
  Synthetic
gtttttggagggttttggggacggggg

SEQ ID NO: 1204 - DNA, 27 bp, Artificial Sequences
  Synthetic
agtttttggagggttttggggacgggg

SEQ ID NO: 1205 - DNA, 27 bp, Artificial Sequences
  Synthetic
tttttggagggttttggggacgggggg

SEQ ID NO: 1206 - DNA, 26 bp, Artificial Sequences
  Synthetic
ggttttggggacggggggcgtttttt

SEQ ID NO: 1207 - DNA, 28 bp, Artificial Sequences
  Synthetic
gagtttttggagggttttggggacgggg

SEQ ID NO: 1208 - DNA, 27 bp, Artificial Sequences
  Synthetic
agcgagaggaggtgttaggtttgcggt

SEQ ID NO: 1209 - DNA, 27 bp, Artificial Sequences
  Synthetic
tcgggtagcgagaggaggtgttaggtt

SEQ ID NO: 1210 - DNA, 27 bp, Artificial Sequences
  Synthetic
gcgagaggaggtgttaggtttgcggta

SEQ ID NO: 1211 - DNA, 27 bp, Artificial Sequences
  Synthetic
atcgggtagcgagaggaggtgttaggt

SEQ ID NO: 1212 - DNA, 28 bp, Artificial Sequences
  Synthetic
agcgagaggaggtgttaggtttgcggta

SEQ ID NO: 1213 - DNA, 27 bp, Artificial Sequences
  Synthetic
gtttttggagggttttggggacggggg

SEQ ID NO: 1214 - DNA, 27 bp, Artificial Sequences
  Synthetic
agtttttggagggttttggggacgggg

SEQ ID NO: 1215 - DNA, 27 bp, Artificial Sequences
  Synthetic
tttttggagggttttggggacgggggg

SEQ ID NO: 1216 - DNA, 26 bp, Artificial Sequences
  Synthetic
ggttttggggacggggggcgtttttt

SEQ ID NO: 1217 - DNA, 28 bp, Artificial Sequences
  Synthetic
gagtttttggagggttttggggacgggg

SEQ ID NO: 1218 - DNA, 27 bp, Artificial Sequences
  Synthetic
gtgggatggagagggtgttgggtggtt

SEQ ID NO: 1219 - DNA, 27 bp, Artificial Sequences
  Synthetic
ttgtgggatggagagggtgttgggtgg

SEQ ID NO: 1220 - DNA, 27 bp, Artificial Sequences
  Synthetic
tgggatggagagggtgttgggtggttt

SEQ ID NO: 1221 - DNA, 27 bp, Artificial Sequences
  Synthetic
tgtgggatggagagggtgttgggtggt

SEQ ID NO: 1222 - DNA, 27 bp, Artificial Sequences
  Synthetic
gggatggagagggtgttgggtggtttg

SEQ ID NO: 1223 - DNA, 27 bp, Artificial Sequences
  Synthetic
agtcgcgggttgttgttttgggttcgt

SEQ ID NO: 1224 - DNA, 27 bp, Artificial Sequences
  Synthetic
gtcgcgggttgttgttttgggttcgtt

SEQ ID NO: 1225 - DNA, 28 bp, Artificial Sequences
  Synthetic
agtcgcgggttgttgttttgggttcgtt

SEQ ID NO: 1226 - DNA, 27 bp, Artificial Sequences
  Synthetic
tcgcgggttgttgttttgggttcgttt

SEQ ID NO: 1227 - DNA, 27 bp, Artificial Sequences
  Synthetic
cgtagtcgcgggttgttgttttgggtt

SEQ ID NO: 1228 - DNA, 27 bp, Artificial Sequences
  Synthetic
ttaggggtcgatgttggtgggttcggg

SEQ ID NO: 1229 - DNA, 27 bp, Artificial Sequences
  Synthetic
gcgtatcgggtcgtttgagttcggggt

SEQ ID NO: 1230 - DNA, 27 bp, Artificial Sequences
  Synthetic
cgtatcgggtcgtttgagttcggggtc

SEQ ID NO: 1231 - DNA, 28 bp, Artificial Sequences
  Synthetic
attaggggtcgatgttggtgggttcggg

SEQ ID NO: 1232 - DNA, 26 bp, Artificial Sequences
  Synthetic
taggggtcgatgttggtgggttcggg

SEQ ID NO: 1233 - DNA, 27 bp, Artificial Sequences
  Synthetic
aggggaaattggaggttagacggcggg

SEQ ID NO: 1234 - DNA, 27 bp, Artificial Sequences
  Synthetic
cgtgttgggcgttgggagttttagggg

SEQ ID NO: 1235 - DNA, 27 bp, Artificial Sequences
  Synthetic
ggggaaattggaggttagacggcgggt

SEQ ID NO: 1236 - DNA, 27 bp, Artificial Sequences
  Synthetic
agaggtcgcggagagtataggggtcgt

SEQ ID NO: 1237 - DNA, 27 bp, Artificial Sequences
  Synthetic
gggggaagggttgagattgcgggagtc

SEQ ID NO: 1238 - DNA, 28 bp, Artificial Sequences
  Synthetic
tgtttttatttgtttggtgcgggtcgga

SEQ ID NO: 1239 - DNA, 28 bp, Artificial Sequences
  Synthetic
ttttatttgtttggtgcgggtcggatgt

SEQ ID NO: 1240 - DNA, 29 bp, Artificial Sequences
  Synthetic
ttgtttttatttgtttggtgcgggtcgga

SEQ ID NO: 1241 - DNA, 29 bp, Artificial Sequences
  Synthetic
tttttatttgtttggtgcgggtcggatgt

SEQ ID NO: 1242 - DNA, 29 bp, Artificial Sequences
  Synthetic
tgtttttatttgtttggtgcgggtcggat

SEQ ID NO: 1243 - DNA, 32 bp, Artificial Sequences
  Synthetic
ttttttggttgggtgtagttttatcgtagggc

SEQ ID NO: 1244 - DNA, 33 bp, Artificial Sequences
  Synthetic
attttttggttgggtgtagttttatcgtagggc

SEQ ID NO: 1245 - DNA, 34 bp, Artificial Sequences
  Synthetic
gattttttggttgggtgtagttttatcgtagggc

SEQ ID NO: 1246 - DNA, 35 bp, Artificial Sequences
  Synthetic
agattttttggttgggtgtagttttatcgtagggc

SEQ ID NO: 1247 - DNA, 36 bp, Artificial Sequences
  Synthetic
gagattttttggttgggtgtagttttatcgtagggc

SEQ ID NO: 1248 - DNA, 27 bp, Artificial Sequences
  Synthetic
ttttgggaggtgggggtgtagtgacga

SEQ ID NO: 1249 - DNA, 27 bp, Artificial Sequences
  Synthetic
tcgttttgggaggtgggggtgtagtga

SEQ ID NO: 1250 - DNA, 27 bp, Artificial Sequences
  Synthetic
tttgggaggtgggggtgtagtgacgat

SEQ ID NO: 1251 - DNA, 27 bp, Artificial Sequences
  Synthetic
gttttgggaggtgggggtgtagtgacg

SEQ ID NO: 1252 - DNA, 27 bp, Artificial Sequences
  Synthetic
cgttttgggaggtgggggtgtagtgac

SEQ ID NO: 1253 - DNA, 27 bp, Artificial Sequences
  Synthetic
tgagggaggcggattttaaagtcgagt

SEQ ID NO: 1254 - DNA, 28 bp, Artificial Sequences
  Synthetic
tgagggaggcggattttaaagtcgagtt

SEQ ID NO: 1255 - DNA, 28 bp, Artificial Sequences
  Synthetic
ttgagggaggcggattttaaagtcgagt

SEQ ID NO: 1256 - DNA, 29 bp, Artificial Sequences
  Synthetic
tgagggaggcggattttaaagtcgagttt

SEQ ID NO: 1257 - DNA, 29 bp, Artificial Sequences
  Synthetic
ttgagggaggcggattttaaagtcgagtt

SEQ ID NO: 1258 - DNA, 27 bp, Artificial Sequences
  Synthetic
gggggtagaggagggggttcggttttg

SEQ ID NO: 1259 - DNA, 27 bp, Artificial Sequences
  Synthetic
tgggggtagaggagggggttcggtttt

SEQ ID NO: 1260 - DNA, 27 bp, Artificial Sequences
  Synthetic
ttgggggtagaggagggggttcggttt

SEQ ID NO: 1261 - DNA, 27 bp, Artificial Sequences
  Synthetic
tttgggggtagaggagggggttcggtt

SEQ ID NO: 1262 - DNA, 27 bp, Artificial Sequences
  Synthetic
ggggtagaggagggggttcggttttga

SEQ ID NO: 1263 - DNA, 27 bp, Artificial Sequences
  Synthetic
tggcgtttcgggtttaaagagaggtgg

SEQ ID NO: 1264 - DNA, 28 bp, Artificial Sequences
  Synthetic
tggcgtttcgggtttaaagagaggtgga

SEQ ID NO: 1265 - DNA, 27 bp, Artificial Sequences
  Synthetic
ggcgtttcgggtttaaagagaggtgga

SEQ ID NO: 1266 - DNA, 28 bp, Artificial Sequences
  Synthetic
atggcgtttcgggtttaaagagaggtgg

SEQ ID NO: 1267 - DNA, 29 bp, Artificial Sequences
  Synthetic
tggcgtttcgggtttaaagagaggtggaa

SEQ ID NO: 1268 - DNA, 27 bp, Artificial Sequences
  Synthetic
tgtaggggagggggcggaggagttatt

SEQ ID NO: 1269 - DNA, 27 bp, Artificial Sequences
  Synthetic
gtatttgtgtaggggagggggcggagg

SEQ ID NO: 1270 - DNA, 27 bp, Artificial Sequences
  Synthetic
tatttgtgtaggggagggggcggagga

SEQ ID NO: 1271 - DNA, 27 bp, Artificial Sequences
  Synthetic
ggtgtatttgtgtaggggagggggcgg

SEQ ID NO: 1272 - DNA, 27 bp, Artificial Sequences
  Synthetic
gggtgtatttgtgtaggggagggggcg

SEQ ID NO: 1273 - DNA, 27 bp, Artificial Sequences
  Synthetic
gtggggagtaaggagggcgggagtttg

SEQ ID NO: 1274 - DNA, 27 bp, Artificial Sequences
  Synthetic
agtggggagtaaggagggcgggagttt

SEQ ID NO: 1275 - DNA, 27 bp, Artificial Sequences
  Synthetic
gaagagtggggagtaaggagggcggga

SEQ ID NO: 1276 - DNA, 27 bp, Artificial Sequences
  Synthetic
aagagtggggagtaaggagggcgggag

SEQ ID NO: 1277 - DNA, 27 bp, Artificial Sequences
  Synthetic
ttgaagagtggggagtaaggagggcgg

SEQ ID NO: 1278 - DNA, 27 bp, Artificial Sequences
  Synthetic
tcgggttgtggcgaaatgaattggttt

SEQ ID NO: 1279 - DNA, 27 bp, Artificial Sequences
  Synthetic
ttcgggttgtggcgaaatgaattggtt

SEQ ID NO: 1280 - DNA, 27 bp, Artificial Sequences
  Synthetic
tttcgggttgtggcgaaatgaattggt

SEQ ID NO: 1281 - DNA, 28 bp, Artificial Sequences
  Synthetic
cgggattaaatgagcggatgtgtttgcg

SEQ ID NO: 1282 - DNA, 29 bp, Artificial Sequences
  Synthetic
tcgggattaaatgagcggatgtgtttgcg

SEQ ID NO: 1283 - DNA, 27 bp, Artificial Sequences
  Synthetic
cggcgaggggtttgtaggggttaggtt

SEQ ID NO: 1284 - DNA, 27 bp, Artificial Sequences
  Synthetic
gcggttgcgaggaagttgaggtttggg

SEQ ID NO: 1285 - DNA, 27 bp, Artificial Sequences
  Synthetic
gtggggagtaaggagggcgggagtttg

SEQ ID NO: 1286 - DNA, 27 bp, Artificial Sequences
  Synthetic
aggtttgggagagtaaggggcgcgtag

SEQ ID NO: 1287 - DNA, 27 bp, Artificial Sequences
  Synthetic
ttcggcgaggggtttgtaggggttagg

SEQ ID NO: 1288 - DNA, 28 bp, Artificial Sequences
  Synthetic
cggggtgggtacgggatatagattcggg

SEQ ID NO: 1289 - DNA, 28 bp, Artificial Sequences
  Synthetic
gggtgggtacgggatatagattcggggg

SEQ ID NO: 1290 - DNA, 28 bp, Artificial Sequences
  Synthetic
ggggtgggtacgggatatagattcgggg

SEQ ID NO: 1291 - DNA, 29 bp, Artificial Sequences
  Synthetic
tcggggtgggtacgggatatagattcggg

SEQ ID NO: 1292 - DNA, 29 bp, Artificial Sequences
  Synthetic
gggtgggtacgggatatagattcggggga

SEQ ID NO: 1293 - DNA, 36 bp, Artificial Sequences
  Synthetic
aattcgtttagtaggtagggtagttttcgggatttt

SEQ ID NO: 1294 - DNA, 27 bp, Artificial Sequences
  Synthetic
tgaggcggtaggggttagtagtgggtt

SEQ ID NO: 1295 - DNA, 27 bp, Artificial Sequences
  Synthetic
ttgaggcggtaggggttagtagtgggt

SEQ ID NO: 1296 - DNA, 28 bp, Artificial Sequences
  Synthetic
tgaggcggtaggggttagtagtgggttt

SEQ ID NO: 1297 - DNA, 28 bp, Artificial Sequences
  Synthetic
ttgaggcggtaggggttagtagtgggtt

SEQ ID NO: 1298 - DNA, 28 bp, Artificial Sequences
  Synthetic
tttgaggcggtaggggttagtagtgggt

SEQ ID NO: 1299 - DNA, 27 bp, Artificial Sequences
  Synthetic
aggagggattttagaggagtggcgggg

SEQ ID NO: 1300 - DNA, 27 bp, Artificial Sequences
  Synthetic
ggagggattttagaggagtggcgggga

SEQ ID NO: 1301 - DNA, 28 bp, Artificial Sequences
  Synthetic
aggagggattttagaggagtggcgggga

SEQ ID NO: 1302 - DNA, 28 bp, Artificial Sequences
  Synthetic
gaggagggattttagaggagtggcgggg

SEQ ID NO: 1303 - DNA, 28 bp, Artificial Sequences
  Synthetic
ggagggattttagaggagtggcggggaa

SEQ ID NO: 1304 - DNA, 27 bp, Artificial Sequences
  Synthetic
aggttttttgggattgtagcgcggtga

SEQ ID NO: 1305 - DNA, 27 bp, Artificial Sequences
  Synthetic
aaggttttttgggattgtagcgcggtg

SEQ ID NO: 1306 - DNA, 28 bp, Artificial Sequences
  Synthetic
aaggttttttgggattgtagcgcggtga

SEQ ID NO: 1307 - DNA, 27 bp, Artificial Sequences
  Synthetic
ggttttttgggattgtagcgcggtgat

SEQ ID NO: 1308 - DNA, 28 bp, Artificial Sequences
  Synthetic
aggttttttgggattgtagcgcggtgat

SEQ ID NO: 1309 - DNA, 36 bp, Artificial Sequences
  Synthetic
agtgtttcgttgttaattgttgatatagaaggggga

SEQ ID NO: 1310 - DNA, 32 bp, Artificial Sequences
  Synthetic
agtgaatagatggtgtttggatagcgtttggt

SEQ ID NO: 1311 - DNA, 33 bp, Artificial Sequences
  Synthetic
agtgaatagatggtgtttggatagcgtttggta

SEQ ID NO: 1312 - DNA, 33 bp, Artificial Sequences
  Synthetic
tagtgaatagatggtgtttggatagcgtttggt

SEQ ID NO: 1313 - DNA, 33 bp, Artificial Sequences
  Synthetic
aggttagtgaatagatggtgtttggatagcgtt

SEQ ID NO: 1314 - DNA, 34 bp, Artificial Sequences
  Synthetic
ttagtgaatagatggtgtttggatagcgtttggt

SEQ ID NO: 1315 - DNA, 27 bp, Artificial Sequences
  Synthetic
tcgcgtatttgttcggaggagtcgggg

SEQ ID NO: 1316 - DNA, 27 bp, Artificial Sequences
  Synthetic
gcggttgggttgcggggttgttttttc

SEQ ID NO: 1317 - DNA, 27 bp, Artificial Sequences
  Synthetic
cgcgtatttgttcggaggagtcggggt

SEQ ID NO: 1318 - DNA, 27 bp, Artificial Sequences
  Synthetic
cggttgggttgcggggttgttttttcg

SEQ ID NO: 1319 - DNA, 27 bp, Artificial Sequences
  Synthetic
gcgtatttgttcggaggagtcggggtc

SEQ ID NO: 1320 - DNA, 27 bp, Artificial Sequences
  Synthetic
tgtttcgtattgtgcgggaggagggcg

SEQ ID NO: 1321 - DNA, 27 bp, Artificial Sequences
  Synthetic
ttgtttcgtattgtgcgggaggagggc

SEQ ID NO: 1322 - DNA, 27 bp, Artificial Sequences
  Synthetic
gtttcgtattgtgcgggaggagggcgg

SEQ ID NO: 1323 - DNA, 26 bp, Artificial Sequences
  Synthetic
gtttcgtattgtgcgggaggagggcg

SEQ ID NO: 1324 - DNA, 28 bp, Artificial Sequences
  Synthetic
tttgtttcgtattgtgcgggaggagggc

SEQ ID NO: 1325 - DNA, 27 bp, Artificial Sequences
  Synthetic
gtgcgtcgcgtgtgttgttaggggaag

SEQ ID NO: 1326 - DNA, 27 bp, Artificial Sequences
  Synthetic
gggcgagggggtgttttttgaggatgc

SEQ ID NO: 1327 - DNA, 27 bp, Artificial Sequences
  Synthetic
cgagggggtgttttttgaggatgcggg

SEQ ID NO: 1328 - DNA, 27 bp, Artificial Sequences
  Synthetic
gttgttaggggaagggggcgttagggt

SEQ ID NO: 1329 - DNA, 27 bp, Artificial Sequences
  Synthetic
tgttgttaggggaagggggcgttaggg

SEQ ID NO: 1330 - DNA, 26 bp, Artificial Sequences
  Synthetic
gtttgtagagcggaggaggaggcgcg

SEQ ID NO: 1331 - DNA, 26 bp, Artificial Sequences
  Synthetic
cgtttgtagagcggaggaggaggcgc

SEQ ID NO: 1332 - DNA, 27 bp, Artificial Sequences
  Synthetic
gtttgtagagcggaggaggaggcgcgg

SEQ ID NO: 1333 - DNA, 25 bp, Artificial Sequences
  Synthetic
tttgtagagcggaggaggaggcgcg

SEQ ID NO: 1334 - DNA, 27 bp, Artificial Sequences
  Synthetic
cgtttgtagagcggaggaggaggcgcg

SEQ ID NO: 1335 - DNA, 27 bp, Artificial Sequences
  Synthetic
gcgcgcgtgtggaaagttagaggatgg

SEQ ID NO: 1336 - DNA, 27 bp, Artificial Sequences
  Synthetic
ttgtgcgcgcgtgtggaaagttagagg

SEQ ID NO: 1337 - DNA, 27 bp, Artificial Sequences
  Synthetic
gggcgagggggtgttttttgaggatgc

SEQ ID NO: 1338 - DNA, 27 bp, Artificial Sequences
  Synthetic
cgagggggtgttttttgaggatgcggg

SEQ ID NO: 1339 - DNA, 27 bp, Artificial Sequences
  Synthetic
gagggaaggtaagggcgcgtgtttgtg

SEQ ID NO: 1340 - DNA, 27 bp, Artificial Sequences
  Synthetic
cggtcgttcgggaggttttagtcgtgt

SEQ ID NO: 1341 - DNA, 28 bp, Artificial Sequences
  Synthetic
tcggtcgttcgggaggttttagtcgtgt

SEQ ID NO: 1342 - DNA, 27 bp, Artificial Sequences
  Synthetic
tcggtcgttcgggaggttttagtcgtg

SEQ ID NO: 1343 - DNA, 27 bp, Artificial Sequences
  Synthetic
ttcggtcgttcgggaggttttagtcgt

SEQ ID NO: 1344 - DNA, 28 bp, Artificial Sequences
  Synthetic
cggtcgttcgggaggttttagtcgtgtt

SEQ ID NO: 1345 - DNA, 27 bp, Artificial Sequences
  Synthetic
gggattagggtttcggagggtgtcggg

SEQ ID NO: 1346 - DNA, 27 bp, Artificial Sequences
  Synthetic
cgggattagggtttcggagggtgtcgg

SEQ ID NO: 1347 - DNA, 27 bp, Artificial Sequences
  Synthetic
gggaacgggttggtggcggttttaagc

SEQ ID NO: 1348 - DNA, 27 bp, Artificial Sequences
  Synthetic
ggattagggtttcggagggtgtcgggc

SEQ ID NO: 1349 - DNA, 27 bp, Artificial Sequences
  Synthetic
tcgggattagggtttcggagggtgtcg

SEQ ID NO: 1350 - DNA, 27 bp, Artificial Sequences
  Synthetic
gcgcgcgggaggaattgtttgagtagg

SEQ ID NO: 1351 - DNA, 27 bp, Artificial Sequences
  Synthetic
ggcgcgcgggaggaattgtttgagtag

SEQ ID NO: 1352 - DNA, 27 bp, Artificial Sequences
  Synthetic
cgttttttgcgtaggtgggtgggtggg

SEQ ID NO: 1353 - DNA, 27 bp, Artificial Sequences
  Synthetic
cgtaaggtcgttagggggtcgcgtgtc

SEQ ID NO: 1354 - DNA, 27 bp, Artificial Sequences
  Synthetic
gttttttgcgtaggtgggtgggtggga

SEQ ID NO: 1355 - DNA, 27 bp, Artificial Sequences
  Synthetic
gggattagggtttcggagggtgtcggg

SEQ ID NO: 1356 - DNA, 27 bp, Artificial Sequences
  Synthetic
cgggattagggtttcggagggtgtcgg

SEQ ID NO: 1357 - DNA, 27 bp, Artificial Sequences
  Synthetic
gggaacgggttggtggcggttttaagc

SEQ ID NO: 1358 - DNA, 27 bp, Artificial Sequences
  Synthetic
ggattagggtttcggagggtgtcgggc

SEQ ID NO: 1359 - DNA, 27 bp, Artificial Sequences
  Synthetic
tcgggattagggtttcggagggtgtcg

SEQ ID NO: 1360 - DNA, 27 bp, Artificial Sequences
  Synthetic
tcggagtagggtcgtaatttcgcggtt

SEQ ID NO: 1361 - DNA, 27 bp, Artificial Sequences
  Synthetic
ttcggagtagggtcgtaatttcgcggt

SEQ ID NO: 1362 - DNA, 27 bp, Artificial Sequences
  Synthetic
cggagtagggtcgtaatttcgcggttt

SEQ ID NO: 1363 - DNA, 28 bp, Artificial Sequences
  Synthetic
tcggagtagggtcgtaatttcgcggttt

SEQ ID NO: 1364 - DNA, 28 bp, Artificial Sequences
  Synthetic
ttcggagtagggtcgtaatttcgcggtt

SEQ ID NO: 1365 - DNA, 27 bp, Artificial Sequences
  Synthetic
gcgaggttgcggttttgtttcgaattt

SEQ ID NO: 1366 - DNA, 23 bp, Artificial Sequences
  Synthetic
ggggcgtcgcgggtgttaaaggg

SEQ ID NO: 1367 - DNA, 28 bp, Artificial Sequences
  Synthetic
gcgaggttgcggttttgtttcgaatttc

SEQ ID NO: 1368 - DNA, 23 bp, Artificial Sequences
  Synthetic
gggcgtcgcgggtgttaaagggc

SEQ ID NO: 1369 - DNA, 26 bp, Artificial Sequences
  Synthetic
gagtttacgcggatgttacggtcgtc

SEQ ID NO: 1370 - DNA, 27 bp, Artificial Sequences
  Synthetic
ttttgcggttcgggcggttgtatttcg

SEQ ID NO: 1371 - DNA, 27 bp, Artificial Sequences
  Synthetic
ttagttttttgcggttcgggcggttgt

SEQ ID NO: 1372 - DNA, 27 bp, Artificial Sequences
  Synthetic
agttttttgcggttcgggcggttgtat

SEQ ID NO: 1373 - DNA, 28 bp, Artificial Sequences
  Synthetic
tttttgcggttcgggcggttgtatttcg

SEQ ID NO: 1374 - DNA, 27 bp, Artificial Sequences
  Synthetic
tcggagtagggtcgtaatttcgcggtt

SEQ ID NO: 1375 - DNA, 27 bp, Artificial Sequences
  Synthetic
ttggggattcgcggggtgtagtcgttc

SEQ ID NO: 1376 - DNA, 27 bp, Artificial Sequences
  Synthetic
gggtgtagtcgttcgggtcgtaggagg

SEQ ID NO: 1377 - DNA, 27 bp, Artificial Sequences
  Synthetic
ggggtgtagtcgttcgggtcgtaggag

SEQ ID NO: 1378 - DNA, 27 bp, Artificial Sequences
  Synthetic
gttggggattcgcggggtgtagtcgtt

SEQ ID NO: 1379 - DNA, 27 bp, Artificial Sequences
  Synthetic
tttcggttggggattcgcggggtgtag

SEQ ID NO: 1380 - DNA, 27 bp, Artificial Sequences
  Synthetic
tttgcggttcgggcggttgtatttcgt

SEQ ID NO: 1381 - DNA, 27 bp, Artificial Sequences
  Synthetic
ttttgcggttcgggcggttgtatttcg

SEQ ID NO: 1382 - DNA, 28 bp, Artificial Sequences
  Synthetic
ttttgcggttcgggcggttgtatttcgt

SEQ ID NO: 1383 - DNA, 26 bp, Artificial Sequences
  Synthetic
ttgcggttcgggcggttgtatttcgt

SEQ ID NO: 1384 - DNA, 27 bp, Artificial Sequences
  Synthetic
ttagttttttgcggttcgggcggttgt

SEQ ID NO: 1385 - DNA, 27 bp, Artificial Sequences
  Synthetic
tgtgacgggggcggggaattataacgt

SEQ ID NO: 1386 - DNA, 27 bp, Artificial Sequences
  Synthetic
ttgtgtagatcgcgaggggagacggtg

SEQ ID NO: 1387 - DNA, 27 bp, Artificial Sequences
  Synthetic
tttgtgtagatcgcgaggggagacggt

SEQ ID NO: 1388 - DNA, 27 bp, Artificial Sequences
  Synthetic
ggtcgggagcgtagtttttcgggaggc

SEQ ID NO: 1389 - DNA, 28 bp, Artificial Sequences
  Synthetic
tgtgacgggggcggggaattataacgtt

SEQ ID NO: 1390 - DNA, 27 bp, Artificial Sequences
  Synthetic
tcgggcggcgtttaggttatgattcgt

SEQ ID NO: 1391 - DNA, 27 bp, Artificial Sequences
  Synthetic
cgggcggcgtttaggttatgattcgtt

SEQ ID NO: 1392 - DNA, 28 bp, Artificial Sequences
  Synthetic
tcgggcggcgtttaggttatgattcgtt

SEQ ID NO: 1393 - DNA, 28 bp, Artificial Sequences
  Synthetic
ttcgggcggcgtttaggttatgattcgt

SEQ ID NO: 1394 - DNA, 27 bp, Artificial Sequences
  Synthetic
ttcgggcggcgtttaggttatgattcg

SEQ ID NO: 1395 - DNA, 27 bp, Artificial Sequences
  Synthetic
ttgtgtagatcgcgaggggagacggtg

SEQ ID NO: 1396 - DNA, 27 bp, Artificial Sequences
  Synthetic
ggagcgtagtttttcgggaggcgggtt

SEQ ID NO: 1397 - DNA, 27 bp, Artificial Sequences
  Synthetic
ttttcgggaggcgggttatggtttggg

SEQ ID NO: 1398 - DNA, 27 bp, Artificial Sequences
  Synthetic
tttgtgtagatcgcgaggggagacggt

SEQ ID NO: 1399 - DNA, 27 bp, Artificial Sequences
  Synthetic
ggtcgggagcgtagtttttcgggaggc

SEQ ID NO: 1400 - DNA, 27 bp, Artificial Sequences
  Synthetic
aggttcgttagttgtcggttggggcga

SEQ ID NO: 1401 - DNA, 27 bp, Artificial Sequences
  Synthetic
ggttcgttagttgtcggttggggcgaa

SEQ ID NO: 1402 - DNA, 28 bp, Artificial Sequences
  Synthetic
aggttcgttagttgtcggttggggcgaa

SEQ ID NO: 1403 - DNA, 27 bp, Artificial Sequences
  Synthetic
taggttcgttagttgtcggttggggcg

SEQ ID NO: 1404 - DNA, 27 bp, Artificial Sequences
  Synthetic
tcgttagttgtcggttggggcgaaagt

SEQ ID NO: 1405 - DNA, 29 bp, Artificial Sequences
  Synthetic
cgggttttcgttttaatcggtagttggcg

SEQ ID NO: 1406 - DNA, 30 bp, Artificial Sequences
  Synthetic
tcgggttttcgttttaatcggtagttggcg

SEQ ID NO: 1407 - DNA, 29 bp, Artificial Sequences
  Synthetic
tcgggttttcgttttaatcggtagttggc

SEQ ID NO: 1408 - DNA, 31 bp, Artificial Sequences
  Synthetic
ttcgggttttcgttttaatcggtagttggcg

SEQ ID NO: 1409 - DNA, 30 bp, Artificial Sequences
  Synthetic
ttcgggttttcgttttaatcggtagttggc

SEQ ID NO: 1410 - DNA, 27 bp, Artificial Sequences
  Synthetic
aggttcgttagttgtcggttggggcga

SEQ ID NO: 1411 - DNA, 27 bp, Artificial Sequences
  Synthetic
ggttcgttagttgtcggttggggcgaa

SEQ ID NO: 1412 - DNA, 28 bp, Artificial Sequences
  Synthetic
aggttcgttagttgtcggttggggcgaa

SEQ ID NO: 1413 - DNA, 27 bp, Artificial Sequences
  Synthetic
taggttcgttagttgtcggttggggcg

SEQ ID NO: 1414 - DNA, 27 bp, Artificial Sequences
  Synthetic
tcgttagttgtcggttggggcgaaagt

SEQ ID NO: 1415 - DNA, 27 bp, Artificial Sequences
  Synthetic
tcggtagttggcgggtttggtggagag

SEQ ID NO: 1416 - DNA, 27 bp, Artificial Sequences
  Synthetic
atcggtagttggcgggtttggtggaga

SEQ ID NO: 1417 - DNA, 27 bp, Artificial Sequences
  Synthetic
tagttggcgggtttggtggagagcgtg

SEQ ID NO: 1418 - DNA, 27 bp, Artificial Sequences
  Synthetic
gtagttggcgggtttggtggagagcgt

SEQ ID NO: 1419 - DNA, 27 bp, Artificial Sequences
  Synthetic
aatcggtagttggcgggtttggtggag

SEQ ID NO: 1420 - DNA, 27 bp, Artificial Sequences
  Synthetic
gggggaggggcggacggtgtaaaataa

SEQ ID NO: 1421 - DNA, 27 bp, Artificial Sequences
  Synthetic
ggagcggtcgtgggagtcgtttaggag

SEQ ID NO: 1422 - DNA, 27 bp, Artificial Sequences
  Synthetic
gataggagagtgtttgggggaggggcg

SEQ ID NO: 1423 - DNA, 27 bp, Artificial Sequences
  Synthetic
cgataggagagtgtttgggggaggggc

SEQ ID NO: 1424 - DNA, 27 bp, Artificial Sequences
  Synthetic
tagcgttcgtagttttcgtcggggggc

SEQ ID NO: 1425 - DNA, 27 bp, Artificial Sequences
  Synthetic
acgtcgggggtttaggtaggtagagaa

SEQ ID NO: 1426 - DNA, 28 bp, Artificial Sequences
  Synthetic
ggtcgagttattttaggcgttcgtgggt

SEQ ID NO: 1427 - DNA, 27 bp, Artificial Sequences
  Synthetic
ggtcgagttattttaggcgttcgtggg

SEQ ID NO: 1428 - DNA, 29 bp, Artificial Sequences
  Synthetic
aggtcgagttattttaggcgttcgtgggt

SEQ ID NO: 1429 - DNA, 28 bp, Artificial Sequences
  Synthetic
aggtcgagttattttaggcgttcgtggg

SEQ ID NO: 1430 - DNA, 27 bp, Artificial Sequences
  Synthetic
acgagggttttgaatgtatagcgcggg

SEQ ID NO: 1431 - DNA, 28 bp, Artificial Sequences
  Synthetic
acgagggttttgaatgtatagcgcggga

SEQ ID NO: 1432 - DNA, 27 bp, Artificial Sequences
  Synthetic
cgagggttttgaatgtatagcgcggga

SEQ ID NO: 1433 - DNA, 27 bp, Artificial Sequences
  Synthetic
agcgcgggagttttaggtttaggagtg

SEQ ID NO: 1434 - DNA, 27 bp, Artificial Sequences
  Synthetic
gcgcgggagttttaggtttaggagtga

SEQ ID NO: 1435 - DNA, 27 bp, Artificial Sequences
  Synthetic
agggttttcgtggtttttagaggcgcg

SEQ ID NO: 1436 - DNA, 28 bp, Artificial Sequences
  Synthetic
tagggttttcgtggtttttagaggcgcg

SEQ ID NO: 1437 - DNA, 26 bp, Artificial Sequences
  Synthetic
gggttttcgtggtttttagaggcgcg

SEQ ID NO: 1438 - DNA, 27 bp, Artificial Sequences
  Synthetic
acgtcgggggtttaggtaggtagagaa

SEQ ID NO: 1439 - DNA, 28 bp, Artificial Sequences
  Synthetic
ggtcgagttattttaggcgttcgtgggt

SEQ ID NO: 1440 - DNA, 28 bp, Artificial Sequences
  Synthetic
cgcggttttttcgttttggtttttgcgt

SEQ ID NO: 1441 - DNA, 27 bp, Artificial Sequences
  Synthetic
cgcggttttttcgttttggtttttgcg

SEQ ID NO: 1442 - DNA, 29 bp, Artificial Sequences
  Synthetic
cgcggttttttcgttttggtttttgcgtt

SEQ ID NO: 1443 - DNA, 30 bp, Artificial Sequences
  Synthetic
cgcggttttttcgttttggtttttgcgttt

SEQ ID NO: 1444 - DNA, 31 bp, Artificial Sequences
  Synthetic
cgcggttttttcgttttggtttttgcgtttt

SEQ ID NO: 1445 - DNA, 27 bp, Artificial Sequences
  Synthetic
gttgggtagtttcgtcgggttgtggcg

SEQ ID NO: 1446 - DNA, 27 bp, Artificial Sequences
  Synthetic
ttgggtagtttcgtcgggttgtggcga

SEQ ID NO: 1447 - DNA, 27 bp, Artificial Sequences
  Synthetic
ggttgggtagtttcgtcgggttgtggc

SEQ ID NO: 1448 - DNA, 27 bp, Artificial Sequences
  Synthetic
gggttgggtagtttcgtcgggttgtgg

SEQ ID NO: 1449 - DNA, 26 bp, Artificial Sequences
  Synthetic
tgggtagtttcgtcgggttgtggcga

SEQ ID NO: 1450 - DNA, 29 bp, Artificial Sequences
  Synthetic
aggtttcgcgtttattttggttcggtgtc

SEQ ID NO: 1451 - DNA, 30 bp, Artificial Sequences
  Synthetic
taggtttcgcgtttattttggttcggtgtc

SEQ ID NO: 1452 - DNA, 31 bp, Artificial Sequences
  Synthetic
ttaggtttcgcgtttattttggttcggtgtc

SEQ ID NO: 1453 - DNA, 32 bp, Artificial Sequences
  Synthetic
tttaggtttcgcgtttattttggttcggtgtc

SEQ ID NO: 1454 - DNA, 27 bp, Artificial Sequences
  Synthetic
cgcgaggggtaggacgaggttgtatgg

SEQ ID NO: 1455 - DNA, 27 bp, Artificial Sequences
  Synthetic
gttgggtagtttcgtcgggttgtggcg

SEQ ID NO: 1456 - DNA, 27 bp, Artificial Sequences
  Synthetic
gcgaggggtaggacgaggttgtatggg

SEQ ID NO: 1457 - DNA, 27 bp, Artificial Sequences
  Synthetic
ttgggtagtttcgtcgggttgtggcga

SEQ ID NO: 1458 - DNA, 27 bp, Artificial Sequences
  Synthetic
ggttgggtagtttcgtcgggttgtggc

SEQ ID NO: 1459 - DNA, 27 bp, Artificial Sequences
  Synthetic
ttttcggttttttgggcgggttttgcg

SEQ ID NO: 1460 - DNA, 26 bp, Artificial Sequences
  Synthetic
ttcggttttttgggcgggttttgcgt

SEQ ID NO: 1461 - DNA, 27 bp, Artificial Sequences
  Synthetic
cgcggtttagttcggtgtagttgaggg

SEQ ID NO: 1462 - DNA, 28 bp, Artificial Sequences
  Synthetic
tttttcggttttttgggcgggttttgcg

SEQ ID NO: 1463 - DNA, 28 bp, Artificial Sequences
  Synthetic
cgcggtttagttcggtgtagttgaggga

SEQ ID NO: 1464 - DNA, 27 bp, Artificial Sequences
  Synthetic
cgcgaggggtaggacgaggttgtatgg

SEQ ID NO: 1465 - DNA, 27 bp, Artificial Sequences
  Synthetic
gcgaggggtaggacgaggttgtatggg

SEQ ID NO: 1466 - DNA, 27 bp, Artificial Sequences
  Synthetic
tcgagttagagtgagcgcggggtttgg

SEQ ID NO: 1467 - DNA, 27 bp, Artificial Sequences
  Synthetic
cgaggttgtatgggttagcgagggggt

SEQ ID NO: 1468 - DNA, 27 bp, Artificial Sequences
  Synthetic
acgaggttgtatgggttagcgaggggg

SEQ ID NO: 1469 - DNA, 27 bp, Artificial Sequences
  Synthetic
tcggaggcgcgcgttgttttgtagttt

SEQ ID NO: 1470 - DNA, 27 bp, Artificial Sequences
  Synthetic
ttcggaggcgcgcgttgttttgtagtt

SEQ ID NO: 1471 - DNA, 27 bp, Artificial Sequences
  Synthetic
tttcggaggcgcgcgttgttttgtagt

SEQ ID NO: 1472 - DNA, 27 bp, Artificial Sequences
  Synthetic
agtttcggaggcgcgcgttgttttgta

SEQ ID NO: 1473 - DNA, 27 bp, Artificial Sequences
  Synthetic
gtttcggaggcgcgcgttgttttgtag

SEQ ID NO: 1474 - DNA, 28 bp, Artificial Sequences
  Synthetic
ggcgtagagttcgtttagggagtcggga

SEQ ID NO: 1475 - DNA, 27 bp, Artificial Sequences
  Synthetic
gcgtagagttcgtttagggagtcggga

SEQ ID NO: 1476 - DNA, 29 bp, Artificial Sequences
  Synthetic
ggcgtagagttcgtttagggagtcgggag

SEQ ID NO: 1477 - DNA, 28 bp, Artificial Sequences
  Synthetic
gcgtagagttcgtttagggagtcgggag

SEQ ID NO: 1478 - DNA, 29 bp, Artificial Sequences
  Synthetic
gcgtagagttcgtttagggagtcgggaga

SEQ ID NO: 1479 - DNA, 27 bp, Artificial Sequences
  Synthetic
ttaaggggcgcgtaggagtttcggagg

SEQ ID NO: 1480 - DNA, 27 bp, Artificial Sequences
  Synthetic
tcggaggcgcgcgttgttttgtagttt

SEQ ID NO: 1481 - DNA, 27 bp, Artificial Sequences
  Synthetic
ttcggaggcgcgcgttgttttgtagtt

SEQ ID NO: 1482 - DNA, 27 bp, Artificial Sequences
  Synthetic
tttcggaggcgcgcgttgttttgtagt

SEQ ID NO: 1483 - DNA, 27 bp, Artificial Sequences
  Synthetic
agtttcggaggcgcgcgttgttttgta

SEQ ID NO: 1484 - DNA, 27 bp, Artificial Sequences
  Synthetic
aggggtgcgttttttaagtttcgggtg

SEQ ID NO: 1485 - DNA, 27 bp, Artificial Sequences
  Synthetic
ggggtgcgttttttaagtttcgggtga

SEQ ID NO: 1486 - DNA, 29 bp, Artificial Sequences
  Synthetic
ggggtgcgttttttaagtttcgggtgagg

SEQ ID NO: 1487 - DNA, 30 bp, Artificial Sequences
  Synthetic
ggggtgcgttttttaagtttcgggtgaggt

SEQ ID NO: 1488 - DNA, 28 bp, Artificial Sequences
  Synthetic
aggggtgcgttttttaagtttcgggtga

SEQ ID NO: 1489 - DNA, 27 bp, Artificial Sequences
  Synthetic
gggaggtaggaggtgggagtgcgtttc

SEQ ID NO: 1490 - DNA, 27 bp, Artificial Sequences
  Synthetic
ttaaggggcgcgtaggagtttcggagg

SEQ ID NO: 1491 - DNA, 27 bp, Artificial Sequences
  Synthetic
ggaggtaggaggtgggagtgcgtttcg

SEQ ID NO: 1492 - DNA, 27 bp, Artificial Sequences
  Synthetic
gaggtaggaggtgggagtgcgtttcgt

SEQ ID NO: 1493 - DNA, 27 bp, Artificial Sequences
  Synthetic
gtttcggggaggtaggaggtgggagtg

SEQ ID NO: 1494 - DNA, 32 bp, Artificial Sequences
  Synthetic
ttttggttggagtttttgtcggttattgtcga

SEQ ID NO: 1495 - DNA, 33 bp, Artificial Sequences
  Synthetic
tttttggttggagtttttgtcggttattgtcga

SEQ ID NO: 1496 - DNA, 34 bp, Artificial Sequences
  Synthetic
ttttttggttggagtttttgtcggttattgtcga

SEQ ID NO: 1497 - DNA, 28 bp, Artificial Sequences
  Synthetic
aacgttaagggtggtaggatagggagga

SEQ ID NO: 1498 - DNA, 28 bp, Artificial Sequences
  Synthetic
acgttaagggtggtaggatagggaggat

SEQ ID NO: 1499 - DNA, 29 bp, Artificial Sequences
  Synthetic
aaacgttaagggtggtaggatagggagga

SEQ ID NO: 1500 - DNA, 29 bp, Artificial Sequences
  Synthetic
acgttaagggtggtaggatagggaggatt

SEQ ID NO: 1501 - DNA, 29 bp, Artificial Sequences
  Synthetic
aacgttaagggtggtaggatagggaggat

SEQ ID NO: 1502 - DNA, 28 bp, Artificial Sequences
  Synthetic
cgtggagaggttgtgtagggagtgaggg

SEQ ID NO: 1503 - DNA, 27 bp, Artificial Sequences
  Synthetic
aggttgtgtagggagtgagggaggtgt

SEQ ID NO: 1504 - DNA, 27 bp, Artificial Sequences
  Synthetic
agaggttgtgtagggagtgagggaggt

SEQ ID NO: 1505 - DNA, 28 bp, Artificial Sequences
  Synthetic
acgtggagaggttgtgtagggagtgagg

SEQ ID NO: 1506 - DNA, 27 bp, Artificial Sequences
  Synthetic
tggagaggttgtgtagggagtgaggga

SEQ ID NO: 1507 - DNA, 27 bp, Artificial Sequences
  Synthetic
tggtttggttttttcgggggcggattt

SEQ ID NO: 1508 - DNA, 27 bp, Artificial Sequences
  Synthetic
atggtttggttttttcgggggcggatt

SEQ ID NO: 1509 - DNA, 27 bp, Artificial Sequences
  Synthetic
tgtgggtgttttgtagggggagaggtt

SEQ ID NO: 1510 - DNA, 27 bp, Artificial Sequences
  Synthetic
ttgtgggtgttttgtagggggagaggt

SEQ ID NO: 1511 - DNA, 27 bp, Artificial Sequences
  Synthetic
tatggtttggttttttcgggggcggat

SEQ ID NO: 1512 - DNA, 27 bp, Artificial Sequences
  Synthetic
gtgggagggggagggggattttcgtac

SEQ ID NO: 1513 - DNA, 27 bp, Artificial Sequences
  Synthetic
ggagggggagggggattttcgtacgag

SEQ ID NO: 1514 - DNA, 27 bp, Artificial Sequences
  Synthetic
gggagggggagggggattttcgtacga

SEQ ID NO: 1515 - DNA, 27 bp, Artificial Sequences
  Synthetic
ggtgggagggggagggggattttcgta

SEQ ID NO: 1516 - DNA, 27 bp, Artificial Sequences
  Synthetic
aggcggagagtttggaagcggagagta

SEQ ID NO: 1517 - DNA, 36 bp, Artificial Sequences
  Synthetic
cgtttagggttatcgggttgtaagttatgaattcgt

SEQ ID NO: 1518 - DNA, 36 bp, Artificial Sequences
  Synthetic
tcgtttagggttatcgggttgtaagttatgaattcg

SEQ ID NO: 1519 - DNA, 27 bp, Artificial Sequences
  Synthetic
aggcggagagtttggaagcggagagta

SEQ ID NO: 1520 - DNA, 27 bp, Artificial Sequences
  Synthetic
taggcggagagtttggaagcggagagt

SEQ ID NO: 1521 - DNA, 27 bp, Artificial Sequences
  Synthetic
agtaggcggagagtttggaagcggaga

SEQ ID NO: 1522 - DNA, 28 bp, Artificial Sequences
  Synthetic
gtaggcggagagtttggaagcggagagt

SEQ ID NO: 1523 - DNA, 27 bp, Artificial Sequences
  Synthetic
gtaggcggagagtttggaagcggagag

SEQ ID NO: 1524 - DNA, 28 bp, Artificial Sequences
  Synthetic
gcggagagtaatttgtttcgggaggcgt

SEQ ID NO: 1525 - DNA, 27 bp, Artificial Sequences
  Synthetic
gcggagagtaatttgtttcgggaggcg

SEQ ID NO: 1526 - DNA, 28 bp, Artificial Sequences
  Synthetic
agcggagagtaatttgtttcgggaggcg

SEQ ID NO: 1527 - DNA, 29 bp, Artificial Sequences
  Synthetic
agcggagagtaatttgtttcgggaggcgt

SEQ ID NO: 1528 - DNA, 29 bp, Artificial Sequences
  Synthetic
gcggagagtaatttgtttcgggaggcgtt

SEQ ID NO: 1529 - DNA, 28 bp, Artificial Sequences
  Synthetic
tggagatttcggcgttgtgtatgttcgg

SEQ ID NO: 1530 - DNA, 27 bp, Artificial Sequences
  Synthetic
ggagatttcggcgttgtgtatgttcgg

SEQ ID NO: 1531 - DNA, 29 bp, Artificial Sequences
  Synthetic
tggagatttcggcgttgtgtatgttcgga

SEQ ID NO: 1532 - DNA, 28 bp, Artificial Sequences
  Synthetic
ggagatttcggcgttgtgtatgttcgga

SEQ ID NO: 1533 - DNA, 29 bp, Artificial Sequences
  Synthetic
cggggtagtcggttatgtgtttgagtcgt

SEQ ID NO: 1534 - DNA, 29 bp, Artificial Sequences
  Synthetic
agcgttggaaaatgttgaaggatagcgag

SEQ ID NO: 1535 - DNA, 29 bp, Artificial Sequences
  Synthetic
gcgttggaaaatgttgaaggatagcgaga

SEQ ID NO: 1536 - DNA, 30 bp, Artificial Sequences
  Synthetic
ggttgggtaagcgttggaaaatgttgaagg

SEQ ID NO: 1537 - DNA, 30 bp, Artificial Sequences
  Synthetic
agcgttggaaaatgttgaaggatagcgaga

SEQ ID NO: 1538 - DNA, 31 bp, Artificial Sequences
  Synthetic
ggttgggtaagcgttggaaaatgttgaagga

SEQ ID NO: 1539 - DNA, 27 bp, Artificial Sequences
  Synthetic
tttggttggcgttgggtttggtcgagg

SEQ ID NO: 1540 - DNA, 27 bp, Artificial Sequences
  Synthetic
tgggttttggttggcgttgggtttggt

SEQ ID NO: 1541 - DNA, 27 bp, Artificial Sequences
  Synthetic
tggcgttgggtttggtcgaggggttta

SEQ ID NO: 1542 - DNA, 27 bp, Artificial Sequences
  Synthetic
ggttttggttggcgttgggtttggtcg

SEQ ID NO: 1543 - DNA, 27 bp, Artificial Sequences
  Synthetic
gggttttggttggcgttgggtttggtc

SEQ ID NO: 1544 - DNA, 28 bp, Artificial Sequences
  Synthetic
tggggttgttttgaggaggagagtaggg

SEQ ID NO: 1545 - DNA, 27 bp, Artificial Sequences
  Synthetic
aggtggtattagggcggtttgttggat

SEQ ID NO: 1546 - DNA, 27 bp, Artificial Sequences
  Synthetic
ggggttgttttgaggaggagagtaggg

SEQ ID NO: 1547 - DNA, 29 bp, Artificial Sequences
  Synthetic
tggggttgttttgaggaggagagtaggga

SEQ ID NO: 1548 - DNA, 28 bp, Artificial Sequences
  Synthetic
ggggttgttttgaggaggagagtaggga

SEQ ID NO: 1549 - DNA, 27 bp, Artificial Sequences
  Synthetic
agttatggtggggtgggggtggaagtt

SEQ ID NO: 1550 - DNA, 27 bp, Artificial Sequences
  Synthetic
tagttatggtggggtgggggtggaagt

SEQ ID NO: 1551 - DNA, 27 bp, Artificial Sequences
  Synthetic
gttatggtggggtgggggtggaagttt

SEQ ID NO: 1552 - DNA, 27 bp, Artificial Sequences
  Synthetic
tatggtggggtgggggtggaagttttg

SEQ ID NO: 1553 - DNA, 28 bp, Artificial Sequences
  Synthetic
agttatggtggggtgggggtggaagttt

SEQ ID NO: 1554 - DNA, 29 bp, Artificial Sequences
  Synthetic
cggggagttcggagttttgtaggtacggg

SEQ ID NO: 1555 - DNA, 29 bp, Artificial Sequences
  Synthetic
ggggagttcggagttttgtaggtacgggg

SEQ ID NO: 1556 - DNA, 27 bp, Artificial Sequences
  Synthetic
tcggagttttgtaggtacggggttggt

SEQ ID NO: 1557 - DNA, 28 bp, Artificial Sequences
  Synthetic
cggggagttcggagttttgtaggtacgg

SEQ ID NO: 1558 - DNA, 29 bp, Artificial Sequences
  Synthetic
gggagttcggagttttgtaggtacggggt

SEQ ID NO: 1559 - DNA, 27 bp, Artificial Sequences
  Synthetic
taggtggcgaggtgaggaaggagaggg

SEQ ID NO: 1560 - DNA, 27 bp, Artificial Sequences
  Synthetic
gatgcgtaggtggcgaggtgaggaagg

SEQ ID NO: 1561 - DNA, 27 bp, Artificial Sequences
  Synthetic
cgtaggtggcgaggtgaggaaggagag

SEQ ID NO: 1562 - DNA, 27 bp, Artificial Sequences
  Synthetic
cgatgcgtaggtggcgaggtgaggaag

SEQ ID NO: 1563 - DNA, 27 bp, Artificial Sequences
  Synthetic
gtaggtggcgaggtgaggaaggagagg

SEQ ID NO: 1564 - DNA, 27 bp, Artificial Sequences
  Synthetic
cgttggttggtggtggagttgcgttga

SEQ ID NO: 1565 - DNA, 27 bp, Artificial Sequences
  Synthetic
taagcgttggttggtggtggagttgcg

SEQ ID NO: 1566 - DNA, 27 bp, Artificial Sequences
  Synthetic
cggttaagcgttggttggtggtggagt

SEQ ID NO: 1567 - DNA, 27 bp, Artificial Sequences
  Synthetic
acggttaagcgttggttggtggtggag

SEQ ID NO: 1568 - DNA, 27 bp, Artificial Sequences
  Synthetic
gcgttggttggtggtggagttgcgttg

SEQ ID NO: 1569 - DNA, 27 bp, Artificial Sequences
  Synthetic
tgatagtcgggcgtgtagtggggggta

SEQ ID NO: 1570 - DNA, 27 bp, Artificial Sequences
  Synthetic
tcgggcgtgtagtggggggtagatagt

SEQ ID NO: 1571 - DNA, 27 bp, Artificial Sequences
  Synthetic
agtcgggcgtgtagtggggggtagata

SEQ ID NO: 1572 - DNA, 27 bp, Artificial Sequences
  Synthetic
tagtcgggcgtgtagtggggggtagat

SEQ ID NO: 1573 - DNA, 27 bp, Artificial Sequences
  Synthetic
atagtcgggcgtgtagtggggggtaga

SEQ ID NO: 1574 - DNA, 27 bp, Artificial Sequences
  Synthetic
gcgtggttttgagcgtggaggttaggg

SEQ ID NO: 1575 - DNA, 27 bp, Artificial Sequences
  Synthetic
gggttggttagtagggggtagcgtggt

SEQ ID NO: 1576 - DNA, 27 bp, Artificial Sequences
  Synthetic
agggttggttagtagggggtagcgtgg

SEQ ID NO: 1577 - DNA, 27 bp, Artificial Sequences
  Synthetic
cgtggaggttagggttggttcgcgtcg

SEQ ID NO: 1578 - DNA, 27 bp, Artificial Sequences
  Synthetic
cgtggttttgagcgtggaggttagggt

SEQ ID NO: 1579 - DNA, 27 bp, Artificial Sequences
  Synthetic
tattggaggttggttttgtcggcgcgg

SEQ ID NO: 1580 - DNA, 27 bp, Artificial Sequences
  Synthetic
ggaggttggttttgtcggcgcggatta

SEQ ID NO: 1581 - DNA, 27 bp, Artificial Sequences
  Synthetic
aggttggttttgtcggcgcggattagt

SEQ ID NO: 1582 - DNA, 28 bp, Artificial Sequences
  Synthetic
ggaggttggttttgtcggcgcggattag

SEQ ID NO: 1583 - DNA, 27 bp, Artificial Sequences
  Synthetic
gtattggaggttggttttgtcggcgcg

SEQ ID NO: 1584 - DNA, 27 bp, Artificial Sequences
  Synthetic
ggaggtggggatggggtggtgaaagtt

SEQ ID NO: 1585 - DNA, 27 bp, Artificial Sequences
  Synthetic
gaggaggtggggatggggtggtgaaag

SEQ ID NO: 1586 - DNA, 27 bp, Artificial Sequences
  Synthetic
gggttggttcgcgtcggtagggttagt

SEQ ID NO: 1587 - DNA, 27 bp, Artificial Sequences
  Synthetic
agggttggttcgcgtcggtagggttag

SEQ ID NO: 1588 - DNA, 27 bp, Artificial Sequences
  Synthetic
aggttagggttggttcgcgtcggtagg

SEQ ID NO: 1589 - DNA, 28 bp, Artificial Sequences
  Synthetic
tgttggttgagaaagcggtaggggatgt

SEQ ID NO: 1590 - DNA, 27 bp, Artificial Sequences
  Synthetic
gttggttgagaaagcggtaggggatgt

SEQ ID NO: 1591 - DNA, 27 bp, Artificial Sequences
  Synthetic
tgttggttgagaaagcggtaggggatg

SEQ ID NO: 1592 - DNA, 30 bp, Artificial Sequences
  Synthetic
cgggttttgttggttgagaaagcggtaggg

SEQ ID NO: 1593 - DNA, 27 bp, Artificial Sequences
  Synthetic
tttgttggttgagaaagcggtagggga

SEQ ID NO: 1594 - DNA, 29 bp, Artificial Sequences
  Synthetic
cgagtttgcgtttgggggagtttagtagt

SEQ ID NO: 1595 - DNA, 28 bp, Artificial Sequences
  Synthetic
cgagtttgcgtttgggggagtttagtag

SEQ ID NO: 1596 - DNA, 29 bp, Artificial Sequences
  Synthetic
tgagaacgggagcgaattttacgagtttg

SEQ ID NO: 1597 - DNA, 30 bp, Artificial Sequences
  Synthetic
tggtttattcggggttaattgagcgtgagt

SEQ ID NO: 1598 - DNA, 30 bp, Artificial Sequences
  Synthetic
agtggtttattcggggttaattgagcgtga

SEQ ID NO: 1599 - DNA, 29 bp, Artificial Sequences
  Synthetic
cgggggttcggacgtttgttattattcgt

SEQ ID NO: 1600 - DNA, 28 bp, Artificial Sequences
  Synthetic
cgggggttcggacgtttgttattattcg

SEQ ID NO: 1601 - DNA, 30 bp, Artificial Sequences
  Synthetic
cgggggttcggacgtttgttattattcgtt

SEQ ID NO: 1602 - DNA, 32 bp, Artificial Sequences
  Synthetic
cgggggttcggacgtttgttattattcgttgg

SEQ ID NO: 1603 - DNA, 31 bp, Artificial Sequences
  Synthetic
cgggggttcggacgtttgttattattcgttg

SEQ ID NO: 1604 - DNA, 28 bp, Artificial Sequences
  Synthetic
cgagtggtgataggcgttcggattttcg

SEQ ID NO: 1605 - DNA, 29 bp, Artificial Sequences
  Synthetic
cgagtggtgataggcgttcggattttcgt

SEQ ID NO: 1606 - DNA, 29 bp, Artificial Sequences
  Synthetic
acgagtggtgataggcgttcggattttcg

SEQ ID NO: 1607 - DNA, 30 bp, Artificial Sequences
  Synthetic
acgagtggtgataggcgttcggattttcgt

SEQ ID NO: 1608 - DNA, 27 bp, Artificial Sequences
  Synthetic
aggcgttcggattttcgtgaagaggat

SEQ ID NO: 1609 - DNA, 27 bp, Artificial Sequences
  Synthetic
gcgttggaggggattagtagcgatcgg

SEQ ID NO: 1610 - DNA, 28 bp, Artificial Sequences
  Synthetic
agcgttggaggggattagtagcgatcgg

SEQ ID NO: 1611 - DNA, 27 bp, Artificial Sequences
  Synthetic
agcgttggaggggattagtagcgatcg

SEQ ID NO: 1612 - DNA, 29 bp, Artificial Sequences
  Synthetic
aagcgttggaggggattagtagcgatcgg

SEQ ID NO: 1613 - DNA, 27 bp, Artificial Sequences
  Synthetic
agaagcgttggaggggattagtagcga

SEQ ID NO: 1614 - DNA, 35 bp, Artificial Sequences
  Synthetic
ggcggttattcggttgtatttaaatgttcgttgcg

SEQ ID NO: 1615 - DNA, 34 bp, Artificial Sequences
  Synthetic
gcggttattcggttgtatttaaatgttcgttgcg

SEQ ID NO: 1616 - DNA, 36 bp, Artificial Sequences
  Synthetic
ggcggttattcggttgtatttaaatgttcgttgcgt

SEQ ID NO: 1617 - DNA, 34 bp, Artificial Sequences
  Synthetic
ggcggttattcggttgtatttaaatgttcgttgc

SEQ ID NO: 1618 - DNA, 35 bp, Artificial Sequences
  Synthetic
gcggttattcggttgtatttaaatgttcgttgcgt

SEQ ID NO: 1619 - DNA, 27 bp, Artificial Sequences
  Synthetic
gcgttggaggggattagtagcgatcgg

SEQ ID NO: 1620 - DNA, 28 bp, Artificial Sequences
  Synthetic
agcgttggaggggattagtagcgatcgg

SEQ ID NO: 1621 - DNA, 27 bp, Artificial Sequences
  Synthetic
agcgttggaggggattagtagcgatcg

SEQ ID NO: 1622 - DNA, 29 bp, Artificial Sequences
  Synthetic
aagcgttggaggggattagtagcgatcgg

SEQ ID NO: 1623 - DNA, 27 bp, Artificial Sequences
  Synthetic
agaagcgttggaggggattagtagcga

SEQ ID NO: 1624 - DNA, 35 bp, Artificial Sequences; identical to SEQ ID NO: 1614
  Synthetic

SEQ ID NO: 1625 - DNA, 34 bp, Artificial Sequences; identical to SEQ ID NO: 1615
  Synthetic

SEQ ID NO: 1626 - DNA, 36 bp, Artificial Sequences; identical to SEQ ID NO: 1616
  Synthetic

SEQ ID NO: 1627 - DNA, 34 bp, Artificial Sequences; identical to SEQ ID NO: 1617
  Synthetic

SEQ ID NO: 1628 - DNA, 35 bp, Artificial Sequences; identical to SEQ ID NO: 1618
  Synthetic

SEQ ID NO: 1629 - DNA, 27 bp, Artificial Sequences
  Synthetic
tttagggaagagaagcgttggagggga

SEQ ID NO: 1630 - DNA, 27 bp, Artificial Sequences
  Synthetic
agggaagagaagcgttggaggggatta

SEQ ID NO: 1631 - DNA, 27 bp, Artificial Sequences
  Synthetic
tagggaagagaagcgttggaggggatt

SEQ ID NO: 1632 - DNA, 27 bp, Artificial Sequences
  Synthetic
ttagggaagagaagcgttggaggggat

SEQ ID NO: 1633 - DNA, 28 bp, Artificial Sequences
  Synthetic
gggaagagaagcgttggaggggattagt

SEQ ID NO: 1634 - DNA, 27 bp, Artificial Sequences
  Synthetic
gcggtagcgttgggtttcgagtgagat

SEQ ID NO: 1635 - DNA, 28 bp, Artificial Sequences
  Synthetic
gcggtagcgttgggtttcgagtgagatt

SEQ ID NO: 1636 - DNA, 26 bp, Artificial Sequences
  Synthetic
gcggtagcgttgggtttcgagtgaga

SEQ ID NO: 1637 - DNA, 27 bp, Artificial Sequences
  Synthetic
tgtggttttggggggttgcgtagtttt

SEQ ID NO: 1638 - DNA, 27 bp, Artificial Sequences
  Synthetic
atgtggttttggggggttgcgtagttt

SEQ ID NO: 1639 - DNA, 30 bp, Artificial Sequences
  Synthetic
gggcgtttgtttaggtagttaaagttgcgt

SEQ ID NO: 1640 - DNA, 30 bp, Artificial Sequences
  Synthetic
tgggcgtttgtttaggtagttaaagttgcg

SEQ ID NO: 1641 - DNA, 31 bp, Artificial Sequences
  Synthetic
tgggcgtttgtttaggtagttaaagttgcgt

SEQ ID NO: 1642 - DNA, 31 bp, Artificial Sequences
  Synthetic
ttgggcgtttgtttaggtagttaaagttgcg

SEQ ID NO: 1643 - DNA, 32 bp, Artificial Sequences
  Synthetic
ttgggcgtttgtttaggtagttaaagttgcgt

SEQ ID NO: 1644 - DNA, 27 bp, Artificial Sequences
  Synthetic
tttgggtagtgtgggaggcgttcggtt

SEQ ID NO: 1645 - DNA, 27 bp, Artificial Sequences
  Synthetic
ttttgggtagtgtgggaggcgttcggt

SEQ ID NO: 1646 - DNA, 27 bp, Artificial Sequences
  Synthetic
gagttaaggatggggggcggcgtgtat

SEQ ID NO: 1647 - DNA, 27 bp, Artificial Sequences
  Synthetic
aagacgtgggagttaaggatggggggc

SEQ ID NO: 1648 - DNA, 27 bp, Artificial Sequences
  Synthetic
taaggatggggggcggcgtgtatatcg

SEQ ID NO: 1649 - DNA, 27 bp, Artificial Sequences
  Synthetic
tttgtagcgggggtagaaggtgtgggc

SEQ ID NO: 1650 - DNA, 27 bp, Artificial Sequences
  Synthetic
gcgttggtttgcgaagggttggtttgt

SEQ ID NO: 1651 - DNA, 26 bp, Artificial Sequences
  Synthetic
ttgtagcgggggtagaaggtgtgggc

SEQ ID NO: 1652 - DNA, 27 bp, Artificial Sequences
  Synthetic
gtttgtagcgggggtagaaggtgtggg

SEQ ID NO: 1653 - DNA, 27 bp, Artificial Sequences
  Synthetic
ggtttgtagcgggggtagaaggtgtgg

SEQ ID NO: 1654 - DNA, 28 bp, Artificial Sequences
  Synthetic
ggttgcgggcgaggattttagagagagg

SEQ ID NO: 1655 - DNA, 29 bp, Artificial Sequences
  Synthetic
ggttgcgggcgaggattttagagagaggt

SEQ ID NO: 1656 - DNA, 27 bp, Artificial Sequences
  Synthetic
tgcgggcgaggattttagagagaggtt

SEQ ID NO: 1657 - DNA, 27 bp, Artificial Sequences
  Synthetic
ttgcgggcgaggattttagagagaggt

SEQ ID NO: 1658 - DNA, 27 bp, Artificial Sequences
  Synthetic
aggttgcgggcgaggattttagagaga

SEQ ID NO: 1659 - DNA, 27 bp, Artificial Sequences
  Synthetic
atagttcggcggttgttttgcgtcggg

SEQ ID NO: 1660 - DNA, 27 bp, Artificial Sequences
  Synthetic
gagtgtttacggggcgcgttggtttgt

SEQ ID NO: 1661 - DNA, 27 bp, Artificial Sequences
  Synthetic
agaagcggtgggaaggtggtagagacg

SEQ ID NO: 1662 - DNA, 27 bp, Artificial Sequences
  Synthetic
cgagtgtttacggggcgcgttggtttg

SEQ ID NO: 1663 - DNA, 27 bp, Artificial Sequences
  Synthetic
atcgagtgtttacggggcgcgttggtt

SEQ ID NO: 1664 - DNA, 27 bp, Artificial Sequences
  Synthetic
agaggggttcgaggtgggttggggata

SEQ ID NO: 1665 - DNA, 27 bp, Artificial Sequences
  Synthetic
tagaggggttcgaggtgggttggggat

SEQ ID NO: 1666 - DNA, 27 bp, Artificial Sequences
  Synthetic
ttagaggggttcgaggtgggttgggga

SEQ ID NO: 1667 - DNA, 27 bp, Artificial Sequences
  Synthetic
aggggttcgaggtgggttggggatagt

SEQ ID NO: 1668 - DNA, 27 bp, Artificial Sequences
  Synthetic
gaggggttcgaggtgggttggggatag

SEQ ID NO: 1669 - DNA, 27 bp, Artificial Sequences
  Synthetic
atagttcggcggttgttttgcgtcggg

SEQ ID NO: 1670 - DNA, 27 bp, Artificial Sequences
  Synthetic
tttcgaattttagcgcggcggaggtgg

SEQ ID NO: 1671 - DNA, 27 bp, Artificial Sequences
  Synthetic
gcggttgttttgcgtcggggtagggta

SEQ ID NO: 1672 - DNA, 28 bp, Artificial Sequences
  Synthetic
atttcgaattttagcgcggcggaggtgg

SEQ ID NO: 1673 - DNA, 27 bp, Artificial Sequences
  Synthetic
cggttgttttgcgtcggggtagggtat

SEQ ID NO: 1674 - DNA, 27 bp, Artificial Sequences
  Synthetic
aggtgaaggaagaaagggaagcggggc

SEQ ID NO: 1675 - DNA, 27 bp, Artificial Sequences
  Synthetic
gtgaaggaagaaagggaagcggggcgg

SEQ ID NO: 1676 - DNA, 27 bp, Artificial Sequences
  Synthetic
ggtgaaggaagaaagggaagcggggcg

SEQ ID NO: 1677 - DNA, 26 bp, Artificial Sequences
  Synthetic
gtgaaggaagaaagggaagcggggcg

SEQ ID NO: 1678 - DNA, 26 bp, Artificial Sequences
  Synthetic
ggtgaaggaagaaagggaagcggggc

SEQ ID NO: 1679 - DNA, 27 bp, Artificial Sequences
  Synthetic
agagaaagaggttttgcgggcgggagg

SEQ ID NO: 1680 - DNA, 27 bp, Artificial Sequences
  Synthetic
gagagaaagaggttttgcgggcgggag

SEQ ID NO: 1681 - DNA, 27 bp, Artificial Sequences
  Synthetic
cgagagaaagaggttttgcgggcggga

SEQ ID NO: 1682 - DNA, 26 bp, Artificial Sequences
  Synthetic
cgagagaaagaggttttgcgggcggg

SEQ ID NO: 1683 - DNA, 26 bp, Artificial Sequences
  Synthetic
gagaaagaggttttgcgggcgggagg

SEQ ID NO: 1684 - DNA, 27 bp, Artificial Sequences
  Synthetic
ggagtgaaggcggcgtttgtgtcgtag

SEQ ID NO: 1685 - DNA, 27 bp, Artificial Sequences
  Synthetic
gttttgggggagtgaaggcggcgtttg

SEQ ID NO: 1686 - DNA, 27 bp, Artificial Sequences
  Synthetic
agagcggatgaggttttgggggagtga

SEQ ID NO: 1687 - DNA, 27 bp, Artificial Sequences
  Synthetic
tgagagcggatgaggttttgggggagt

SEQ ID NO: 1688 - DNA, 27 bp, Artificial Sequences
  Synthetic
agtgaaggcggcgtttgtgtcgtagtc

SEQ ID NO: 1689 - DNA, 27 bp, Artificial Sequences
  Synthetic
aggaacgcggaggttagtttgtttggc

SEQ ID NO: 1690 - DNA, 28 bp, Artificial Sequences
  Synthetic
gaggaacgcggaggttagtttgtttggc

SEQ ID NO: 1691 - DNA, 29 bp, Artificial Sequences
  Synthetic
tgaggaacgcggaggttagtttgtttggc

SEQ ID NO: 1692 - DNA, 30 bp, Artificial Sequences
  Synthetic
gtgaggaacgcggaggttagtttgtttggc

SEQ ID NO: 1693 - DNA, 27 bp, Artificial Sequences
  Synthetic
tgtgaggaacgcggaggttagtttgtt

SEQ ID NO: 1694 - DNA, 27 bp, Artificial Sequences
  Synthetic
ggagtgaaggcggcgtttgtgtcgtag

SEQ ID NO: 1695 - DNA, 27 bp, Artificial Sequences
  Synthetic
gttttgggggagtgaaggcggcgtttg

SEQ ID NO: 1696 - DNA, 27 bp, Artificial Sequences
  Synthetic
agagcggatgaggttttgggggagtga

SEQ ID NO: 1697 - DNA, 27 bp, Artificial Sequences
  Synthetic
tgagagcggatgaggttttgggggagt

SEQ ID NO: 1698 - DNA, 27 bp, Artificial Sequences
  Synthetic
agtgaaggcggcgtttgtgtcgtagtc

SEQ ID NO: 1699 - DNA, 27 bp, Artificial Sequences
  Synthetic
aggaacgcggaggttagtttgtttggc

SEQ ID NO: 1700 - DNA, 28 bp, Artificial Sequences
  Synthetic
gaggaacgcggaggttagtttgtttggc

SEQ ID NO: 1701 - DNA, 29 bp, Artificial Sequences
  Synthetic
tgaggaacgcggaggttagtttgtttggc

SEQ ID NO: 1702 - DNA, 30 bp, Artificial Sequences; identical to SEQ ID NO: 1692
  Synthetic

SEQ ID NO: 1703 - DNA, 27 bp, Artificial Sequences
  Synthetic
tgtgaggaacgcggaggttagtttgtt

SEQ ID NO: 1704 - DNA, 27 bp, Artificial Sequences
  Synthetic
ggagtgaaggcggcgtttgtgtcgtag

SEQ ID NO: 1705 - DNA, 27 bp, Artificial Sequences
  Synthetic
gttttgggggagtgaaggcggcgtttg

SEQ ID NO: 1706 - DNA, 27 bp, Artificial Sequences
  Synthetic
agtgaaggcggcgtttgtgtcgtagtc

SEQ ID NO: 1707 - DNA, 27 bp, Artificial Sequences
  Synthetic
gagtgaaggcggcgtttgtgtcgtagt

SEQ ID NO: 1708 - DNA, 27 bp, Artificial Sequences
  Synthetic
gggagtgaaggcggcgtttgtgtcgta

SEQ ID NO: 1709 - DNA, 27 bp, Artificial Sequences
  Synthetic
tgcgggcgtttagtgtagcgtattgtt

SEQ ID NO: 1710 - DNA, 27 bp, Artificial Sequences
  Synthetic
ttgcgggcgtttagtgtagcgtattgt

SEQ ID NO: 1711 - DNA, 28 bp, Artificial Sequences
  Synthetic
tgcgggcgtttagtgtagcgtattgttt

SEQ ID NO: 1712 - DNA, 28 bp, Artificial Sequences
  Synthetic
ttgcgggcgtttagtgtagcgtattgtt

SEQ ID NO: 1713 - DNA, 27 bp, Artificial Sequences
  Synthetic
gcgggcgtttagtgtagcgtattgttt

SEQ ID NO: 1714 - DNA, 27 bp, Artificial Sequences
  Synthetic
ggacgtcgggagtagggtagtgcgttg

SEQ ID NO: 1715 - DNA, 27 bp, Artificial Sequences
  Synthetic
tttggacgtcgggagtagggtagtgcg

SEQ ID NO: 1716 - DNA, 27 bp, Artificial Sequences
  Synthetic
gacgtcgggagtagggtagtgcgttgt

SEQ ID NO: 1717 - DNA, 27 bp, Artificial Sequences
  Synthetic
tggacgtcgggagtagggtagtgcgtt

SEQ ID NO: 1718 - DNA, 27 bp, Artificial Sequences
  Synthetic
ttggacgtcgggagtagggtagtgcgt

SEQ ID NO: 1719 - DNA, 27 bp, Artificial Sequences
  Synthetic
ggtgttcgcggggattttcgttcggta

SEQ ID NO: 1720 - DNA, 26 bp, Artificial Sequences
  Synthetic
ggtgttcgcggggattttcgttcggt

SEQ ID NO: 1721 - DNA, 28 bp, Artificial Sequences
  Synthetic
ggtgttcgcggggattttcgttcggtag

SEQ ID NO: 1722 - DNA, 27 bp, Artificial Sequences
  Synthetic
tgttcgcggggattttcgttcggtagt

SEQ ID NO: 1723 - DNA, 27 bp, Artificial Sequences
  Synthetic
cggtgttcgcggggattttcgttcggt

SEQ ID NO: 1724 - DNA, 27 bp, Artificial Sequences
  Synthetic
ggagaggggttgtcgggcgaggatttt

SEQ ID NO: 1725 - DNA, 27 bp, Artificial Sequences
  Synthetic
gggtagtgcgttgtattgggcgttcgt

SEQ ID NO: 1726 - DNA, 27 bp, Artificial Sequences
  Synthetic
agggtagtgcgttgtattgggcgttcg

SEQ ID NO: 1727 - DNA, 27 bp, Artificial Sequences
  Synthetic
gagaggggttgtcgggcgaggattttc

SEQ ID NO: 1728 - DNA, 26 bp, Artificial Sequences
  Synthetic
ggagaggggttgtcgggcgaggattt

SEQ ID NO: 1729 - DNA, 28 bp, Artificial Sequences
  Synthetic
gcggttattcgtttgttagttcgcgtcg

SEQ ID NO: 1730 - DNA, 29 bp, Artificial Sequences
  Synthetic
gcggttattcgtttgttagttcgcgtcgt

SEQ ID NO: 1731 - DNA, 27 bp, Artificial Sequences
  Synthetic
tcgtttgttagttcgcgtcgtttggtt

SEQ ID NO: 1732 - DNA, 27 bp, Artificial Sequences
  Synthetic
ttcgtttgttagttcgcgtcgtttggt

SEQ ID NO: 1733 - DNA, 28 bp, Artificial Sequences
  Synthetic
cgcgtcgtttggtttttgtaggagttgt

SEQ ID NO: 1734 - DNA, 27 bp, Artificial Sequences
  Synthetic
ggagaggggttgtcgggcgaggatttt

SEQ ID NO: 1735 - DNA, 27 bp, Artificial Sequences
  Synthetic
gagaggggttgtcgggcgaggattttc

SEQ ID NO: 1736 - DNA, 26 bp, Artificial Sequences
  Synthetic
ggagaggggttgtcgggcgaggattt

SEQ ID NO: 1737 - DNA, 28 bp, Artificial Sequences
  Synthetic
ggagaggggttgtcgggcgaggattttc

SEQ ID NO: 1738 - DNA, 27 bp, Artificial Sequences
  Synthetic
gaagagggagaggggttgtcgggcgag

SEQ ID NO: 1739 - DNA, 27 bp, Artificial Sequences
  Synthetic
tggggtattggttttgtacgtcgcgaa

SEQ ID NO: 1740 - DNA, 27 bp, Artificial Sequences
  Synthetic
ttggggtattggttttgtacgtcgcga

SEQ ID NO: 1741 - DNA, 29 bp, Artificial Sequences
  Synthetic
tggggtattggttttgtacgtcgcgaagt

SEQ ID NO: 1742 - DNA, 28 bp, Artificial Sequences
  Synthetic
ggggtattggttttgtacgtcgcgaagt

SEQ ID NO: 1743 - DNA, 28 bp, Artificial Sequences
  Synthetic
tggggtattggttttgtacgtcgcgaag

SEQ ID NO: 1744 - DNA, 27 bp, Artificial Sequences
  Synthetic
ggagaggggttgtcgggcgaggatttt

SEQ ID NO: 1745 - DNA, 27 bp, Artificial Sequences
  Synthetic
taggaattaggcggcgcgggttggtag

SEQ ID NO: 1746 - DNA, 27 bp, Artificial Sequences
  Synthetic
tttgtaggaattaggcggcgcgggttg

SEQ ID NO: 1747 - DNA, 27 bp, Artificial Sequences
  Synthetic
gtaggaattaggcggcgcgggttggta

SEQ ID NO: 1748 - DNA, 27 bp, Artificial Sequences
  Synthetic
ttttgtaggaattaggcggcgcgggtt

SEQ ID NO: 1749 - DNA, 27 bp, Artificial Sequences
  Synthetic
tggggtattggttttgtacgtcgcgaa

SEQ ID NO: 1750 - DNA, 27 bp, Artificial Sequences
  Synthetic
ttggggtattggttttgtacgtcgcga

SEQ ID NO: 1751 - DNA, 27 bp, Artificial Sequences
  Synthetic
cgaggaatacggcgcgatgtaggttta

SEQ ID NO: 1752 - DNA, 29 bp, Artificial Sequences
  Synthetic
tggggtattggttttgtacgtcgcgaagt

SEQ ID NO: 1753 - DNA, 28 bp, Artificial Sequences
  Synthetic
ggggtattggttttgtacgtcgcgaagt

SEQ ID NO: 1754 - DNA, 27 bp, Artificial Sequences
  Synthetic
taggaattaggcggcgcgggttggtag

SEQ ID NO: 1755 - DNA, 27 bp, Artificial Sequences
  Synthetic
tttgtaggaattaggcggcgcgggttg

SEQ ID NO: 1756 - DNA, 27 bp, Artificial Sequences
  Synthetic
gtaggaattaggcggcgcgggttggta

SEQ ID NO: 1757 - DNA, 27 bp, Artificial Sequences
  Synthetic
ttttgtaggaattaggcggcgcgggtt

SEQ ID NO: 1758 - DNA, 27 bp, Artificial Sequences
  Synthetic
tttttgtaggaattaggcggcgcgggt

SEQ ID NO: 1759 - DNA, 27 bp, Artificial Sequences
  Synthetic
cgaggaatacggcgcgatgtaggttta

SEQ ID NO: 1760 - DNA, 27 bp, Artificial Sequences
  Synthetic
acggcgcgatgtaggtttagtgttagt

SEQ ID NO: 1761 - DNA, 28 bp, Artificial Sequences
  Synthetic
cgaggaatacggcgcgatgtaggtttag

SEQ ID NO: 1762 - DNA, 29 bp, Artificial Sequences
  Synthetic
cgaggaatacggcgcgatgtaggtttagt

SEQ ID NO: 1763 - DNA, 26 bp, Artificial Sequences
  Synthetic
cgaggaatacggcgcgatgtaggttt

SEQ ID NO: 1764 - DNA, 27 bp, Artificial Sequences
  Synthetic
gcggtggatagggtgttttggttggcg

SEQ ID NO: 1765 - DNA, 27 bp, Artificial Sequences
  Synthetic
cgcggtggatagggtgttttggttggc

SEQ ID NO: 1766 - DNA, 27 bp, Artificial Sequences
  Synthetic
gcgcggtggatagggtgttttggttgg

SEQ ID NO: 1767 - DNA, 27 bp, Artificial Sequences
  Synthetic
agcgcggtggatagggtgttttggttg

SEQ ID NO: 1768 - DNA, 27 bp, Artificial Sequences
  Synthetic
cggtggatagggtgttttggttggcgt

SEQ ID NO: 1769 - DNA, 27 bp, Artificial Sequences
  Synthetic
gcgcgcggttggatttggagaacgtat

SEQ ID NO: 1770 - DNA, 27 bp, Artificial Sequences
  Synthetic
cggaaaagaaggcggtcggggattcgt

SEQ ID NO: 1771 - DNA, 27 bp, Artificial Sequences
  Synthetic
ttgcggaaaagaaggcggtcggggatt

SEQ ID NO: 1772 - DNA, 27 bp, Artificial Sequences
  Synthetic
tttgcggaaaagaaggcggtcggggat

SEQ ID NO: 1773 - DNA, 27 bp, Artificial Sequences
  Synthetic
ttttgcggaaaagaaggcggtcgggga

SEQ ID NO: 1774 - DNA, 27 bp, Artificial Sequences
  Synthetic
tgttgaagttgcggttgagttgttcga

SEQ ID NO: 1775 - DNA, 28 bp, Artificial Sequences
  Synthetic
tgttgaagttgcggttgagttgttcgaa

SEQ ID NO: 1776 - DNA, 28 bp, Artificial Sequences
  Synthetic
ttgttgaagttgcggttgagttgttcga

SEQ ID NO: 1777 - DNA, 28 bp, Artificial Sequences
  Synthetic
gttgttgaagttgcggttgagttgttcg

SEQ ID NO: 1778 - DNA, 29 bp, Artificial Sequences
  Synthetic
agttgttgaagttgcggttgagttgttcg

SEQ ID NO: 1779 - DNA, 27 bp, Artificial Sequences
  Synthetic
gcgggtagtttggtggacgtgatgttt

SEQ ID NO: 1780 - DNA, 26 bp, Artificial Sequences
  Synthetic
gtacggtgggcgcgggtagtttggtg

SEQ ID NO: 1781 - DNA, 27 bp, Artificial Sequences
  Synthetic
gtacggtgggcgcgggtagtttggtgg

SEQ ID NO: 1782 - DNA, 25 bp, Artificial Sequences
  Synthetic
tacggtgggcgcgggtagtttggtg

SEQ ID NO: 1783 - DNA, 25 bp, Artificial Sequences
  Synthetic
gtacggtgggcgcgggtagtttggt

SEQ ID NO: 1784 - DNA, 27 bp, Artificial Sequences
  Synthetic
cggtgcgtatcgggttggggaagtatt

SEQ ID NO: 1785 - DNA, 28 bp, Artificial Sequences
  Synthetic
cggtgcgtatcgggttggggaagtattg

SEQ ID NO: 1786 - DNA, 29 bp, Artificial Sequences
  Synthetic
cggtgcgtatcgggttggggaagtattgt

SEQ ID NO: 1787 - DNA, 28 bp, Artificial Sequences
  Synthetic
ggtgcgtatcgggttggggaagtattgt

SEQ ID NO: 1788 - DNA, 27 bp, Artificial Sequences
  Synthetic
ggtgcgtatcgggttggggaagtattg

SEQ ID NO: 1789 - DNA, 24 bp, Artificial Sequences
  Synthetic
gcgagttggtggcgttgttggtgc

SEQ ID NO: 1790 - DNA, 25 bp, Artificial Sequences
  Synthetic
gcgagttggtggcgttgttggtgcg

SEQ ID NO: 1791 - DNA, 24 bp, Artificial Sequences
  Synthetic
cgagttggtggcgttgttggtgcg

SEQ ID NO: 1792 - DNA, 28 bp, Artificial Sequences
  Synthetic
cgttatgagtgtcgtgtgtttcggttgt

SEQ ID NO: 1793 - DNA, 29 bp, Artificial Sequences
  Synthetic
cgttatgagtgtcgtgtgtttcggttgtc

SEQ ID NO: 1794 - DNA, 27 bp, Artificial Sequences
  Synthetic
ggggtcgtcgtggttgtagcggtagtc

SEQ ID NO: 1795 - DNA, 26 bp, Artificial Sequences
  Synthetic
ggggtcgtcgtggttgtagcggtagt

SEQ ID NO: 1796 - DNA, 27 bp, Artificial Sequences
  Synthetic
cggggtcgtcgtggttgtagcggtagt

SEQ ID NO: 1797 - DNA, 26 bp, Artificial Sequences
  Synthetic
cggggtcgtcgtggttgtagcggtag

SEQ ID NO: 1798 - DNA, 26 bp, Artificial Sequences
  Synthetic
gggtcgtcgtggttgtagcggtagtc

SEQ ID NO: 1799 - DNA, 27 bp, Artificial Sequences
  Synthetic
ttcgagggttacgtgttgagcgaggcg

SEQ ID NO: 1800 - DNA, 27 bp, Artificial Sequences
  Synthetic
tttcgagggttacgtgttgagcgaggc

SEQ ID NO: 1801 - DNA, 26 bp, Artificial Sequences
  Synthetic
tcgagggttacgtgttgagcgaggcg

SEQ ID NO: 1802 - DNA, 28 bp, Artificial Sequences
  Synthetic
tttcgagggttacgtgttgagcgaggcg

SEQ ID NO: 1803 - DNA, 28 bp, Artificial Sequences
  Synthetic
ttttcgagggttacgtgttgagcgaggc

SEQ ID NO: 1804 - DNA, 27 bp, Artificial Sequences
  Synthetic
ggggtcgtcgtggttgtagcggtagtc

SEQ ID NO: 1805 - DNA, 26 bp, Artificial Sequences
  Synthetic
ggggtcgtcgtggttgtagcggtagt

SEQ ID NO: 1806 - DNA, 27 bp, Artificial Sequences
  Synthetic
cggggtcgtcgtggttgtagcggtagt

SEQ ID NO: 1807 - DNA, 26 bp, Artificial Sequences
  Synthetic
cggggtcgtcgtggttgtagcggtag

SEQ ID NO: 1808 - DNA, 26 bp, Artificial Sequences
  Synthetic
gggtcgtcgtggttgtagcggtagtc

SEQ ID NO: 1809 - DNA, 27 bp, Artificial Sequences
  Synthetic
ttcgagggttacgtgttgagcgaggcg

SEQ ID NO: 1810 - DNA, 27 bp, Artificial Sequences
  Synthetic
tttcgagggttacgtgttgagcgaggc

SEQ ID NO: 1811 - DNA, 26 bp, Artificial Sequences
  Synthetic
tcgagggttacgtgttgagcgaggcg

SEQ ID NO: 1812 - DNA, 28 bp, Artificial Sequences
  Synthetic
tttcgagggttacgtgttgagcgaggcg

SEQ ID NO: 1813 - DNA, 28 bp, Artificial Sequences
  Synthetic
ttttcgagggttacgtgttgagcgaggc

SEQ ID NO: 1814 - DNA, 27 bp, Artificial Sequences
  Synthetic
ggggtcgtcgtggttgtagcggtagtc

SEQ ID NO: 1815 - DNA, 26 bp, Artificial Sequences
  Synthetic
ggggtcgtcgtggttgtagcggtagt

SEQ ID NO: 1816 - DNA, 27 bp, Artificial Sequences
  Synthetic
cggggtcgtcgtggttgtagcggtagt

SEQ ID NO: 1817 - DNA, 26 bp, Artificial Sequences
  Synthetic
cggggtcgtcgtggttgtagcggtag

SEQ ID NO: 1818 - DNA, 26 bp, Artificial Sequences
  Synthetic
gggtcgtcgtggttgtagcggtagtc

SEQ ID NO: 1819 - DNA, 27 bp, Artificial Sequences
  Synthetic
ttcgagggttacgtgttgagcgaggcg

SEQ ID NO: 1820 - DNA, 27 bp, Artificial Sequences
  Synthetic
tttcgagggttacgtgttgagcgaggc

SEQ ID NO: 1821 - DNA, 26 bp, Artificial Sequences
  Synthetic
tcgagggttacgtgttgagcgaggcg

SEQ ID NO: 1822 - DNA, 28 bp, Artificial Sequences
  Synthetic
tttcgagggttacgtgttgagcgaggcg

SEQ ID NO: 1823 - DNA, 28 bp, Artificial Sequences
  Synthetic
ttttcgagggttacgtgttgagcgaggc

SEQ ID NO: 1824 - DNA, 27 bp, Artificial Sequences
  Synthetic
gcggtcgtttgggcgtgattttttggt

SEQ ID NO: 1825 - DNA, 27 bp, Artificial Sequences
  Synthetic
ggtgcggtcgtttgggcgtgatttttt

SEQ ID NO: 1826 - DNA, 27 bp, Artificial Sequences
  Synthetic
tgcggtcgtttgggcgtgattttttgg

SEQ ID NO: 1827 - DNA, 27 bp, Artificial Sequences
  Synthetic
cggtgcggtcgtttgggcgtgattttt

SEQ ID NO: 1828 - DNA, 27 bp, Artificial Sequences
  Synthetic
aggggcgtagagggaaggattagcgtt

SEQ ID NO: 1829 - DNA, 27 bp, Artificial Sequences
  Synthetic
ggaaagggcggtggttgtgggtaaagc

SEQ ID NO: 1830 - DNA, 27 bp, Artificial Sequences
  Synthetic
gggcggtggttgtgggtaaagcgtttt

SEQ ID NO: 1831 - DNA, 27 bp, Artificial Sequences
  Synthetic
gaaagggcggtggttgtgggtaaagcg

SEQ ID NO: 1832 - DNA, 27 bp, Artificial Sequences
  Synthetic
agggcggtggttgtgggtaaagcgttt

SEQ ID NO: 1833 - DNA, 27 bp, Artificial Sequences
  Synthetic
aagggcggtggttgtgggtaaagcgtt

SEQ ID NO: 1834 - DNA, 27 bp, Artificial Sequences
  Synthetic
aggggcgtagagggaaggattagcgtt

SEQ ID NO: 1835 - DNA, 27 bp, Artificial Sequences
  Synthetic
tggttggggttgtagggggttcgtttt

SEQ ID NO: 1836 - DNA, 27 bp, Artificial Sequences
  Synthetic
ttggttggggttgtagggggttcgttt

SEQ ID NO: 1837 - DNA, 27 bp, Artificial Sequences
  Synthetic
taggggcgtagagggaaggattagcgt

SEQ ID NO: 1838 - DNA, 27 bp, Artificial Sequences
  Synthetic
tgtagggggttcgttttttaggggcgt

SEQ ID NO: 1839 - DNA, 27 bp, Artificial Sequences
  Synthetic
ggaaagggcggtggttgtgggtaaagc

SEQ ID NO: 1840 - DNA, 27 bp, Artificial Sequences
  Synthetic
gcgcgggttttcgtagggagaagagga

SEQ ID NO: 1841 - DNA, 27 bp, Artificial Sequences
  Synthetic
gggcggtggttgtgggtaaagcgtttt

SEQ ID NO: 1842 - DNA, 27 bp, Artificial Sequences
  Synthetic
gaaagggcggtggttgtgggtaaagcg

SEQ ID NO: 1843 - DNA, 27 bp, Artificial Sequences
  Synthetic
agggagaagaggaggagagtcggcgtc

SEQ ID NO: 1844 - DNA, 27 bp, Artificial Sequences
  Synthetic
agagcgaggttaaggtttgggggtagt

SEQ ID NO: 1845 - DNA, 28 bp, Artificial Sequences
  Synthetic
gagagcgaggttaaggtttgggggtagt

SEQ ID NO: 1846 - DNA, 27 bp, Artificial Sequences
  Synthetic
gagagcgaggttaaggtttgggggtag

SEQ ID NO: 1847 - DNA, 27 bp, Artificial Sequences
  Synthetic
gagcgaggttaaggtttgggggtagtt

SEQ ID NO: 1848 - DNA, 28 bp, Artificial Sequences
  Synthetic
agagcgaggttaaggtttgggggtagtt

SEQ ID NO: 1849 - DNA, 27 bp, Artificial Sequences
  Synthetic
gcgcgggttttcgtagggagaagagga

SEQ ID NO: 1850 - DNA, 27 bp, Artificial Sequences
  Synthetic
cggcggtggtttagtcgttgggtttcg

SEQ ID NO: 1851 - DNA, 27 bp, Artificial Sequences
  Synthetic
agggagaagaggaggagagtcggcgtc

SEQ ID NO: 1852 - DNA, 27 bp, Artificial Sequences
  Synthetic
ttttttaggattgggttcgggcggcgc

SEQ ID NO: 1853 - DNA, 27 bp, Artificial Sequences
  Synthetic
tagggagaagaggaggagagtcggcgt

SEQ ID NO: 1854 - DNA, 28 bp, Artificial Sequences
  Synthetic
gggtgtcggtttgggggttttggattgg

SEQ ID NO: 1855 - DNA, 28 bp, Artificial Sequences
  Synthetic
ggtgtcggtttgggggttttggattggt

SEQ ID NO: 1856 - DNA, 27 bp, Artificial Sequences
  Synthetic
ggtgtcggtttgggggttttggattgg

SEQ ID NO: 1857 - DNA, 27 bp, Artificial Sequences
  Synthetic
gggtgtcggtttgggggttttggattg

SEQ ID NO: 1858 - DNA, 27 bp, Artificial Sequences
  Synthetic
gtgtcggtttgggggttttggattggt

SEQ ID NO: 1859 - DNA, 27 bp, Artificial Sequences
  Synthetic
gggttttgaggttaggggagcgtggga

SEQ ID NO: 1860 - DNA, 27 bp, Artificial Sequences
  Synthetic
tttcggttcgttgagtcggcggtttgg

SEQ ID NO: 1861 - DNA, 27 bp, Artificial Sequences
  Synthetic
tgggttttgaggttaggggagcgtggg

SEQ ID NO: 1862 - DNA, 27 bp, Artificial Sequences
  Synthetic
ttcggttcgttgagtcggcggtttggt

SEQ ID NO: 1863 - DNA, 27 bp, Artificial Sequences
  Synthetic
tcggttcgttgagtcggcggtttggtc

SEQ ID NO: 1864 - DNA, 32 bp, Artificial Sequences
  Synthetic
gcgttttgggttttaggtttttgttttacggt

SEQ ID NO: 1865 - DNA, 33 bp, Artificial Sequences
  Synthetic
agcgttttgggttttaggtttttgttttacggt

SEQ ID NO: 1866 - DNA, 33 bp, Artificial Sequences
  Synthetic
gcgttttgggttttaggtttttgttttacggtt

SEQ ID NO: 1867 - DNA, 33 bp, Artificial Sequences
  Synthetic
tgggttttaggtttttgttttacggttaggtcg

SEQ ID NO: 1868 - DNA, 33 bp, Artificial Sequences
  Synthetic
aagcgttttgggttttaggtttttgttttacgg

SEQ ID NO: 1869 - DNA, 27 bp, Artificial Sequences
  Synthetic
gggttttgaggttaggggagcgtggga

SEQ ID NO: 1870 - DNA, 27 bp, Artificial Sequences
  Synthetic
tgggttttgaggttaggggagcgtggg

SEQ ID NO: 1871 - DNA, 27 bp, Artificial Sequences
  Synthetic
ggcgggggcggttttttagggagagta

SEQ ID NO: 1872 - DNA, 28 bp, Artificial Sequences
  Synthetic
gggttttgaggttaggggagcgtgggat

SEQ ID NO: 1873 - DNA, 27 bp, Artificial Sequences
  Synthetic
gcgggggcggttttttagggagagtaa

SEQ ID NO: 1874 - DNA, 27 bp, Artificial Sequences
  Synthetic
ggcgggggcggttttttagggagagta

SEQ ID NO: 1875 - DNA, 27 bp, Artificial Sequences
  Synthetic
gcgggggcggttttttagggagagtaa

SEQ ID NO: 1876 - DNA, 28 bp, Artificial Sequences
  Synthetic
ggcgggggcggttttttagggagagtaa

SEQ ID NO: 1877 - DNA, 26 bp, Artificial Sequences
  Synthetic
ggcgggggcggttttttagggagagt

SEQ ID NO: 1878 - DNA, 28 bp, Artificial Sequences
  Synthetic
gcgggggcggttttttagggagagtaat

SEQ ID NO: 1879 - DNA, 27 bp, Artificial Sequences
  Synthetic
ttttggagtcggtttgcggtgaggtcg

SEQ ID NO: 1880 - DNA, 28 bp, Artificial Sequences
  Synthetic
tttttggagtcggtttgcggtgaggtcg

SEQ ID NO: 1881 - DNA, 26 bp, Artificial Sequences
  Synthetic
tttggagtcggtttgcggtgaggtcg

SEQ ID NO: 1882 - DNA, 27 bp, Artificial Sequences
  Synthetic
ttcgtcggggtaagtgggagttgttgt

SEQ ID NO: 1883 - DNA, 27 bp, Artificial Sequences
  Synthetic
tttttggagtcggtttgcggtgaggtc

SEQ ID NO: 1884 - DNA, 27 bp, Artificial Sequences
  Synthetic
tcggagaggtcggtataaaggcggata

SEQ ID NO: 1885 - DNA, 26 bp, Artificial Sequences
  Synthetic
tcggagaggtcggtataaaggcggat

SEQ ID NO: 1886 - DNA, 28 bp, Artificial Sequences
  Synthetic
tcggagaggtcggtataaaggcggatat

SEQ ID NO: 1887 - DNA, 28 bp, Artificial Sequences
  Synthetic
cggagaggtcggtataaaggcggatatg

SEQ ID NO: 1888 - DNA, 29 bp, Artificial Sequences
  Synthetic
cggagaggtcggtataaaggcggatatga

SEQ ID NO: 1889 - DNA, 27 bp, Artificial Sequences
  Synthetic
ggagtcggtttgcggtgaggtcggtat

SEQ ID NO: 1890 - DNA, 27 bp, Artificial Sequences
  Synthetic
ttttggagtcggtttgcggtgaggtcg

SEQ ID NO: 1891 - DNA, 27 bp, Artificial Sequences
  Synthetic
tttggagtcggtttgcggtgaggtcgg

SEQ ID NO: 1892 - DNA, 26 bp, Artificial Sequences
  Synthetic
ggagtcggtttgcggtgaggtcggta

SEQ ID NO: 1893 - DNA, 27 bp, Artificial Sequences
  Synthetic
tggagtcggtttgcggtgaggtcggta

SEQ ID NO: 1894 - DNA, 27 bp, Artificial Sequences
  Synthetic
tcggagaggtcggtataaaggcggata

SEQ ID NO: 1895 - DNA, 26 bp, Artificial Sequences
  Synthetic
tcggagaggtcggtataaaggcggat

SEQ ID NO: 1896 - DNA, 28 bp, Artificial Sequences
  Synthetic
tcggagaggtcggtataaaggcggatat

SEQ ID NO: 1897 - DNA, 28 bp, Artificial Sequences
  Synthetic
cggagaggtcggtataaaggcggatatg

SEQ ID NO: 1898 - DNA, 29 bp, Artificial Sequences
  Synthetic
cggagaggtcggtataaaggcggatatga

SEQ ID NO: 1899 - DNA, 31 bp, Artificial Sequences
  Synthetic
gggggcgttgtaggttaattgatagttacgg

SEQ ID NO: 1900 - DNA, 32 bp, Artificial Sequences
  Synthetic
agggggcgttgtaggttaattgatagttacgg

SEQ ID NO: 1901 - DNA, 32 bp, Artificial Sequences
  Synthetic
gggggcgttgtaggttaattgatagttacgga

SEQ ID NO: 1902 - DNA, 33 bp, Artificial Sequences
  Synthetic
agggggcgttgtaggttaattgatagttacgga

SEQ ID NO: 1903 - DNA, 31 bp, Artificial Sequences
  Synthetic
agggggcgttgtaggttaattgatagttacg

SEQ ID NO: 1904 - DNA, 28 bp, Artificial Sequences
  Synthetic
ggtcgtcggttcggtcgttttgagttcg

SEQ ID NO: 1905 - DNA, 27 bp, Artificial Sequences
  Synthetic
gtcgtcggttcggtcgttttgagttcg

SEQ ID NO: 1906 - DNA, 27 bp, Artificial Sequences
  Synthetic
ggtcgtcggttcggtcgttttgagttc

SEQ ID NO: 1907 - DNA, 26 bp, Artificial Sequences
  Synthetic
ggtcgtcggttcggtcgttttgagtt

SEQ ID NO: 1908 - DNA, 26 bp, Artificial Sequences
  Synthetic
tcgtcggttcggtcgttttgagttcg

SEQ ID NO: 1909 - DNA, 27 bp, Artificial Sequences
  Synthetic
aaatcggatttagggcggtcgggtcgg

SEQ ID NO: 1910 - DNA, 26 bp, Artificial Sequences
  Synthetic
aatcggatttagggcggtcgggtcgg

SEQ ID NO: 1911 - DNA, 27 bp, Artificial Sequences
  Synthetic
tttcggtgttgcgtgtggtagtggagt

SEQ ID NO: 1912 - DNA, 27 bp, Artificial Sequences
  Synthetic
agtttcggtgttgcgtgtggtagtgga

SEQ ID NO: 1913 - DNA, 28 bp, Artificial Sequences
  Synthetic
gtttcggtgttgcgtgtggtagtggagt

SEQ ID NO: 1914 - DNA, 28 bp, Artificial Sequences
  Synthetic
ggtcgtcggttcggtcgttttgagttcg

SEQ ID NO: 1915 - DNA, 27 bp, Artificial Sequences
  Synthetic
tcgtcggttcggtcgttttgagttcga

SEQ ID NO: 1916 - DNA, 27 bp, Artificial Sequences
  Synthetic
gtcgtcggttcggtcgttttgagttcg

SEQ ID NO: 1917 - DNA, 27 bp, Artificial Sequences
  Synthetic
ggtcgtcggttcggtcgttttgagttc

SEQ ID NO: 1918 - DNA, 28 bp, Artificial Sequences
  Synthetic
gtcgtcggttcggtcgttttgagttcga

SEQ ID NO: 1919 - DNA, 27 bp, Artificial Sequences
  Synthetic
tcgttgtagaagcggggaggggtagtt

SEQ ID NO: 1920 - DNA, 27 bp, Artificial Sequences
  Synthetic
ttcgttgtagaagcggggaggggtagt

SEQ ID NO: 1921 - DNA, 27 bp, Artificial Sequences
  Synthetic
tttcggtgttgcgtgtggtagtggagt

SEQ ID NO: 1922 - DNA, 27 bp, Artificial Sequences
  Synthetic
agtttcggtgttgcgtgtggtagtgga

SEQ ID NO: 1923 - DNA, 28 bp, Artificial Sequences
  Synthetic
gtttcggtgttgcgtgtggtagtggagt

SEQ ID NO: 1924 - DNA, 27 bp, Artificial Sequences
  Synthetic
gcgtcgttggtgtggggagggtagtag

SEQ ID NO: 1925 - DNA, 27 bp, Artificial Sequences
  Synthetic
cgtcgttggtgtggggagggtagtagg

SEQ ID NO: 1926 - DNA, 27 bp, Artificial Sequences
  Synthetic
gtcgttggtgtggggagggtagtaggt

SEQ ID NO: 1927 - DNA, 26 bp, Artificial Sequences
  Synthetic
gcgtcgttggtgtggggagggtagta

SEQ ID NO: 1928 - DNA, 27 bp, Artificial Sequences
  Synthetic
cgcgtcgttggtgtggggagggtagta

SEQ ID NO: 1929 - DNA, 27 bp, Artificial Sequences
  Synthetic
atttcgggtgggtcgttttggttggcg

SEQ ID NO: 1930 - DNA, 27 bp, Artificial Sequences
  Synthetic
tttcgggtgggtcgttttggttggcga

SEQ ID NO: 1931 - DNA, 27 bp, Artificial Sequences
  Synthetic
gcgggtcgggagtgtagttgtgtttga

SEQ ID NO: 1932 - DNA, 27 bp, Artificial Sequences
  Synthetic
tcgttgtagaagcggggaggggtagtt

SEQ ID NO: 1933 - DNA, 27 bp, Artificial Sequences
  Synthetic
ttcgttgtagaagcggggaggggtagt

SEQ ID NO: 1934 - DNA, 27 bp, Artificial Sequences
  Synthetic
cggtgtggcggggtttcgttaagagag

SEQ ID NO: 1935 - DNA, 27 bp, Artificial Sequences
  Synthetic
gcggtgtggcggggtttcgttaagaga

SEQ ID NO: 1936 - DNA, 26 bp, Artificial Sequences
  Synthetic
gcggtgtggcggggtttcgttaagag

SEQ ID NO: 1937 - DNA, 28 bp, Artificial Sequences
  Synthetic
cggtgtggcggggtttcgttaagagaga

SEQ ID NO: 1938 - DNA, 27 bp, Artificial Sequences
  Synthetic
ggtgtggcggggtttcgttaagagaga

SEQ ID NO: 1939 - DNA, 30 bp, Artificial Sequences
  Synthetic
tgtgggttagtgggagttgtaggtgttagt

SEQ ID NO: 1940 - DNA, 30 bp, Artificial Sequences
  Synthetic
cgtttatgtgggttagtgggagttgtaggt

SEQ ID NO: 1941 - DNA, 30 bp, Artificial Sequences
  Synthetic
tcgtttatgtgggttagtgggagttgtagg

SEQ ID NO: 1942 - DNA, 31 bp, Artificial Sequences
  Synthetic
tcgtttatgtgggttagtgggagttgtaggt

SEQ ID NO: 1943 - DNA, 31 bp, Artificial Sequences
  Synthetic
tgtgggttagtgggagttgtaggtgttagtt

SEQ ID NO: 1944 - DNA, 27 bp, Artificial Sequences
  Synthetic
cgaggcggcgtttaggggtttttgtgg

SEQ ID NO: 1945 - DNA, 27 bp, Artificial Sequences
  Synthetic
cggtgtggcggggtttcgttaagagag

SEQ ID NO: 1946 - DNA, 27 bp, Artificial Sequences
  Synthetic
gaggcggcgtttaggggtttttgtggc

SEQ ID NO: 1947 - DNA, 27 bp, Artificial Sequences
  Synthetic
gcggtgtggcggggtttcgttaagaga

SEQ ID NO: 1948 - DNA, 26 bp, Artificial Sequences
  Synthetic
gcggtgtggcggggtttcgttaagag

SEQ ID NO: 1949 - DNA, 30 bp, Artificial Sequences; identical to SEQ ID NO: 1939
  Synthetic

SEQ ID NO: 1950 - DNA, 30 bp, Artificial Sequences; identical to SEQ ID NO: 1940
  Synthetic

SEQ ID NO: 1951 - DNA, 30 bp, Artificial Sequences; identical to SEQ ID NO: 1941
  Synthetic

SEQ ID NO: 1952 - DNA, 31 bp, Artificial Sequences; identical to SEQ ID NO: 1942
  Synthetic

SEQ ID NO: 1953 - DNA, 31 bp, Artificial Sequences; identical to SEQ ID NO: 1943
  Synthetic

SEQ ID NO: 1954 - DNA, 28 bp, Artificial Sequences
  Synthetic
aggatgtggtcgggttgagaaaattcgt

SEQ ID NO: 1955 - DNA, 29 bp, Artificial Sequences
  Synthetic
tggtcgggttgagaaaattcgttttgggt

SEQ ID NO: 1956 - DNA, 28 bp, Artificial Sequences
  Synthetic
ggtcgggttgagaaaattcgttttgggt

SEQ ID NO: 1957 - DNA, 28 bp, Artificial Sequences
  Synthetic
tggtcgggttgagaaaattcgttttggg

SEQ ID NO: 1958 - DNA, 29 bp, Artificial Sequences
  Synthetic
gtggtcgggttgagaaaattcgttttggg

SEQ ID NO: 1959 - DNA, 27 bp, Artificial Sequences
  Synthetic
tgagggtcggaatgggtttagggtaga

SEQ ID NO: 1960 - DNA, 27 bp, Artificial Sequences
  Synthetic
ttttgagggtcggaatgggtttagggt

SEQ ID NO: 1961 - DNA, 28 bp, Artificial Sequences
  Synthetic
ttgagggtcggaatgggtttagggtaga

SEQ ID NO: 1962 - DNA, 28 bp, Artificial Sequences
  Synthetic
gggtcggaatgggtttagggtagattcg

SEQ ID NO: 1963 - DNA, 28 bp, Artificial Sequences
  Synthetic
tgagggtcggaatgggtttagggtagat

SEQ ID NO: 1964 - DNA, 27 bp, Artificial Sequences
  Synthetic
ttgggtttgggggagggggaggaaaag

SEQ ID NO: 1965 - DNA, 27 bp, Artificial Sequences
  Synthetic
tggatgtgtagtggaggggacgagggt

SEQ ID NO: 1966 - DNA, 27 bp, Artificial Sequences
  Synthetic
aggggaatgtgcgtggagttgaggagg

SEQ ID NO: 1967 - DNA, 27 bp, Artificial Sequences
  Synthetic
agggaggggaatgtgcgtggagttgag

SEQ ID NO: 1968 - DNA, 27 bp, Artificial Sequences
  Synthetic
cggttatttgggtttgggggaggggga

SEQ ID NO: 1969 - DNA, 27 bp, Artificial Sequences
  Synthetic
gttggggagggttggtttttgcgggtt

SEQ ID NO: 1970 - DNA, 27 bp, Artificial Sequences
  Synthetic
gagttggggagggttggtttttgcggg

SEQ ID NO: 1971 - DNA, 27 bp, Artificial Sequences
  Synthetic
aggattcggtggaggagaaaggcgtcg

SEQ ID NO: 1972 - DNA, 27 bp, Artificial Sequences
  Synthetic
ttcgggggatttcggtggtaggcgttt

SEQ ID NO: 1973 - DNA, 27 bp, Artificial Sequences
  Synthetic
taggttcgggggatttcggtggtaggc

SEQ ID NO: 1974 - DNA, 27 bp, Artificial Sequences
  Synthetic
gtcgcggtgggaattgggttgtggttt

SEQ ID NO: 1975 - DNA, 27 bp, Artificial Sequences
  Synthetic
gatgtcgcggtgggaattgggttgtgg

SEQ ID NO: 1976 - DNA, 27 bp, Artificial Sequences
  Synthetic
ggatgtcgcggtgggaattgggttgtg

SEQ ID NO: 1977 - DNA, 27 bp, Artificial Sequences
  Synthetic
cgaggggaagtgttgggggaagaaggg

SEQ ID NO: 1978 - DNA, 27 bp, Artificial Sequences
  Synthetic
ggtcgggagggttggggtaggtgtaga

SEQ ID NO: 1979 - DNA, 27 bp, Artificial Sequences
  Synthetic
tggggatgtgaggtatggtagggtcga

SEQ ID NO: 1980 - DNA, 27 bp, Artificial Sequences
  Synthetic
ttggggatgtgaggtatggtagggtcg

SEQ ID NO: 1981 - DNA, 28 bp, Artificial Sequences
  Synthetic
tggggatgtgaggtatggtagggtcgaa

SEQ ID NO: 1982 - DNA, 28 bp, Artificial Sequences
  Synthetic
ttggggatgtgaggtatggtagggtcga

SEQ ID NO: 1983 - DNA, 27 bp, Artificial Sequences
  Synthetic
ggggatgtgaggtatggtagggtcgaa

SEQ ID NO: 1984 - DNA, 27 bp, Artificial Sequences
  Synthetic
tatgggttttggtcgggaggaatgagc

SEQ ID NO: 1985 - DNA, 26 bp, Artificial Sequences
  Synthetic
atgggttttggtcgggaggaatgagc

SEQ ID NO: 1986 - DNA, 28 bp, Artificial Sequences
  Synthetic
ttatgggttttggtcgggaggaatgagc

SEQ ID NO: 1987 - DNA, 25 bp, Artificial Sequences
  Synthetic
tgggttttggtcgggaggaatgagc

SEQ ID NO: 1988 - DNA, 29 bp, Artificial Sequences
  Synthetic
attatgggttttggtcgggaggaatgagc

SEQ ID NO: 1989 - DNA, 25 bp, Artificial Sequences
  Synthetic
cgcgtggagggttcggtcggtattc

SEQ ID NO: 1990 - DNA, 27 bp, Artificial Sequences
  Synthetic
tatgggttttggtcgggaggaatgagc

SEQ ID NO: 1991 - DNA, 26 bp, Artificial Sequences
  Synthetic
atgggttttggtcgggaggaatgagc

SEQ ID NO: 1992 - DNA, 28 bp, Artificial Sequences
  Synthetic
ttatgggttttggtcgggaggaatgagc

SEQ ID NO: 1993 - DNA, 24 bp, Artificial Sequences
  Synthetic
cgcgtggagggttcggtcggtatt

SEQ ID NO: 1994 - DNA, 25 bp, Artificial Sequences
  Synthetic
cgcgtggagggttcggtcggtattc

SEQ ID NO: 1995 - DNA, 27 bp, Artificial Sequences
  Synthetic
tatgggttttggtcgggaggaatgagc

SEQ ID NO: 1996 - DNA, 27 bp, Artificial Sequences
  Synthetic
gcggggaggttgtatcgggaagtttaa

SEQ ID NO: 1997 - DNA, 29 bp, Artificial Sequences
  Synthetic
gcggggaggttgtatcgggaagtttaagt

SEQ ID NO: 1998 - DNA, 26 bp, Artificial Sequences
  Synthetic
atgggttttggtcgggaggaatgagc

SEQ ID NO: 1999 - DNA, 27 bp, Artificial Sequences
  Synthetic
gcggtcgttagagggcgcggtttatat

SEQ ID NO: 2000 - DNA, 28 bp, Artificial Sequences
  Synthetic
gcggtcgttagagggcgcggtttatatt

SEQ ID NO: 2001 - DNA, 28 bp, Artificial Sequences
  Synthetic
cgcgttcggaatttgggtttttcggtgt

SEQ ID NO: 2002 - DNA, 27 bp, Artificial Sequences
  Synthetic
cgcgttcggaatttgggtttttcggtg

SEQ ID NO: 2003 - DNA, 26 bp, Artificial Sequences
  Synthetic
gcggtcgttagagggcgcggtttata

SEQ ID NO: 2004 - DNA, 27 bp, Artificial Sequences
  Synthetic
tcggattgggttcgggaaaggtagcgg

SEQ ID NO: 2005 - DNA, 27 bp, Artificial Sequences
  Synthetic
ggattgggttcgggaaaggtagcgggt

SEQ ID NO: 2006 - DNA, 27 bp, Artificial Sequences
  Synthetic
gggttcgggaaaggtagcgggtattgc

SEQ ID NO: 2007 - DNA, 27 bp, Artificial Sequences
  Synthetic
cggattgggttcgggaaaggtagcggg

SEQ ID NO: 2008 - DNA, 27 bp, Artificial Sequences
  Synthetic
gggtttcggattgggttcgggaaaggt

SEQ ID NO: 2009 - DNA, 27 bp, Artificial Sequences
  Synthetic
cggggattttgatttcgcgcggatttc

SEQ ID NO: 2010 - DNA, 26 bp, Artificial Sequences
  Synthetic
cggggattttgatttcgcgcggattt

SEQ ID NO: 2011 - DNA, 28 bp, Artificial Sequences
  Synthetic
tgggtttttcggtgtagttttttcgcga

SEQ ID NO: 2012 - DNA, 25 bp, Artificial Sequences
  Synthetic
cggggattttgatttcgcgcggatt

SEQ ID NO: 2013 - DNA, 29 bp, Artificial Sequences
  Synthetic
ttgggtttttcggtgtagttttttcgcga

SEQ ID NO: 2014 - DNA, 27 bp, Artificial Sequences
  Synthetic
gaggttcgcgcgaggttaaggttttcg

SEQ ID NO: 2015 - DNA, 26 bp, Artificial Sequences
  Synthetic
aggttcgcgcgaggttaaggttttcg

SEQ ID NO: 2016 - DNA, 27 bp, Artificial Sequences
  Synthetic
agggagagttaagtaaggcgacgaggt

SEQ ID NO: 2017 - DNA, 27 bp, Artificial Sequences
  Synthetic
gggagagttaagtaaggcgacgaggtt

SEQ ID NO: 2018 - DNA, 28 bp, Artificial Sequences
  Synthetic
agggagagttaagtaaggcgacgaggtt

SEQ ID NO: 2019 - DNA, 27 bp, Artificial Sequences
  Synthetic
cggggattttgatttcgcgcggatttc

SEQ ID NO: 2020 - DNA, 26 bp, Artificial Sequences
  Synthetic
cggggattttgatttcgcgcggattt

SEQ ID NO: 2021 - DNA, 25 bp, Artificial Sequences
  Synthetic
cggggattttgatttcgcgcggatt

SEQ ID NO: 2022 - DNA, 24 bp, Artificial Sequences
  Synthetic
cggggattttgatttcgcgcggat

SEQ ID NO: 2023 - DNA, 23 bp, Artificial Sequences
  Synthetic
cggggattttgatttcgcgcgga

SEQ ID NO: 2024 - DNA, 32 bp, Artificial Sequences
  Synthetic
cgggaagtttttattttggttatagtcgcgcg

SEQ ID NO: 2025 - DNA, 33 bp, Artificial Sequences
  Synthetic
cgggaagtttttattttggttatagtcgcgcga

SEQ ID NO: 2026 - DNA, 19 bp, Artificial Sequences
  Synthetic
gcggagagaggcggcgggg

SEQ ID NO: 2027 - DNA, 32 bp, Artificial Sequences
  Synthetic
gggaagtttttattttggttatagtcgcgcga

SEQ ID NO: 2028 - DNA, 32 bp, Artificial Sequences
  Synthetic
aggcgggaagtttttattttggttatagtcgc

SEQ ID NO: 2029 - DNA, 30 bp, Artificial Sequences
  Synthetic
gcggtaatttttcgtttcggttttggcgcg

SEQ ID NO: 2030 - DNA, 30 bp, Artificial Sequences
  Synthetic
cgcggtaatttttcgtttcggttttggcgc

SEQ ID NO: 2031 - DNA, 29 bp, Artificial Sequences
  Synthetic
gcggtaatttttcgtttcggttttggcgc

SEQ ID NO: 2032 - DNA, 29 bp, Artificial Sequences
  Synthetic
cggtaatttttcgtttcggttttggcgcg

SEQ ID NO: 2033 - DNA, 29 bp, Artificial Sequences
  Synthetic
cgcggtaatttttcgtttcggttttggcg

SEQ ID NO: 2034 - DNA, 27 bp, Artificial Sequences
  Synthetic
cgggttggggataatgcgggggtagta

SEQ ID NO: 2035 - DNA, 26 bp, Artificial Sequences
  Synthetic
cgggttggggataatgcgggggtagt

SEQ ID NO: 2036 - DNA, 28 bp, Artificial Sequences
  Synthetic
cgggttggggataatgcgggggtagtag

SEQ ID NO: 2037 - DNA, 28 bp, Artificial Sequences
  Synthetic
gggttggggataatgcgggggtagtagt

SEQ ID NO: 2038 - DNA, 27 bp, Artificial Sequences
  Synthetic
gggttggggataatgcgggggtagtag

SEQ ID NO: 2039 - DNA, 27 bp, Artificial Sequences
  Synthetic
tcgcgcggttgtgattaggataagggt

SEQ ID NO: 2040 - DNA, 29 bp, Artificial Sequences
  Synthetic
cgttcgcgcggttgtgattaggataaggg

SEQ ID NO: 2041 - DNA, 27 bp, Artificial Sequences
  Synthetic
cgcgcggttgtgattaggataagggtt

SEQ ID NO: 2042 - DNA, 28 bp, Artificial Sequences
  Synthetic
tcgcgcggttgtgattaggataagggtt

SEQ ID NO: 2043 - DNA, 28 bp, Artificial Sequences
  Synthetic
ttcgcgcggttgtgattaggataagggt

SEQ ID NO: 2044 - DNA, 27 bp, Artificial Sequences
  Synthetic
cgggttggggataatgcgggggtagta

SEQ ID NO: 2045 - DNA, 27 bp, Artificial Sequences
  Synthetic
tttgtttgggttttgggggtgcgagcg

SEQ ID NO: 2046 - DNA, 27 bp, Artificial Sequences
  Synthetic
acgttttgtttgggttttgggggtgcg

SEQ ID NO: 2047 - DNA, 27 bp, Artificial Sequences
  Synthetic
ttttgtttgggttttgggggtgcgagc

SEQ ID NO: 2048 - DNA, 26 bp, Artificial Sequences
  Synthetic
cgggttggggataatgcgggggtagt

SEQ ID NO: 2049 - DNA, 27 bp, Artificial Sequences
  Synthetic
tcgcgcggttgtgattaggataagggt

SEQ ID NO: 2050 - DNA, 29 bp, Artificial Sequences
  Synthetic
cgttcgcgcggttgtgattaggataaggg

SEQ ID NO: 2051 - DNA, 27 bp, Artificial Sequences
  Synthetic
cgcgcggttgtgattaggataagggtt

SEQ ID NO: 2052 - DNA, 28 bp, Artificial Sequences
  Synthetic
tcgcgcggttgtgattaggataagggtt

SEQ ID NO: 2053 - DNA, 28 bp, Artificial Sequences
  Synthetic
ttcgcgcggttgtgattaggataagggt

SEQ ID NO: 2054 - DNA, 27 bp, Artificial Sequences
  Synthetic
tttgtttgggttttgggggtgcgagcg

SEQ ID NO: 2055 - DNA, 27 bp, Artificial Sequences
  Synthetic
acgttttgtttgggttttgggggtgcg

SEQ ID NO: 2056 - DNA, 27 bp, Artificial Sequences
  Synthetic
ttttgtttgggttttgggggtgcgagc

SEQ ID NO: 2057 - DNA, 28 bp, Artificial Sequences
  Synthetic
acgttttgtttgggttttgggggtgcga

SEQ ID NO: 2058 - DNA, 27 bp, Artificial Sequences
  Synthetic
cgttttgtttgggttttgggggtgcga

SEQ ID NO: 2059 - DNA, 23 bp, Artificial Sequences
  Synthetic
ggttcggaggagagggcggggtc

SEQ ID NO: 2060 - DNA, 22 bp, Artificial Sequences
  Synthetic
ggttcggaggagagggcggggt

SEQ ID NO: 2061 - DNA, 24 bp, Artificial Sequences
  Synthetic
gggttcggaggagagggcggggtc

SEQ ID NO: 2062 - DNA, 30 bp, Artificial Sequences
  Synthetic
cggagtcggtattttgggtcgtattttcgg

SEQ ID NO: 2063 - DNA, 31 bp, Artificial Sequences
  Synthetic
cggagtcggtattttgggtcgtattttcggt

SEQ ID NO: 2064 - DNA, 28 bp, Artificial Sequences
  Synthetic
aggaagcggcggtaatttttaagagggt

SEQ ID NO: 2065 - DNA, 29 bp, Artificial Sequences
  Synthetic
gcggcggtaatttttaagagggttttgcg

SEQ ID NO: 2066 - DNA, 30 bp, Artificial Sequences
  Synthetic
agcggcggtaatttttaagagggttttgcg

SEQ ID NO: 2067 - DNA, 30 bp, Artificial Sequences
  Synthetic
gcggcggtaatttttaagagggttttgcga

SEQ ID NO: 2068 - DNA, 31 bp, Artificial Sequences
  Synthetic
agcggcggtaatttttaagagggttttgcga

SEQ ID NO: 2069 - DNA, 27 bp, Artificial Sequences
  Synthetic
agggtcgggggcgtttggagagaaatt

SEQ ID NO: 2070 - DNA, 27 bp, Artificial Sequences
  Synthetic
gagggtcgggggcgtttggagagaaat

SEQ ID NO: 2071 - DNA, 27 bp, Artificial Sequences
  Synthetic
gggtcgggggcgtttggagagaaattt

SEQ ID NO: 2072 - DNA, 28 bp, Artificial Sequences
  Synthetic
agggtcgggggcgtttggagagaaattt

SEQ ID NO: 2073 - DNA, 26 bp, Artificial Sequences
  Synthetic
agggtcgggggcgtttggagagaaat

SEQ ID NO: 2074 - DNA, 28 bp, Artificial Sequences
  Synthetic
aggaagcggcggtaatttttaagagggt

SEQ ID NO: 2075 - DNA, 29 bp, Artificial Sequences
  Synthetic
gcggcggtaatttttaagagggttttgcg

SEQ ID NO: 2076 - DNA, 30 bp, Artificial Sequences; identical to SEQ ID NO: 2066
  Synthetic

SEQ ID NO: 2077 - DNA, 30 bp, Artificial Sequences; identical to SEQ ID NO: 2067
  Synthetic

SEQ ID NO: 2078 - DNA, 31 bp, Artificial Sequences; identical to SEQ ID NO: 2068
  Synthetic

SEQ ID NO: 2079 - DNA, 27 bp, Artificial Sequences
  Synthetic
gggtcgggggcgtttggagagaaattt

SEQ ID NO: 2080 - DNA, 27 bp, Artificial Sequences
  Synthetic
tgagcgtttttagttaggcgaggcgga

SEQ ID NO: 2081 - DNA, 26 bp, Artificial Sequences
  Synthetic
gggtcgggggcgtttggagagaaatt

SEQ ID NO: 2082 - DNA, 27 bp, Artificial Sequences
  Synthetic
ttgagcgtttttagttaggcgaggcgg

SEQ ID NO: 2083 - DNA, 28 bp, Artificial Sequences
  Synthetic
gggtcgggggcgtttggagagaaattta

SEQ ID NO: 2084 - DNA, 30 bp, Artificial Sequences
  Synthetic
tcgcgtttagattcggtttttgagggaaaa

SEQ ID NO: 2085 - DNA, 30 bp, Artificial Sequences
  Synthetic
ttcgcgtttagattcggtttttgagggaaa

SEQ ID NO: 2086 - DNA, 30 bp, Artificial Sequences
  Synthetic
tttcgcgtttagattcggtttttgagggaa

SEQ ID NO: 2087 - DNA, 30 bp, Artificial Sequences
  Synthetic
ttttcgcgtttagattcggtttttgaggga

SEQ ID NO: 2088 - DNA, 31 bp, Artificial Sequences
  Synthetic
ttcgcgtttagattcggtttttgagggaaaa

SEQ ID NO: 2089 - DNA, 28 bp, Artificial Sequences
  Synthetic
tggacgcggagatggagttaagtgtggt

SEQ ID NO: 2090 - DNA, 27 bp, Artificial Sequences
  Synthetic
ggacgcggagatggagttaagtgtggt

SEQ ID NO: 2091 - DNA, 27 bp, Artificial Sequences
  Synthetic
tggacgcggagatggagttaagtgtgg

SEQ ID NO: 2092 - DNA, 28 bp, Artificial Sequences
  Synthetic
ggacgcggagatggagttaagtgtggtt

SEQ ID NO: 2093 - DNA, 28 bp, Artificial Sequences
  Synthetic
ttggacgcggagatggagttaagtgtgg

SEQ ID NO: 2094 - DNA, 27 bp, Artificial Sequences
  Synthetic
aggtttggtcgggattggagggcgtag

SEQ ID NO: 2095 - DNA, 27 bp, Artificial Sequences
  Synthetic
ggtttggtcgggattggagggcgtaga

SEQ ID NO: 2096 - DNA, 27 bp, Artificial Sequences
  Synthetic
gaggtttggtcgggattggagggcgta

SEQ ID NO: 2097 - DNA, 27 bp, Artificial Sequences
  Synthetic
ggcgtagagtcgtcggggagcgtattc

SEQ ID NO: 2098 - DNA, 27 bp, Artificial Sequences
  Synthetic
tagaggtttggtcgggattggagggcg

SEQ ID NO: 2099 - DNA, 27 bp, Artificial Sequences
  Synthetic
aggtttttgggttgggagtcgagtcgt

SEQ ID NO: 2100 - DNA, 27 bp, Artificial Sequences
  Synthetic
ggtttttgggttgggagtcgagtcgtt

SEQ ID NO: 2101 - DNA, 28 bp, Artificial Sequences
  Synthetic
aggtttttgggttgggagtcgagtcgtt

SEQ ID NO: 2102 - DNA, 27 bp, Artificial Sequences
  Synthetic
cggttaggtttttgggttgggagtcga

SEQ ID NO: 2103 - DNA, 27 bp, Artificial Sequences
  Synthetic
tcggttaggtttttgggttgggagtcg

SEQ ID NO: 2104 - DNA, 27 bp, Artificial Sequences
  Synthetic
tcgttcgtgtggggtttcgtttgttgt

SEQ ID NO: 2105 - DNA, 28 bp, Artificial Sequences
  Synthetic
ttcgttcgtgtggggtttcgtttgttgt

SEQ ID NO: 2106 - DNA, 27 bp, Artificial Sequences
  Synthetic
ttcgttcgtgtggggtttcgtttgttg

SEQ ID NO: 2107 - DNA, 27 bp, Artificial Sequences
  Synthetic
cgttcgtgtggggtttcgtttgttgta

SEQ ID NO: 2108 - DNA, 27 bp, Artificial Sequences
  Synthetic
tttcgttcgtgtggggtttcgtttgtt

SEQ ID NO: 2109 - DNA, 27 bp, Artificial Sequences
  Synthetic
aggtttttgggttgggagtcgagtcgt

SEQ ID NO: 2110 - DNA, 27 bp, Artificial Sequences
  Synthetic
ggtttttgggttgggagtcgagtcgtt

SEQ ID NO: 2111 - DNA, 28 bp, Artificial Sequences
  Synthetic
aggtttttgggttgggagtcgagtcgtt

SEQ ID NO: 2112 - DNA, 27 bp, Artificial Sequences
  Synthetic
cggttaggtttttgggttgggagtcga

SEQ ID NO: 2113 - DNA, 27 bp, Artificial Sequences
  Synthetic
tcggttaggtttttgggttgggagtcg

SEQ ID NO: 2114 - DNA, 27 bp, Artificial Sequences
  Synthetic
gcgtcgtttaagcgttgcgtagagagc

SEQ ID NO: 2115 - DNA, 27 bp, Artificial Sequences
  Synthetic
tcgttcgtgtggggtttcgtttgttgt

SEQ ID NO: 2116 - DNA, 28 bp, Artificial Sequences
  Synthetic
ttcgttcgtgtggggtttcgtttgttgt

SEQ ID NO: 2117 - DNA, 27 bp, Artificial Sequences
  Synthetic
ttcgttcgtgtggggtttcgtttgttg

SEQ ID NO: 2118 - DNA, 27 bp, Artificial Sequences
  Synthetic
cgttcgtgtggggtttcgtttgttgta

SEQ ID NO: 2119 - DNA, 27 bp, Artificial Sequences
  Synthetic
atcgaggcgttggaaggggaaaagcga

SEQ ID NO: 2120 - DNA, 27 bp, Artificial Sequences
  Synthetic
cgaggcgttggaaggggaaaagcgaat

SEQ ID NO: 2121 - DNA, 27 bp, Artificial Sequences
  Synthetic
aatcgaggcgttggaaggggaaaagcg

SEQ ID NO: 2122 - DNA, 27 bp, Artificial Sequences
  Synthetic
tcgaggcgttggaaggggaaaagcgaa

SEQ ID NO: 2123 - DNA, 28 bp, Artificial Sequences
  Synthetic
cgaggcgttggaaggggaaaagcgaatg

SEQ ID NO: 2124 - DNA, 27 bp, Artificial Sequences
  Synthetic
gcgtcgtttaagcgttgcgtagagagc

SEQ ID NO: 2125 - DNA, 27 bp, Artificial Sequences
  Synthetic
tcgttcgtgtggggtttcgtttgttgt

SEQ ID NO: 2126 - DNA, 28 bp, Artificial Sequences
  Synthetic
ttcgttcgtgtggggtttcgtttgttgt

SEQ ID NO: 2127 - DNA, 27 bp, Artificial Sequences
  Synthetic
ttcgttcgtgtggggtttcgtttgttg

SEQ ID NO: 2128 - DNA, 27 bp, Artificial Sequences
  Synthetic
cgttcgtgtggggtttcgtttgttgta

SEQ ID NO: 2129 - DNA, 28 bp, Artificial Sequences
  Synthetic
cgggtttaggagtaacgtttggaggggg

SEQ ID NO: 2130 - DNA, 29 bp, Artificial Sequences
  Synthetic
cgggtttaggagtaacgtttggagggggt

SEQ ID NO: 2131 - DNA, 29 bp, Artificial Sequences
  Synthetic
tcgggtttaggagtaacgtttggaggggg

SEQ ID NO: 2132 - DNA, 29 bp, Artificial Sequences
  Synthetic
gggaggagtcgacgaagattaggagtggg

SEQ ID NO: 2133 - DNA, 29 bp, Artificial Sequences
  Synthetic
ggggaggagtcgacgaagattaggagtgg

SEQ ID NO: 2134 - DNA, 27 bp, Artificial Sequences
  Synthetic
gtcggttaggggtttagggtcggacgg

SEQ ID NO: 2135 - DNA, 27 bp, Artificial Sequences
  Synthetic
cgtcgtcggttaggggtttagggtcgg

SEQ ID NO: 2136 - DNA, 27 bp, Artificial Sequences
  Synthetic
aggagagggagaggtaggataggcggc

SEQ ID NO: 2137 - DNA, 27 bp, Artificial Sequences
  Synthetic
gggagaggtaggataggcggcggagat

SEQ ID NO: 2138 - DNA, 27 bp, Artificial Sequences
  Synthetic
acggttgggcggagggttttagggtta

SEQ ID NO: 2139 - DNA, 27 bp, Artificial Sequences
  Synthetic
tagagggtgttcgggggattatgcgcg

SEQ ID NO: 2140 - DNA, 27 bp, Artificial Sequences
  Synthetic
gcggttcggttgttcgttgcgttaggt

SEQ ID NO: 2141 - DNA, 27 bp, Artificial Sequences
  Synthetic
ggggaggattagggtgggtggtttggg

SEQ ID NO: 2142 - DNA, 27 bp, Artificial Sequences
  Synthetic
gggggattatgcgcggggttaggatgt

SEQ ID NO: 2143 - DNA, 27 bp, Artificial Sequences
  Synthetic
cggcgtagagggtgttcgggggattat

SEQ ID NO: 2144 - DNA, 27 bp, Artificial Sequences
  Synthetic
gaggttgggggttcggattgggagtcg

SEQ ID NO: 2145 - DNA, 27 bp, Artificial Sequences
  Synthetic
cgaggttgggggttcggattgggagtc

SEQ ID NO: 2146 - DNA, 27 bp, Artificial Sequences
  Synthetic
ggtgggggcgtaggaggaggggtatac

SEQ ID NO: 2147 - DNA, 27 bp, Artificial Sequences
  Synthetic
aggttgggggttcggattgggagtcga

SEQ ID NO: 2148 - DNA, 27 bp, Artificial Sequences
  Synthetic
aggtgggggcgtaggaggaggggtata

SEQ ID NO: 2149 - DNA, 27 bp, Artificial Sequences
  Synthetic
gcggttcggttgttcgttgcgttaggt

SEQ ID NO: 2150 - DNA, 27 bp, Artificial Sequences
  Synthetic
ggcggttcggttgttcgttgcgttagg

SEQ ID NO: 2151 - DNA, 27 bp, Artificial Sequences
  Synthetic
gggcggttcggttgttcgttgcgttag

SEQ ID NO: 2152 - DNA, 27 bp, Artificial Sequences
  Synthetic
gagtttatggtcggtcgggttggggcg

SEQ ID NO: 2153 - DNA, 28 bp, Artificial Sequences
  Synthetic
gcggttcggttgttcgttgcgttaggtt

SEQ ID NO: 2154 - DNA, 27 bp, Artificial Sequences
  Synthetic
ggtgggggcgtaggaggaggggtatac

SEQ ID NO: 2155 - DNA, 27 bp, Artificial Sequences
  Synthetic
aggtgggggcgtaggaggaggggtata

SEQ ID NO: 2156 - DNA, 26 bp, Artificial Sequences
  Synthetic
ggtgggggcgtaggaggaggggtata

SEQ ID NO: 2157 - DNA, 27 bp, Artificial Sequences
  Synthetic
gaggtgggggcgtaggaggaggggtat

SEQ ID NO: 2158 - DNA, 26 bp, Artificial Sequences
  Synthetic
gtgggggcgtaggaggaggggtatac

SEQ ID NO: 2159 - DNA, 27 bp, Artificial Sequences
  Synthetic
tcgggtcgcggtggatttggagttttt

SEQ ID NO: 2160 - DNA, 27 bp, Artificial Sequences
  Synthetic
ttcgggtcgcggtggatttggagtttt

SEQ ID NO: 2161 - DNA, 27 bp, Artificial Sequences
  Synthetic
tttcgggtcgcggtggatttggagttt

SEQ ID NO: 2162 - DNA, 27 bp, Artificial Sequences
  Synthetic
atttcgggtcgcggtggatttggagtt

SEQ ID NO: 2163 - DNA, 27 bp, Artificial Sequences
  Synthetic
tatttcgggtcgcggtggatttggagt

SEQ ID NO: 2164 - DNA, 27 bp, Artificial Sequences
  Synthetic
agcgtttggaggtatggttcggtttga

SEQ ID NO: 2165 - DNA, 27 bp, Artificial Sequences
  Synthetic
tcggtttgattgtgtacggtgtagcgt

SEQ ID NO: 2166 - DNA, 27 bp, Artificial Sequences
  Synthetic
cggtttgattgtgtacggtgtagcgtt

SEQ ID NO: 2167 - DNA, 29 bp, Artificial Sequences
  Synthetic
ggttcggtttgattgtgtacggtgtagcg

SEQ ID NO: 2168 - DNA, 30 bp, Artificial Sequences
  Synthetic
ggttcggtttgattgtgtacggtgtagcgt

SEQ ID NO: 2169 - DNA, 27 bp, Artificial Sequences
  Synthetic
ggttggggtaggcgcggagagtagaag

SEQ ID NO: 2170 - DNA, 27 bp, Artificial Sequences
  Synthetic
taggttggggtaggcgcggagagtaga

SEQ ID NO: 2171 - DNA, 27 bp, Artificial Sequences
  Synthetic
aggttggggtaggcgcggagagtagaa

SEQ ID NO: 2172 - DNA, 27 bp, Artificial Sequences
  Synthetic
gttggggtaggcgcggagagtagaagt

SEQ ID NO: 2173 - DNA, 27 bp, Artificial Sequences
  Synthetic
gcgttgcggggcgttgtatcgtgtata

SEQ ID NO: 2174 - DNA, 27 bp, Artificial Sequences
  Synthetic
agcgtttggaggtatggttcggtttga

SEQ ID NO: 2175 - DNA, 27 bp, Artificial Sequences
  Synthetic
tcggtttgattgtgtacggtgtagcgt

SEQ ID NO: 2176 - DNA, 27 bp, Artificial Sequences
  Synthetic
cggtttgattgtgtacggtgtagcgtt

SEQ ID NO: 2177 - DNA, 29 bp, Artificial Sequences
  Synthetic
ggttcggtttgattgtgtacggtgtagcg

SEQ ID NO: 2178 - DNA, 30 bp, Artificial Sequences; identical to SEQ ID NO: 2168
  Synthetic

SEQ ID NO: 2179 - DNA, 27 bp, Artificial Sequences
  Synthetic
ggggtcgttggtattgcggtcgtttcg

SEQ ID NO: 2180 - DNA, 27 bp, Artificial Sequences
  Synthetic
cggggtcgttggtattgcggtcgtttc

SEQ ID NO: 2181 - DNA, 27 bp, Artificial Sequences
  Synthetic
aggtttttggggttcgggagggttcga

SEQ ID NO: 2182 - DNA, 27 bp, Artificial Sequences
  Synthetic
gggtcgttggtattgcggtcgtttcgt

SEQ ID NO: 2183 - DNA, 26 bp, Artificial Sequences
  Synthetic
cggggtcgttggtattgcggtcgttt

SEQ ID NO: 2184 - DNA, 27 bp, Artificial Sequences
  Synthetic
ttttgttcgtcgtagggttggtcggtt

SEQ ID NO: 2185 - DNA, 27 bp, Artificial Sequences
  Synthetic
tttttgttcgtcgtagggttggtcggt

SEQ ID NO: 2186 - DNA, 25 bp, Artificial Sequences
  Synthetic
ttcggaggaagagtaggggcggggc

SEQ ID NO: 2187 - DNA, 24 bp, Artificial Sequences
  Synthetic
ttcggaggaagagtaggggcgggg

SEQ ID NO: 2188 - DNA, 29 bp, Artificial Sequences
  Synthetic
cgttttttgttcgtcgtagggttggtcgg

SEQ ID NO: 2189 - DNA, 27 bp, Artificial Sequences
  Synthetic
ggggtcgttggtattgcggtcgtttcg

SEQ ID NO: 2190 - DNA, 27 bp, Artificial Sequences
  Synthetic
cggggtcgttggtattgcggtcgtttc

SEQ ID NO: 2191 - DNA, 27 bp, Artificial Sequences
  Synthetic
agtagcgatggtgagggtttaggcggg

SEQ ID NO: 2192 - DNA, 27 bp, Artificial Sequences
  Synthetic
agtggcgagggtgggagagaggagttt

SEQ ID NO: 2193 - DNA, 27 bp, Artificial Sequences
  Synthetic
gtagcgatggtgagggtttaggcgggg

SEQ ID NO: 2194 - DNA, 27 bp, Artificial Sequences
  Synthetic
gcgtagggagtggagggttcgtttcgt

SEQ ID NO: 2195 - DNA, 28 bp, Artificial Sequences
  Synthetic
gcgtagggagtggagggttcgtttcgtt

SEQ ID NO: 2196 - DNA, 27 bp, Artificial Sequences
  Synthetic
cgtagggagtggagggttcgtttcgtt

SEQ ID NO: 2197 - DNA, 26 bp, Artificial Sequences
  Synthetic
gcgtagggagtggagggttcgtttcg

SEQ ID NO: 2198 - DNA, 27 bp, Artificial Sequences
  Synthetic
gggagtggagggttcgtttcgttttgt

SEQ ID NO: 2199 - DNA, 27 bp, Artificial Sequences
  Synthetic
agtggcgagggtgggagagaggagttt

SEQ ID NO: 2200 - DNA, 27 bp, Artificial Sequences
  Synthetic
cggggtcggttagttttgcgacgggta

SEQ ID NO: 2201 - DNA, 27 bp, Artificial Sequences
  Synthetic
agttttgcgacgggtagagggcgagtg

SEQ ID NO: 2202 - DNA, 27 bp, Artificial Sequences
  Synthetic
tagttttgcgacgggtagagggcgagt

SEQ ID NO: 2203 - DNA, 27 bp, Artificial Sequences
  Synthetic
ggttagttttgcgacgggtagagggcg

SEQ ID NO: 2204 - DNA, 27 bp, Artificial Sequences
  Synthetic
gcgtagggagtggagggttcgtttcgt

SEQ ID NO: 2205 - DNA, 28 bp, Artificial Sequences
  Synthetic
gcgtagggagtggagggttcgtttcgtt

SEQ ID NO: 2206 - DNA, 27 bp, Artificial Sequences
  Synthetic
gacgcggaaaaggaggtttagggaggt

SEQ ID NO: 2207 - DNA, 27 bp, Artificial Sequences
  Synthetic
cgtagggagtggagggttcgtttcgtt

SEQ ID NO: 2208 - DNA, 28 bp, Artificial Sequences
  Synthetic
agacgcggaaaaggaggtttagggaggt

SEQ ID NO: 2209 - DNA, 27 bp, Artificial Sequences
  Synthetic
ttgggagaagggtgtggttggggttgc

SEQ ID NO: 2210 - DNA, 27 bp, Artificial Sequences
  Synthetic
tttgggagaagggtgtggttggggttg

SEQ ID NO: 2211 - DNA, 27 bp, Artificial Sequences
  Synthetic
ttttgggagaagggtgtggttggggtt

SEQ ID NO: 2212 - DNA, 27 bp, Artificial Sequences
  Synthetic
tttttgggagaagggtgtggttggggt

SEQ ID NO: 2213 - DNA, 26 bp, Artificial Sequences
  Synthetic
tgggagaagggtgtggttggggttgc

SEQ ID NO: 2214 - DNA, 33 bp, Artificial Sequences
  Synthetic
aggaggaattttgagatggggttagaatagggt

SEQ ID NO: 2215 - DNA, 33 bp, Artificial Sequences
  Synthetic
ggaggaattttgagatggggttagaatagggtt

SEQ ID NO: 2216 - DNA, 34 bp, Artificial Sequences
  Synthetic
aggaggaattttgagatggggttagaatagggtt

SEQ ID NO: 2217 - DNA, 34 bp, Artificial Sequences
  Synthetic
taggaggaattttgagatggggttagaatagggt

SEQ ID NO: 2218 - DNA, 35 bp, Artificial Sequences
  Synthetic
aggaggaattttgagatggggttagaatagggtta

SEQ ID NO: 2219 - DNA, 27 bp, Artificial Sequences
  Synthetic
cgggaaggggtaggagtgggaggtttt

SEQ ID NO: 2220 - DNA, 27 bp, Artificial Sequences
  Synthetic
gcgggaaggggtaggagtgggaggttt

SEQ ID NO: 2221 - DNA, 28 bp, Artificial Sequences
  Synthetic
cgggaaggggtaggagtgggaggttttt

SEQ ID NO: 2222 - DNA, 26 bp, Artificial Sequences
  Synthetic
cgggaaggggtaggagtgggaggttt

SEQ ID NO: 2223 - DNA, 26 bp, Artificial Sequences
  Synthetic
gcgggaaggggtaggagtgggaggtt

SEQ ID NO: 2224 - DNA, 27 bp, Artificial Sequences
  Synthetic
cgggagaatgggcgtagttttttggtt

SEQ ID NO: 2225 - DNA, 28 bp, Artificial Sequences
  Synthetic
cgggagaatgggcgtagttttttggttt

SEQ ID NO: 2226 - DNA, 29 bp, Artificial Sequences
  Synthetic
cgggagaatgggcgtagttttttggtttt

SEQ ID NO: 2227 - DNA, 30 bp, Artificial Sequences
  Synthetic
cgggagaatgggcgtagttttttggttttt

SEQ ID NO: 2228 - DNA, 30 bp, Artificial Sequences
  Synthetic
tgggcgtagttttttggtttttgtatgggg

SEQ ID NO: 2229 - DNA, 27 bp, Artificial Sequences
  Synthetic
ttaggtttggtcggggttggtagcggg

SEQ ID NO: 2230 - DNA, 27 bp, Artificial Sequences
  Synthetic
ggggtacggggaggtgggagttgattt

SEQ ID NO: 2231 - DNA, 27 bp, Artificial Sequences
  Synthetic
gtttggtcggggttggtagcggggtac

SEQ ID NO: 2232 - DNA, 27 bp, Artificial Sequences
  Synthetic
gttaggtttggtcggggttggtagcgg

SEQ ID NO: 2233 - DNA, 28 bp, Artificial Sequences
  Synthetic
agttaggtttggtcggggttggtagcgg

SEQ ID NO: 2234 - DNA, 27 bp, Artificial Sequences
  Synthetic
tgtcgtgggttagggttgggtaagagt

SEQ ID NO: 2235 - DNA, 28 bp, Artificial Sequences
  Synthetic
tgtcgtgggttagggttgggtaagagtt

SEQ ID NO: 2236 - DNA, 28 bp, Artificial Sequences
  Synthetic
ttgtcgtgggttagggttgggtaagagt

SEQ ID NO: 2237 - DNA, 27 bp, Artificial Sequences
  Synthetic
gtcgtgggttagggttgggtaagagtt

SEQ ID NO: 2238 - DNA, 27 bp, Artificial Sequences
  Synthetic
ttgtcgtgggttagggttgggtaagag

SEQ ID NO: 2239 - DNA, 27 bp, Artificial Sequences
  Synthetic
agggcggcgtagtttgtggggtttttg

SEQ ID NO: 2240 - DNA, 27 bp, Artificial Sequences
  Synthetic
tttcggttcgggttgtaggaggcgtgt

SEQ ID NO: 2241 - DNA, 27 bp, Artificial Sequences
  Synthetic
gttggtaagggcggcgtagtttgtggg

SEQ ID NO: 2242 - DNA, 27 bp, Artificial Sequences
  Synthetic
tgggtttcggttcgggttgtaggaggc

SEQ ID NO: 2243 - DNA, 27 bp, Artificial Sequences
  Synthetic
gagcgttgggtatgggtttcggttcgg

SEQ ID NO: 2244 - DNA, 27 bp, Artificial Sequences
  Synthetic
ggggttcgtacggttggaggcgtagtt

SEQ ID NO: 2245 - DNA, 27 bp, Artificial Sequences
  Synthetic
ggttggggttggcggggtttatttggg

SEQ ID NO: 2246 - DNA, 27 bp, Artificial Sequences
  Synthetic
tttggttcgtgtgttggtggcggttgt

SEQ ID NO: 2247 - DNA, 27 bp, Artificial Sequences
  Synthetic
ggggttggcggggtttatttgggatgg

SEQ ID NO: 2248 - DNA, 27 bp, Artificial Sequences
  Synthetic
ggttggaggcgtagttttggtcgggga

SEQ ID NO: 2249 - DNA, 27 bp, Artificial Sequences
  Synthetic
tttcggttcgggttgtaggaggcgtgt

SEQ ID NO: 2250 - DNA, 27 bp, Artificial Sequences
  Synthetic
ggagtcggtggaagaggagaagagcgc

SEQ ID NO: 2251 - DNA, 27 bp, Artificial Sequences
  Synthetic
gagtcggtggaagaggagaagagcgcg

SEQ ID NO: 2252 - DNA, 27 bp, Artificial Sequences
  Synthetic
gggagtcggtggaagaggagaagagcg

SEQ ID NO: 2253 - DNA, 27 bp, Artificial Sequences
  Synthetic
tgggtttcggttcgggttgtaggaggc

SEQ ID NO: 2254 - DNA, 27 bp, Artificial Sequences
  Synthetic
aggcggaaggattggattcggggttgt

SEQ ID NO: 2255 - DNA, 27 bp, Artificial Sequences
  Synthetic
cgaggcggaaggattggattcggggtt

SEQ ID NO: 2256 - DNA, 27 bp, Artificial Sequences
  Synthetic
gaggcggaaggattggattcggggttg

SEQ ID NO: 2257 - DNA, 27 bp, Artificial Sequences
  Synthetic
ggcggaaggattggattcggggttgtt

SEQ ID NO: 2258 - DNA, 28 bp, Artificial Sequences
  Synthetic
aggcggaaggattggattcggggttgtt

SEQ ID NO: 2259 - DNA, 28 bp, Artificial Sequences
  Synthetic
ggggatatggggagttggttgaaggcgt

SEQ ID NO: 2260 - DNA, 27 bp, Artificial Sequences
  Synthetic
ggggatatggggagttggttgaaggcg

SEQ ID NO: 2261 - DNA, 27 bp, Artificial Sequences
  Synthetic
cggggatatggggagttggttgaaggc

SEQ ID NO: 2262 - DNA, 28 bp, Artificial Sequences
  Synthetic
tcggggatatggggagttggttgaaggc

SEQ ID NO: 2263 - DNA, 28 bp, Artificial Sequences
  Synthetic
gggagttggttgaaggcgtaaaggagcg

SEQ ID NO: 2264 - DNA, 27 bp, Artificial Sequences
  Synthetic
gcgtggtggcgttgtgtttggtttgag

SEQ ID NO: 2265 - DNA, 27 bp, Artificial Sequences
  Synthetic
cggtggtggcgggaagttttaggtcgt

SEQ ID NO: 2266 - DNA, 27 bp, Artificial Sequences
  Synthetic
cgtggtggcgttgtgtttggtttgagg

SEQ ID NO: 2267 - DNA, 26 bp, Artificial Sequences
  Synthetic
gcggtggtggcgggaagttttaggtc

SEQ ID NO: 2268 - DNA, 28 bp, Artificial Sequences
  Synthetic
cgtggtggcgttgtgtttggtttgaggt

SEQ ID NO: 2269 - DNA, 27 bp, Artificial Sequences
  Synthetic
gttggttcgttttagcgggcgggagac

SEQ ID NO: 2270 - DNA, 27 bp, Artificial Sequences
  Synthetic
ggggttcggggagattttggaggtcgt

SEQ ID NO: 2271 - DNA, 27 bp, Artificial Sequences
  Synthetic
ggttaggtttcgcgtgttggggttcgg

SEQ ID NO: 2272 - DNA, 27 bp, Artificial Sequences
  Synthetic
gggttaggtttcgcgtgttggggttcg

SEQ ID NO: 2273 - DNA, 27 bp, Artificial Sequences
  Synthetic
tggggttcggggagattttggaggtcg

SEQ ID NO: 2274 - DNA, 27 bp, Artificial Sequences
  Synthetic
ggcggaaagtaggatggggaggcgttt

SEQ ID NO: 2275 - DNA, 27 bp, Artificial Sequences
  Synthetic
acggataaggcggaggaggtggtttgt

SEQ ID NO: 2276 - DNA, 27 bp, Artificial Sequences
  Synthetic
aggagaaggggtttttagggtcggcgt

SEQ ID NO: 2277 - DNA, 27 bp, Artificial Sequences
  Synthetic
ggttacggataaggcggaggaggtggt

SEQ ID NO: 2278 - DNA, 27 bp, Artificial Sequences
  Synthetic
gcggaaagtaggatggggaggcgtttt

SEQ ID NO: 2279 - DNA, 27 bp, Artificial Sequences
  Synthetic
tttggtacgggttttttcgggtggcgg

SEQ ID NO: 2280 - DNA, 27 bp, Artificial Sequences
  Synthetic
tggtacgggttttttcgggtggcggta

SEQ ID NO: 2281 - DNA, 27 bp, Artificial Sequences
  Synthetic
agggcgtcggtggtttaggtttagggt

SEQ ID NO: 2282 - DNA, 27 bp, Artificial Sequences
  Synthetic
ggtacgggttttttcgggtggcggtaa

SEQ ID NO: 2283 - DNA, 27 bp, Artificial Sequences
  Synthetic
gcggtaagggcgtcggtggtttaggtt

SEQ ID NO: 2284 - DNA, 27 bp, Artificial Sequences
  Synthetic
gtttacggttagcgtggaggagggggg

SEQ ID NO: 2285 - DNA, 27 bp, Artificial Sequences
  Synthetic
gttagcgtggaggaggggggcgttttc

SEQ ID NO: 2286 - DNA, 26 bp, Artificial Sequences
  Synthetic
tttacggttagcgtggaggagggggg

SEQ ID NO: 2287 - DNA, 26 bp, Artificial Sequences
  Synthetic
ttagcgtggaggaggggggcgttttc

SEQ ID NO: 2288 - DNA, 27 bp, Artificial Sequences
  Synthetic
tttacggttagcgtggaggaggggggc

SEQ ID NO: 2289 - DNA, 27 bp, Artificial Sequences
  Synthetic
cgaggaggggggttggggtagaataat

SEQ ID NO: 2290 - DNA, 28 bp, Artificial Sequences
  Synthetic
cgaggaggggggttggggtagaataatt

SEQ ID NO: 2291 - DNA, 26 bp, Artificial Sequences
  Synthetic
cgaggaggggggttggggtagaataa

SEQ ID NO: 2292 - DNA, 29 bp, Artificial Sequences
  Synthetic
tgttttgttttgttttgttttgcgcgcgt

SEQ ID NO: 2293 - DNA, 28 bp, Artificial Sequences
  Synthetic
gttttgttttgttttgttttgcgcgcgt

SEQ ID NO: 2294 - DNA, 27 bp, Artificial Sequences
  Synthetic
gagggtagagcggcggggaatagtgtg

SEQ ID NO: 2295 - DNA, 27 bp, Artificial Sequences
  Synthetic
tcggtgagcgcgttttagaggagtcgt

SEQ ID NO: 2296 - DNA, 27 bp, Artificial Sequences
  Synthetic
gttggtttgggtcgggttgggtcgttt

SEQ ID NO: 2297 - DNA, 27 bp, Artificial Sequences
  Synthetic
taggttggtttgggtcgggttgggtcg

SEQ ID NO: 2298 - DNA, 27 bp, Artificial Sequences
  Synthetic
agagggtagagcggcggggaatagtgt

SEQ ID NO: 2299 - DNA, 29 bp, Artificial Sequences
  Synthetic
tgttttgttttgttttgttttgcgcgcgt

SEQ ID NO: 2300 - DNA, 28 bp, Artificial Sequences
  Synthetic
gttttgttttgttttgttttgcgcgcgt

SEQ ID NO: 2301 - DNA, 28 bp, Artificial Sequences
  Synthetic
tgttttgttttgttttgttttgcgcgcg

SEQ ID NO: 2302 - DNA, 29 bp, Artificial Sequences
  Synthetic
ttgttttgttttgttttgttttgcgcgcg

SEQ ID NO: 2303 - DNA, 30 bp, Artificial Sequences
  Synthetic
ttgttttgttttgttttgttttgcgcgcgt

SEQ ID NO: 2304 - DNA, 27 bp, Artificial Sequences
  Synthetic
gttggtttgggtcgggttgggtcgttt

SEQ ID NO: 2305 - DNA, 27 bp, Artificial Sequences
  Synthetic
taggttggtttgggtcgggttgggtcg

SEQ ID NO: 2306 - DNA, 27 bp, Artificial Sequences
  Synthetic
ttggtttgggtcgggttgggtcgtttt

SEQ ID NO: 2307 - DNA, 27 bp, Artificial Sequences
  Synthetic
ggttggtttgggtcgggttgggtcgtt

SEQ ID NO: 2308 - DNA, 28 bp, Artificial Sequences
  Synthetic
gttggtttgggtcgggttgggtcgtttt

SEQ ID NO: 2309 - DNA, 27 bp, Artificial Sequences
  Synthetic
gttgtttttgtggggaggtagcgcggt

SEQ ID NO: 2310 - DNA, 27 bp, Artificial Sequences
  Synthetic
tcgttgtttttgtggggaggtagcgcg

SEQ ID NO: 2311 - DNA, 27 bp, Artificial Sequences
  Synthetic
cgttgtttttgtggggaggtagcgcgg

SEQ ID NO: 2312 - DNA, 27 bp, Artificial Sequences
  Synthetic
tgtttttgtggggaggtagcgcggttt

SEQ ID NO: 2313 - DNA, 27 bp, Artificial Sequences
  Synthetic
ttgtttttgtggggaggtagcgcggtt

SEQ ID NO: 2314 - DNA, 27 bp, Artificial Sequences
  Synthetic
agcggggtgggtagtcggcgttatttt

SEQ ID NO: 2315 - DNA, 27 bp, Artificial Sequences
  Synthetic
agagagggttatagagggaggcgcgga

SEQ ID NO: 2316 - DNA, 27 bp, Artificial Sequences
  Synthetic
gagcggggtgggtagtcggcgttattt

SEQ ID NO: 2317 - DNA, 27 bp, Artificial Sequences
  Synthetic
gcggggtgggtagtcggcgttattttt

SEQ ID NO: 2318 - DNA, 27 bp, Artificial Sequences
  Synthetic
gagagggttatagagggaggcgcggag

SEQ ID NO: 2319 - DNA, 27 bp, Artificial Sequences
  Synthetic
tgtagtggcgagaggagggagtagcgt

SEQ ID NO: 2320 - DNA, 27 bp, Artificial Sequences
  Synthetic
tgggggtggttggggagagggtgatat

SEQ ID NO: 2321 - DNA, 27 bp, Artificial Sequences
  Synthetic
ttgggggtggttggggagagggtgata

SEQ ID NO: 2322 - DNA, 27 bp, Artificial Sequences
  Synthetic
gtagtggcgagaggagggagtagcgtt

SEQ ID NO: 2323 - DNA, 27 bp, Artificial Sequences
  Synthetic
tttgggggtggttggggagagggtgat

SEQ ID NO: 2324 - DNA, 27 bp, Artificial Sequences
  Synthetic
ggcgggggataaaggcggatatttcga

SEQ ID NO: 2325 - DNA, 28 bp, Artificial Sequences
  Synthetic
ggcgggggataaaggcggatatttcgag

SEQ ID NO: 2326 - DNA, 29 bp, Artificial Sequences
  Synthetic
ggcgggggataaaggcggatatttcgagt

SEQ ID NO: 2327 - DNA, 28 bp, Artificial Sequences
  Synthetic
gcgggggataaaggcggatatttcgagt

SEQ ID NO: 2328 - DNA, 27 bp, Artificial Sequences
  Synthetic
gcgggggataaaggcggatatttcgag

SEQ ID NO: 2329 - DNA, 27 bp, Artificial Sequences
  Synthetic
tgtagtggcgagaggagggagtagcgt

SEQ ID NO: 2330 - DNA, 27 bp, Artificial Sequences
  Synthetic
gtttatcgggaggggttcgggcgagag

SEQ ID NO: 2331 - DNA, 27 bp, Artificial Sequences
  Synthetic
tgggtgcgtgagtgtttgtgtgcgttc

SEQ ID NO: 2332 - DNA, 27 bp, Artificial Sequences
  Synthetic
ggtgcgtgagtgtttgtgtgcgttcgt

SEQ ID NO: 2333 - DNA, 27 bp, Artificial Sequences
  Synthetic
gtgggtgcgtgagtgtttgtgtgcgtt

SEQ ID NO: 2334 - DNA, 27 bp, Artificial Sequences
  Synthetic
ttgttttcgaggtgtttgggggtcgcg

SEQ ID NO: 2335 - DNA, 27 bp, Artificial Sequences
  Synthetic
cgagggttgtttatcggtcgcgcgtag

SEQ ID NO: 2336 - DNA, 28 bp, Artificial Sequences
  Synthetic
tttgttttcgaggtgtttgggggtcgcg

SEQ ID NO: 2337 - DNA, 26 bp, Artificial Sequences
  Synthetic
tgttttcgaggtgtttgggggtcgcg

SEQ ID NO: 2338 - DNA, 27 bp, Artificial Sequences
  Synthetic
gagggttgtttatcggtcgcgcgtaga

SEQ ID NO: 2339 - DNA, 27 bp, Artificial Sequences
  Synthetic
tagggttcgaaattgaggtggggggcg

SEQ ID NO: 2340 - DNA, 27 bp, Artificial Sequences
  Synthetic
gggttcgaaattgaggtggggggcgta

SEQ ID NO: 2341 - DNA, 27 bp, Artificial Sequences
  Synthetic
ggttcgaaattgaggtggggggcgtat

SEQ ID NO: 2342 - DNA, 28 bp, Artificial Sequences
  Synthetic
ttagggttcgaaattgaggtggggggcg

SEQ ID NO: 2343 - DNA, 28 bp, Artificial Sequences
  Synthetic
gggttcgaaattgaggtggggggcgtat

SEQ ID NO: 2344 - DNA, 31 bp, Artificial Sequences
  Synthetic
gcgaaaggttatgggttggaataagttagcg

SEQ ID NO: 2345 - DNA, 32 bp, Artificial Sequences
  Synthetic
gcgaaaggttatgggttggaataagttagcgt

SEQ ID NO: 2346 - DNA, 33 bp, Artificial Sequences
  Synthetic
gcgaaaggttatgggttggaataagttagcgta

SEQ ID NO: 2347 - DNA, 34 bp, Artificial Sequences
  Synthetic
gcgaaaggttatgggttggaataagttagcgtat

SEQ ID NO: 2348 - DNA, 27 bp, Artificial Sequences
  Synthetic
tagggttcgaaattgaggtggggggcg

SEQ ID NO: 2349 - DNA, 27 bp, Artificial Sequences
  Synthetic
gggttcgaaattgaggtggggggcgta

SEQ ID NO: 2350 - DNA, 27 bp, Artificial Sequences
  Synthetic
ggttcgaaattgaggtggggggcgtat

SEQ ID NO: 2351 - DNA, 28 bp, Artificial Sequences
  Synthetic
ttagggttcgaaattgaggtggggggcg

SEQ ID NO: 2352 - DNA, 28 bp, Artificial Sequences
  Synthetic
gggttcgaaattgaggtggggggcgtat

SEQ ID NO: 2353 - DNA, 27 bp, Artificial Sequences
  Synthetic
gggattgcggagtggaggtaaggtcgg

SEQ ID NO: 2354 - DNA, 27 bp, Artificial Sequences
  Synthetic
tgggattgcggagtggaggtaaggtcg

SEQ ID NO: 2355 - DNA, 27 bp, Artificial Sequences
  Synthetic
attgcggagtggaggtaaggtcggagg

SEQ ID NO: 2356 - DNA, 27 bp, Artificial Sequences
  Synthetic
ggattgcggagtggaggtaaggtcgga

SEQ ID NO: 2357 - DNA, 27 bp, Artificial Sequences
  Synthetic
cgtacggggcggtggagtttttgggta

SEQ ID NO: 2358 - DNA, 27 bp, Artificial Sequences
  Synthetic
ggagacggggtttgggggagcgatttt

SEQ ID NO: 2359 - DNA, 27 bp, Artificial Sequences
  Synthetic
cgtgggttaagcgtcgggggttgttta

SEQ ID NO: 2360 - DNA, 26 bp, Artificial Sequences
  Synthetic
cgtgggttaagcgtcgggggttgttt

SEQ ID NO: 2361 - DNA, 27 bp, Artificial Sequences
  Synthetic
gcgtgggttaagcgtcgggggttgttt

SEQ ID NO: 2362 - DNA, 26 bp, Artificial Sequences
  Synthetic
ggagacggggtttgggggagcgattt

SEQ ID NO: 2363 - DNA, 27 bp, Artificial Sequences
  Synthetic
gcggggagattttgagatcgcggtgtg

SEQ ID NO: 2364 - DNA, 26 bp, Artificial Sequences
  Synthetic
gcggggagattttgagatcgcggtgt

SEQ ID NO: 2365 - DNA, 28 bp, Artificial Sequences
  Synthetic
tgtttgtgtttggttcggtgagggtcgt

SEQ ID NO: 2366 - DNA, 27 bp, Artificial Sequences
  Synthetic
gtttgtgtttggttcggtgagggtcgt

SEQ ID NO: 2367 - DNA, 27 bp, Artificial Sequences
  Synthetic
tgtttgtgtttggttcggtgagggtcg

SEQ ID NO: 2368 - DNA, 28 bp, Artificial Sequences
  Synthetic
tggcgggcggattgggtatagtttttgt

SEQ ID NO: 2369 - DNA, 27 bp, Artificial Sequences
  Synthetic
ggcgggcggattgggtatagtttttgt

SEQ ID NO: 2370 - DNA, 27 bp, Artificial Sequences
  Synthetic
tggcgggcggattgggtatagtttttg

SEQ ID NO: 2371 - DNA, 27 bp, Artificial Sequences
  Synthetic
ttggcgggcggattgggtatagttttt

SEQ ID NO: 2372 - DNA, 27 bp, Artificial Sequences
  Synthetic
tttggcgggcggattgggtatagtttt

SEQ ID NO: 2373 - DNA, 27 bp, Artificial Sequences
  Synthetic
gcggggagattttgagatcgcggtgtg

SEQ ID NO: 2374 - DNA, 27 bp, Artificial Sequences
  Synthetic
gggcgtcggtagtagggtaaggtaggg

SEQ ID NO: 2375 - DNA, 28 bp, Artificial Sequences
  Synthetic
gggcgtcggtagtagggtaaggtaggga

SEQ ID NO: 2376 - DNA, 26 bp, Artificial Sequences
  Synthetic
gcggggagattttgagatcgcggtgt

SEQ ID NO: 2377 - DNA, 27 bp, Artificial Sequences
  Synthetic
ggcgtcggtagtagggtaaggtaggga

SEQ ID NO: 2378 - DNA, 27 bp, Artificial Sequences
  Synthetic
tgcggggggaagggggaatggttttta

SEQ ID NO: 2379 - DNA, 27 bp, Artificial Sequences
  Synthetic
ttgttaaagtgcggggggaagggggaa

SEQ ID NO: 2380 - DNA, 27 bp, Artificial Sequences
  Synthetic
tttgttaaagtgcggggggaaggggga

SEQ ID NO: 2381 - DNA, 27 bp, Artificial Sequences
  Synthetic
tgttaaagtgcggggggaagggggaat

SEQ ID NO: 2382 - DNA, 27 bp, Artificial Sequences
  Synthetic
ttaaagtgcggggggaagggggaatgg

SEQ ID NO: 2383 - DNA, 33 bp, Artificial Sequences
  Synthetic
tgggttttaaggttaaggatgtttggttacgga

SEQ ID NO: 2384 - DNA, 34 bp, Artificial Sequences
  Synthetic
tgggttttaaggttaaggatgtttggttacggag

SEQ ID NO: 2385 - DNA, 34 bp, Artificial Sequences
  Synthetic
gggttttaaggttaaggatgtttggttacggaga

SEQ ID NO: 2386 - DNA, 34 bp, Artificial Sequences
  Synthetic
ttgggttttaaggttaaggatgtttggttacgga

SEQ ID NO: 2387 - DNA, 35 bp, Artificial Sequences
  Synthetic
tgggttttaaggttaaggatgtttggttacggaga

SEQ ID NO: 2388 - DNA, 27 bp, Artificial Sequences
  Synthetic
cgtcggcggtttttcgtggttaagtat

SEQ ID NO: 2389 - DNA, 28 bp, Artificial Sequences
  Synthetic
cgtcggcggtttttcgtggttaagtatt

SEQ ID NO: 2390 - DNA, 26 bp, Artificial Sequences
  Synthetic
cgtcggcggtttttcgtggttaagta

SEQ ID NO: 2391 - DNA, 28 bp, Artificial Sequences
  Synthetic
tggttttggagtttaggggttgcgtttt

SEQ ID NO: 2392 - DNA, 28 bp, Artificial Sequences
  Synthetic
ttggttttggagtttaggggttgcgttt

SEQ ID NO: 2393 - DNA, 27 bp, Artificial Sequences
  Synthetic
ggcgtcgcgttagagggttgagggtta

SEQ ID NO: 2394 - DNA, 28 bp, Artificial Sequences
  Synthetic
ggcgtcgcgttagagggttgagggttaa

SEQ ID NO: 2395 - DNA, 27 bp, Artificial Sequences
  Synthetic
gcgtcgcgttagagggttgagggttaa

SEQ ID NO: 2396 - DNA, 27 bp, Artificial Sequences
  Synthetic
gcgttagagggttgagggttaagcggt

SEQ ID NO: 2397 - DNA, 26 bp, Artificial Sequences
  Synthetic
ggcgtcgcgttagagggttgagggtt

SEQ ID NO: 2398 - DNA, 27 bp, Artificial Sequences
  Synthetic
ttcggtggtattcgttcgtgcgttggg

SEQ ID NO: 2399 - DNA, 27 bp, Artificial Sequences
  Synthetic
gggcgggagagaggatttcggtggtat

SEQ ID NO: 2400 - DNA, 27 bp, Artificial Sequences
  Synthetic
ggggcgggagagaggatttcggtggta

SEQ ID NO: 2401 - DNA, 28 bp, Artificial Sequences
  Synthetic
tttcggtggtattcgttcgtgcgttggg

SEQ ID NO: 2402 - DNA, 28 bp, Artificial Sequences
  Synthetic
gggcgggagagaggatttcggtggtatt

SEQ ID NO: 2403 - DNA, 27 bp, Artificial Sequences
  Synthetic
ggcgtcgcgttagagggttgagggtta

SEQ ID NO: 2404 - DNA, 28 bp, Artificial Sequences
  Synthetic
ggcgtcgcgttagagggttgagggttaa

SEQ ID NO: 2405 - DNA, 27 bp, Artificial Sequences
  Synthetic
gcgtcgcgttagagggttgagggttaa

SEQ ID NO: 2406 - DNA, 27 bp, Artificial Sequences
  Synthetic
gcgttagagggttgagggttaagcggt

SEQ ID NO: 2407 - DNA, 26 bp, Artificial Sequences
  Synthetic
ggcgtcgcgttagagggttgagggtt

SEQ ID NO: 2408 - DNA, 27 bp, Artificial Sequences
  Synthetic
ttggcgcggcgtttattcgttgggttt

SEQ ID NO: 2409 - DNA, 27 bp, Artificial Sequences
  Synthetic
tttggcgcggcgtttattcgttgggtt

SEQ ID NO: 2410 - DNA, 27 bp, Artificial Sequences
  Synthetic
ttttggcgcggcgtttattcgttgggt

SEQ ID NO: 2411 - DNA, 27 bp, Artificial Sequences
  Synthetic
ttcggtggtattcgttcgtgcgttggg

SEQ ID NO: 2412 - DNA, 27 bp, Artificial Sequences
  Synthetic
tttttggcgcggcgtttattcgttggg

SEQ ID NO: 2413 - DNA, 27 bp, Artificial Sequences
  Synthetic
ggttaggatagtaggtcgcgcggggga

SEQ ID NO: 2414 - DNA, 27 bp, Artificial Sequences
  Synthetic
agggttaggatagtaggtcgcgcgggg

SEQ ID NO: 2415 - DNA, 26 bp, Artificial Sequences
  Synthetic
ggttaggatagtaggtcgcgcggggg

SEQ ID NO: 2416 - DNA, 26 bp, Artificial Sequences
  Synthetic
gggttaggatagtaggtcgcgcgggg

SEQ ID NO: 2417 - DNA, 27 bp, Artificial Sequences
  Synthetic
tagggttaggatagtaggtcgcgcggg

SEQ ID NO: 2418 - DNA, 27 bp, Artificial Sequences
  Synthetic
tcgcgcggtttgttgttttggttttga

SEQ ID NO: 2419 - DNA, 27 bp, Artificial Sequences
  Synthetic
gcggtcgcgtttgttcgttcgtatttt

SEQ ID NO: 2420 - DNA, 30 bp, Artificial Sequences
  Synthetic
gcgcggtttgttgttttggttttgatcggg

SEQ ID NO: 2421 - DNA, 30 bp, Artificial Sequences
  Synthetic
cgcgcggtttgttgttttggttttgatcgg

SEQ ID NO: 2422 - DNA, 27 bp, Artificial Sequences
  Synthetic
ttcgcgcggtttgttgttttggttttg

SEQ ID NO: 2423 - DNA, 30 bp, Artificial Sequences
  Synthetic
agttcggttagggttaggatagtaggtcgt

SEQ ID NO: 2424 - DNA, 32 bp, Artificial Sequences
  Synthetic
gcgttagttcggttagggttaggatagtaggt

SEQ ID NO: 2425 - DNA, 34 bp, Artificial Sequences
  Synthetic
gcgttagttcggttagggttaggatagtaggtcg

SEQ ID NO: 2426 - DNA, 35 bp, Artificial Sequences
  Synthetic
gcgttagttcggttagggttaggatagtaggtcgt

SEQ ID NO: 2427 - DNA, 33 bp, Artificial Sequences
  Synthetic
gcgttagttcggttagggttaggatagtaggtc

SEQ ID NO: 2428 - DNA, 28 bp, Artificial Sequences
  Synthetic
gcgttagaagcggtagttgtgggatcgg

SEQ ID NO: 2429 - DNA, 29 bp, Artificial Sequences
  Synthetic
gcgttagaagcggtagttgtgggatcgga

SEQ ID NO: 2430 - DNA, 27 bp, Artificial Sequences
  Synthetic
gcgttagaagcggtagttgtgggatcg

SEQ ID NO: 2431 - DNA, 27 bp, Artificial Sequences
  Synthetic
cgttagaagcggtagttgtgggatcgg

SEQ ID NO: 2432 - DNA, 28 bp, Artificial Sequences
  Synthetic
cgttagaagcggtagttgtgggatcgga

SEQ ID NO: 2433 - DNA, 31 bp, Artificial Sequences
  Synthetic
ttttgtggaagttaggtttgtagtcggaggt

SEQ ID NO: 2434 - DNA, 32 bp, Artificial Sequences
  Synthetic
tttttgtggaagttaggtttgtagtcggaggt

SEQ ID NO: 2435 - DNA, 33 bp, Artificial Sequences
  Synthetic
ttttttgtggaagttaggtttgtagtcggaggt

SEQ ID NO: 2436 - DNA, 33 bp, Artificial Sequences
  Synthetic
ttttgtggaagttaggtttgtagtcggaggtaa

SEQ ID NO: 2437 - DNA, 33 bp, Artificial Sequences
  Synthetic
tttttgtggaagttaggtttgtagtcggaggta

SEQ ID NO: 2438 - DNA, 28 bp, Artificial Sequences
  Synthetic
gcgttagaagcggtagttgtgggatcgg

SEQ ID NO: 2439 - DNA, 29 bp, Artificial Sequences
  Synthetic
gcgttagaagcggtagttgtgggatcgga

SEQ ID NO: 2440 - DNA, 28 bp, Artificial Sequences
  Synthetic
tgggttttgacgaagcggtaggtgttgt

SEQ ID NO: 2441 - DNA, 27 bp, Artificial Sequences
  Synthetic
gggttttgacgaagcggtaggtgttgt

SEQ ID NO: 2442 - DNA, 27 bp, Artificial Sequences
  Synthetic
tgggttttgacgaagcggtaggtgttg

SEQ ID NO: 2443 - DNA, 31 bp, Artificial Sequences; identical to SEQ ID NO: 2433
  Synthetic

SEQ ID NO: 2444 - DNA, 32 bp, Artificial Sequences; identical to SEQ ID NO: 2434
  Synthetic

SEQ ID NO: 2445 - DNA, 33 bp, Artificial Sequences; identical to SEQ ID NO: 2435
  Synthetic

SEQ ID NO: 2446 - DNA, 33 bp, Artificial Sequences; identical to SEQ ID NO: 2436
  Synthetic

SEQ ID NO: 2447 - DNA, 33 bp, Artificial Sequences; identical to SEQ ID NO: 2437
  Synthetic

SEQ ID NO: 2448 - DNA, 27 bp, Artificial Sequences
  Synthetic
gggggcggcgaggttgtaaggttgtat

SEQ ID NO: 2449 - DNA, 27 bp, Artificial Sequences
  Synthetic
ggcgcgggagaaggttgtaagggtttt

SEQ ID NO: 2450 - DNA, 27 bp, Artificial Sequences
  Synthetic
cggcgcgggagaaggttgtaagggttt

SEQ ID NO: 2451 - DNA, 28 bp, Artificial Sequences
  Synthetic
gggggcggcgaggttgtaaggttgtata

SEQ ID NO: 2452 - DNA, 28 bp, Artificial Sequences
  Synthetic
gggtttttggttttcgacgcggtttggg

SEQ ID NO: 2453 - DNA, 27 bp, Artificial Sequences
  Synthetic
tcggttagaggtggcgggtttatgcgt

SEQ ID NO: 2454 - DNA, 27 bp, Artificial Sequences
  Synthetic
aggaagtcggttagaggtggcgggttt

SEQ ID NO: 2455 - DNA, 27 bp, Artificial Sequences
  Synthetic
aaggaagtcggttagaggtggcgggtt

SEQ ID NO: 2456 - DNA, 27 bp, Artificial Sequences
  Synthetic
aaaggaagtcggttagaggtggcgggt

SEQ ID NO: 2457 - DNA, 27 bp, Artificial Sequences
  Synthetic
agtcgggggaagtaacgggttaagcgt

SEQ ID NO: 2458 - DNA, 28 bp, Artificial Sequences
  Synthetic
gcgttgagattttggtatggggttgcgt

SEQ ID NO: 2459 - DNA, 28 bp, Artificial Sequences
  Synthetic
tgcgttgagattttggtatggggttgcg

SEQ ID NO: 2460 - DNA, 29 bp, Artificial Sequences
  Synthetic
tgcgttgagattttggtatggggttgcgt

SEQ ID NO: 2461 - DNA, 27 bp, Artificial Sequences
  Synthetic
gcgttgagattttggtatggggttgcg

SEQ ID NO: 2462 - DNA, 27 bp, Artificial Sequences
  Synthetic
tgcgttgagattttggtatggggttgc

SEQ ID NO: 2463 - DNA, 27 bp, Artificial Sequences
  Synthetic
cgtagtcggtagggagaaggaaggggt

SEQ ID NO: 2464 - DNA, 27 bp, Artificial Sequences
  Synthetic
tgagcgaggtgaaggaggttttgggtt

SEQ ID NO: 2465 - DNA, 27 bp, Artificial Sequences
  Synthetic
ttgagcgaggtgaaggaggttttgggt

SEQ ID NO: 2466 - DNA, 29 bp, Artificial Sequences
  Synthetic
gcgaggtgaaggaggttttgggttttcgg

SEQ ID NO: 2467 - DNA, 28 bp, Artificial Sequences
  Synthetic
cgtagtcggtagggagaaggaaggggtt

SEQ ID NO: 2468 - DNA, 28 bp, Artificial Sequences
  Synthetic
gcgttgagattttggtatggggttgcgt

SEQ ID NO: 2469 - DNA, 28 bp, Artificial Sequences
  Synthetic
tgcgttgagattttggtatggggttgcg

SEQ ID NO: 2470 - DNA, 29 bp, Artificial Sequences
  Synthetic
tgcgttgagattttggtatggggttgcgt

SEQ ID NO: 2471 - DNA, 27 bp, Artificial Sequences
  Synthetic
gcgttgagattttggtatggggttgcg

SEQ ID NO: 2472 - DNA, 27 bp, Artificial Sequences
  Synthetic
tgcgttgagattttggtatggggttgc

SEQ ID NO: 2473 - DNA, 27 bp, Artificial Sequences
  Synthetic
ggtgtgggaggtggatcgggaaatgga

SEQ ID NO: 2474 - DNA, 27 bp, Artificial Sequences
  Synthetic
taattgtagcgggggtgtgggaggtgg

SEQ ID NO: 2475 - DNA, 27 bp, Artificial Sequences
  Synthetic
gggtgtgggaggtggatcgggaaatgg

SEQ ID NO: 2476 - DNA, 27 bp, Artificial Sequences
  Synthetic
ggggtgtgggaggtggatcgggaaatg

SEQ ID NO: 2477 - DNA, 27 bp, Artificial Sequences
  Synthetic
attgtagcgggggtgtgggaggtggat

SEQ ID NO: 2478 - DNA, 27 bp, Artificial Sequences
  Synthetic
ggggagtaggaggggtgtgtgttgtgg

SEQ ID NO: 2479 - DNA, 27 bp, Artificial Sequences
  Synthetic
cggggagtaggaggggtgtgtgttgtg

SEQ ID NO: 2480 - DNA, 27 bp, Artificial Sequences
  Synthetic
tgtggtaggggttggggtaggtgggta

SEQ ID NO: 2481 - DNA, 27 bp, Artificial Sequences
  Synthetic
gggtatggggaaaggggttgtaggcgt

SEQ ID NO: 2482 - DNA, 27 bp, Artificial Sequences
  Synthetic
gtgggtaggggagaggcgagggttttg

SEQ ID NO: 2483 - DNA, 27 bp, Artificial Sequences
  Synthetic
gaggaggggtaggttgagggaggaggg

SEQ ID NO: 2484 - DNA, 27 bp, Artificial Sequences
  Synthetic
ggttgagggaggagggggacgggatat

SEQ ID NO: 2485 - DNA, 27 bp, Artificial Sequences
  Synthetic
tgaggaggggtaggttgagggaggagg

SEQ ID NO: 2486 - DNA, 26 bp, Artificial Sequences
  Synthetic
aggaggggtaggttgagggaggaggg

SEQ ID NO: 2487 - DNA, 27 bp, Artificial Sequences
  Synthetic
aggttgagggaggagggggacgggata

SEQ ID NO: 2488 - DNA, 29 bp, Artificial Sequences
  Synthetic
agcggtagagagtaagggtttagttcggt

SEQ ID NO: 2489 - DNA, 29 bp, Artificial Sequences
  Synthetic
tgggtagcggtagagagtaagggtttagt

SEQ ID NO: 2490 - DNA, 29 bp, Artificial Sequences
  Synthetic
gcggtagagagtaagggtttagttcggtt

SEQ ID NO: 2491 - DNA, 30 bp, Artificial Sequences
  Synthetic
agcggtagagagtaagggtttagttcggtt

SEQ ID NO: 2492 - DNA, 32 bp, Artificial Sequences
  Synthetic
gggtagcggtagagagtaagggtttagttcgg

SEQ ID NO: 2493 - DNA, 27 bp, Artificial Sequences
  Synthetic
cggcggtggtaggaggagtgagtgttt

SEQ ID NO: 2494 - DNA, 27 bp, Artificial Sequences
  Synthetic
tttcggcggtggtaggaggagtgagtg

SEQ ID NO: 2495 - DNA, 27 bp, Artificial Sequences
  Synthetic
tcggcggtggtaggaggagtgagtgtt

SEQ ID NO: 2496 - DNA, 27 bp, Artificial Sequences
  Synthetic
ttcggcggtggtaggaggagtgagtgt

SEQ ID NO: 2497 - DNA, 27 bp, Artificial Sequences
  Synthetic
ttttcggcggtggtaggaggagtgagt

SEQ ID NO: 2498 - DNA, 27 bp, Artificial Sequences
  Synthetic
cgtcggaagggttaggggaaggttagg

SEQ ID NO: 2499 - DNA, 28 bp, Artificial Sequences
  Synthetic
cgtcggaagggttaggggaaggttagga

SEQ ID NO: 2500 - DNA, 28 bp, Artificial Sequences
  Synthetic
tcgtcggaagggttaggggaaggttagg

SEQ ID NO: 2501 - DNA, 29 bp, Artificial Sequences
  Synthetic
tcgtcggaagggttaggggaaggttagga

SEQ ID NO: 2502 - DNA, 27 bp, Artificial Sequences
  Synthetic
cggaagggttaggggaaggttaggagg

SEQ ID NO: 2503 - DNA, 27 bp, Artificial Sequences
  Synthetic
gcggttatagagttcgagcggggggtc

SEQ ID NO: 2504 - DNA, 26 bp, Artificial Sequences
  Synthetic
gcggttatagagttcgagcggggggt

SEQ ID NO: 2505 - DNA, 26 bp, Artificial Sequences
  Synthetic
cggttatagagttcgagcggggggtc

SEQ ID NO: 2506 - DNA, 25 bp, Artificial Sequences
  Synthetic
gcggttatagagttcgagcgggggg

SEQ ID NO: 2507 - DNA, 25 bp, Artificial Sequences
  Synthetic
cggttatagagttcgagcggggggt

SEQ ID NO: 2508 - DNA, 27 bp, Artificial Sequences
  Synthetic
tataggttcggggaaggttgggtcggg

SEQ ID NO: 2509 - DNA, 27 bp, Artificial Sequences
  Synthetic
ataggttcggggaaggttgggtcgggg

SEQ ID NO: 2510 - DNA, 26 bp, Artificial Sequences
  Synthetic
ataggttcggggaaggttgggtcggg

SEQ ID NO: 2511 - DNA, 28 bp, Artificial Sequences
  Synthetic
tataggttcggggaaggttgggtcgggg

SEQ ID NO: 2512 - DNA, 28 bp, Artificial Sequences
  Synthetic
ttataggttcggggaaggttgggtcggg

SEQ ID NO: 2513 - DNA, 27 bp, Artificial Sequences
  Synthetic
gcggttatagagttcgagcggggggtc

SEQ ID NO: 2514 - DNA, 26 bp, Artificial Sequences
  Synthetic
gcggttatagagttcgagcggggggt

SEQ ID NO: 2515 - DNA, 26 bp, Artificial Sequences
  Synthetic
cggttatagagttcgagcggggggtc

SEQ ID NO: 2516 - DNA, 25 bp, Artificial Sequences
  Synthetic
gcggttatagagttcgagcgggggg

SEQ ID NO: 2517 - DNA, 25 bp, Artificial Sequences
  Synthetic
cggttatagagttcgagcggggggt

SEQ ID NO: 2518 - DNA, 27 bp, Artificial Sequences
  Synthetic
tataggttcggggaaggttgggtcggg

SEQ ID NO: 2519 - DNA, 27 bp, Artificial Sequences
  Synthetic
ataggttcggggaaggttgggtcgggg

SEQ ID NO: 2520 - DNA, 26 bp, Artificial Sequences
  Synthetic
ataggttcggggaaggttgggtcggg

SEQ ID NO: 2521 - DNA, 28 bp, Artificial Sequences
  Synthetic
tataggttcggggaaggttgggtcgggg

SEQ ID NO: 2522 - DNA, 28 bp, Artificial Sequences
  Synthetic
ttataggttcggggaaggttgggtcggg

SEQ ID NO: 2523 - DNA, 27 bp, Artificial Sequences
  Synthetic
gcgtgcgggcgtagtaatgttttagcg

SEQ ID NO: 2524 - DNA, 28 bp, Artificial Sequences
  Synthetic
gcgtgcgggcgtagtaatgttttagcga

SEQ ID NO: 2525 - DNA, 29 bp, Artificial Sequences
  Synthetic
gcgtgcgggcgtagtaatgttttagcgag

SEQ ID NO: 2526 - DNA, 27 bp, Artificial Sequences
  Synthetic
cgtgcgggcgtagtaatgttttagcga

SEQ ID NO: 2527 - DNA, 27 bp, Artificial Sequences
  Synthetic
tcgagtttgtggttggagttcgggttc

SEQ ID NO: 2528 - DNA, 27 bp, Artificial Sequences
  Synthetic
tataggttcggggaaggttgggtcggg

SEQ ID NO: 2529 - DNA, 27 bp, Artificial Sequences
  Synthetic
ataggttcggggaaggttgggtcgggg

SEQ ID NO: 2530 - DNA, 27 bp, Artificial Sequences
  Synthetic
ggagttcggggatagttcggcgttgtt

SEQ ID NO: 2531 - DNA, 26 bp, Artificial Sequences
  Synthetic
ataggttcggggaaggttgggtcggg

SEQ ID NO: 2532 - DNA, 27 bp, Artificial Sequences
  Synthetic
tcggggatagttcggcgttgttgttgt

SEQ ID NO: 2533 - DNA, 27 bp, Artificial Sequences
  Synthetic
ttcggatagtagcggcgtggtgtgtgg

SEQ ID NO: 2534 - DNA, 27 bp, Artificial Sequences
  Synthetic
tcgattcggatagtagcggcgtggtgt

SEQ ID NO: 2535 - DNA, 27 bp, Artificial Sequences
  Synthetic
cgattcggatagtagcggcgtggtgtg

SEQ ID NO: 2536 - DNA, 28 bp, Artificial Sequences
  Synthetic
tcgattcggatagtagcggcgtggtgtg

SEQ ID NO: 2537 - DNA, 27 bp, Artificial Sequences
  Synthetic
gcgtgcgggcgtagtaatgttttagcg

SEQ ID NO: 2538 - DNA, 27 bp, Artificial Sequences
  Synthetic
gaggggggcggggggttttaagagtat

SEQ ID NO: 2539 - DNA, 27 bp, Artificial Sequences
  Synthetic
aggagaaggaaaggtaggaggggggcg

SEQ ID NO: 2540 - DNA, 27 bp, Artificial Sequences
  Synthetic
gaggagaaggaaaggtaggaggggggc

SEQ ID NO: 2541 - DNA, 27 bp, Artificial Sequences
  Synthetic
taggaggggggcggggggttttaagag

SEQ ID NO: 2542 - DNA, 27 bp, Artificial Sequences
  Synthetic
ggaggggggcggggggttttaagagta

SEQ ID NO: 2543 - DNA, 27 bp, Artificial Sequences
  Synthetic
aggttgtaggttgtgtcgagtggaggt

SEQ ID NO: 2544 - DNA, 27 bp, Artificial Sequences
  Synthetic
aggttgtgtcgagtggaggtagaggaa

SEQ ID NO: 2545 - DNA, 28 bp, Artificial Sequences
  Synthetic
aaggttgtaggttgtgtcgagtggaggt

SEQ ID NO: 2546 - DNA, 27 bp, Artificial Sequences
  Synthetic
aaggttgtaggttgtgtcgagtggagg

SEQ ID NO: 2547 - DNA, 28 bp, Artificial Sequences
  Synthetic
ggttgtgtcgagtggaggtagaggaagt

SEQ ID NO: 2548 - DNA, 27 bp, Artificial Sequences
  Synthetic
gcgtaggaatgtagggatggcggaggt

SEQ ID NO: 2549 - DNA, 28 bp, Artificial Sequences
  Synthetic
gcgtaggaatgtagggatggcggaggta

SEQ ID NO: 2550 - DNA, 27 bp, Artificial Sequences
  Synthetic
aggaatgtagggatggcggaggtagga

SEQ ID NO: 2551 - DNA, 26 bp, Artificial Sequences
  Synthetic
gcgtaggaatgtagggatggcggagg

SEQ ID NO: 2552 - DNA, 29 bp, Artificial Sequences
  Synthetic
gcgtaggaatgtagggatggcggaggtag

SEQ ID NO: 2553 - DNA, 27 bp, Artificial Sequences
  Synthetic
agggttaggattgttgtgtcggcgtgg

SEQ ID NO: 2554 - DNA, 27 bp, Artificial Sequences
  Synthetic
gggttaggattgttgtgtcggcgtgga

SEQ ID NO: 2555 - DNA, 28 bp, Artificial Sequences
  Synthetic
agggttaggattgttgtgtcggcgtgga

SEQ ID NO: 2556 - DNA, 28 bp, Artificial Sequences
  Synthetic
gggttaggattgttgtgtcggcgtggag

SEQ ID NO: 2557 - DNA, 29 bp, Artificial Sequences
  Synthetic
gggttaggattgttgtgtcggcgtggaga

SEQ ID NO: 2558 - DNA, 27 bp, Artificial Sequences
  Synthetic
agaggtttagagggatcgcggcggttc

SEQ ID NO: 2559 - DNA, 27 bp, Artificial Sequences
  Synthetic
gagaggtttagagggatcgcggcggtt

SEQ ID NO: 2560 - DNA, 27 bp, Artificial Sequences
  Synthetic
ttggagaggtttagagggatcgcggcg

SEQ ID NO: 2561 - DNA, 27 bp, Artificial Sequences
  Synthetic
gtaattaagtcggttgtgcgggcgggg

SEQ ID NO: 2562 - DNA, 27 bp, Artificial Sequences
  Synthetic
ggtaattaagtcggttgtgcgggcggg

SEQ ID NO: 2563 - DNA, 27 bp, Artificial Sequences
  Synthetic
agggttaggattgttgtgtcggcgtgg

SEQ ID NO: 2564 - DNA, 27 bp, Artificial Sequences
  Synthetic
gggttaggattgttgtgtcggcgtgga

SEQ ID NO: 2565 - DNA, 28 bp, Artificial Sequences
  Synthetic
agggttaggattgttgtgtcggcgtgga

SEQ ID NO: 2566 - DNA, 28 bp, Artificial Sequences
  Synthetic
gggttaggattgttgtgtcggcgtggag

SEQ ID NO: 2567 - DNA, 29 bp, Artificial Sequences
  Synthetic
gggttaggattgttgtgtcggcgtggaga

SEQ ID NO: 2568 - DNA, 27 bp, Artificial Sequences
  Synthetic
gtaattaagtcggttgtgcgggcgggg

SEQ ID NO: 2569 - DNA, 27 bp, Artificial Sequences
  Synthetic
ggtaattaagtcggttgtgcgggcggg

SEQ ID NO: 2570 - DNA, 27 bp, Artificial Sequences
  Synthetic
tggtaattaagtcggttgtgcgggcgg

SEQ ID NO: 2571 - DNA, 27 bp, Artificial Sequences
  Synthetic
taattaagtcggttgtgcgggcggggg

SEQ ID NO: 2572 - DNA, 28 bp, Artificial Sequences
  Synthetic
ttggtaattaagtcggttgtgcgggcgg

SEQ ID NO: 2573 - DNA, 27 bp, Artificial Sequences
  Synthetic
ttttcgggcgttgcgggttatcggttc

SEQ ID NO: 2574 - DNA, 27 bp, Artificial Sequences
  Synthetic
tgttagggtttggggtttgggaggcgt

SEQ ID NO: 2575 - DNA, 27 bp, Artificial Sequences
  Synthetic
tgcgggttatcggttcggttttgtgcg

SEQ ID NO: 2576 - DNA, 27 bp, Artificial Sequences
  Synthetic
ggcgttgcgggttatcggttcggtttt

SEQ ID NO: 2577 - DNA, 27 bp, Artificial Sequences
  Synthetic
tttttcgggcgttgcgggttatcggtt

SEQ ID NO: 2578 - DNA, 27 bp, Artificial Sequences
  Synthetic
gtcggggttgcggggttttcgttatgg

SEQ ID NO: 2579 - DNA, 27 bp, Artificial Sequences
  Synthetic
ttgcggggttttcgttatggcgttcgg

SEQ ID NO: 2580 - DNA, 27 bp, Artificial Sequences
  Synthetic
gcggggttttcgttatggcgttcggtt

SEQ ID NO: 2581 - DNA, 27 bp, Artificial Sequences
  Synthetic
cgtcggggttgcggggttttcgttatg

SEQ ID NO: 2582 - DNA, 27 bp, Artificial Sequences
  Synthetic
gggttgcggggttttcgttatggcgtt

SEQ ID NO: 2583 - DNA, 27 bp, Artificial Sequences
  Synthetic
tggggatgggaggaggtgaggttagtt

SEQ ID NO: 2584 - DNA, 27 bp, Artificial Sequences
  Synthetic
atggggatgggaggaggtgaggttagt

SEQ ID NO: 2585 - DNA, 28 bp, Artificial Sequences
  Synthetic
atggggatgggaggaggtgaggttagtt

SEQ ID NO: 2586 - DNA, 26 bp, Artificial Sequences
  Synthetic
tggggatgggaggaggtgaggttagt

SEQ ID NO: 2587 - DNA, 28 bp, Artificial Sequences
  Synthetic
tggggatgggaggaggtgaggttagtta

SEQ ID NO: 2588 - DNA, 27 bp, Artificial Sequences
  Synthetic
tcggaggttgtttttgagaggtgggga

SEQ ID NO: 2589 - DNA, 27 bp, Artificial Sequences
  Synthetic
tgagaggtggggattaggagggaggaa

SEQ ID NO: 2590 - DNA, 27 bp, Artificial Sequences
  Synthetic
ttgagaggtggggattaggagggagga

SEQ ID NO: 2591 - DNA, 27 bp, Artificial Sequences
  Synthetic
ttcggaggttgtttttgagaggtgggg

SEQ ID NO: 2592 - DNA, 28 bp, Artificial Sequences
  Synthetic
ttcggaggttgtttttgagaggtgggga

SEQ ID NO: 2593 - DNA, 27 bp, Artificial Sequences
  Synthetic
aggtagggagagttgtcggagtaaggt

SEQ ID NO: 2594 - DNA, 28 bp, Artificial Sequences
  Synthetic
aggtagggagagttgtcggagtaaggtt

SEQ ID NO: 2595 - DNA, 28 bp, Artificial Sequences
  Synthetic
aaggtagggagagttgtcggagtaaggt

SEQ ID NO: 2596 - DNA, 29 bp, Artificial Sequences
  Synthetic
aggtagggagagttgtcggagtaaggttt

SEQ ID NO: 2597 - DNA, 29 bp, Artificial Sequences
  Synthetic
aaggtagggagagttgtcggagtaaggtt

SEQ ID NO: 2598 - DNA, 27 bp, Artificial Sequences
  Synthetic
atggtgtaggggttagaggatgtgggt

SEQ ID NO: 2599 - DNA, 29 bp, Artificial Sequences
  Synthetic
tggtgtaggggttagaggatgtgggtagg

SEQ ID NO: 2600 - DNA, 27 bp, Artificial Sequences
  Synthetic
aggggttagaggatgtgggtaggaagt

SEQ ID NO: 2601 - DNA, 28 bp, Artificial Sequences
  Synthetic
ggtgtaggggttagaggatgtgggtagg

SEQ ID NO: 2602 - DNA, 27 bp, Artificial Sequences
  Synthetic
tggtgtaggggttagaggatgtgggta

SEQ ID NO: 2603 - DNA, 30 bp, Artificial Sequences
  Synthetic
ggtttgtgacgtcggttaataatcggttgg

SEQ ID NO: 2604 - DNA, 31 bp, Artificial Sequences
  Synthetic
tggtttgtgacgtcggttaataatcggttgg

SEQ ID NO: 2605 - DNA, 31 bp, Artificial Sequences
  Synthetic
ggtttgtgacgtcggttaataatcggttgga

SEQ ID NO: 2606 - DNA, 32 bp, Artificial Sequences
  Synthetic
tggtttgtgacgtcggttaataatcggttgga

SEQ ID NO: 2607 - DNA, 30 bp, Artificial Sequences
  Synthetic
gttggtttgtgacgtcggttaataatcggt

SEQ ID NO: 2608 - DNA, 27 bp, Artificial Sequences
  Synthetic
gtattgcgggggattgcgggcgtttta

SEQ ID NO: 2609 - DNA, 27 bp, Artificial Sequences
  Synthetic
gggggattgcgggcgttttagttcgac

SEQ ID NO: 2610 - DNA, 27 bp, Artificial Sequences
  Synthetic
tattgcgggggattgcgggcgttttag

SEQ ID NO: 2611 - DNA, 27 bp, Artificial Sequences
  Synthetic
cgtagtagtcgagcgggcggttagtgt

SEQ ID NO: 2612 - DNA, 27 bp, Artificial Sequences
  Synthetic
gcgtagtagtcgagcgggcggttagtg

SEQ ID NO: 2613 - DNA, 27 bp, Artificial Sequences
  Synthetic
attcgtcgggttggggcgttcgtagtt

SEQ ID NO: 2614 - DNA, 27 bp, Artificial Sequences
  Synthetic
cgggttggggcgttcgtagtttttcgt

SEQ ID NO: 2615 - DNA, 27 bp, Artificial Sequences
  Synthetic
cgtcgggttggggcgttcgtagttttt

SEQ ID NO: 2616 - DNA, 27 bp, Artificial Sequences
  Synthetic
tcgtcgggttggggcgttcgtagtttt

SEQ ID NO: 2617 - DNA, 27 bp, Artificial Sequences
  Synthetic
ttcgtcgggttggggcgttcgtagttt

SEQ ID NO: 2618 - DNA, 27 bp, Artificial Sequences
  Synthetic
gtattgcgggggattgcgggcgtttta

SEQ ID NO: 2619 - DNA, 27 bp, Artificial Sequences
  Synthetic
gggggattgcgggcgttttagttcgac

SEQ ID NO: 2620 - DNA, 27 bp, Artificial Sequences
  Synthetic
tattgcgggggattgcgggcgttttag

SEQ ID NO: 2621 - DNA, 27 bp, Artificial Sequences
  Synthetic
tcgcggcgttgttgggttagtagggta

SEQ ID NO: 2622 - DNA, 27 bp, Artificial Sequences
  Synthetic
tagtattgcgggggattgcgggcgttt

SEQ ID NO: 2623 - DNA, 27 bp, Artificial Sequences
  Synthetic
attcgtcgggttggggcgttcgtagtt

SEQ ID NO: 2624 - DNA, 27 bp, Artificial Sequences
  Synthetic
cgggttggggcgttcgtagtttttcgt

SEQ ID NO: 2625 - DNA, 27 bp, Artificial Sequences
  Synthetic
cgtcgggttggggcgttcgtagttttt

SEQ ID NO: 2626 - DNA, 27 bp, Artificial Sequences
  Synthetic
tcgtcgggttggggcgttcgtagtttt

SEQ ID NO: 2627 - DNA, 27 bp, Artificial Sequences
  Synthetic
ttcgtcgggttggggcgttcgtagttt

SEQ ID NO: 2628 - DNA, 27 bp, Artificial Sequences
  Synthetic
tcgtttaggtagggattggcgtcggtt

SEQ ID NO: 2629 - DNA, 27 bp, Artificial Sequences
  Synthetic
ttcgtttaggtagggattggcgtcggt

SEQ ID NO: 2630 - DNA, 28 bp, Artificial Sequences
  Synthetic
ttcgtttaggtagggattggcgtcggtt

SEQ ID NO: 2631 - DNA, 28 bp, Artificial Sequences
  Synthetic
tttcgtttaggtagggattggcgtcggt

SEQ ID NO: 2632 - DNA, 27 bp, Artificial Sequences
  Synthetic
tttcgtttaggtagggattggcgtcgg

SEQ ID NO: 2633 - DNA, 27 bp, Artificial Sequences
  Synthetic
cgggttggggcgttcgtagtttttcgt

SEQ ID NO: 2634 - DNA, 27 bp, Artificial Sequences
  Synthetic
cgtcgggttggggcgttcgtagttttt

SEQ ID NO: 2635 - DNA, 27 bp, Artificial Sequences
  Synthetic
tcgggttggggcgttcgtagtttttcg

SEQ ID NO: 2636 - DNA, 28 bp, Artificial Sequences
  Synthetic
gtcgggttggggcgttcgtagtttttcg

SEQ ID NO: 2637 - DNA, 28 bp, Artificial Sequences
  Synthetic
cgtcgggttggggcgttcgtagtttttc

SEQ ID NO: 2638 - DNA, 29 bp, Artificial Sequences
  Synthetic
ggaatcggataggtttttgggtttggcgt

SEQ ID NO: 2639 - DNA, 29 bp, Artificial Sequences
  Synthetic
tggaatcggataggtttttgggtttggcg

SEQ ID NO: 2640 - DNA, 30 bp, Artificial Sequences
  Synthetic
tggaatcggataggtttttgggtttggcgt

SEQ ID NO: 2641 - DNA, 28 bp, Artificial Sequences
  Synthetic
ggaatcggataggtttttgggtttggcg

SEQ ID NO: 2642 - DNA, 28 bp, Artificial Sequences
  Synthetic
gaatcggataggtttttgggtttggcgt

SEQ ID NO: 2643 - DNA, 29 bp, Artificial Sequences
  Synthetic
ggcgttaatttttatttgggcgaggaggt

SEQ ID NO: 2644 - DNA, 29 bp, Artificial Sequences
  Synthetic
gttgttttgttggtttaatagcgtcgcgg

SEQ ID NO: 2645 - DNA, 32 bp, Artificial Sequences
  Synthetic
cggtgttgttttgttggtttaatagcgtcgcg

SEQ ID NO: 2646 - DNA, 30 bp, Artificial Sequences
  Synthetic
tgttgttttgttggtttaatagcgtcgcgg

SEQ ID NO: 2647 - DNA, 32 bp, Artificial Sequences
  Synthetic
cgcgtatggtcggcgttaatttttatttgggc

SEQ ID NO: 2648 - DNA, 29 bp, Artificial Sequences
  Synthetic
ggaatcggataggtttttgggtttggcgt

SEQ ID NO: 2649 - DNA, 29 bp, Artificial Sequences
  Synthetic
tggaatcggataggtttttgggtttggcg

SEQ ID NO: 2650 - DNA, 30 bp, Artificial Sequences; identical to SEQ ID NO: 2640
  Synthetic

SEQ ID NO: 2651 - DNA, 28 bp, Artificial Sequences
  Synthetic
ggaatcggataggtttttgggtttggcg

SEQ ID NO: 2652 - DNA, 28 bp, Artificial Sequences
  Synthetic
gaatcggataggtttttgggtttggcgt

SEQ ID NO: 2653 - DNA, 29 bp, Artificial Sequences
  Synthetic
ggcgttaatttttatttgggcgaggaggt

SEQ ID NO: 2654 - DNA, 32 bp, Artificial Sequences; identical to SEQ ID NO: 2647
  Synthetic

SEQ ID NO: 2655 - DNA, 30 bp, Artificial Sequences
  Synthetic
ggcgttaatttttatttgggcgaggaggtc

SEQ ID NO: 2656 - DNA, 31 bp, Artificial Sequences
  Synthetic
gcgtatggtcggcgttaatttttatttgggc

SEQ ID NO: 2657 - DNA, 31 bp, Artificial Sequences
  Synthetic
cgcgtatggtcggcgttaatttttatttggg

SEQ ID NO: 2658 - DNA, 29 bp, Artificial Sequences
  Synthetic
tgggttagtatttcgtttttgagcgggga

SEQ ID NO: 2659 - DNA, 30 bp, Artificial Sequences
  Synthetic
tgggttagtatttcgtttttgagcggggac

SEQ ID NO: 2660 - DNA, 29 bp, Artificial Sequences
  Synthetic
gggttagtatttcgtttttgagcggggac

SEQ ID NO: 2661 - DNA, 31 bp, Artificial Sequences
  Synthetic
cgttgggttagtatttcgtttttgagcgggg

SEQ ID NO: 2662 - DNA, 29 bp, Artificial Sequences
  Synthetic
ttgggttagtatttcgtttttgagcgggg

SEQ ID NO: 2663 - DNA, 27 bp, Artificial Sequences
  Synthetic
cggggatttacgagtaggttaagcgga

SEQ ID NO: 2664 - DNA, 29 bp, Artificial Sequences
  Synthetic
cggggatttacgagtaggttaagcggagg

SEQ ID NO: 2665 - DNA, 28 bp, Artificial Sequences
  Synthetic
cggggatttacgagtaggttaagcggag

SEQ ID NO: 2666 - DNA, 28 bp, Artificial Sequences
  Synthetic
ggggatttacgagtaggttaagcggagg

SEQ ID NO: 2667 - DNA, 27 bp, Artificial Sequences
  Synthetic
gggtaggggcggtttagttgtgcgagt

SEQ ID NO: 2668 - DNA, 27 bp, Artificial Sequences
  Synthetic
cgggtaggggcggtttagttgtgcgag

SEQ ID NO: 2669 - DNA, 28 bp, Artificial Sequences
  Synthetic
gggtaggggcggtttagttgtgcgagta

SEQ ID NO: 2670 - DNA, 26 bp, Artificial Sequences
  Synthetic
cgggtaggggcggtttagttgtgcga

SEQ ID NO: 2671 - DNA, 27 bp, Artificial Sequences
  Synthetic
ggtaggggcggtttagttgtgcgagta

SEQ ID NO: 2672 - DNA, 27 bp, Artificial Sequences
  Synthetic
agcgaggtgttggtttagcgggattgc

SEQ ID NO: 2673 - DNA, 28 bp, Artificial Sequences
  Synthetic
gagcgaggtgttggtttagcgggattgc

SEQ ID NO: 2674 - DNA, 27 bp, Artificial Sequences
  Synthetic
agagcgaggtgttggtttagcgggatt

SEQ ID NO: 2675 - DNA, 27 bp, Artificial Sequences
  Synthetic
aagagcgaggtgttggtttagcgggat

SEQ ID NO: 2676 - DNA, 27 bp, Artificial Sequences
  Synthetic
gagcgaggtgttggtttagcgggattg

SEQ ID NO: 2677 - DNA, 27 bp, Artificial Sequences
  Synthetic
aggcggagttggggaagagttgtgagg

SEQ ID NO: 2678 - DNA, 27 bp, Artificial Sequences
  Synthetic
ggaggcggagttggggaagagttgtga

SEQ ID NO: 2679 - DNA, 27 bp, Artificial Sequences
  Synthetic
taaggaggagtgtggggaggcggagtt

SEQ ID NO: 2680 - DNA, 27 bp, Artificial Sequences
  Synthetic
cggagttggggaagagttgtgaggggt

SEQ ID NO: 2681 - DNA, 27 bp, Artificial Sequences
  Synthetic
agagttgtgaggggttggttgggggtt

SEQ ID NO: 2682 - DNA, 27 bp, Artificial Sequences
  Synthetic
tatagggattggcgggggtatcgtggg

SEQ ID NO: 2683 - DNA, 28 bp, Artificial Sequences
  Synthetic
gggtcgttttatagggattggcgggggt

SEQ ID NO: 2684 - DNA, 27 bp, Artificial Sequences
  Synthetic
gggtcgttttatagggattggcggggg

SEQ ID NO: 2685 - DNA, 27 bp, Artificial Sequences
  Synthetic
ggggtcgttttatagggattggcgggg

SEQ ID NO: 2686 - DNA, 28 bp, Artificial Sequences
  Synthetic
aggggtcgttttatagggattggcgggg

SEQ ID NO: 2687 - DNA, 27 bp, Artificial Sequences
  Synthetic
attttgagagggagggttcggcgggag

SEQ ID NO: 2688 - DNA, 27 bp, Artificial Sequences
  Synthetic
gattttgagagggagggttcggcggga

SEQ ID NO: 2689 - DNA, 27 bp, Artificial Sequences
  Synthetic
tggggattttgagagggagggttcggc

SEQ ID NO: 2690 - DNA, 27 bp, Artificial Sequences
  Synthetic
gggagggtcgtagcgtggggattttga

SEQ ID NO: 2691 - DNA, 27 bp, Artificial Sequences
  Synthetic
ttgggttgcgttagagtaggcgggagg

SEQ ID NO: 2692 - DNA, 27 bp, Artificial Sequences
  Synthetic
tgggttaggcgttaggtgtaggtggcg

SEQ ID NO: 2693 - DNA, 27 bp, Artificial Sequences
  Synthetic
ttcgggttaagtttggttgtcgcgcgg

SEQ ID NO: 2694 - DNA, 27 bp, Artificial Sequences
  Synthetic
tcggtttatttggcgggtgggtagggt

SEQ ID NO: 2695 - DNA, 27 bp, Artificial Sequences
  Synthetic
cgggttaagtttggttgtcgcgcggtt

SEQ ID NO: 2696 - DNA, 27 bp, Artificial Sequences
  Synthetic
gggttaggcgttaggtgtaggtggcgg

SEQ ID NO: 2697 - DNA, 27 bp, Artificial Sequences
  Synthetic
cgaggaggaagggaggaatcgtgtggg

SEQ ID NO: 2698 - DNA, 27 bp, Artificial Sequences
  Synthetic
ttggagcgtttaggtagggttggggcg

SEQ ID NO: 2699 - DNA, 27 bp, Artificial Sequences
  Synthetic
gaggaggaagggaggaatcgtgtgggg

SEQ ID NO: 2700 - DNA, 27 bp, Artificial Sequences
  Synthetic
gaggaagggaggaatcgtgtgggggaa

SEQ ID NO: 2701 - DNA, 27 bp, Artificial Sequences
  Synthetic
cggcggcggaggaggagttttattgag

SEQ ID NO: 2702 - DNA, 27 bp, Artificial Sequences
  Synthetic
ttggagaggcgggggaagattaacggg

SEQ ID NO: 2703 - DNA, 27 bp, Artificial Sequences
  Synthetic
ttttcgggtagaggttggagaggcggg

SEQ ID NO: 2704 - DNA, 27 bp, Artificial Sequences
  Synthetic
ggtagaggttggagaggcgggggaaga

SEQ ID NO: 2705 - DNA, 27 bp, Artificial Sequences
  Synthetic
gtagaggttggagaggcgggggaagat

SEQ ID NO: 2706 - DNA, 27 bp, Artificial Sequences
  Synthetic
cgttagtttttgcgcgcgggagatagc

SEQ ID NO: 2707 - DNA, 27 bp, Artificial Sequences
  Synthetic
cggcgcggttaagtagggaagggagta

SEQ ID NO: 2708 - DNA, 27 bp, Artificial Sequences
  Synthetic
ttttagaaatgtagggagggcgcggcg

SEQ ID NO: 2709 - DNA, 26 bp, Artificial Sequences
  Synthetic
cggcgcggttaagtagggaagggagt

SEQ ID NO: 2710 - DNA, 28 bp, Artificial Sequences
  Synthetic
cggcgcggttaagtagggaagggagtag

SEQ ID NO: 2711 - DNA, 28 bp, Artificial Sequences
  Synthetic
gttttagaaatgtagggagggcgcggcg

SEQ ID NO: 2712 - DNA, 29 bp, Artificial Sequences
  Synthetic
cgttcgttcgttttagtttcggagcgtcg

SEQ ID NO: 2713 - DNA, 27 bp, Artificial Sequences
  Synthetic
cgttcgttcgttttagtttcggagcgt

SEQ ID NO: 2714 - DNA, 27 bp, Artificial Sequences
  Synthetic
ttcgttcgttttagtttcggagcgtcg

SEQ ID NO: 2715 - DNA, 27 bp, Artificial Sequences
  Synthetic
cgagggcggtggtagtttgtagttaga

SEQ ID NO: 2716 - DNA, 28 bp, Artificial Sequences
  Synthetic
gttcgttcgttttagtttcggagcgtcg

SEQ ID NO: 2717 - DNA, 27 bp, Artificial Sequences
  Synthetic
cggcgcggttaagtagggaagggagta

SEQ ID NO: 2718 - DNA, 27 bp, Artificial Sequences
  Synthetic
ttttagaaatgtagggagggcgcggcg

SEQ ID NO: 2719 - DNA, 27 bp, Artificial Sequences
  Synthetic
ggcggtagggttgggttttcggtggaa

SEQ ID NO: 2720 - DNA, 27 bp, Artificial Sequences
  Synthetic
ttcggcggtagggttgggttttcggtg

SEQ ID NO: 2721 - DNA, 27 bp, Artificial Sequences
  Synthetic
gttcggcggtagggttgggttttcggt

SEQ ID NO: 2722 - DNA, 27 bp, Artificial Sequences
  Synthetic
tgtgtataagttcggggcgtcggggtg

SEQ ID NO: 2723 - DNA, 27 bp, Artificial Sequences
  Synthetic
ttgtgtataagttcggggcgtcggggt

SEQ ID NO: 2724 - DNA, 27 bp, Artificial Sequences
  Synthetic
gggcggttgggtttgggtttaggtgtt

SEQ ID NO: 2725 - DNA, 27 bp, Artificial Sequences
  Synthetic
gtgtataagttcggggcgtcggggtgg

SEQ ID NO: 2726 - DNA, 27 bp, Artificial Sequences
  Synthetic
gttgtgtataagttcggggcgtcgggg

SEQ ID NO: 2727 - DNA, 27 bp, Artificial Sequences
  Synthetic
gtgatggtggtggtggtgatgcggttg

SEQ ID NO: 2728 - DNA, 27 bp, Artificial Sequences
  Synthetic
tgcggggtttgagtggggtgtagtagc

SEQ ID NO: 2729 - DNA, 27 bp, Artificial Sequences
  Synthetic
ggtttgagtggggtgtagtagcggcgt

SEQ ID NO: 2730 - DNA, 27 bp, Artificial Sequences
  Synthetic
cggggtttgagtggggtgtagtagcgg

SEQ ID NO: 2731 - DNA, 27 bp, Artificial Sequences
  Synthetic
cgtcgtcgtgatggtggtggtggtgat

SEQ ID NO: 2732 - DNA, 28 bp, Artificial Sequences
  Synthetic
cggcgtcggtagttcgggttttagttcg

SEQ ID NO: 2733 - DNA, 29 bp, Artificial Sequences
  Synthetic
cggcgtcggtagttcgggttttagttcga

SEQ ID NO: 2734 - DNA, 27 bp, Artificial Sequences
  Synthetic
ggcgtcggtagttcgggttttagttcg

SEQ ID NO: 2735 - DNA, 27 bp, Artificial Sequences
  Synthetic
cggcgtcggtagttcgggttttagttc

SEQ ID NO: 2736 - DNA, 28 bp, Artificial Sequences
  Synthetic
ggcgtcggtagttcgggttttagttcga

SEQ ID NO: 2737 - DNA, 27 bp, Artificial Sequences
  Synthetic
gtgatggtggtggtggtgatgcggttg

SEQ ID NO: 2738 - DNA, 27 bp, Artificial Sequences
  Synthetic
tgcggggtttgagtggggtgtagtagc

SEQ ID NO: 2739 - DNA, 27 bp, Artificial Sequences
  Synthetic
ggtttgagtggggtgtagtagcggcgt

SEQ ID NO: 2740 - DNA, 27 bp, Artificial Sequences
  Synthetic
cggggtttgagtggggtgtagtagcgg

SEQ ID NO: 2741 - DNA, 27 bp, Artificial Sequences
  Synthetic
cgtcgtggtttgtaggtgtgaggcgga

SEQ ID NO: 2742 - DNA, 28 bp, Artificial Sequences
  Synthetic
cggcgtcggtagttcgggttttagttcg

SEQ ID NO: 2743 - DNA, 28 bp, Artificial Sequences
  Synthetic
tgggattttggtgtgtcgtagcggatgg

SEQ ID NO: 2744 - DNA, 27 bp, Artificial Sequences
  Synthetic
gggattttggtgtgtcgtagcggatgg

SEQ ID NO: 2745 - DNA, 29 bp, Artificial Sequences
  Synthetic
cggcgtcggtagttcgggttttagttcga

SEQ ID NO: 2746 - DNA, 27 bp, Artificial Sequences
  Synthetic
ggcgtcggtagttcgggttttagttcg

SEQ ID NO: 2747 - DNA, 27 bp, Artificial Sequences
  Synthetic
ttttaggaggtcggcgttgagattggc

SEQ ID NO: 2748 - DNA, 28 bp, Artificial Sequences
  Synthetic
gttttaggaggtcggcgttgagattggc

SEQ ID NO: 2749 - DNA, 29 bp, Artificial Sequences
  Synthetic
agttttaggaggtcggcgttgagattggc

SEQ ID NO: 2750 - DNA, 26 bp, Artificial Sequences
  Synthetic
tttaggaggtcggcgttgagattggc

SEQ ID NO: 2751 - DNA, 27 bp, Artificial Sequences
  Synthetic
gttttaggaggtcggcgttgagattgg

SEQ ID NO: 2752 - DNA, 33 bp, Artificial Sequences
  Synthetic
tggtgagattttttcggagtagtattttggggt

SEQ ID NO: 2753 - DNA, 34 bp, Artificial Sequences
  Synthetic
gtggtgagattttttcggagtagtattttggggt

SEQ ID NO: 2754 - DNA, 34 bp, Artificial Sequences
  Synthetic
agtggtgagattttttcggagtagtattttgggg

SEQ ID NO: 2755 - DNA, 35 bp, Artificial Sequences
  Synthetic
agtggtgagattttttcggagtagtattttggggt

SEQ ID NO: 2756 - DNA, 34 bp, Artificial Sequences
  Synthetic
agattttttcggagtagtattttggggttagcgt

SEQ ID NO: 2757 - DNA, 27 bp, Artificial Sequences
  Synthetic
ttcgggttgcggtaaggtgtacgggaa

SEQ ID NO: 2758 - DNA, 27 bp, Artificial Sequences
  Synthetic
tttcgggttgcggtaaggtgtacggga

SEQ ID NO: 2759 - DNA, 27 bp, Artificial Sequences
  Synthetic
atttcgggttgcggtaaggtgtacggg

SEQ ID NO: 2760 - DNA, 28 bp, Artificial Sequences
  Synthetic
tttcgggttgcggtaaggtgtacgggaa

SEQ ID NO: 2761 - DNA, 28 bp, Artificial Sequences
  Synthetic
atttcgggttgcggtaaggtgtacggga

SEQ ID NO: 2762 - DNA, 27 bp, Artificial Sequences
  Synthetic
ggggcgtttttaggttgttggcgttcg

SEQ ID NO: 2763 - DNA, 27 bp, Artificial Sequences
  Synthetic
cggggcgtttttaggttgttggcgttc

SEQ ID NO: 2764 - DNA, 28 bp, Artificial Sequences
  Synthetic
gggcgtttttaggttgttggcgttcgtg

SEQ ID NO: 2765 - DNA, 28 bp, Artificial Sequences
  Synthetic
gggtcgttcgttcgtgtgttagcgtagg

SEQ ID NO: 2766 - DNA, 28 bp, Artificial Sequences
  Synthetic
cggggcgtttttaggttgttggcgttcg

SEQ ID NO: 2767 - DNA, 27 bp, Artificial Sequences
  Synthetic
gttcggacgagttgtagcggtatttgc

SEQ ID NO: 2768 - DNA, 30 bp, Artificial Sequences
  Synthetic
agcgtttcgtttgttcggtgtgtaataagc

SEQ ID NO: 2769 - DNA, 27 bp, Artificial Sequences
  Synthetic
ggggcgtttttaggttgttggcgttcg

SEQ ID NO: 2770 - DNA, 27 bp, Artificial Sequences
  Synthetic
cggggcgtttttaggttgttggcgttc

SEQ ID NO: 2771 - DNA, 27 bp, Artificial Sequences
  Synthetic
gggcgtttttaggttgttggcgttcgt

SEQ ID NO: 2772 - DNA, 28 bp, Artificial Sequences
  Synthetic
ggggcgtttttaggttgttggcgttcgt

SEQ ID NO: 2773 - DNA, 27 bp, Artificial Sequences
  Synthetic
tgtaggatgaggtcgggggattcggaa

SEQ ID NO: 2774 - DNA, 27 bp, Artificial Sequences
  Synthetic
ggaggcgggagggtaggggttttagtg

SEQ ID NO: 2775 - DNA, 27 bp, Artificial Sequences
  Synthetic
ggcgggagggtaggggttttagtgacg

SEQ ID NO: 2776 - DNA, 27 bp, Artificial Sequences
  Synthetic
tgatttcggcgttagtgtcgttcgggc

SEQ ID NO: 2777 - DNA, 27 bp, Artificial Sequences
  Synthetic
gcggcgggggtaaaaagggtagcgata

SEQ ID NO: 2778 - DNA, 27 bp, Artificial Sequences
  Synthetic
tataacgggggcggcgggggtaaaaag

SEQ ID NO: 2779 - DNA, 27 bp, Artificial Sequences
  Synthetic
tttattcgggcgcggaaggtagagggg

SEQ ID NO: 2780 - DNA, 27 bp, Artificial Sequences
  Synthetic
gcgtttagttcgggttttgggggcgtt

SEQ ID NO: 2781 - DNA, 27 bp, Artificial Sequences
  Synthetic
gggcgcggaaggtagaggggagttttt

SEQ ID NO: 2782 - DNA, 27 bp, Artificial Sequences
  Synthetic
gcgcggaaggtagaggggagtttttcg

SEQ ID NO: 2783 - DNA, 27 bp, Artificial Sequences
  Synthetic
ggggcgtttttaggttgttggcgttcg

SEQ ID NO: 2784 - DNA, 27 bp, Artificial Sequences
  Synthetic
ggaggcgggagggtaggggttttagtg

SEQ ID NO: 2785 - DNA, 27 bp, Artificial Sequences
  Synthetic
ggcgggagggtaggggttttagtgacg

SEQ ID NO: 2786 - DNA, 27 bp, Artificial Sequences
  Synthetic
gcgggagggtaggggttttagtgacgt

SEQ ID NO: 2787 - DNA, 27 bp, Artificial Sequences
  Synthetic
gacgtttttagggttcgggttgggcgc

SEQ ID NO: 2788 - DNA, 27 bp, Artificial Sequences
  Synthetic
tgacgtttttagggttcgggttgggcg

SEQ ID NO: 2789 - DNA, 27 bp, Artificial Sequences
  Synthetic
tttattcgggcgcggaaggtagagggg

SEQ ID NO: 2790 - DNA, 27 bp, Artificial Sequences
  Synthetic
gggcgcggaaggtagaggggagttttt

SEQ ID NO: 2791 - DNA, 27 bp, Artificial Sequences
  Synthetic
gcgcggaaggtagaggggagtttttcg

SEQ ID NO: 2792 - DNA, 27 bp, Artificial Sequences
  Synthetic
ttattcgggcgcggaaggtagagggga

SEQ ID NO: 2793 - DNA, 27 bp, Artificial Sequences
  Synthetic
ggcgcggaaggtagaggggagtttttc

SEQ ID NO: 2794 - DNA, 27 bp, Artificial Sequences
  Synthetic
ggaggcgggagggtaggggttttagtg

SEQ ID NO: 2795 - DNA, 27 bp, Artificial Sequences
  Synthetic
ggcgggagggtaggggttttagtgacg

SEQ ID NO: 2796 - DNA, 27 bp, Artificial Sequences
  Synthetic
gcgggagggtaggggttttagtgacgt

SEQ ID NO: 2797 - DNA, 27 bp, Artificial Sequences
  Synthetic
gggttttcgggttgcggttcgttcgtt

SEQ ID NO: 2798 - DNA, 27 bp, Artificial Sequences
  Synthetic
gacgtttttagggttcgggttgggcgc

SEQ ID NO: 2799 - DNA, 27 bp, Artificial Sequences
  Synthetic
tttattcgggcgcggaaggtagagggg

SEQ ID NO: 2800 - DNA, 27 bp, Artificial Sequences
  Synthetic
gggcgcggaaggtagaggggagttttt

SEQ ID NO: 2801 - DNA, 27 bp, Artificial Sequences
  Synthetic
agtttgggcgagtggtatgtgtgtgcg

SEQ ID NO: 2802 - DNA, 27 bp, Artificial Sequences
  Synthetic
gcgcggaaggtagaggggagtttttcg

SEQ ID NO: 2803 - DNA, 27 bp, Artificial Sequences
  Synthetic
ttattcgggcgcggaaggtagagggga

SEQ ID NO: 2804 - DNA, 27 bp, Artificial Sequences
  Synthetic
gtagggtgtagagtcgtcgttgggggg

SEQ ID NO: 2805 - DNA, 27 bp, Artificial Sequences
  Synthetic
tagggtgtagagtcgtcgttggggggc

SEQ ID NO: 2806 - DNA, 27 bp, Artificial Sequences
  Synthetic
agtagggtgtagagtcgtcgttggggg

SEQ ID NO: 2807 - DNA, 28 bp, Artificial Sequences
  Synthetic
agtagggtgtagagtcgtcgttgggggg

SEQ ID NO: 2808 - DNA, 28 bp, Artificial Sequences
  Synthetic
gagtagggtgtagagtcgtcgttggggg

SEQ ID NO: 2809 - DNA, 28 bp, Artificial Sequences
  Synthetic
tcggtcggagttgttgtgtagttttcgt

SEQ ID NO: 2810 - DNA, 28 bp, Artificial Sequences
  Synthetic
cggtcggagttgttgtgtagttttcgtt

SEQ ID NO: 2811 - DNA, 29 bp, Artificial Sequences
  Synthetic
tcggtcggagttgttgtgtagttttcgtt

SEQ ID NO: 2812 - DNA, 29 bp, Artificial Sequences
  Synthetic
ttcggtcggagttgttgtgtagttttcgt

SEQ ID NO: 2813 - DNA, 29 bp, Artificial Sequences
  Synthetic
tttcggtcggagttgttgtgtagttttcg

SEQ ID NO: 2814 - DNA, 27 bp, Artificial Sequences
  Synthetic
gtagggtgtagagtcgtcgttgggggg

SEQ ID NO: 2815 - DNA, 27 bp, Artificial Sequences
  Synthetic
tagggtgtagagtcgtcgttggggggc

SEQ ID NO: 2816 - DNA, 27 bp, Artificial Sequences
  Synthetic
agtagggtgtagagtcgtcgttggggg

SEQ ID NO: 2817 - DNA, 28 bp, Artificial Sequences
  Synthetic
agtagggtgtagagtcgtcgttgggggg

SEQ ID NO: 2818 - DNA, 28 bp, Artificial Sequences
  Synthetic
gagtagggtgtagagtcgtcgttggggg

SEQ ID NO: 2819 - DNA, 28 bp, Artificial Sequences
  Synthetic
tcggtcggagttgttgtgtagttttcgt

SEQ ID NO: 2820 - DNA, 28 bp, Artificial Sequences
  Synthetic
cggtcggagttgttgtgtagttttcgtt

SEQ ID NO: 2821 - DNA, 29 bp, Artificial Sequences
  Synthetic
tcggtcggagttgttgtgtagttttcgtt

SEQ ID NO: 2822 - DNA, 29 bp, Artificial Sequences
  Synthetic
ttcggtcggagttgttgtgtagttttcgt

SEQ ID NO: 2823 - DNA, 29 bp, Artificial Sequences
  Synthetic
tttcggtcggagttgttgtgtagttttcg

SEQ ID NO: 2824 - DNA, 27 bp, Artificial Sequences
  Synthetic
gcgcggaaggtgtttagtggtcggatg

SEQ ID NO: 2825 - DNA, 27 bp, Artificial Sequences
  Synthetic
agagggcgcggaaggtgtttagtggtc

SEQ ID NO: 2826 - DNA, 27 bp, Artificial Sequences
  Synthetic
gagagggcgcggaaggtgtttagtggt

SEQ ID NO: 2827 - DNA, 27 bp, Artificial Sequences
  Synthetic
cgcggaaggtgtttagtggtcggatgg

SEQ ID NO: 2828 - DNA, 27 bp, Artificial Sequences
  Synthetic
ttcggtcgagagtaggggtgcgagagg

SEQ ID NO: 2829 - DNA, 26 bp, Artificial Sequences
  Synthetic
cggttgtagttttaggcgcggcggtc

SEQ ID NO: 2830 - DNA, 25 bp, Artificial Sequences
  Synthetic
cggttgtagttttaggcgcggcggt

SEQ ID NO: 2831 - DNA, 27 bp, Artificial Sequences
  Synthetic
gcggttgtagttttaggcgcggcggtc

SEQ ID NO: 2832 - DNA, 25 bp, Artificial Sequences
  Synthetic
gcggttgtagttttaggcgcggcgg

SEQ ID NO: 2833 - DNA, 26 bp, Artificial Sequences
  Synthetic
gcggttgtagttttaggcgcggcggt

SEQ ID NO: 2834 - DNA, 27 bp, Artificial Sequences
  Synthetic
gcgcggaaggtgtttagtggtcggatg

SEQ ID NO: 2835 - DNA, 27 bp, Artificial Sequences
  Synthetic
agagggcgcggaaggtgtttagtggtc

SEQ ID NO: 2836 - DNA, 27 bp, Artificial Sequences
  Synthetic
gagagggcgcggaaggtgtttagtggt

SEQ ID NO: 2837 - DNA, 27 bp, Artificial Sequences
  Synthetic
cgcggaaggtgtttagtggtcggatgg

SEQ ID NO: 2838 - DNA, 27 bp, Artificial Sequences
  Synthetic
ttcggtcgagagtaggggtgcgagagg

SEQ ID NO: 2839 - DNA, 26 bp, Artificial Sequences
  Synthetic
cggttgtagttttaggcgcggcggtc

SEQ ID NO: 2840 - DNA, 25 bp, Artificial Sequences
  Synthetic
cggttgtagttttaggcgcggcggt

SEQ ID NO: 2841 - DNA, 27 bp, Artificial Sequences
  Synthetic
gcggttgtagttttaggcgcggcggtc

SEQ ID NO: 2842 - DNA, 25 bp, Artificial Sequences
  Synthetic
gcggttgtagttttaggcgcggcgg

SEQ ID NO: 2843 - DNA, 26 bp, Artificial Sequences
  Synthetic
gcggttgtagttttaggcgcggcggt

SEQ ID NO: 2844 - DNA, 27 bp, Artificial Sequences
  Synthetic
aaggggtagggtaggttttcggtggcg

SEQ ID NO: 2845 - DNA, 27 bp, Artificial Sequences
  Synthetic
gcgcggaaggtgtttagtggtcggatg

SEQ ID NO: 2846 - DNA, 27 bp, Artificial Sequences
  Synthetic
agagggcgcggaaggtgtttagtggtc

SEQ ID NO: 2847 - DNA, 27 bp, Artificial Sequences
  Synthetic
gagagggcgcggaaggtgtttagtggt

SEQ ID NO: 2848 - DNA, 27 bp, Artificial Sequences
  Synthetic
cggtcgtcgcgtttgaggttgtagtcg

SEQ ID NO: 2849 - DNA, 27 bp, Artificial Sequences
  Synthetic
tcgtaggtgtggttttagaatcggcgt

SEQ ID NO: 2850 - DNA, 28 bp, Artificial Sequences
  Synthetic
gcggtagcgtttggttatgttttggtcg

SEQ ID NO: 2851 - DNA, 29 bp, Artificial Sequences
  Synthetic
gcggtagcgtttggttatgttttggtcgt

SEQ ID NO: 2852 - DNA, 28 bp, Artificial Sequences
  Synthetic
ttcgtaggtgtggttttagaatcggcgt

SEQ ID NO: 2853 - DNA, 28 bp, Artificial Sequences
  Synthetic
cggtagcgtttggttatgttttggtcgt

SEQ ID NO: 2854 - DNA, 27 bp, Artificial Sequences
  Synthetic
aaggggtagggtaggttttcggtggcg

SEQ ID NO: 2855 - DNA, 27 bp, Artificial Sequences
  Synthetic
cggtcgtcgcgtttgaggttgtagtcg

SEQ ID NO: 2856 - DNA, 27 bp, Artificial Sequences
  Synthetic
gggtagggtaggttttcggtggcggtc

SEQ ID NO: 2857 - DNA, 27 bp, Artificial Sequences
  Synthetic
ggtagggtaggttttcggtggcggtcg

SEQ ID NO: 2858 - DNA, 27 bp, Artificial Sequences
  Synthetic
gtgcgagtggaaggggtagggtaggtt

SEQ ID NO: 2859 - DNA, 27 bp, Artificial Sequences
  Synthetic
tcgtaggtgtggttttagaatcggcgt

SEQ ID NO: 2860 - DNA, 28 bp, Artificial Sequences
  Synthetic
gcggtagcgtttggttatgttttggtcg

SEQ ID NO: 2861 - DNA, 29 bp, Artificial Sequences
  Synthetic
gcggtagcgtttggttatgttttggtcgt

SEQ ID NO: 2862 - DNA, 28 bp, Artificial Sequences
  Synthetic
ttcgtaggtgtggttttagaatcggcgt

SEQ ID NO: 2863 - DNA, 28 bp, Artificial Sequences
  Synthetic
cggtagcgtttggttatgttttggtcgt

SEQ ID NO: 2864 - DNA, 27 bp, Artificial Sequences
  Synthetic
aaggggtagggtaggttttcggtggcg

SEQ ID NO: 2865 - DNA, 27 bp, Artificial Sequences
  Synthetic
ggggtcggttgggtgcggttaggatat

SEQ ID NO: 2866 - DNA, 27 bp, Artificial Sequences
  Synthetic
gggtagggtaggttttcggtggcggtc

SEQ ID NO: 2867 - DNA, 27 bp, Artificial Sequences
  Synthetic
tgtagaagttggggtcggttgggtgcg

SEQ ID NO: 2868 - DNA, 27 bp, Artificial Sequences
  Synthetic
ggtagggtaggttttcggtggcggtcg

SEQ ID NO: 2869 - DNA, 27 bp, Artificial Sequences
  Synthetic
tgggataggagttgggaatacggggcg

SEQ ID NO: 2870 - DNA, 28 bp, Artificial Sequences
  Synthetic
ttgggataggagttgggaatacggggcg

SEQ ID NO: 2871 - DNA, 27 bp, Artificial Sequences
  Synthetic
aggttcggaaggggtagaggttttggg

SEQ ID NO: 2872 - DNA, 27 bp, Artificial Sequences
  Synthetic
ggttcggaaggggtagaggttttggga

SEQ ID NO: 2873 - DNA, 27 bp, Artificial Sequences
  Synthetic
ttgggataggagttgggaatacggggc

SEQ ID NO: 2874 - DNA, 27 bp, Artificial Sequences
  Synthetic
ggggtcggttgggtgcggttaggatat

SEQ ID NO: 2875 - DNA, 27 bp, Artificial Sequences
  Synthetic
tgtagaagttggggtcggttgggtgcg

SEQ ID NO: 2876 - DNA, 27 bp, Artificial Sequences
  Synthetic
gtgtagaagttggggtcggttgggtgc

SEQ ID NO: 2877 - DNA, 27 bp, Artificial Sequences
  Synthetic
gaagttggggtcggttgggtgcggtta

SEQ ID NO: 2878 - DNA, 27 bp, Artificial Sequences
  Synthetic
aagttggggtcggttgggtgcggttag

SEQ ID NO: 2879 - DNA, 27 bp, Artificial Sequences
  Synthetic
gggtattcggggttgggtttggtcgga

SEQ ID NO: 2880 - DNA, 27 bp, Artificial Sequences
  Synthetic
agggtattcggggttgggtttggtcgg

SEQ ID NO: 2881 - DNA, 27 bp, Artificial Sequences
  Synthetic
ggtattcggggttgggtttggtcggag

SEQ ID NO: 2882 - DNA, 28 bp, Artificial Sequences
  Synthetic
ggtattcggggttgggtttggtcggaga

SEQ ID NO: 2883 - DNA, 28 bp, Artificial Sequences
  Synthetic
tagggtattcggggttgggtttggtcgg

SEQ ID NO: 2884 - DNA, 27 bp, Artificial Sequences
  Synthetic
gtggtttcgggtaggttgagtgtcgcg

SEQ ID NO: 2885 - DNA, 27 bp, Artificial Sequences
  Synthetic
ggtggtttcgggtaggttgagtgtcgc

SEQ ID NO: 2886 - DNA, 27 bp, Artificial Sequences
  Synthetic
tgagtgtcgcggttagttcgtatcggc

SEQ ID NO: 2887 - DNA, 28 bp, Artificial Sequences
  Synthetic
tggtggtttcgggtaggttgagtgtcgc

SEQ ID NO: 2888 - DNA, 27 bp, Artificial Sequences
  Synthetic
cgggtaggttgagtgtcgcggttagtt

SEQ ID NO: 2889 - DNA, 27 bp, Artificial Sequences
  Synthetic
gggtggtttcggttttggcgcggatta

SEQ ID NO: 2890 - DNA, 27 bp, Artificial Sequences
  Synthetic
cggcgtcgggtttaggtttcggaagtt

SEQ ID NO: 2891 - DNA, 28 bp, Artificial Sequences
  Synthetic
gggtggtttcggttttggcgcggattaa

SEQ ID NO: 2892 - DNA, 27 bp, Artificial Sequences
  Synthetic
ggtggtttcggttttggcgcggattaa

SEQ ID NO: 2893 - DNA, 28 bp, Artificial Sequences
  Synthetic
cggcgtcgggtttaggtttcggaagttt

SEQ ID NO: 2894 - DNA, 25 bp, Artificial Sequences
  Synthetic
gcggttagttcgtatcggcggggtc

SEQ ID NO: 2895 - DNA, 30 bp, Artificial Sequences
  Synthetic
gcgttagagtcggagttatttagcgtcgcg

SEQ ID NO: 2896 - DNA, 24 bp, Artificial Sequences
  Synthetic
gcggttagttcgtatcggcggggt

SEQ ID NO: 2897 - DNA, 29 bp, Artificial Sequences
  Synthetic
gcgttagagtcggagttatttagcgtcgc

SEQ ID NO: 2898 - DNA, 29 bp, Artificial Sequences
  Synthetic
cgttagagtcggagttatttagcgtcgcg

SEQ ID NO: 2899 - DNA, 27 bp, Artificial Sequences
  Synthetic
cggcgtcgggtttaggtttcggaagtt

SEQ ID NO: 2900 - DNA, 28 bp, Artificial Sequences
  Synthetic
cggcgtcgggtttaggtttcggaagttt

SEQ ID NO: 2901 - DNA, 26 bp, Artificial Sequences
  Synthetic
cggcgtcgggtttaggtttcggaagt

SEQ ID NO: 2902 - DNA, 29 bp, Artificial Sequences
  Synthetic
cggcgtcgggtttaggtttcggaagtttg

SEQ ID NO: 2903 - DNA, 27 bp, Artificial Sequences
  Synthetic
ggcgtcgggtttaggtttcggaagttt

SEQ ID NO: 2904 - DNA, 27 bp, Artificial Sequences
  Synthetic
agagtcggagttatttagcgtcgcgtt

SEQ ID NO: 2905 - DNA, 30 bp, Artificial Sequences; identical to SEQ ID NO: 2895
  Synthetic

SEQ ID NO: 2906 - DNA, 31 bp, Artificial Sequences
  Synthetic
gcgttagagtcggagttatttagcgtcgcgt

SEQ ID NO: 2907 - DNA, 28 bp, Artificial Sequences
  Synthetic
agagtcggagttatttagcgtcgcgttt

SEQ ID NO: 2908 - DNA, 29 bp, Artificial Sequences
  Synthetic
gcgttagagtcggagttatttagcgtcgc

SEQ ID NO: 2909 - DNA, 27 bp, Artificial Sequences
  Synthetic
tgttagggtacgtagagagcggttcgg

SEQ ID NO: 2910 - DNA, 28 bp, Artificial Sequences
  Synthetic
ttgttagggtacgtagagagcggttcgg

SEQ ID NO: 2911 - DNA, 27 bp, Artificial Sequences
  Synthetic
ttgttagggtacgtagagagcggttcg

SEQ ID NO: 2912 - DNA, 29 bp, Artificial Sequences
  Synthetic
tgcgttgttggtcgtttgtttgttagggt

SEQ ID NO: 2913 - DNA, 28 bp, Artificial Sequences
  Synthetic
gcgttgttggtcgtttgtttgttagggt

SEQ ID NO: 2914 - DNA, 31 bp, Artificial Sequences
  Synthetic
agtggttgtaggattaatagttcggcgttgg

SEQ ID NO: 2915 - DNA, 31 bp, Artificial Sequences
  Synthetic
ggtagtcgagtcgttttttgcgtattttggt

SEQ ID NO: 2916 - DNA, 32 bp, Artificial Sequences
  Synthetic
gagtggttgtaggattaatagttcggcgttgg

SEQ ID NO: 2917 - DNA, 31 bp, Artificial Sequences
  Synthetic
tgagtggttgtaggattaatagttcggcgtt

SEQ ID NO: 2918 - DNA, 33 bp, Artificial Sequences
  Synthetic
tgagtggttgtaggattaatagttcggcgttgg

SEQ ID NO: 2919 - DNA, 27 bp, Artificial Sequences
  Synthetic
cgggcgggagtgggtggtgattgtaaa

SEQ ID NO: 2920 - DNA, 27 bp, Artificial Sequences
  Synthetic
atttggtgtgagaaacgggcgggagtg

SEQ ID NO: 2921 - DNA, 27 bp, Artificial Sequences
  Synthetic
tttggtgtgagaaacgggcgggagtgg

SEQ ID NO: 2922 - DNA, 27 bp, Artificial Sequences
  Synthetic
gggcgggagtgggtggtgattgtaaaa

SEQ ID NO: 2923 - DNA, 27 bp, Artificial Sequences
  Synthetic
aatttggtgtgagaaacgggcgggagt

SEQ ID NO: 2924 - DNA, 27 bp, Artificial Sequences
  Synthetic
cggcgtcgggggagaaagttatttagt

SEQ ID NO: 2925 - DNA, 28 bp, Artificial Sequences
  Synthetic
cggcgtcgggggagaaagttatttagtt

SEQ ID NO: 2926 - DNA, 29 bp, Artificial Sequences
  Synthetic
tcgatttgggttttttagttttcgcgggt

SEQ ID NO: 2927 - DNA, 30 bp, Artificial Sequences
  Synthetic
tcgatttgggttttttagttttcgcgggtt

SEQ ID NO: 2928 - DNA, 30 bp, Artificial Sequences
  Synthetic
ttcgatttgggttttttagttttcgcgggt

SEQ ID NO: 2929 - DNA, 27 bp, Artificial Sequences
  Synthetic
cgcgggagttgagaggtttaggtcgga

SEQ ID NO: 2930 - DNA, 27 bp, Artificial Sequences
  Synthetic
tcgcgggagttgagaggtttaggtcgg

SEQ ID NO: 2931 - DNA, 27 bp, Artificial Sequences
  Synthetic
cgggcgggagtgggtggtgattgtaaa

SEQ ID NO: 2932 - DNA, 27 bp, Artificial Sequences
  Synthetic
atttggtgtgagaaacgggcgggagtg

SEQ ID NO: 2933 - DNA, 27 bp, Artificial Sequences
  Synthetic
tttggtgtgagaaacgggcgggagtgg

SEQ ID NO: 2934 - DNA, 27 bp, Artificial Sequences
  Synthetic
tgaagcgtttttggggttggcggtaga

SEQ ID NO: 2935 - DNA, 27 bp, Artificial Sequences
  Synthetic
aagcgtttttggggttggcggtagaga

SEQ ID NO: 2936 - DNA, 27 bp, Artificial Sequences
  Synthetic
agcgtttttggggttggcggtagagat

SEQ ID NO: 2937 - DNA, 28 bp, Artificial Sequences
  Synthetic
tgaagcgtttttggggttggcggtagag

SEQ ID NO: 2938 - DNA, 27 bp, Artificial Sequences
  Synthetic
gaagcgtttttggggttggcggtagag

SEQ ID NO: 2939 - DNA, 27 bp, Artificial Sequences
  Synthetic
agagcgggttatgtgggttcgtttttg

SEQ ID NO: 2940 - DNA, 27 bp, Artificial Sequences
  Synthetic
gagcgggttatgtgggttcgtttttga

SEQ ID NO: 2941 - DNA, 28 bp, Artificial Sequences
  Synthetic
agagcgggttatgtgggttcgtttttga

SEQ ID NO: 2942 - DNA, 28 bp, Artificial Sequences
  Synthetic
gagcgggttatgtgggttcgtttttgaa

SEQ ID NO: 2943 - DNA, 29 bp, Artificial Sequences
  Synthetic
agagcgggttatgtgggttcgtttttgaa

SEQ ID NO: 2944 - DNA, 27 bp, Artificial Sequences
  Synthetic
gttgttgggggttgtaggtcgagaggt

SEQ ID NO: 2945 - DNA, 27 bp, Artificial Sequences
  Synthetic
tgttgggggttgtaggtcgagaggttc

SEQ ID NO: 2946 - DNA, 27 bp, Artificial Sequences
  Synthetic
ttgttgggggttgtaggtcgagaggtt

SEQ ID NO: 2947 - DNA, 28 bp, Artificial Sequences
  Synthetic
gttgttgggggttgtaggtcgagaggtt

SEQ ID NO: 2948 - DNA, 27 bp, Artificial Sequences
  Synthetic
gagaagtcgtcgaaggtagtggcgttc

SEQ ID NO: 2949 - DNA, 27 bp, Artificial Sequences
  Synthetic
gcgcgttgttttgggtcgttacgttcg

SEQ ID NO: 2950 - DNA, 27 bp, Artificial Sequences
  Synthetic
ggcgcgttgttttgggtcgttacgttc

SEQ ID NO: 2951 - DNA, 27 bp, Artificial Sequences
  Synthetic
cgcgttgttttgggtcgttacgttcgt

SEQ ID NO: 2952 - DNA, 28 bp, Artificial Sequences
  Synthetic
gcgcgttgttttgggtcgttacgttcgt

SEQ ID NO: 2953 - DNA, 28 bp, Artificial Sequences
  Synthetic
ggcgcgttgttttgggtcgttacgttcg

SEQ ID NO: 2954 - DNA, 27 bp, Artificial Sequences
  Synthetic
ttttggtttagcggtcgtttcgggcgt

SEQ ID NO: 2955 - DNA, 27 bp, Artificial Sequences
  Synthetic
tttggtttagcggtcgtttcgggcgta

SEQ ID NO: 2956 - DNA, 27 bp, Artificial Sequences
  Synthetic
ttggtttagcggtcgtttcgggcgtat

SEQ ID NO: 2957 - DNA, 27 bp, Artificial Sequences
  Synthetic
gaaggtagtggcgttcgtaggttgcgt

SEQ ID NO: 2958 - DNA, 27 bp, Artificial Sequences
  Synthetic
tttttggtttagcggtcgtttcgggcg

SEQ ID NO: 2959 - DNA, 27 bp, Artificial Sequences
  Synthetic
gcgcgttgttttgggtcgttacgttcg

SEQ ID NO: 2960 - DNA, 27 bp, Artificial Sequences
  Synthetic
ggcgcgttgttttgggtcgttacgttc

SEQ ID NO: 2961 - DNA, 27 bp, Artificial Sequences
  Synthetic
cgcgttgttttgggtcgttacgttcgt

SEQ ID NO: 2962 - DNA, 28 bp, Artificial Sequences
  Synthetic
gcgcgttgttttgggtcgttacgttcgt

SEQ ID NO: 2963 - DNA, 28 bp, Artificial Sequences
  Synthetic
ggcgcgttgttttgggtcgttacgttcg

SEQ ID NO: 2964 - DNA, 27 bp, Artificial Sequences
  Synthetic
ttttggtttagcggtcgtttcgggcgt

SEQ ID NO: 2965 - DNA, 27 bp, Artificial Sequences
  Synthetic
tttggtttagcggtcgtttcgggcgta

SEQ ID NO: 2966 - DNA, 27 bp, Artificial Sequences
  Synthetic
ttggtttagcggtcgtttcgggcgtat

SEQ ID NO: 2967 - DNA, 27 bp, Artificial Sequences
  Synthetic
tttttggtttagcggtcgtttcgggcg

SEQ ID NO: 2968 - DNA, 28 bp, Artificial Sequences
  Synthetic
tttttggtttagcggtcgtttcgggcgt

SEQ ID NO: 2969 - DNA, 26 bp, Artificial Sequences
  Synthetic
ggtcgttgggttagaggagcgcggtc

SEQ ID NO: 2970 - DNA, 25 bp, Artificial Sequences
  Synthetic
ggtcgttgggttagaggagcgcggt

SEQ ID NO: 2971 - DNA, 25 bp, Artificial Sequences
  Synthetic
gtcgttgggttagaggagcgcggtc

SEQ ID NO: 2972 - DNA, 29 bp, Artificial Sequences
  Synthetic
gcgtagtttgcgggcgttattgttttcgg

SEQ ID NO: 2973 - DNA, 28 bp, Artificial Sequences
  Synthetic
gcgtagtttgcgggcgttattgttttcg

SEQ ID NO: 2974 - DNA, 27 bp, Artificial Sequences
  Synthetic
ttttggtttagcggtcgtttcgggcgt

SEQ ID NO: 2975 - DNA, 27 bp, Artificial Sequences
  Synthetic
tttggtttagcggtcgtttcgggcgta

SEQ ID NO: 2976 - DNA, 27 bp, Artificial Sequences
  Synthetic
ttggtttagcggtcgtttcgggcgtat

SEQ ID NO: 2977 - DNA, 27 bp, Artificial Sequences
  Synthetic
tttttggtttagcggtcgtttcgggcg

SEQ ID NO: 2978 - DNA, 28 bp, Artificial Sequences
  Synthetic
tttttggtttagcggtcgtttcgggcgt

SEQ ID NO: 2979 - DNA, 26 bp, Artificial Sequences
  Synthetic
ggtcgttgggttagaggagcgcggtc

SEQ ID NO: 2980 - DNA, 25 bp, Artificial Sequences
  Synthetic
ggtcgttgggttagaggagcgcggt

SEQ ID NO: 2981 - DNA, 25 bp, Artificial Sequences
  Synthetic
gtcgttgggttagaggagcgcggtc

SEQ ID NO: 2982 - DNA, 24 bp, Artificial Sequences
  Synthetic
ggtcgttgggttagaggagcgcgg

SEQ ID NO: 2983 - DNA, 24 bp, Artificial Sequences
  Synthetic
gtcgttgggttagaggagcgcggt

SEQ ID NO: 2984 - DNA, 27 bp, Artificial Sequences
  Synthetic
ttttggagtagggtcgtggagttcggc

SEQ ID NO: 2985 - DNA, 28 bp, Artificial Sequences
  Synthetic
tttttggagtagggtcgtggagttcggc

SEQ ID NO: 2986 - DNA, 29 bp, Artificial Sequences
  Synthetic
ggggcgtagggagttttttggagtagggt

SEQ ID NO: 2987 - DNA, 28 bp, Artificial Sequences
  Synthetic
ggggcgtagggagttttttggagtaggg

SEQ ID NO: 2988 - DNA, 29 bp, Artificial Sequences
  Synthetic
aggggcgtagggagttttttggagtaggg

SEQ ID NO: 2989 - DNA, 32 bp, Artificial Sequences
  Synthetic
gggggttttttgcgtttttggttttaaggacg

SEQ ID NO: 2990 - DNA, 33 bp, Artificial Sequences
  Synthetic
agggggttttttgcgtttttggttttaaggacg

SEQ ID NO: 2991 - DNA, 33 bp, Artificial Sequences
  Synthetic
gggggttttttgcgtttttggttttaaggacga

SEQ ID NO: 2992 - DNA, 31 bp, Artificial Sequences
  Synthetic
agggggttttttgcgtttttggttttaagga

SEQ ID NO: 2993 - DNA, 31 bp, Artificial Sequences
  Synthetic
ggggttttttgcgtttttggttttaaggacg

SEQ ID NO: 2994 - DNA, 27 bp, Artificial Sequences
  Synthetic
tcggttcggggagtatgggtatcgttt

SEQ ID NO: 2995 - DNA, 27 bp, Artificial Sequences
  Synthetic
atcggttcggggagtatgggtatcgtt

SEQ ID NO: 2996 - DNA, 27 bp, Artificial Sequences
  Synthetic
aatcggttcggggagtatgggtatcgt

SEQ ID NO: 2997 - DNA, 27 bp, Artificial Sequences
  Synthetic
tcgtcgggtagtgaaggtcgtaggtaa

SEQ ID NO: 2998 - DNA, 27 bp, Artificial Sequences
  Synthetic
agttgagcgggtttttggtgtcgtttt

SEQ ID NO: 2999 - DNA, 27 bp, Artificial Sequences
  Synthetic
tggttgcgtttcgaaggtttggtgcgt

SEQ ID NO: 3000 - DNA, 27 bp, Artificial Sequences
  Synthetic
gcggttggttgcgtttcgaaggtttgg

SEQ ID NO: 3001 - DNA, 27 bp, Artificial Sequences
  Synthetic
ggttgcgtttcgaaggtttggtgcgtt

SEQ ID NO: 3002 - DNA, 27 bp, Artificial Sequences
  Synthetic
ttggttgcgtttcgaaggtttggtgcg

SEQ ID NO: 3003 - DNA, 28 bp, Artificial Sequences
  Synthetic
tggttgcgtttcgaaggtttggtgcgtt

SEQ ID NO: 3004 - DNA, 27 bp, Artificial Sequences
  Synthetic
ggggggtaagggttcgcgttaaggagt

SEQ ID NO: 3005 - DNA, 27 bp, Artificial Sequences
  Synthetic
aagcgttttgggttgtggagtgggtcg

SEQ ID NO: 3006 - DNA, 27 bp, Artificial Sequences
  Synthetic
cggggggtaagggttcgcgttaaggag

SEQ ID NO: 3007 - DNA, 27 bp, Artificial Sequences
  Synthetic
agcgggttgggattggaatgaaagcgt

SEQ ID NO: 3008 - DNA, 26 bp, Artificial Sequences
  Synthetic
cggggggtaagggttcgcgttaagga

SEQ ID NO: 3009 - DNA, 27 bp, Artificial Sequences
  Synthetic
ataggggaagggggcggtcggtttttt

SEQ ID NO: 3010 - DNA, 27 bp, Artificial Sequences
  Synthetic
ttgtagtggcgcgtcggtgtatagggg

SEQ ID NO: 3011 - DNA, 27 bp, Artificial Sequences
  Synthetic
gtataggggaagggggcggtcggtttt

SEQ ID NO: 3012 - DNA, 27 bp, Artificial Sequences
  Synthetic
gtagtggcgcgtcggtgtataggggaa

SEQ ID NO: 3013 - DNA, 27 bp, Artificial Sequences
  Synthetic
tagtggcgcgtcggtgtataggggaag

SEQ ID NO: 3014 - DNA, 27 bp, Artificial Sequences
  Synthetic
ggggggtaagggttcgcgttaaggagt

SEQ ID NO: 3015 - DNA, 27 bp, Artificial Sequences
  Synthetic
aagcgttttgggttgtggagtgggtcg

SEQ ID NO: 3016 - DNA, 27 bp, Artificial Sequences
  Synthetic
cggggggtaagggttcgcgttaaggag

SEQ ID NO: 3017 - DNA, 27 bp, Artificial Sequences
  Synthetic
agcgggttgggattggaatgaaagcgt

SEQ ID NO: 3018 - DNA, 26 bp, Artificial Sequences
  Synthetic
cggggggtaagggttcgcgttaagga

SEQ ID NO: 3019 - DNA, 27 bp, Artificial Sequences
  Synthetic
gcgatttggcgggggagggtgagttat

SEQ ID NO: 3020 - DNA, 27 bp, Artificial Sequences
  Synthetic
cgatttggcgggggagggtgagttatt

SEQ ID NO: 3021 - DNA, 26 bp, Artificial Sequences
  Synthetic
gcgatttggcgggggagggtgagtta

SEQ ID NO: 3022 - DNA, 28 bp, Artificial Sequences
  Synthetic
gcgatttggcgggggagggtgagttatt

SEQ ID NO: 3023 - DNA, 27 bp, Artificial Sequences
  Synthetic
tttggcgggggagggtgagttatttgt

SEQ ID NO: 3024 - DNA, 27 bp, Artificial Sequences
  Synthetic
ggggggtaagggttcgcgttaaggagt

SEQ ID NO: 3025 - DNA, 27 bp, Artificial Sequences
  Synthetic
cggggggtaagggttcgcgttaaggag

SEQ ID NO: 3026 - DNA, 26 bp, Artificial Sequences
  Synthetic
cggggggtaagggttcgcgttaagga

SEQ ID NO: 3027 - DNA, 28 bp, Artificial Sequences
  Synthetic
ggggggtaagggttcgcgttaaggagtc

SEQ ID NO: 3028 - DNA, 26 bp, Artificial Sequences
  Synthetic
cgttttgggttgtggagtgggtcggg

SEQ ID NO: 3029 - DNA, 27 bp, Artificial Sequences
  Synthetic
gggtggggtgtaggtagttcggcgttt

SEQ ID NO: 3030 - DNA, 27 bp, Artificial Sequences
  Synthetic
gtacggggtggggtgtaggtagttcgg

SEQ ID NO: 3031 - DNA, 27 bp, Artificial Sequences
  Synthetic
ggtacggggtggggtgtaggtagttcg

SEQ ID NO: 3032 - DNA, 27 bp, Artificial Sequences
  Synthetic
tacggggtggggtgtaggtagttcggc

SEQ ID NO: 3033 - DNA, 26 bp, Artificial Sequences
  Synthetic
gggtggggtgtaggtagttcggcgtt

SEQ ID NO: 3034 - DNA, 27 bp, Artificial Sequences
  Synthetic
ggggggtaagggttcgcgttaaggagt

SEQ ID NO: 3035 - DNA, 27 bp, Artificial Sequences
  Synthetic
cggggggtaagggttcgcgttaaggag

SEQ ID NO: 3036 - DNA, 26 bp, Artificial Sequences
  Synthetic
cggggggtaagggttcgcgttaagga

SEQ ID NO: 3037 - DNA, 28 bp, Artificial Sequences
  Synthetic
ggggggtaagggttcgcgttaaggagtc

SEQ ID NO: 3038 - DNA, 28 bp, Artificial Sequences
  Synthetic
gggggtaagggttcgcgttaaggagtcg

SEQ ID NO: 3039 - DNA, 27 bp, Artificial Sequences
  Synthetic
gggtggggtgtaggtagttcggcgttt

SEQ ID NO: 3040 - DNA, 27 bp, Artificial Sequences
  Synthetic
gtacggggtggggtgtaggtagttcgg

SEQ ID NO: 3041 - DNA, 27 bp, Artificial Sequences
  Synthetic
ggtacggggtggggtgtaggtagttcg

SEQ ID NO: 3042 - DNA, 27 bp, Artificial Sequences
  Synthetic
tacggggtggggtgtaggtagttcggc

SEQ ID NO: 3043 - DNA, 26 bp, Artificial Sequences
  Synthetic
gggtggggtgtaggtagttcggcgtt

SEQ ID NO: 3044 - DNA, 27 bp, Artificial Sequences
  Synthetic
cggaagttggagagttagcgacggggt

SEQ ID NO: 3045 - DNA, 27 bp, Artificial Sequences
  Synthetic
tcggaagttggagagttagcgacgggg

SEQ ID NO: 3046 - DNA, 28 bp, Artificial Sequences
  Synthetic
cggaagttggagagttagcgacggggtt

SEQ ID NO: 3047 - DNA, 27 bp, Artificial Sequences
  Synthetic
tttttcgggcgttaggggtcgtttcga

SEQ ID NO: 3048 - DNA, 28 bp, Artificial Sequences
  Synthetic
ttcggaagttggagagttagcgacgggg

SEQ ID NO: 3049 - DNA, 28 bp, Artificial Sequences
  Synthetic
gcgatcgtatttagaggaggcgttgggg

SEQ ID NO: 3050 - DNA, 29 bp, Artificial Sequences
  Synthetic
gcgatcgtatttagaggaggcgttgggga

SEQ ID NO: 3051 - DNA, 27 bp, Artificial Sequences
  Synthetic
gcgatcgtatttagaggaggcgttggg

SEQ ID NO: 3052 - DNA, 27 bp, Artificial Sequences
  Synthetic
cgatcgtatttagaggaggcgttgggg

SEQ ID NO: 3053 - DNA, 27 bp, Artificial Sequences
  Synthetic
aggtttatgtgttcggttcggttcggt

SEQ ID NO: 3054 - DNA, 27 bp, Artificial Sequences
  Synthetic
cggaagttggagagttagcgacggggt

SEQ ID NO: 3055 - DNA, 27 bp, Artificial Sequences
  Synthetic
tcggaagttggagagttagcgacgggg

SEQ ID NO: 3056 - DNA, 27 bp, Artificial Sequences
  Synthetic
gttgggcgggttaggttaggtcgggtc

SEQ ID NO: 3057 - DNA, 27 bp, Artificial Sequences
  Synthetic
gcggtcgcgtttgtggttttggtagtc

SEQ ID NO: 3058 - DNA, 28 bp, Artificial Sequences
  Synthetic
cggaagttggagagttagcgacggggtt

SEQ ID NO: 3059 - DNA, 27 bp, Artificial Sequences
  Synthetic
aggtttatgtgttcggttcggttcggt

SEQ ID NO: 3060 - DNA, 27 bp, Artificial Sequences
  Synthetic
ttatgtgttcggttcggttcggttcga

SEQ ID NO: 3061 - DNA, 29 bp, Artificial Sequences
  Synthetic
ggtttatgtgttcggttcggttcggttcg

SEQ ID NO: 3062 - DNA, 27 bp, Artificial Sequences
  Synthetic
tttatgtgttcggttcggttcggttcg

SEQ ID NO: 3063 - DNA, 27 bp, Artificial Sequences
  Synthetic
ggtttatgtgttcggttcggttcggtt

SEQ ID NO: 3064 - DNA, 27 bp, Artificial Sequences
  Synthetic
gggtcgcgcgattaatggtggaggttg

SEQ ID NO: 3065 - DNA, 27 bp, Artificial Sequences
  Synthetic
gttgggcgggttaggttaggtcgggtc

SEQ ID NO: 3066 - DNA, 27 bp, Artificial Sequences
  Synthetic
tgggtcgcgcgattaatggtggaggtt

SEQ ID NO: 3067 - DNA, 27 bp, Artificial Sequences
  Synthetic
tgggtttgcgggttttaattgcggcgt

SEQ ID NO: 3068 - DNA, 27 bp, Artificial Sequences
  Synthetic
gggtttgcgggttttaattgcggcgtt

SEQ ID NO: 3069 - DNA, 30 bp, Artificial Sequences
  Synthetic
ggttgtagtttttattattggtcgcgcggt

SEQ ID NO: 3070 - DNA, 30 bp, Artificial Sequences
  Synthetic
aggttgtagtttttattattggtcgcgcgg

SEQ ID NO: 3071 - DNA, 31 bp, Artificial Sequences
  Synthetic
aggttgtagtttttattattggtcgcgcggt

SEQ ID NO: 3072 - DNA, 31 bp, Artificial Sequences
  Synthetic
ggttgtagtttttattattggtcgcgcggtt

SEQ ID NO: 3073 - DNA, 32 bp, Artificial Sequences
  Synthetic
aggttgtagtttttattattggtcgcgcggtt

SEQ ID NO: 3074 - DNA, 27 bp, Artificial Sequences
  Synthetic
tcggcggcggatagtgtaatgttgggt

SEQ ID NO: 3075 - DNA, 27 bp, Artificial Sequences
  Synthetic
gggagttgttcggcggcggatagtgta

SEQ ID NO: 3076 - DNA, 27 bp, Artificial Sequences
  Synthetic
cggcggcggatagtgtaatgttgggtg

SEQ ID NO: 3077 - DNA, 27 bp, Artificial Sequences
  Synthetic
agtgtaatgttgggtgggagtgcggga

SEQ ID NO: 3078 - DNA, 27 bp, Artificial Sequences
  Synthetic
gcggcggatagtgtaatgttgggtggg

SEQ ID NO: 3079 - DNA, 27 bp, Artificial Sequences
  Synthetic
gttttgcgcgtttggtttcggcggttc

SEQ ID NO: 3080 - DNA, 27 bp, Artificial Sequences
  Synthetic
aggtcggttttgcgcgtttggtttcgg

SEQ ID NO: 3081 - DNA, 26 bp, Artificial Sequences
  Synthetic
ggtcggttttgcgcgtttggtttcgg

SEQ ID NO: 3082 - DNA, 26 bp, Artificial Sequences
  Synthetic
ttttgcgcgtttggtttcggcggttc

SEQ ID NO: 3083 - DNA, 26 bp, Artificial Sequences
  Synthetic
gttttgcgcgtttggtttcggcggtt

SEQ ID NO: 3084 - DNA, 27 bp, Artificial Sequences
  Synthetic
gcgtagggtcggtttgtaggtgtggtt

SEQ ID NO: 3085 - DNA, 28 bp, Artificial Sequences
  Synthetic
gcgtagggtcggtttgtaggtgtggttg

SEQ ID NO: 3086 - DNA, 29 bp, Artificial Sequences
  Synthetic
gcgtagggtcggtttgtaggtgtggttga

SEQ ID NO: 3087 - DNA, 27 bp, Artificial Sequences
  Synthetic
tgtaggtgtggttgatggttcggtcgt

SEQ ID NO: 3088 - DNA, 28 bp, Artificial Sequences
  Synthetic
gggtcggtttgtaggtgtggttgatggt

SEQ ID NO: 3089 - DNA, 27 bp, Artificial Sequences
  Synthetic
cgggggaacgtacgggtggtagaggtc

SEQ ID NO: 3090 - DNA, 26 bp, Artificial Sequences
  Synthetic
gggggaacgtacgggtggtagaggtc

SEQ ID NO: 3091 - DNA, 26 bp, Artificial Sequences
  Synthetic
cgttgtcgggggttgggagggtatcg

SEQ ID NO: 3092 - DNA, 26 bp, Artificial Sequences
  Synthetic
cgggggaacgtacgggtggtagaggt

SEQ ID NO: 3093 - DNA, 25 bp, Artificial Sequences
  Synthetic
cgggggaacgtacgggtggtagagg

SEQ ID NO: 3094 - DNA, 27 bp, Artificial Sequences
  Synthetic
gcgtagggtcggtttgtaggtgtggtt

SEQ ID NO: 3095 - DNA, 28 bp, Artificial Sequences
  Synthetic
gcgtagggtcggtttgtaggtgtggttg

SEQ ID NO: 3096 - DNA, 29 bp, Artificial Sequences
  Synthetic
gcgtagggtcggtttgtaggtgtggttga

SEQ ID NO: 3097 - DNA, 27 bp, Artificial Sequences
  Synthetic
tgtaggtgtggttgatggttcggtcgt

SEQ ID NO: 3098 - DNA, 28 bp, Artificial Sequences
  Synthetic
gggtcggtttgtaggtgtggttgatggt

SEQ ID NO: 3099 - DNA, 26 bp, Artificial Sequences
  Synthetic
gttcggaggtagaggcggttaggggc

SEQ ID NO: 3100 - DNA, 26 bp, Artificial Sequences
  Synthetic
cgggttcggaggtagaggcggttagg

SEQ ID NO: 3101 - DNA, 27 bp, Artificial Sequences
  Synthetic
gggttcggaggtagaggcggttagggg

SEQ ID NO: 3102 - DNA, 27 bp, Artificial Sequences
  Synthetic
cgggggaacgtacgggtggtagaggtc

SEQ ID NO: 3103 - DNA, 26 bp, Artificial Sequences
  Synthetic
ggttcggaggtagaggcggttagggg

SEQ ID NO: 3104 - DNA, 27 bp, Artificial Sequences
  Synthetic
gcgtagggtcggtttgtaggtgtggtt

SEQ ID NO: 3105 - DNA, 28 bp, Artificial Sequences
  Synthetic
gcgtagggtcggtttgtaggtgtggttg

SEQ ID NO: 3106 - DNA, 27 bp, Artificial Sequences
  Synthetic
cggtcgttacgtgcgtttttggatgga

SEQ ID NO: 3107 - DNA, 27 bp, Artificial Sequences
  Synthetic
tcggtcgttacgtgcgtttttggatgg

SEQ ID NO: 3108 - DNA, 29 bp, Artificial Sequences
  Synthetic
gcgtagggtcggtttgtaggtgtggttga

SEQ ID NO: 3109 - DNA, 27 bp, Artificial Sequences
  Synthetic
tcgttcgggaagtcgggtagcggtttt

SEQ ID NO: 3110 - DNA, 27 bp, Artificial Sequences
  Synthetic
atcgttcgggaagtcgggtagcggttt

SEQ ID NO: 3111 - DNA, 27 bp, Artificial Sequences
  Synthetic
gttgggtcgttggggttagggttggga

SEQ ID NO: 3112 - DNA, 27 bp, Artificial Sequences
  Synthetic
tgggtcgttggggttagggttgggatc

SEQ ID NO: 3113 - DNA, 27 bp, Artificial Sequences
  Synthetic
gtatcgttcgggaagtcgggtagcggt

SEQ ID NO: 3114 - DNA, 27 bp, Artificial Sequences
  Synthetic
cggttcgggtcgcggttttagttttgg

SEQ ID NO: 3115 - DNA, 28 bp, Artificial Sequences
  Synthetic
cggttcgggtcgcggttttagttttggt

SEQ ID NO: 3116 - DNA, 27 bp, Artificial Sequences
  Synthetic
ggttcgggtcgcggttttagttttggt

SEQ ID NO: 3117 - DNA, 29 bp, Artificial Sequences
  Synthetic
cggttcgggtcgcggttttagttttggtt

SEQ ID NO: 3118 - DNA, 27 bp, Artificial Sequences
  Synthetic
acgtgcgtttttggatggagtcgttgt

SEQ ID NO: 3119 - DNA, 27 bp, Artificial Sequences
  Synthetic
ggaagtggaggaggaggaggtggtgga

SEQ ID NO: 3120 - DNA, 27 bp, Artificial Sequences
  Synthetic
aagtggaggaggaggaggtggtggagg

SEQ ID NO: 3121 - DNA, 27 bp, Artificial Sequences
  Synthetic
aggaagtggaggaggaggaggtggtgg

SEQ ID NO: 3122 - DNA, 27 bp, Artificial Sequences
  Synthetic
gaagtggaggaggaggaggtggtggag

SEQ ID NO: 3123 - DNA, 27 bp, Artificial Sequences
  Synthetic
aaggaagtggaggaggaggaggtggtg

SEQ ID NO: 3124 - DNA, 28 bp, Artificial Sequences
  Synthetic
ggttcgggagttttaggggagtagcggt

SEQ ID NO: 3125 - DNA, 28 bp, Artificial Sequences
  Synthetic
tggttcgggagttttaggggagtagcgg

SEQ ID NO: 3126 - DNA, 27 bp, Artificial Sequences
  Synthetic
ggttcgggagttttaggggagtagcgg

SEQ ID NO: 3127 - DNA, 29 bp, Artificial Sequences
  Synthetic
gtggttcgggagttttaggggagtagcgg

SEQ ID NO: 3128 - DNA, 27 bp, Artificial Sequences
  Synthetic
gttcgggagttttaggggagtagcggt

SEQ ID NO: 3129 - DNA, 27 bp, Artificial Sequences
  Synthetic
tcgggtggtcgttgtaagttgagggtt

SEQ ID NO: 3130 - DNA, 29 bp, Artificial Sequences
  Synthetic
gggatcgggtggtcgttgtaagttgaggg

SEQ ID NO: 3131 - DNA, 27 bp, Artificial Sequences
  Synthetic
atcgggtggtcgttgtaagttgagggt

SEQ ID NO: 3132 - DNA, 27 bp, Artificial Sequences
  Synthetic
tgggatcgggtggtcgttgtaagttga

SEQ ID NO: 3133 - DNA, 28 bp, Artificial Sequences
  Synthetic
ggatcgggtggtcgttgtaagttgaggg

SEQ ID NO: 3134 - DNA, 28 bp, Artificial Sequences
  Synthetic
ggttcgggagttttaggggagtagcggt

SEQ ID NO: 3135 - DNA, 28 bp, Artificial Sequences
  Synthetic
tggttcgggagttttaggggagtagcgg

SEQ ID NO: 3136 - DNA, 27 bp, Artificial Sequences
  Synthetic
ggttcgggagttttaggggagtagcgg

SEQ ID NO: 3137 - DNA, 29 bp, Artificial Sequences
  Synthetic
gtggttcgggagttttaggggagtagcgg

SEQ ID NO: 3138 - DNA, 27 bp, Artificial Sequences
  Synthetic
gttcgggagttttaggggagtagcggt

SEQ ID NO: 3139 - DNA, 27 bp, Artificial Sequences
  Synthetic
tcgggtggtcgttgtaagttgagggtt

SEQ ID NO: 3140 - DNA, 29 bp, Artificial Sequences
  Synthetic
gggatcgggtggtcgttgtaagttgaggg

SEQ ID NO: 3141 - DNA, 27 bp, Artificial Sequences
  Synthetic
atcgggtggtcgttgtaagttgagggt

SEQ ID NO: 3142 - DNA, 27 bp, Artificial Sequences
  Synthetic
tgggatcgggtggtcgttgtaagttga

SEQ ID NO: 3143 - DNA, 28 bp, Artificial Sequences
  Synthetic
ggatcgggtggtcgttgtaagttgaggg

SEQ ID NO: 3144 - DNA, 27 bp, Artificial Sequences
  Synthetic
gggggaatcgggtttggggtagggatc

SEQ ID NO: 3145 - DNA, 27 bp, Artificial Sequences
  Synthetic
gaatcgggtttggggtagggatcgggg

SEQ ID NO: 3146 - DNA, 27 bp, Artificial Sequences
  Synthetic
ggaatcgggtttggggtagggatcggg

SEQ ID NO: 3147 - DNA, 27 bp, Artificial Sequences
  Synthetic
gggaatcgggtttggggtagggatcgg

SEQ ID NO: 3148 - DNA, 27 bp, Artificial Sequences
  Synthetic
ggggaatcgggtttggggtagggatcg

SEQ ID NO: 3149 - DNA, 27 bp, Artificial Sequences
  Synthetic
tcgggtggtcgttgtaagttgagggtt

SEQ ID NO: 3150 - DNA, 29 bp, Artificial Sequences
  Synthetic
gggatcgggtggtcgttgtaagttgaggg

SEQ ID NO: 3151 - DNA, 27 bp, Artificial Sequences
  Synthetic
atcgggtggtcgttgtaagttgagggt

SEQ ID NO: 3152 - DNA, 27 bp, Artificial Sequences
  Synthetic
tgggatcgggtggtcgttgtaagttga

SEQ ID NO: 3153 - DNA, 28 bp, Artificial Sequences
  Synthetic
ggatcgggtggtcgttgtaagttgaggg

SEQ ID NO: 3154 - DNA, 27 bp, Artificial Sequences
  Synthetic
gggggaatcgggtttggggtagggatc

SEQ ID NO: 3155 - DNA, 27 bp, Artificial Sequences
  Synthetic
gaatcgggtttggggtagggatcgggg

SEQ ID NO: 3156 - DNA, 27 bp, Artificial Sequences
  Synthetic
ggaatcgggtttggggtagggatcggg

SEQ ID NO: 3157 - DNA, 27 bp, Artificial Sequences
  Synthetic
gggaatcgggtttggggtagggatcgg

SEQ ID NO: 3158 - DNA, 27 bp, Artificial Sequences
  Synthetic
ggggaatcgggtttggggtagggatcg

SEQ ID NO: 3159 - DNA, 34 bp, Artificial Sequences
  Synthetic
atttatttgggttaagttgttgttgttgcggttg

SEQ ID NO: 3160 - DNA, 35 bp, Artificial Sequences
  Synthetic
tgtatttatttgggttaagttgttgttgttgcggt

SEQ ID NO: 3161 - DNA, 36 bp, Artificial Sequences
  Synthetic
tgtatttatttgggttaagttgttgttgttgcggtt

SEQ ID NO: 3162 - DNA, 36 bp, Artificial Sequences
  Synthetic
ttgtatttatttgggttaagttgttgttgttgcggt

SEQ ID NO: 3163 - DNA, 36 bp, Artificial Sequences
  Synthetic
gtatttatttgggttaagttgttgttgttgcggttg

SEQ ID NO: 3164 - DNA, 27 bp, Artificial Sequences
  Synthetic
ggtggcggcgggtagagggtgtttttt

SEQ ID NO: 3165 - DNA, 26 bp, Artificial Sequences
  Synthetic
gtggcggcgggtagagggtgtttttt

SEQ ID NO: 3166 - DNA, 27 bp, Artificial Sequences
  Synthetic
gtaagaggtggcggcgggtagagggtg

SEQ ID NO: 3167 - DNA, 27 bp, Artificial Sequences
  Synthetic
aggtggcggcgggtagagggtgttttt

SEQ ID NO: 3168 - DNA, 26 bp, Artificial Sequences
  Synthetic
ggtggcggcgggtagagggtgttttt

SEQ ID NO: 3169 - DNA, 27 bp, Artificial Sequences
  Synthetic
cggggtttcgtttagttttcgcgcgtc

SEQ ID NO: 3170 - DNA, 28 bp, Artificial Sequences
  Synthetic
cgggtcgcggggtttcgtttagttttcg

SEQ ID NO: 3171 - DNA, 27 bp, Artificial Sequences
  Synthetic
gggtcgcggggtttcgtttagttttcg

SEQ ID NO: 3172 - DNA, 27 bp, Artificial Sequences
  Synthetic
cgggtcgcggggtttcgtttagttttc

SEQ ID NO: 3173 - DNA, 26 bp, Artificial Sequences
  Synthetic
cggggtttcgtttagttttcgcgcgt

SEQ ID NO: 3174 - DNA, 27 bp, Artificial Sequences
  Synthetic
gtggaggtagcggggtaggtcgtttgg

SEQ ID NO: 3175 - DNA, 27 bp, Artificial Sequences
  Synthetic
gattatattgcggtcgagtcggggcgc

SEQ ID NO: 3176 - DNA, 27 bp, Artificial Sequences
  Synthetic
agtggaggtagcggggtaggtcgtttg

SEQ ID NO: 3177 - DNA, 27 bp, Artificial Sequences
  Synthetic
attatattgcggtcgagtcggggcgcg

SEQ ID NO: 3178 - DNA, 26 bp, Artificial Sequences
  Synthetic
gaggtagcggggtaggtcgtttgggg

SEQ ID NO: 3179 - DNA, 27 bp, Artificial Sequences
  Synthetic
cggggtttcgtttagttttcgcgcgtc

SEQ ID NO: 3180 - DNA, 28 bp, Artificial Sequences
  Synthetic
cgggtcgcggggtttcgtttagttttcg

SEQ ID NO: 3181 - DNA, 27 bp, Artificial Sequences
  Synthetic
gggtcgcggggtttcgtttagttttcg

SEQ ID NO: 3182 - DNA, 27 bp, Artificial Sequences
  Synthetic
cgggtcgcggggtttcgtttagttttc

SEQ ID NO: 3183 - DNA, 27 bp, Artificial Sequences
  Synthetic
cgtttttgaggttaggtagtcgcgggc

SEQ ID NO: 3184 - DNA, 28 bp, Artificial Sequences
  Synthetic
cgggtatgagcgtttagtagttgagcgt

SEQ ID NO: 3185 - DNA, 29 bp, Artificial Sequences
  Synthetic
tcgggtatgagcgtttagtagttgagcgt

SEQ ID NO: 3186 - DNA, 28 bp, Artificial Sequences
  Synthetic
tcgggtatgagcgtttagtagttgagcg

SEQ ID NO: 3187 - DNA, 29 bp, Artificial Sequences
  Synthetic
gtcgggtatgagcgtttagtagttgagcg

SEQ ID NO: 3188 - DNA, 30 bp, Artificial Sequences
  Synthetic
gtcgggtatgagcgtttagtagttgagcgt

SEQ ID NO: 3189 - DNA, 27 bp, Artificial Sequences
  Synthetic
ggtttgtggggcggttgttttcgtcgt

SEQ ID NO: 3190 - DNA, 27 bp, Artificial Sequences
  Synthetic
ttcggtcgtattgtcgcgggggtttgt

SEQ ID NO: 3191 - DNA, 27 bp, Artificial Sequences
  Synthetic
attcggtcgtattgtcgcgggggtttg

SEQ ID NO: 3192 - DNA, 27 bp, Artificial Sequences
  Synthetic
ggggtttgtggggcggttgttttcgtc

SEQ ID NO: 3193 - DNA, 27 bp, Artificial Sequences
  Synthetic
gggtttgtggggcggttgttttcgtcg

SEQ ID NO: 3194 - DNA, 23 bp, Artificial Sequences
  Synthetic
cggtttcggcggcgagagtagtc

SEQ ID NO: 3195 - DNA, 22 bp, Artificial Sequences
  Synthetic
cggtttcggcggcgagagtagt

SEQ ID NO: 3196 - DNA, 31 bp, Artificial Sequences
  Synthetic
gtagtcgttttataggttttcgcggtagtgc

SEQ ID NO: 3197 - DNA, 32 bp, Artificial Sequences
  Synthetic
agtagtcgttttataggttttcgcggtagtgc

SEQ ID NO: 3198 - DNA, 33 bp, Artificial Sequences
  Synthetic
gagtagtcgttttataggttttcgcggtagtgc

SEQ ID NO: 3199 - DNA, 27 bp, Artificial Sequences
  Synthetic
gcgggcggcgttaagtagttagagagc

SEQ ID NO: 3200 - DNA, 27 bp, Artificial Sequences
  Synthetic
cgggcggcgttaagtagttagagagcg

SEQ ID NO: 3201 - DNA, 28 bp, Artificial Sequences
  Synthetic
cgggcggcgttaagtagttagagagcga

SEQ ID NO: 3202 - DNA, 28 bp, Artificial Sequences
  Synthetic
gcgggcggcgttaagtagttagagagcg

SEQ ID NO: 3203 - DNA, 27 bp, Artificial Sequences
  Synthetic
gggcggcgttaagtagttagagagcga

SEQ ID NO: 3204 - DNA, 29 bp, Artificial Sequences
  Synthetic
aggttcgttttttggttgtttagcgtcgt

SEQ ID NO: 3205 - DNA, 30 bp, Artificial Sequences
  Synthetic
gaggttcgttttttggttgtttagcgtcgt

SEQ ID NO: 3206 - DNA, 23 bp, Artificial Sequences
  Synthetic
cggtttcggcggcgagagtagtc

SEQ ID NO: 3207 - DNA, 30 bp, Artificial Sequences
  Synthetic
aggttcgttttttggttgtttagcgtcgtt

SEQ ID NO: 3208 - DNA, 30 bp, Artificial Sequences
  Synthetic
ggttcgttttttggttgtttagcgtcgttc

SEQ ID NO: 3209 - DNA, 27 bp, Artificial Sequences
  Synthetic
tcgggttgttttcgtcggggtggaagt

SEQ ID NO: 3210 - DNA, 27 bp, Artificial Sequences
  Synthetic
tatttagtttcggagggcggcggggac

SEQ ID NO: 3211 - DNA, 27 bp, Artificial Sequences
  Synthetic
gtatttagtttcggagggcggcgggga

SEQ ID NO: 3212 - DNA, 27 bp, Artificial Sequences
  Synthetic
gtcgggttgttttcgtcggggtggaag

SEQ ID NO: 3213 - DNA, 27 bp, Artificial Sequences
  Synthetic
cggtttggtaggtagcggtcgggttgt

SEQ ID NO: 3214 - DNA, 27 bp, Artificial Sequences
  Synthetic
gttcggttgtgggcgtaaaagggggtg

SEQ ID NO: 3215 - DNA, 27 bp, Artificial Sequences
  Synthetic
ggggcgtgtggagtttttatgggcgtc

SEQ ID NO: 3216 - DNA, 27 bp, Artificial Sequences
  Synthetic
gtgggggcgtgtggagtttttatgggc

SEQ ID NO: 3217 - DNA, 27 bp, Artificial Sequences
  Synthetic
atgtggttggttgttcggttgtgggcg

SEQ ID NO: 3218 - DNA, 27 bp, Artificial Sequences
  Synthetic
ggcgtgtggagtttttatgggcgtcgt

SEQ ID NO: 3219 - DNA, 27 bp, Artificial Sequences
  Synthetic
ggcgggagggaggaagtaagcgagttt

SEQ ID NO: 3220 - DNA, 27 bp, Artificial Sequences
  Synthetic
tgtttgaggaggtgggtgggagtgagc

SEQ ID NO: 3221 - DNA, 27 bp, Artificial Sequences
  Synthetic
ggtgtgtttgaggaggtgggtgggagt

SEQ ID NO: 3222 - DNA, 27 bp, Artificial Sequences
  Synthetic
tgtgggtgtgtttgaggaggtgggtgg

SEQ ID NO: 3223 - DNA, 27 bp, Artificial Sequences
  Synthetic
gggtgtgtttgaggaggtgggtgggag

SEQ ID NO: 3224 - DNA, 27 bp, Artificial Sequences
  Synthetic
ttgttgtcgggtgtaggtcgttcggga

SEQ ID NO: 3225 - DNA, 27 bp, Artificial Sequences
  Synthetic
tgttgtcgggtgtaggtcgttcgggat

SEQ ID NO: 3226 - DNA, 27 bp, Artificial Sequences
  Synthetic
tttgttgtcgggtgtaggtcgttcggg

SEQ ID NO: 3227 - DNA, 28 bp, Artificial Sequences
  Synthetic
tgttgtcgggtgtaggtcgttcgggatc

SEQ ID NO: 3228 - DNA, 27 bp, Artificial Sequences
  Synthetic
gttgtcgggtgtaggtcgttcgggatc

SEQ ID NO: 3229 - DNA, 27 bp, Artificial Sequences
  Synthetic
gggtgtgagcgattttaattcgacggt

SEQ ID NO: 3230 - DNA, 28 bp, Artificial Sequences
  Synthetic
agggtgtgagcgattttaattcgacggt

SEQ ID NO: 3231 - DNA, 29 bp, Artificial Sequences
  Synthetic
tagggtgtgagcgattttaattcgacggt

SEQ ID NO: 3232 - DNA, 30 bp, Artificial Sequences
  Synthetic
atagggtgtgagcgattttaattcgacggt

SEQ ID NO: 3233 - DNA, 31 bp, Artificial Sequences
  Synthetic
tatagggtgtgagcgattttaattcgacggt

SEQ ID NO: 3234 - DNA, 33 bp, Artificial Sequences
  Synthetic
tgtgtttgtcggagcgttagattaagatttggt

SEQ ID NO: 3235 - DNA, 33 bp, Artificial Sequences
  Synthetic
gtgtttgtcggagcgttagattaagatttggtt

SEQ ID NO: 3236 - DNA, 33 bp, Artificial Sequences
  Synthetic
ttgtgtttgtcggagcgttagattaagatttgg

SEQ ID NO: 3237 - DNA, 34 bp, Artificial Sequences
  Synthetic
tgtgtttgtcggagcgttagattaagatttggtt

SEQ ID NO: 3238 - DNA, 34 bp, Artificial Sequences
  Synthetic
ttgtgtttgtcggagcgttagattaagatttggt

SEQ ID NO: 3239 - DNA, 27 bp, Artificial Sequences
  Synthetic
tgttggttgggggcgattgaggaggag

SEQ ID NO: 3240 - DNA, 27 bp, Artificial Sequences
  Synthetic
gttggttgggggcgattgaggaggagt

SEQ ID NO: 3241 - DNA, 27 bp, Artificial Sequences
  Synthetic
atgttggttgggggcgattgaggagga

SEQ ID NO: 3242 - DNA, 27 bp, Artificial Sequences
  Synthetic
tggttgggggcgattgaggaggagtaa

SEQ ID NO: 3243 - DNA, 27 bp, Artificial Sequences
  Synthetic
ttggttgggggcgattgaggaggagta

SEQ ID NO: 3244 - DNA, 27 bp, Artificial Sequences
  Synthetic
cgtttttggagtggggatgcggtggat

SEQ ID NO: 3245 - DNA, 28 bp, Artificial Sequences
  Synthetic
cgtttttggagtggggatgcggtggatt

SEQ ID NO: 3246 - DNA, 26 bp, Artificial Sequences
  Synthetic
cgtttttggagtggggatgcggtgga

SEQ ID NO: 3247 - DNA, 27 bp, Artificial Sequences
  Synthetic
gtttttggagtggggatgcggtggatt

SEQ ID NO: 3248 - DNA, 29 bp, Artificial Sequences
  Synthetic
cgtttttggagtggggatgcggtggattt

SEQ ID NO: 3249 - DNA, 31 bp, Artificial Sequences
  Synthetic
ggttggtgggaatgattttgtaatgtgggaa

SEQ ID NO: 3250 - DNA, 31 bp, Artificial Sequences
  Synthetic
agtagcggattttttggtttgtaatgagcgt

SEQ ID NO: 3251 - DNA, 32 bp, Artificial Sequences
  Synthetic
ggttggtgggaatgattttgtaatgtgggaaa

SEQ ID NO: 3252 - DNA, 32 bp, Artificial Sequences
  Synthetic
agtagcggattttttggtttgtaatgagcgtt

SEQ ID NO: 3253 - DNA, 35 bp, Artificial Sequences
  Synthetic
gcgttagtagcggattttttggtttgtaatgagcg

SEQ ID NO: 3254 - DNA, 27 bp, Artificial Sequences
  Synthetic
agtgtggtttcggttgggggagggttt

SEQ ID NO: 3255 - DNA, 27 bp, Artificial Sequences
  Synthetic
gtggtttcggttgggggagggttttgg

SEQ ID NO: 3256 - DNA, 27 bp, Artificial Sequences
  Synthetic
gagtgtggtttcggttgggggagggtt

SEQ ID NO: 3257 - DNA, 27 bp, Artificial Sequences
  Synthetic
gtgtggtttcggttgggggagggtttt

SEQ ID NO: 3258 - DNA, 27 bp, Artificial Sequences
  Synthetic
tgtggtttcggttgggggagggttttg

SEQ ID NO: 3259 - DNA, 30 bp, Artificial Sequences
  Synthetic
tggttggtgggaatgattttgtaatgtggg

SEQ ID NO: 3260 - DNA, 31 bp, Artificial Sequences
  Synthetic
tggttggtgggaatgattttgtaatgtggga

SEQ ID NO: 3261 - DNA, 31 bp, Artificial Sequences
  Synthetic
gtggttggtgggaatgattttgtaatgtggg

SEQ ID NO: 3262 - DNA, 32 bp, Artificial Sequences
  Synthetic
agtggttggtgggaatgattttgtaatgtggg

SEQ ID NO: 3263 - DNA, 32 bp, Artificial Sequences
  Synthetic
gtggttggtgggaatgattttgtaatgtggga

SEQ ID NO: 3264 - DNA, 27 bp, Artificial Sequences
  Synthetic
agtgtggtttcggttgggggagggttt

SEQ ID NO: 3265 - DNA, 27 bp, Artificial Sequences
  Synthetic
ggtttggcggttgttgggtttgtggga

SEQ ID NO: 3266 - DNA, 27 bp, Artificial Sequences
  Synthetic
gtggtttcggttgggggagggttttgg

SEQ ID NO: 3267 - DNA, 27 bp, Artificial Sequences
  Synthetic
gcggttgttgggtttgtgggatttgcg

SEQ ID NO: 3268 - DNA, 27 bp, Artificial Sequences
  Synthetic
gagtgtggtttcggttgggggagggtt

SEQ ID NO: 3269 - DNA, 27 bp, Artificial Sequences
  Synthetic
aggaaggcgaggaggattgcgtaatga

SEQ ID NO: 3270 - DNA, 28 bp, Artificial Sequences
  Synthetic
ggaaggcgaggaggattgcgtaatgagt

SEQ ID NO: 3271 - DNA, 27 bp, Artificial Sequences
  Synthetic
ggaaggcgaggaggattgcgtaatgag

SEQ ID NO: 3272 - DNA, 27 bp, Artificial Sequences
  Synthetic
cgaggtttggagtcgtttaggcgttga

SEQ ID NO: 3273 - DNA, 29 bp, Artificial Sequences
  Synthetic
aggaaggcgaggaggattgcgtaatgagt

SEQ ID NO: 3274 - DNA, 27 bp, Artificial Sequences
  Synthetic
agggtgtaagagcgggaaaagtgcgga

SEQ ID NO: 3275 - DNA, 27 bp, Artificial Sequences
  Synthetic
agagcgggaaaagtgcggagtagggaa

SEQ ID NO: 3276 - DNA, 27 bp, Artificial Sequences
  Synthetic
aagagcgggaaaagtgcggagtaggga

SEQ ID NO: 3277 - DNA, 27 bp, Artificial Sequences
  Synthetic
gggtgtaagagcgggaaaagtgcggag

SEQ ID NO: 3278 - DNA, 27 bp, Artificial Sequences
  Synthetic
ggtgtaagagcgggaaaagtgcggagt

SEQ ID NO: 3279 - DNA, 27 bp, Artificial Sequences
  Synthetic
gcgtttatagcgattaggggacggggt

SEQ ID NO: 3280 - DNA, 28 bp, Artificial Sequences
  Synthetic
gcgtttatagcgattaggggacggggtt

SEQ ID NO: 3281 - DNA, 27 bp, Artificial Sequences
  Synthetic
cggcggtagtaaacgtttcggtaagga

SEQ ID NO: 3282 - DNA, 27 bp, Artificial Sequences
  Synthetic
cgtttatagcgattaggggacggggtt

SEQ ID NO: 3283 - DNA, 26 bp, Artificial Sequences
  Synthetic
gcgtttatagcgattaggggacgggg

SEQ ID NO: 3284 - DNA, 27 bp, Artificial Sequences
  Synthetic
attagggttcggttgttttggaggcgt

SEQ ID NO: 3285 - DNA, 27 bp, Artificial Sequences
  Synthetic
tagggttcggttgttttggaggcgtag

SEQ ID NO: 3286 - DNA, 27 bp, Artificial Sequences
  Synthetic
ttagggttcggttgttttggaggcgta

SEQ ID NO: 3287 - DNA, 26 bp, Artificial Sequences
  Synthetic
agggttcggttgttttggaggcgtag

SEQ ID NO: 3288 - DNA, 28 bp, Artificial Sequences
  Synthetic
ttagggttcggttgttttggaggcgtag

SEQ ID NO: 3289 - DNA, 29 bp, Artificial Sequences
  Synthetic
tgtcggaaggaaggtattttttgagcggt

SEQ ID NO: 3290 - DNA, 30 bp, Artificial Sequences
  Synthetic
tgtcggaaggaaggtattttttgagcggtt

SEQ ID NO: 3291 - DNA, 30 bp, Artificial Sequences
  Synthetic
ttgtcggaaggaaggtattttttgagcggt

SEQ ID NO: 3292 - DNA, 29 bp, Artificial Sequences
  Synthetic
gtcggaaggaaggtattttttgagcggtt

SEQ ID NO: 3293 - DNA, 29 bp, Artificial Sequences
  Synthetic
ttgtcggaaggaaggtattttttgagcgg

SEQ ID NO: 3294 - DNA, 27 bp, Artificial Sequences
  Synthetic
attagggttcggttgttttggaggcgt

SEQ ID NO: 3295 - DNA, 27 bp, Artificial Sequences
  Synthetic
tagggttcggttgttttggaggcgtag

SEQ ID NO: 3296 - DNA, 27 bp, Artificial Sequences
  Synthetic
ttagggttcggttgttttggaggcgta

SEQ ID NO: 3297 - DNA, 29 bp, Artificial Sequences
  Synthetic
ggttttgtatttcgggtttgcggttgggt

SEQ ID NO: 3298 - DNA, 29 bp, Artificial Sequences
  Synthetic
tggttttgtatttcgggtttgcggttggg

SEQ ID NO: 3299 - DNA, 30 bp, Artificial Sequences
  Synthetic
gggttaaacggttttttgtcggaaggaagg

SEQ ID NO: 3300 - DNA, 31 bp, Artificial Sequences
  Synthetic
gggttaaacggttttttgtcggaaggaaggt

SEQ ID NO: 3301 - DNA, 31 bp, Artificial Sequences
  Synthetic
agggttaaacggttttttgtcggaaggaagg

SEQ ID NO: 3302 - DNA, 32 bp, Artificial Sequences
  Synthetic
agggttaaacggttttttgtcggaaggaaggt

SEQ ID NO: 3303 - DNA, 30 bp, Artificial Sequences
  Synthetic
ggttaaacggttttttgtcggaaggaaggt

SEQ ID NO: 3304 - DNA, 27 bp, Artificial Sequences
  Synthetic
tatttggcgggtggggagaagcggatt

SEQ ID NO: 3305 - DNA, 27 bp, Artificial Sequences
  Synthetic
ttatttggcgggtggggagaagcggat

SEQ ID NO: 3306 - DNA, 27 bp, Artificial Sequences
  Synthetic
gattgcgtcgtttcgggtggtaggtgg

SEQ ID NO: 3307 - DNA, 27 bp, Artificial Sequences
  Synthetic
ggattgcgtcgtttcgggtggtaggtg

SEQ ID NO: 3308 - DNA, 27 bp, Artificial Sequences
  Synthetic
gcggcgagggtggttgtggtagttgta

SEQ ID NO: 3309 - DNA, 27 bp, Artificial Sequences
  Synthetic
cgttcgtttcgttgtgtcgtgcgtttt

SEQ ID NO: 3310 - DNA, 28 bp, Artificial Sequences
  Synthetic
cgttcgtttcgttgtgtcgtgcgttttg

SEQ ID NO: 3311 - DNA, 29 bp, Artificial Sequences
  Synthetic
cgttcgtttcgttgtgtcgtgcgttttgt

SEQ ID NO: 3312 - DNA, 27 bp, Artificial Sequences
  Synthetic
tcgtttcgttgtgtcgtgcgttttgtt

SEQ ID NO: 3313 - DNA, 27 bp, Artificial Sequences
  Synthetic
ttcgtttcgttgtgtcgtgcgttttgt

SEQ ID NO: 3314 - DNA, 27 bp, Artificial Sequences
  Synthetic
gtggttttgggatttcgagtcggggcg

SEQ ID NO: 3315 - DNA, 27 bp, Artificial Sequences
  Synthetic
tatttggcgggtggggagaagcggatt

SEQ ID NO: 3316 - DNA, 27 bp, Artificial Sequences
  Synthetic
ttatttggcgggtggggagaagcggat

SEQ ID NO: 3317 - DNA, 27 bp, Artificial Sequences
  Synthetic
gggcgttttaggggtagagcgtacggt

SEQ ID NO: 3318 - DNA, 27 bp, Artificial Sequences
  Synthetic
tcggggcgttttaggggtagagcgtac

SEQ ID NO: 3319 - DNA, 27 bp, Artificial Sequences
  Synthetic
tggaggagaggggaaggcgtgtatgga

SEQ ID NO: 3320 - DNA, 27 bp, Artificial Sequences
  Synthetic
gtggaggagaggggaaggcgtgtatgg

SEQ ID NO: 3321 - DNA, 27 bp, Artificial Sequences
  Synthetic
ggaggagaggggaaggcgtgtatggag

SEQ ID NO: 3322 - DNA, 27 bp, Artificial Sequences
  Synthetic
agtggaggagaggggaaggcgtgtatg

SEQ ID NO: 3323 - DNA, 27 bp, Artificial Sequences
  Synthetic
agtcgtttgagagaaggcgagaggggt

SEQ ID NO: 3324 - DNA, 28 bp, Artificial Sequences
  Synthetic
tgtcggagttttcgtatcgtgcgttttt

SEQ ID NO: 3325 - DNA, 28 bp, Artificial Sequences
  Synthetic
ttgtcggagttttcgtatcgtgcgtttt

SEQ ID NO: 3326 - DNA, 28 bp, Artificial Sequences
  Synthetic
tttgtcggagttttcgtatcgtgcgttt

SEQ ID NO: 3327 - DNA, 28 bp, Artificial Sequences
  Synthetic
ttttgtcggagttttcgtatcgtgcgtt

SEQ ID NO: 3328 - DNA, 28 bp, Artificial Sequences
  Synthetic
tttttgtcggagttttcgtatcgtgcgt

SEQ ID NO: 3329 - DNA, 27 bp, Artificial Sequences
  Synthetic
cggggtcgttagttttttgaagggcgt

SEQ ID NO: 3330 - DNA, 27 bp, Artificial Sequences
  Synthetic
ttttggggtgaaagattcgggtgcgaa

SEQ ID NO: 3331 - DNA, 27 bp, Artificial Sequences
  Synthetic
tttttggggtgaaagattcgggtgcga

SEQ ID NO: 3332 - DNA, 27 bp, Artificial Sequences
  Synthetic
ttttttggggtgaaagattcgggtgcg

SEQ ID NO: 3333 - DNA, 28 bp, Artificial Sequences
  Synthetic
tttttggggtgaaagattcgggtgcgaa

SEQ ID NO: 3334 - DNA, 27 bp, Artificial Sequences
  Synthetic
cggcgagtgtaaagtagttgcgtttcg

SEQ ID NO: 3335 - DNA, 28 bp, Artificial Sequences
  Synthetic
tcggcgagtgtaaagtagttgcgtttcg

SEQ ID NO: 3336 - DNA, 29 bp, Artificial Sequences
  Synthetic
atcggcgagtgtaaagtagttgcgtttcg

SEQ ID NO: 3337 - DNA, 28 bp, Artificial Sequences
  Synthetic
agaatcggcgagtgtaaagtagttgcgt

SEQ ID NO: 3338 - DNA, 28 bp, Artificial Sequences
  Synthetic
atcggcgagtgtaaagtagttgcgtttc

SEQ ID NO: 3339 - DNA, 27 bp, Artificial Sequences
  Synthetic
tgttcggtatttgcgcgtgttttgggt

SEQ ID NO: 3340 - DNA, 27 bp, Artificial Sequences
  Synthetic
tcggtatttgcgcgtgttttgggtagt

SEQ ID NO: 3341 - DNA, 28 bp, Artificial Sequences
  Synthetic
ttgttcggtatttgcgcgtgttttgggt

SEQ ID NO: 3342 - DNA, 27 bp, Artificial Sequences
  Synthetic
ttgttcggtatttgcgcgtgttttggg

SEQ ID NO: 3343 - DNA, 28 bp, Artificial Sequences
  Synthetic
tgttcggtatttgcgcgtgttttgggta

SEQ ID NO: 3344 - DNA, 27 bp, Artificial Sequences
  Synthetic
atattgcgaatcgggggtggcggtagt

SEQ ID NO: 3345 - DNA, 27 bp, Artificial Sequences
  Synthetic
attgcgaatcgggggtggcggtagtag

SEQ ID NO: 3346 - DNA, 27 bp, Artificial Sequences
  Synthetic
gaaatattgcgaatcgggggtggcggt

SEQ ID NO: 3347 - DNA, 27 bp, Artificial Sequences
  Synthetic
tattgcgaatcgggggtggcggtagta

SEQ ID NO: 3348 - DNA, 27 bp, Artificial Sequences
  Synthetic
agaaatattgcgaatcgggggtggcgg

SEQ ID NO: 3349 - DNA, 27 bp, Artificial Sequences
  Synthetic
cggcgcgaggttggttttgtttttcgg

SEQ ID NO: 3350 - DNA, 27 bp, Artificial Sequences
  Synthetic
gcggcgcgaggttggttttgtttttcg

SEQ ID NO: 3351 - DNA, 27 bp, Artificial Sequences
  Synthetic
ggcgcgaggttggttttgtttttcgga

SEQ ID NO: 3352 - DNA, 28 bp, Artificial Sequences
  Synthetic
cggcgcgaggttggttttgtttttcgga

SEQ ID NO: 3353 - DNA, 28 bp, Artificial Sequences
  Synthetic
ggcgcgaggttggttttgtttttcggag

SEQ ID NO: 3354 - DNA, 29 bp, Artificial Sequences
  Synthetic
gggatttagtgatttcgaggaggagcgcg

SEQ ID NO: 3355 - DNA, 29 bp, Artificial Sequences
  Synthetic
cgggatttagtgatttcgaggaggagcgc

SEQ ID NO: 3356 - DNA, 29 bp, Artificial Sequences
  Synthetic
gcgggatttagtgatttcgaggaggagcg

SEQ ID NO: 3357 - DNA, 30 bp, Artificial Sequences
  Synthetic
tgcgggatttagtgatttcgaggaggagcg

SEQ ID NO: 3358 - DNA, 30 bp, Artificial Sequences
  Synthetic
gggatttagtgatttcgaggaggagcgcga

SEQ ID NO: 3359 - DNA, 27 bp, Artificial Sequences
  Synthetic
gggttatcggtcgagggtgtttggggt

SEQ ID NO: 3360 - DNA, 27 bp, Artificial Sequences
  Synthetic
cgagggtgtttggggttttgtcgtcgg

SEQ ID NO: 3361 - DNA, 27 bp, Artificial Sequences
  Synthetic
cggtcgagggtgtttggggttttgtcg

SEQ ID NO: 3362 - DNA, 27 bp, Artificial Sequences
  Synthetic
tcgggttatcggtcgagggtgtttggg

SEQ ID NO: 3363 - DNA, 27 bp, Artificial Sequences
  Synthetic
cggcgcgaggttggttttgtttttcgg

SEQ ID NO: 3364 - DNA, 34 bp, Artificial Sequences
  Synthetic
cggcgataagattttaagtattttcggtcggtgg

SEQ ID NO: 3365 - DNA, 33 bp, Artificial Sequences
  Synthetic
tcggcgataagattttaagtattttcggtcggt

SEQ ID NO: 3366 - DNA, 35 bp, Artificial Sequences
  Synthetic
cggcgataagattttaagtattttcggtcggtggt

SEQ ID NO: 3367 - DNA, 33 bp, Artificial Sequences
  Synthetic
cggcgataagattttaagtattttcggtcggtg

SEQ ID NO: 3368 - DNA, 35 bp, Artificial Sequences
  Synthetic
tcggcgataagattttaagtattttcggtcggtgg

SEQ ID NO: 3369 - DNA, 24 bp, Artificial Sequences
  Synthetic
cgcgtagttggggtggtcgggttc

SEQ ID NO: 3370 - DNA, 23 bp, Artificial Sequences
  Synthetic
cgcgtagttggggtggtcgggtt

SEQ ID NO: 3371 - DNA, 22 bp, Artificial Sequences
  Synthetic
cgcgtagttggggtggtcgggt

SEQ ID NO: 3372 - DNA, 23 bp, Artificial Sequences
  Synthetic
gcgtagttggggtggtcgggttc

SEQ ID NO: 3373 - DNA, 22 bp, Artificial Sequences
  Synthetic
gacgcgtagttggggtggtcgg

SEQ ID NO: 3374 - DNA, 27 bp, Artificial Sequences
  Synthetic
tcgtttaggttggtgcgcgtcggtttt

SEQ ID NO: 3375 - DNA, 27 bp, Artificial Sequences
  Synthetic
tggagtagtttaagtcggagcgcggcg

SEQ ID NO: 3376 - DNA, 27 bp, Artificial Sequences
  Synthetic
atcgtttaggttggtgcgcgtcggttt

SEQ ID NO: 3377 - DNA, 27 bp, Artificial Sequences
  Synthetic
ggagtagtttaagtcggagcgcggcgt

SEQ ID NO: 3378 - DNA, 27 bp, Artificial Sequences
  Synthetic
cgtttaggttggtgcgcgtcggttttc

SEQ ID NO: 3379 - DNA, 27 bp, Artificial Sequences
  Synthetic
gaggtttcgggggtgttttacggtgcg

SEQ ID NO: 3380 - DNA, 26 bp, Artificial Sequences
  Synthetic
aggtttcgggggtgttttacggtgcg

SEQ ID NO: 3381 - DNA, 28 bp, Artificial Sequences
  Synthetic
ggtcgttttttgttggaataggcggcgt

SEQ ID NO: 3382 - DNA, 27 bp, Artificial Sequences
  Synthetic
ggtcgttttttgttggaataggcggcg

SEQ ID NO: 3383 - DNA, 28 bp, Artificial Sequences
  Synthetic
aggtcgttttttgttggaataggcggcg

SEQ ID NO: 3384 - DNA, 27 bp, Artificial Sequences
  Synthetic
gttttacgtcgcgggaggagttggtgc

SEQ ID NO: 3385 - DNA, 27 bp, Artificial Sequences
  Synthetic
agtttaagtcggagcgcggcgtatcgt

SEQ ID NO: 3386 - DNA, 27 bp, Artificial Sequences
  Synthetic
cggcgtatcgtggggtattttcggggt

SEQ ID NO: 3387 - DNA, 27 bp, Artificial Sequences
  Synthetic
tggagtagtttaagtcggagcgcggcg

SEQ ID NO: 3388 - DNA, 27 bp, Artificial Sequences
  Synthetic
ggagtagtttaagtcggagcgcggcgt

SEQ ID NO: 3389 - DNA, 27 bp, Artificial Sequences
  Synthetic
cgatgttttgggggtggagggtcgaga

SEQ ID NO: 3390 - DNA, 27 bp, Artificial Sequences
  Synthetic
cgaggtttgaggtcgggttgcgttgac

SEQ ID NO: 3391 - DNA, 27 bp, Artificial Sequences
  Synthetic
tgttcgtcggttcgcggtttttgggtt

SEQ ID NO: 3392 - DNA, 27 bp, Artificial Sequences
  Synthetic
cgggttttcgaggggatggggtacgtt

SEQ ID NO: 3393 - DNA, 27 bp, Artificial Sequences
  Synthetic
tacggttcgcgatgttttgggggtgga

SEQ ID NO: 3394 - DNA, 28 bp, Artificial Sequences
  Synthetic
gggggacgagtttgggaggtttaggagt

SEQ ID NO: 3395 - DNA, 27 bp, Artificial Sequences
  Synthetic
gggggacgagtttgggaggtttaggag

SEQ ID NO: 3396 - DNA, 25 bp, Artificial Sequences
  Synthetic
gcgggaggagttggtgcgttcgtac

SEQ ID NO: 3397 - DNA, 27 bp, Artificial Sequences
  Synthetic
ggggacgagtttgggaggtttaggagt

SEQ ID NO: 3398 - DNA, 29 bp, Artificial Sequences
  Synthetic
gggggacgagtttgggaggtttaggagtc

SEQ ID NO: 3399 - DNA, 27 bp, Artificial Sequences
  Synthetic
tgttcgtcggttcgcggtttttgggtt

SEQ ID NO: 3400 - DNA, 27 bp, Artificial Sequences
  Synthetic
ttgttcgtcggttcgcggtttttgggt

SEQ ID NO: 3401 - DNA, 27 bp, Artificial Sequences
  Synthetic
gttcgtcggttcgcggtttttgggttt

SEQ ID NO: 3402 - DNA, 27 bp, Artificial Sequences
  Synthetic
tttgttcgtcggttcgcggtttttggg

SEQ ID NO: 3403 - DNA, 28 bp, Artificial Sequences
  Synthetic
tgttcgtcggttcgcggtttttgggttt

SEQ ID NO: 3404 - DNA, 27 bp, Artificial Sequences
  Synthetic
gcgggtaggatagagtcgggggaaggt

SEQ ID NO: 3405 - DNA, 27 bp, Artificial Sequences
  Synthetic
agtttgggaggtttaggagtcgcgggt

SEQ ID NO: 3406 - DNA, 27 bp, Artificial Sequences
  Synthetic
ggcgggtaggatagagtcgggggaagg

SEQ ID NO: 3407 - DNA, 27 bp, Artificial Sequences
  Synthetic
cggcgggtaggatagagtcgggggaag

SEQ ID NO: 3408 - DNA, 27 bp, Artificial Sequences
  Synthetic
gtttgggaggtttaggagtcgcgggtc

SEQ ID NO: 3409 - DNA, 27 bp, Artificial Sequences
  Synthetic
tcgttttggtttttgggggatcggcgg

SEQ ID NO: 3410 - DNA, 27 bp, Artificial Sequences
  Synthetic
gtacggtttgcgtcgggggttttcgtt

SEQ ID NO: 3411 - DNA, 27 bp, Artificial Sequences
  Synthetic
ttcggcgtggtttagggtaggaagcgt

SEQ ID NO: 3412 - DNA, 27 bp, Artificial Sequences
  Synthetic
tacggtttgcgtcgggggttttcgttt

SEQ ID NO: 3413 - DNA, 27 bp, Artificial Sequences
  Synthetic
cggtttgcgtcgggggttttcgttttc

SEQ ID NO: 3414 - DNA, 28 bp, Artificial Sequences
  Synthetic
ggtcgtgcgttttttgttttgggttacg

SEQ ID NO: 3415 - DNA, 29 bp, Artificial Sequences
  Synthetic
aggtcgtgcgttttttgttttgggttacg

SEQ ID NO: 3416 - DNA, 29 bp, Artificial Sequences
  Synthetic
ggcgtcgggattaattttcgttgattcgg

SEQ ID NO: 3417 - DNA, 30 bp, Artificial Sequences
  Synthetic
aggcgtcgggattaattttcgttgattcgg

SEQ ID NO: 3418 - DNA, 30 bp, Artificial Sequences
  Synthetic
ggcgtcgggattaattttcgttgattcgga

SEQ ID NO: 3419 - DNA, 27 bp, Artificial Sequences
  Synthetic
acggtttgcgtcgggggttttcgtttt

SEQ ID NO: 3420 - DNA, 27 bp, Artificial Sequences
  Synthetic
gtacggtttgcgtcgggggttttcgtt

SEQ ID NO: 3421 - DNA, 27 bp, Artificial Sequences
  Synthetic
ttcggcgtggtttagggtaggaagcgt

SEQ ID NO: 3422 - DNA, 27 bp, Artificial Sequences
  Synthetic
tacggtttgcgtcgggggttttcgttt

SEQ ID NO: 3423 - DNA, 27 bp, Artificial Sequences
  Synthetic
cggtttgcgtcgggggttttcgttttc

SEQ ID NO: 3424 - DNA, 27 bp, Artificial Sequences
  Synthetic
acgtcgggtttggagggcgttgttgta

SEQ ID NO: 3425 - DNA, 27 bp, Artificial Sequences
  Synthetic
cgtcgggtttggagggcgttgttgtat

SEQ ID NO: 3426 - DNA, 27 bp, Artificial Sequences
  Synthetic
ttttgggttacgtcgggtttggagggc

SEQ ID NO: 3427 - DNA, 27 bp, Artificial Sequences
  Synthetic
gggcggggtttgaggtagagaagaggt

SEQ ID NO: 3428 - DNA, 27 bp, Artificial Sequences
  Synthetic
agggcggggtttgaggtagagaagagg

SEQ ID NO: 3429 - DNA, 27 bp, Artificial Sequences
  Synthetic
cgagtttaggggaggtgggtcgggttc

SEQ ID NO: 3430 - DNA, 27 bp, Artificial Sequences
  Synthetic
atcgagtttaggggaggtgggtcgggt

SEQ ID NO: 3431 - DNA, 27 bp, Artificial Sequences
  Synthetic
tcgagtttaggggaggtgggtcgggtt

SEQ ID NO: 3432 - DNA, 27 bp, Artificial Sequences
  Synthetic
gcgggtttttcggcggttttagggttt

SEQ ID NO: 3433 - DNA, 27 bp, Artificial Sequences
  Synthetic
tcggcgatttttgttttggttgcgggt

SEQ ID NO: 3434 - DNA, 27 bp, Artificial Sequences
  Synthetic
ttggaattcgggaaaggggaggacggg

SEQ ID NO: 3435 - DNA, 27 bp, Artificial Sequences
  Synthetic
gaattcgggaaaggggaggacggggag

SEQ ID NO: 3436 - DNA, 27 bp, Artificial Sequences
  Synthetic
ttacggcgagtcggggagtttggtgag

SEQ ID NO: 3437 - DNA, 27 bp, Artificial Sequences
  Synthetic
gagttacggcgagtcggggagtttggt

SEQ ID NO: 3438 - DNA, 27 bp, Artificial Sequences
  Synthetic
agtttggtgaggttggagcgcggtttg

SEQ ID NO: 3439 - DNA, 27 bp, Artificial Sequences
  Synthetic
agggagggttttagcgcgtcgtttgga

SEQ ID NO: 3440 - DNA, 27 bp, Artificial Sequences
  Synthetic
aagggagggttttagcgcgtcgtttgg

SEQ ID NO: 3441 - DNA, 27 bp, Artificial Sequences
  Synthetic
gggagggttttagcgcgtcgtttggat

SEQ ID NO: 3442 - DNA, 27 bp, Artificial Sequences
  Synthetic
ggtaagggagggttttagcgcgtcgtt

SEQ ID NO: 3443 - DNA, 28 bp, Artificial Sequences
  Synthetic
agggagggttttagcgcgtcgtttggat

SEQ ID NO: 3444 - DNA, 27 bp, Artificial Sequences
  Synthetic
gcgaatgttggagagagtttaggacgc

SEQ ID NO: 3445 - DNA, 28 bp, Artificial Sequences
  Synthetic
tggcgaatgttggagagagtttaggacg

SEQ ID NO: 3446 - DNA, 28 bp, Artificial Sequences
  Synthetic
ttgggtggggtagtattgttatggcgaa

SEQ ID NO: 3447 - DNA, 28 bp, Artificial Sequences
  Synthetic
tttgggtggggtagtattgttatggcga

SEQ ID NO: 3448 - DNA, 29 bp, Artificial Sequences
  Synthetic
atggcgaatgttggagagagtttaggacg

SEQ ID NO: 3449 - DNA, 27 bp, Artificial Sequences
  Synthetic
tggggggtgaggtaggtgtattgtggt

SEQ ID NO: 3450 - DNA, 28 bp, Artificial Sequences
  Synthetic
tggggggtgaggtaggtgtattgtggtt

SEQ ID NO: 3451 - DNA, 28 bp, Artificial Sequences
  Synthetic
ttggggggtgaggtaggtgtattgtggt

SEQ ID NO: 3452 - DNA, 27 bp, Artificial Sequences
  Synthetic
ggggggtgaggtaggtgtattgtggtt

SEQ ID NO: 3453 - DNA, 27 bp, Artificial Sequences
  Synthetic
ttggggggtgaggtaggtgtattgtgg

SEQ ID NO: 3454 - DNA, 27 bp, Artificial Sequences
  Synthetic
ttttcgggggtttttgggggtgtagcg

SEQ ID NO: 3455 - DNA, 27 bp, Artificial Sequences
  Synthetic
cgggggtttttgggggtgtagcggtta

SEQ ID NO: 3456 - DNA, 27 bp, Artificial Sequences
  Synthetic
tttcgggggtttttgggggtgtagcgg

SEQ ID NO: 3457 - DNA, 27 bp, Artificial Sequences
  Synthetic
gggggtttttgggggtgtagcggttat

SEQ ID NO: 3458 - DNA, 28 bp, Artificial Sequences
  Synthetic
tttttcgggggtttttgggggtgtagcg

SEQ ID NO: 3459 - DNA, 27 bp, Artificial Sequences
  Synthetic
gggtttcgggcggtgagtattcgaggt

SEQ ID NO: 3460 - DNA, 27 bp, Artificial Sequences
  Synthetic
ggtttcgggcggtgagtattcgaggtc

SEQ ID NO: 3461 - DNA, 28 bp, Artificial Sequences
  Synthetic
gggtttcgggcggtgagtattcgaggtc

SEQ ID NO: 3462 - DNA, 26 bp, Artificial Sequences
  Synthetic
gggtttcgggcggtgagtattcgagg

SEQ ID NO: 3463 - DNA, 25 bp, Artificial Sequences
  Synthetic
cgggtttggggaatggagcgacgtc

SEQ ID NO: 3464 - DNA, 27 bp, Artificial Sequences
  Synthetic
ttttcgggggtttttgggggtgtagcg

SEQ ID NO: 3465 - DNA, 27 bp, Artificial Sequences
  Synthetic
cgggggtttttgggggtgtagcggtta

SEQ ID NO: 3466 - DNA, 27 bp, Artificial Sequences
  Synthetic
tttcgggggtttttgggggtgtagcgg

SEQ ID NO: 3467 - DNA, 27 bp, Artificial Sequences
  Synthetic
gggggtttttgggggtgtagcggttat

SEQ ID NO: 3468 - DNA, 28 bp, Artificial Sequences
  Synthetic
tttttcgggggtttttgggggtgtagcg

SEQ ID NO: 3469 - DNA, 27 bp, Artificial Sequences
  Synthetic
gggtttcgggcggtgagtattcgaggt

SEQ ID NO: 3470 - DNA, 27 bp, Artificial Sequences
  Synthetic
ggtttcgggcggtgagtattcgaggtc

SEQ ID NO: 3471 - DNA, 28 bp, Artificial Sequences
  Synthetic
gggtttcgggcggtgagtattcgaggtc

SEQ ID NO: 3472 - DNA, 26 bp, Artificial Sequences
  Synthetic
gggtttcgggcggtgagtattcgagg

SEQ ID NO: 3473 - DNA, 26 bp, Artificial Sequences
  Synthetic
ggtttcgggcggtgagtattcgaggt

SEQ ID NO: 3474 - DNA, 27 bp, Artificial Sequences
  Synthetic
ttttcgggggtttttgggggtgtagcg

SEQ ID NO: 3475 - DNA, 27 bp, Artificial Sequences
  Synthetic
cgggggtttttgggggtgtagcggtta

SEQ ID NO: 3476 - DNA, 27 bp, Artificial Sequences
  Synthetic
tttcgggggtttttgggggtgtagcgg

SEQ ID NO: 3477 - DNA, 27 bp, Artificial Sequences
  Synthetic
gggggtttttgggggtgtagcggttat

SEQ ID NO: 3478 - DNA, 28 bp, Artificial Sequences
  Synthetic
tttttcgggggtttttgggggtgtagcg

SEQ ID NO: 3479 - DNA, 28 bp, Artificial Sequences
  Synthetic
gcggagagttgagtcgtaggtattcgcg

SEQ ID NO: 3480 - DNA, 29 bp, Artificial Sequences
  Synthetic
gcggagagttgagtcgtaggtattcgcgt

SEQ ID NO: 3481 - DNA, 27 bp, Artificial Sequences
  Synthetic
gcggagagttgagtcgtaggtattcgc

SEQ ID NO: 3482 - DNA, 24 bp, Artificial Sequences
  Synthetic
tcgggcgtggagtcgagtgaggtc

SEQ ID NO: 3483 - DNA, 28 bp, Artificial Sequences
  Synthetic
cggagagttgagtcgtaggtattcgcgt

SEQ ID NO: 3484 - DNA, 28 bp, Artificial Sequences
  Synthetic
ggttcgttgggttgcggttttattcggt

SEQ ID NO: 3485 - DNA, 27 bp, Artificial Sequences
  Synthetic
ggttcgttgggttgcggttttattcgg

SEQ ID NO: 3486 - DNA, 28 bp, Artificial Sequences
  Synthetic
aggttcgttgggttgcggttttattcgg

SEQ ID NO: 3487 - DNA, 29 bp, Artificial Sequences
  Synthetic
aggttcgttgggttgcggttttattcggt

SEQ ID NO: 3488 - DNA, 27 bp, Artificial Sequences
  Synthetic
gttcgttgggttgcggttttattcggt

SEQ ID NO: 3489 - DNA, 27 bp, Artificial Sequences
  Synthetic
tagagcgtatcgagtcgggcggagagt

SEQ ID NO: 3490 - DNA, 27 bp, Artificial Sequences
  Synthetic
gagcgtatcgagtcgggcggagagttg

SEQ ID NO: 3491 - DNA, 27 bp, Artificial Sequences
  Synthetic
gagtcgggcggagagttgagtcgtagg

SEQ ID NO: 3492 - DNA, 27 bp, Artificial Sequences
  Synthetic
agtcgggcggagagttgagtcgtaggt

SEQ ID NO: 3493 - DNA, 27 bp, Artificial Sequences
  Synthetic
agagcgtatcgagtcgggcggagagtt

SEQ ID NO: 3494 - DNA, 27 bp, Artificial Sequences
  Synthetic
cggttcggtgcgttttgtgaggggttt

SEQ ID NO: 3495 - DNA, 27 bp, Artificial Sequences
  Synthetic
tcgttcggttcggtgcgttttgtgagg

SEQ ID NO: 3496 - DNA, 27 bp, Artificial Sequences
  Synthetic
gttcggttcggtgcgttttgtgagggg

SEQ ID NO: 3497 - DNA, 27 bp, Artificial Sequences
  Synthetic
cgttcggttcggtgcgttttgtgaggg

SEQ ID NO: 3498 - DNA, 27 bp, Artificial Sequences
  Synthetic
tcggttcggtgcgttttgtgaggggtt

SEQ ID NO: 3499 - DNA, 27 bp, Artificial Sequences
  Synthetic
gagcggcggaagagttcgggagttttt

SEQ ID NO: 3500 - DNA, 27 bp, Artificial Sequences
  Synthetic
agcggcggaagagttcgggagtttttt

SEQ ID NO: 3501 - DNA, 28 bp, Artificial Sequences
  Synthetic
gagcggcggaagagttcgggagtttttt

SEQ ID NO: 3502 - DNA, 26 bp, Artificial Sequences
  Synthetic
gagcggcggaagagttcgggagtttt

SEQ ID NO: 3503 - DNA, 26 bp, Artificial Sequences
  Synthetic
agcggcggaagagttcgggagttttt

SEQ ID NO: 3504 - DNA, 27 bp, Artificial Sequences
  Synthetic
ggagagggttggtaagagagtcgcggt

SEQ ID NO: 3505 - DNA, 27 bp, Artificial Sequences
  Synthetic
aggagagggttggtaagagagtcgcgg

SEQ ID NO: 3506 - DNA, 28 bp, Artificial Sequences
  Synthetic
aggagagggttggtaagagagtcgcggt

SEQ ID NO: 3507 - DNA, 28 bp, Artificial Sequences
  Synthetic
aaggagagggttggtaagagagtcgcgg

SEQ ID NO: 3508 - DNA, 27 bp, Artificial Sequences
  Synthetic
tgagggagagtagaaggttcgggggtt

SEQ ID NO: 3509 - DNA, 28 bp, Artificial Sequences
  Synthetic
tgggtggaatgatcggttttggagacgt

SEQ ID NO: 3510 - DNA, 27 bp, Artificial Sequences
  Synthetic
gggtggaatgatcggttttggagacgt

SEQ ID NO: 3511 - DNA, 27 bp, Artificial Sequences
  Synthetic
tgggtggaatgatcggttttggagacg

SEQ ID NO: 3512 - DNA, 29 bp, Artificial Sequences
  Synthetic
tgggtggaatgatcggttttggagacgtt

SEQ ID NO: 3513 - DNA, 29 bp, Artificial Sequences
  Synthetic
ttgggtggaatgatcggttttggagacgt

SEQ ID NO: 3514 - DNA, 27 bp, Artificial Sequences
  Synthetic
gggcggtaggttgtagtggaggggttt

SEQ ID NO: 3515 - DNA, 27 bp, Artificial Sequences
  Synthetic
tagtcgtggtagggtgtaggggacggt

SEQ ID NO: 3516 - DNA, 27 bp, Artificial Sequences
  Synthetic
agtcgtggtagggtgtaggggacggtg

SEQ ID NO: 3517 - DNA, 27 bp, Artificial Sequences
  Synthetic
ggagagggttggtaagagagtcgcggt

SEQ ID NO: 3518 - DNA, 27 bp, Artificial Sequences
  Synthetic
ggtagtcgtggtagggtgtaggggacg

SEQ ID NO: 3519 - DNA, 27 bp, Artificial Sequences
  Synthetic
tgggttttttcggtcgggtcggtaggt

SEQ ID NO: 3520 - DNA, 27 bp, Artificial Sequences
  Synthetic
tatggtgggcgtgggttttttcggtcg

SEQ ID NO: 3521 - DNA, 27 bp, Artificial Sequences
  Synthetic
cgtgggttttttcggtcgggtcggtag

SEQ ID NO: 3522 - DNA, 27 bp, Artificial Sequences
  Synthetic
gtgggttttttcggtcgggtcggtagg

SEQ ID NO: 3523 - DNA, 27 bp, Artificial Sequences
  Synthetic
agtaggggattatggtgggcgtgggtt

SEQ ID NO: 3524 - DNA, 27 bp, Artificial Sequences
  Synthetic
gggttttgggggtgtttgtcggttcgg

SEQ ID NO: 3525 - DNA, 27 bp, Artificial Sequences
  Synthetic
gggcggtaggttgtagtggaggggttt

SEQ ID NO: 3526 - DNA, 27 bp, Artificial Sequences
  Synthetic
ttttcggtggtgtgtgggttttggggg

SEQ ID NO: 3527 - DNA, 27 bp, Artificial Sequences
  Synthetic
ggtggtgtgtgggttttgggggtgttt

SEQ ID NO: 3528 - DNA, 27 bp, Artificial Sequences
  Synthetic
ggttttgggggtgtttgtcggttcggt

SEQ ID NO: 3529 - DNA, 27 bp, Artificial Sequences
  Synthetic
agtaggggattatggtgggcgtgggtt

SEQ ID NO: 3530 - DNA, 27 bp, Artificial Sequences
  Synthetic
aggggattatggtgggcgtgggttttt

SEQ ID NO: 3531 - DNA, 27 bp, Artificial Sequences
  Synthetic
tagtaggggattatggtgggcgtgggt

SEQ ID NO: 3532 - DNA, 27 bp, Artificial Sequences
  Synthetic
gtaggggattatggtgggcgtgggttt

SEQ ID NO: 3533 - DNA, 28 bp, Artificial Sequences
  Synthetic
agtaggggattatggtgggcgtgggttt

SEQ ID NO: 3534 - DNA, 27 bp, Artificial Sequences
  Synthetic
gaggaaggagggcggttaggtcgggtg

SEQ ID NO: 3535 - DNA, 27 bp, Artificial Sequences
  Synthetic
tgttgggttagaggggtcgtgggtttt

SEQ ID NO: 3536 - DNA, 27 bp, Artificial Sequences
  Synthetic
ttgttgggttagaggggtcgtgggttt

SEQ ID NO: 3537 - DNA, 27 bp, Artificial Sequences
  Synthetic
tttgttgggttagaggggtcgtgggtt

SEQ ID NO: 3538 - DNA, 27 bp, Artificial Sequences
  Synthetic
ttttgttgggttagaggggtcgtgggt

SEQ ID NO: 3539 - DNA, 27 bp, Artificial Sequences
  Synthetic
cggattcgcggttttagttcggtgttt

SEQ ID NO: 3540 - DNA, 28 bp, Artificial Sequences
  Synthetic
gcgggttttcgtatgtatgtgagtcggt

SEQ ID NO: 3541 - DNA, 27 bp, Artificial Sequences
  Synthetic
gcgggttttcgtatgtatgtgagtcgg

SEQ ID NO: 3542 - DNA, 29 bp, Artificial Sequences
  Synthetic
agcgggttttcgtatgtatgtgagtcggt

SEQ ID NO: 3543 - DNA, 28 bp, Artificial Sequences
  Synthetic
agcgggttttcgtatgtatgtgagtcgg

SEQ ID NO: 3544 - DNA, 27 bp, Artificial Sequences
  Synthetic
gtggggttgggtgcggtggttttgtag

SEQ ID NO: 3545 - DNA, 27 bp, Artificial Sequences
  Synthetic
tggggttgggtgcggtggttttgtaga

SEQ ID NO: 3546 - DNA, 27 bp, Artificial Sequences
  Synthetic
ggggttgggtgcggtggttttgtagaa

SEQ ID NO: 3547 - DNA, 27 bp, Artificial Sequences
  Synthetic
ggtggggttgggtgcggtggttttgta

SEQ ID NO: 3548 - DNA, 28 bp, Artificial Sequences
  Synthetic
tggggttgggtgcggtggttttgtagaa

SEQ ID NO: 3549 - DNA, 28 bp, Artificial Sequences
  Synthetic
gcgggttttcgtatgtatgtgagtcggt

SEQ ID NO: 3550 - DNA, 27 bp, Artificial Sequences
  Synthetic
gcgggttttcgtatgtatgtgagtcgg

SEQ ID NO: 3551 - DNA, 29 bp, Artificial Sequences
  Synthetic
agcgggttttcgtatgtatgtgagtcggt

SEQ ID NO: 3552 - DNA, 28 bp, Artificial Sequences
  Synthetic
agcgggttttcgtatgtatgtgagtcgg

SEQ ID NO: 3553 - DNA, 30 bp, Artificial Sequences
  Synthetic
ggagcgggttttcgtatgtatgtgagtcgg

SEQ ID NO: 3554 - DNA, 27 bp, Artificial Sequences
  Synthetic
gtggggttgggtgcggtggttttgtag

SEQ ID NO: 3555 - DNA, 27 bp, Artificial Sequences
  Synthetic
tggggttgggtgcggtggttttgtaga

SEQ ID NO: 3556 - DNA, 27 bp, Artificial Sequences
  Synthetic
ggggttgggtgcggtggttttgtagaa

SEQ ID NO: 3557 - DNA, 27 bp, Artificial Sequences
  Synthetic
ggtggggttgggtgcggtggttttgta

SEQ ID NO: 3558 - DNA, 28 bp, Artificial Sequences
  Synthetic
tggggttgggtgcggtggttttgtagaa

SEQ ID NO: 3559 - DNA, 27 bp, Artificial Sequences
  Synthetic
tgttttttcggtcggttaggcgggtcg

SEQ ID NO: 3560 - DNA, 27 bp, Artificial Sequences
  Synthetic
cgttgttttttcggtcggttaggcggg

SEQ ID NO: 3561 - DNA, 28 bp, Artificial Sequences
  Synthetic
cgttgttttttcggtcggttaggcgggt

SEQ ID NO: 3562 - DNA, 28 bp, Artificial Sequences
  Synthetic
ttgttttttcggtcggttaggcgggtcg

SEQ ID NO: 3563 - DNA, 28 bp, Artificial Sequences
  Synthetic
tcgttgttttttcggtcggttaggcggg

SEQ ID NO: 3564 - DNA, 27 bp, Artificial Sequences
  Synthetic
tagggttttcggataggggcgcgaagg

SEQ ID NO: 3565 - DNA, 27 bp, Artificial Sequences
  Synthetic
agttagggttttcggataggggcgcga

SEQ ID NO: 3566 - DNA, 27 bp, Artificial Sequences
  Synthetic
gagttagggttttcggataggggcgcg

SEQ ID NO: 3567 - DNA, 27 bp, Artificial Sequences
  Synthetic
ggagttagggttttcggataggggcgc

SEQ ID NO: 3568 - DNA, 28 bp, Artificial Sequences
  Synthetic
ttagggttttcggataggggcgcgaagg

SEQ ID NO: 3569 - DNA, 27 bp, Artificial Sequences
  Synthetic
tgttttttcggtcggttaggcgggtcg

SEQ ID NO: 3570 - DNA, 27 bp, Artificial Sequences
  Synthetic
cgttgttttttcggtcggttaggcggg

SEQ ID NO: 3571 - DNA, 28 bp, Artificial Sequences
  Synthetic
cgttgttttttcggtcggttaggcgggt

SEQ ID NO: 3572 - DNA, 28 bp, Artificial Sequences
  Synthetic
ttgttttttcggtcggttaggcgggtcg

SEQ ID NO: 3573 - DNA, 28 bp, Artificial Sequences
  Synthetic
tcgttgttttttcggtcggttaggcggg

SEQ ID NO: 3574 - DNA, 27 bp, Artificial Sequences
  Synthetic
tagggttttcggataggggcgcgaagg

SEQ ID NO: 3575 - DNA, 27 bp, Artificial Sequences
  Synthetic
agttagggttttcggataggggcgcga

SEQ ID NO: 3576 - DNA, 27 bp, Artificial Sequences
  Synthetic
gagttagggttttcggataggggcgcg

SEQ ID NO: 3577 - DNA, 27 bp, Artificial Sequences
  Synthetic
ggagttagggttttcggataggggcgc

SEQ ID NO: 3578 - DNA, 28 bp, Artificial Sequences
  Synthetic
ttagggttttcggataggggcgcgaagg

SEQ ID NO: 3579 - DNA, 27 bp, Artificial Sequences
  Synthetic
tgttttttcggtcggttaggcgggtcg

SEQ ID NO: 3580 - DNA, 27 bp, Artificial Sequences
  Synthetic
cgttgttttttcggtcggttaggcggg

SEQ ID NO: 3581 - DNA, 28 bp, Artificial Sequences
  Synthetic
cgttgttttttcggtcggttaggcgggt

SEQ ID NO: 3582 - DNA, 28 bp, Artificial Sequences
  Synthetic
ttgttttttcggtcggttaggcgggtcg

SEQ ID NO: 3583 - DNA, 28 bp, Artificial Sequences
  Synthetic
tcgttgttttttcggtcggttaggcggg

SEQ ID NO: 3584 - DNA, 27 bp, Artificial Sequences
  Synthetic
tagggttttcggataggggcgcgaagg

SEQ ID NO: 3585 - DNA, 27 bp, Artificial Sequences
  Synthetic
cggttcgtttggtcggtcggaggagta

SEQ ID NO: 3586 - DNA, 27 bp, Artificial Sequences
  Synthetic
agttagggttttcggataggggcgcga

SEQ ID NO: 3587 - DNA, 27 bp, Artificial Sequences
  Synthetic
gagttagggttttcggataggggcgcg

SEQ ID NO: 3588 - DNA, 27 bp, Artificial Sequences
  Synthetic
gttcgtttggtcggtcggaggagtagc

SEQ ID NO: 3589 - DNA, 27 bp, Artificial Sequences
  Synthetic
gttttttcggtcggttaggcgggtcgt

SEQ ID NO: 3590 - DNA, 27 bp, Artificial Sequences
  Synthetic
tgttttttcggtcggttaggcgggtcg

SEQ ID NO: 3591 - DNA, 27 bp, Artificial Sequences
  Synthetic
cgttgttttttcggtcggttaggcggg

SEQ ID NO: 3592 - DNA, 28 bp, Artificial Sequences
  Synthetic
cgttgttttttcggtcggttaggcgggt

SEQ ID NO: 3593 - DNA, 28 bp, Artificial Sequences
  Synthetic
ttgttttttcggtcggttaggcgggtcg

SEQ ID NO: 3594 - DNA, 27 bp, Artificial Sequences
  Synthetic
cggttcgtttggtcggtcggaggagta

SEQ ID NO: 3595 - DNA, 27 bp, Artificial Sequences
  Synthetic
gttcgtttggtcggtcggaggagtagc

SEQ ID NO: 3596 - DNA, 28 bp, Artificial Sequences
  Synthetic
cggttcgtttggtcggtcggaggagtag

SEQ ID NO: 3597 - DNA, 26 bp, Artificial Sequences
  Synthetic
cggttcgtttggtcggtcggaggagt

SEQ ID NO: 3598 - DNA, 28 bp, Artificial Sequences
  Synthetic
ggttcgtttggtcggtcggaggagtagc

SEQ ID NO: 3599 - DNA, 27 bp, Artificial Sequences
  Synthetic
agtcgggttgttaggtaagtcgcgtga

SEQ ID NO: 3600 - DNA, 27 bp, Artificial Sequences
  Synthetic
tgagtcgggttgttaggtaagtcgcgt

SEQ ID NO: 3601 - DNA, 28 bp, Artificial Sequences
  Synthetic
ggttcgggtttgagtcgggttgttaggt

SEQ ID NO: 3602 - DNA, 27 bp, Artificial Sequences
  Synthetic
ggttcgggtttgagtcgggttgttagg

SEQ ID NO: 3603 - DNA, 29 bp, Artificial Sequences
  Synthetic
aggttcgggtttgagtcgggttgttaggt

SEQ ID NO: 3604 - DNA, 27 bp, Artificial Sequences
  Synthetic
aggaggttgttggacgtgtcggaggat

SEQ ID NO: 3605 - DNA, 28 bp, Artificial Sequences
  Synthetic
ggaggttgttggacgtgtcggaggatgt

SEQ ID NO: 3606 - DNA, 27 bp, Artificial Sequences
  Synthetic
ggaggttgttggacgtgtcggaggatg

SEQ ID NO: 3607 - DNA, 28 bp, Artificial Sequences
  Synthetic
aggaggttgttggacgtgtcggaggatg

SEQ ID NO: 3608 - DNA, 27 bp, Artificial Sequences
  Synthetic
taggaggttgttggacgtgtcggagga

SEQ ID NO: 3609 - DNA, 34 bp, Artificial Sequences
  Synthetic
ttttcggattttaattagtttcggtggttgtggt

SEQ ID NO: 3610 - DNA, 35 bp, Artificial Sequences
  Synthetic
gttttcggattttaattagtttcggtggttgtggt

SEQ ID NO: 3611 - DNA, 35 bp, Artificial Sequences
  Synthetic
tgttttcggattttaattagtttcggtggttgtgg

SEQ ID NO: 3612 - DNA, 36 bp, Artificial Sequences
  Synthetic
tgttttcggattttaattagtttcggtggttgtggt

SEQ ID NO: 3613 - DNA, 36 bp, Artificial Sequences
  Synthetic
ttgttttcggattttaattagtttcggtggttgtgg

SEQ ID NO: 3614 - DNA, 27 bp, Artificial Sequences
  Synthetic
aggaggttgttggacgtgtcggaggat

SEQ ID NO: 3615 - DNA, 28 bp, Artificial Sequences
  Synthetic
ggaggttgttggacgtgtcggaggatgt

SEQ ID NO: 3616 - DNA, 27 bp, Artificial Sequences
  Synthetic
ggaggttgttggacgtgtcggaggatg

SEQ ID NO: 3617 - DNA, 27 bp, Artificial Sequences
  Synthetic
tgggttaggggttggggtaggtttcga

SEQ ID NO: 3618 - DNA, 28 bp, Artificial Sequences
  Synthetic
aggaggttgttggacgtgtcggaggatg

SEQ ID NO: 3619 - DNA, 27 bp, Artificial Sequences
  Synthetic
gcgtgggtggtttttggttggggaagt

SEQ ID NO: 3620 - DNA, 27 bp, Artificial Sequences
  Synthetic
agcgtgggtggtttttggttggggaag

SEQ ID NO: 3621 - DNA, 27 bp, Artificial Sequences
  Synthetic
aggttgtggcgtgtttggtggtgttgt

SEQ ID NO: 3622 - DNA, 27 bp, Artificial Sequences
  Synthetic
tgtagcgtgggtggtttttggttgggg

SEQ ID NO: 3623 - DNA, 27 bp, Artificial Sequences
  Synthetic
gtagcgtgggtggtttttggttgggga

SEQ ID NO: 3624 - DNA, 27 bp, Artificial Sequences
  Synthetic
cgttacgtgtttggagaggcggtgtta

SEQ ID NO: 3625 - DNA, 26 bp, Artificial Sequences
  Synthetic
cgttacgtgtttggagaggcggtgtt

SEQ ID NO: 3626 - DNA, 28 bp, Artificial Sequences
  Synthetic
cgttacgtgtttggagaggcggtgttat

SEQ ID NO: 3627 - DNA, 25 bp, Artificial Sequences
  Synthetic
cgttacgtgtttggagaggcggtgt

SEQ ID NO: 3628 - DNA, 29 bp, Artificial Sequences
  Synthetic
cgttacgtgtttggagaggcggtgttatt

SEQ ID NO: 3629 - DNA, 27 bp, Artificial Sequences
  Synthetic
tggtgagaggtggttgggaggaagttt

SEQ ID NO: 3630 - DNA, 27 bp, Artificial Sequences
  Synthetic
ttggtgagaggtggttgggaggaagtt

SEQ ID NO: 3631 - DNA, 27 bp, Artificial Sequences
  Synthetic
tttggtgagaggtggttgggaggaagt

SEQ ID NO: 3632 - DNA, 28 bp, Artificial Sequences
  Synthetic
ttggtgagaggtggttgggaggaagttt

SEQ ID NO: 3633 - DNA, 28 bp, Artificial Sequences
  Synthetic
tttggtgagaggtggttgggaggaagtt

SEQ ID NO: 3634 - DNA, 27 bp, Artificial Sequences
  Synthetic
cgtttgcggggggtagaggagagaagg

SEQ ID NO: 3635 - DNA, 27 bp, Artificial Sequences
  Synthetic
ttgcggggggtagaggagagaaggaga

SEQ ID NO: 3636 - DNA, 27 bp, Artificial Sequences
  Synthetic
tgcggggggtagaggagagaaggagat

SEQ ID NO: 3637 - DNA, 27 bp, Artificial Sequences
  Synthetic
tttgcggggggtagaggagagaaggag

SEQ ID NO: 3638 - DNA, 28 bp, Artificial Sequences
  Synthetic
tttgcggggggtagaggagagaaggaga

SEQ ID NO: 3639 - DNA, 27 bp, Artificial Sequences
  Synthetic
cgcggcggttgatttcggttcggtatt

SEQ ID NO: 3640 - DNA, 27 bp, Artificial Sequences
  Synthetic
ggagaagggcggtaatggggagttcgt

SEQ ID NO: 3641 - DNA, 27 bp, Artificial Sequences
  Synthetic
aggagaagggcggtaatggggagttcg

SEQ ID NO: 3642 - DNA, 27 bp, Artificial Sequences
  Synthetic
agaagggcggtaatggggagttcgtgt

SEQ ID NO: 3643 - DNA, 26 bp, Artificial Sequences
  Synthetic
cgcggcggttgatttcggttcggtat

SEQ ID NO: 3644 - DNA, 27 bp, Artificial Sequences
  Synthetic
cgcggcggttgatttcggttcggtatt

SEQ ID NO: 3645 - DNA, 26 bp, Artificial Sequences
  Synthetic
cgcggcggttgatttcggttcggtat

SEQ ID NO: 3646 - DNA, 28 bp, Artificial Sequences
  Synthetic
cgcggcggttgatttcggttcggtattt

SEQ ID NO: 3647 - DNA, 27 bp, Artificial Sequences
  Synthetic
gcggcggttgatttcggttcggtattt

SEQ ID NO: 3648 - DNA, 27 bp, Artificial Sequences
  Synthetic
gcgcggcggttgatttcggttcggtat

SEQ ID NO: 3649 - DNA, 27 bp, Artificial Sequences
  Synthetic
tggaggtagtagatgtcgggtcggggt

SEQ ID NO: 3650 - DNA, 27 bp, Artificial Sequences
  Synthetic
tagatgtcgggtcggggttagtcgtcg

SEQ ID NO: 3651 - DNA, 27 bp, Artificial Sequences
  Synthetic
cggggttggaggtagtagatgtcgggt

SEQ ID NO: 3652 - DNA, 28 bp, Artificial Sequences
  Synthetic
gcgtcggggttggaggtagtagatgtcg

SEQ ID NO: 3653 - DNA, 28 bp, Artificial Sequences
  Synthetic
tggaggtagtagatgtcgggtcggggtt

SEQ ID NO: 3654 - DNA, 27 bp, Artificial Sequences
  Synthetic
cgcggcggttgatttcggttcggtatt

SEQ ID NO: 3655 - DNA, 26 bp, Artificial Sequences
  Synthetic
cgcggcggttgatttcggttcggtat

SEQ ID NO: 3656 - DNA, 28 bp, Artificial Sequences
  Synthetic
cgcggcggttgatttcggttcggtattt

SEQ ID NO: 3657 - DNA, 27 bp, Artificial Sequences
  Synthetic
gcggcggttgatttcggttcggtattt

SEQ ID NO: 3658 - DNA, 27 bp, Artificial Sequences
  Synthetic
gcgcggcggttgatttcggttcggtat

SEQ ID NO: 3659 - DNA, 27 bp, Artificial Sequences
  Synthetic
agtagtcggggtggttgaaagcgggtt

SEQ ID NO: 3660 - DNA, 27 bp, Artificial Sequences
  Synthetic
tggaggtagtagatgtcgggtcggggt

SEQ ID NO: 3661 - DNA, 27 bp, Artificial Sequences
  Synthetic
agtcggggtggttgaaagcgggttttt

SEQ ID NO: 3662 - DNA, 27 bp, Artificial Sequences
  Synthetic
tagtagtcggggtggttgaaagcgggt

SEQ ID NO: 3663 - DNA, 27 bp, Artificial Sequences
  Synthetic
gtagtcggggtggttgaaagcgggttt

SEQ ID NO: 3664 - DNA, 27 bp, Artificial Sequences
  Synthetic
agttatttcggttgttgtacgtggcgc

SEQ ID NO: 3665 - DNA, 27 bp, Artificial Sequences
  Synthetic
agggtgttaggagtttgttcgcgtttg

SEQ ID NO: 3666 - DNA, 28 bp, Artificial Sequences
  Synthetic
tggtcgaatataggaaggggagagggag

SEQ ID NO: 3667 - DNA, 28 bp, Artificial Sequences
  Synthetic
tagttatttcggttgttgtacgtggcgc

SEQ ID NO: 3668 - DNA, 29 bp, Artificial Sequences
  Synthetic
tggtcgaatataggaaggggagagggaga

SEQ ID NO: 3669 - DNA, 27 bp, Artificial Sequences
  Synthetic
gtgagcgaggggttttgttgtggaggt

SEQ ID NO: 3670 - DNA, 28 bp, Artificial Sequences
  Synthetic
agtgagcgaggggttttgttgtggaggt

SEQ ID NO: 3671 - DNA, 27 bp, Artificial Sequences
  Synthetic
agtgagcgaggggttttgttgtggagg

SEQ ID NO: 3672 - DNA, 28 bp, Artificial Sequences
  Synthetic
gggtagtgagcgaggggttttgttgtgg

SEQ ID NO: 3673 - DNA, 27 bp, Artificial Sequences
  Synthetic
agggtagtgagcgaggggttttgttgt

SEQ ID NO: 3674 - DNA, 27 bp, Artificial Sequences
  Synthetic
gcgtggatgatggagatggggtgtgga

SEQ ID NO: 3675 - DNA, 27 bp, Artificial Sequences
  Synthetic
ggtgggaggagtggaggtaggaagggt

SEQ ID NO: 3676 - DNA, 27 bp, Artificial Sequences
  Synthetic
ttggcgtggatgatggagatggggtgt

SEQ ID NO: 3677 - DNA, 27 bp, Artificial Sequences
  Synthetic
gtgatttgtagcgggggtgggaggagt

SEQ ID NO: 3678 - DNA, 27 bp, Artificial Sequences
  Synthetic
tgatttgtagcgggggtgggaggagtg

SEQ ID NO: 3679 - DNA, 27 bp, Artificial Sequences
  Synthetic
ggaagaggcgggcgttttaggggtagt

SEQ ID NO: 3680 - DNA, 27 bp, Artificial Sequences
  Synthetic
gtagaatggtggggaggaagaggcggg

SEQ ID NO: 3681 - DNA, 27 bp, Artificial Sequences
  Synthetic
aggaagaggcgggcgttttaggggtag

SEQ ID NO: 3682 - DNA, 27 bp, Artificial Sequences
  Synthetic
gaggaagaggcgggcgttttaggggta

SEQ ID NO: 3683 - DNA, 27 bp, Artificial Sequences
  Synthetic
gtggggaggaagaggcgggcgttttag

SEQ ID NO: 3684 - DNA, 27 bp, Artificial Sequences
  Synthetic
gagcgcggcgggagggaagttgtatta

SEQ ID NO: 3685 - DNA, 27 bp, Artificial Sequences
  Synthetic
agcgcggcgggagggaagttgtattag

SEQ ID NO: 3686 - DNA, 27 bp, Artificial Sequences
  Synthetic
gcgcggcgggagggaagttgtattagt

SEQ ID NO: 3687 - DNA, 26 bp, Artificial Sequences
  Synthetic
agcgcggcgggagggaagttgtatta

SEQ ID NO: 3688 - DNA, 27 bp, Artificial Sequences
  Synthetic
cgcggcgggagggaagttgtattagtt

SEQ ID NO: 3689 - DNA, 29 bp, Artificial Sequences
  Synthetic
cgtaagcgttaagtcgggtgttttttcga

SEQ ID NO: 3690 - DNA, 33 bp, Artificial Sequences
  Synthetic
tgcgtttttgttttgttcgttatagaggttggt

SEQ ID NO: 3691 - DNA, 33 bp, Artificial Sequences
  Synthetic
gcgtttttgttttgttcgttatagaggttggtg

SEQ ID NO: 3692 - DNA, 34 bp, Artificial Sequences
  Synthetic
gcgtttttgttttgttcgttatagaggttggtgt

SEQ ID NO: 3693 - DNA, 34 bp, Artificial Sequences
  Synthetic
tgcgtttttgttttgttcgttatagaggttggtg

SEQ ID NO: 3694 - DNA, 29 bp, Artificial Sequences
  Synthetic
gggttacgtaaaagtttttcggttcgcgg

SEQ ID NO: 3695 - DNA, 30 bp, Artificial Sequences
  Synthetic
tgggttacgtaaaagtttttcggttcgcgg

SEQ ID NO: 3696 - DNA, 30 bp, Artificial Sequences
  Synthetic
gggttacgtaaaagtttttcggttcgcgga

SEQ ID NO: 3697 - DNA, 31 bp, Artificial Sequences
  Synthetic
tgggttacgtaaaagtttttcggttcgcgga

SEQ ID NO: 3698 - DNA, 29 bp, Artificial Sequences
  Synthetic
tgggttacgtaaaagtttttcggttcgcg

SEQ ID NO: 3699 - DNA, 27 bp, Artificial Sequences
  Synthetic
gcgggtcgggaaatttttgcgtagttt

SEQ ID NO: 3700 - DNA, 26 bp, Artificial Sequences
  Synthetic
gcgggtcgggaaatttttgcgtagtt

SEQ ID NO: 3701 - DNA, 28 bp, Artificial Sequences
  Synthetic
gcgggtcgggaaatttttgcgtagttta

SEQ ID NO: 3702 - DNA, 29 bp, Artificial Sequences
  Synthetic
gcgggtcgggaaatttttgcgtagtttag

SEQ ID NO: 3703 - DNA, 30 bp, Artificial Sequences
  Synthetic
gcgggtcgggaaatttttgcgtagtttaga

SEQ ID NO: 3704 - DNA, 27 bp, Artificial Sequences
  Synthetic
ttggtagttggggggcgagaaagaagt

SEQ ID NO: 3705 - DNA, 27 bp, Artificial Sequences
  Synthetic
agttggtagttggggggcgagaaagaa

SEQ ID NO: 3706 - DNA, 28 bp, Artificial Sequences
  Synthetic
gttggtagttggggggcgagaaagaagt

SEQ ID NO: 3707 - DNA, 27 bp, Artificial Sequences
  Synthetic
gttggtagttggggggcgagaaagaag

SEQ ID NO: 3708 - DNA, 29 bp, Artificial Sequences
  Synthetic
agttggtagttggggggcgagaaagaagt

SEQ ID NO: 3709 - DNA, 27 bp, Artificial Sequences
  Synthetic
gcgggtcgggaaatttttgcgtagttt

SEQ ID NO: 3710 - DNA, 26 bp, Artificial Sequences
  Synthetic
gcgggtcgggaaatttttgcgtagtt

SEQ ID NO: 3711 - DNA, 28 bp, Artificial Sequences
  Synthetic
gcgggtcgggaaatttttgcgtagttta

SEQ ID NO: 3712 - DNA, 29 bp, Artificial Sequences
  Synthetic
gcgggtcgggaaatttttgcgtagtttag

SEQ ID NO: 3713 - DNA, 30 bp, Artificial Sequences; identical to SEQ ID NO: 3703
  Synthetic

SEQ ID NO: 3714 - DNA, 27 bp, Artificial Sequences
  Synthetic
ttggtagttggggggcgagaaagaagt

SEQ ID NO: 3715 - DNA, 27 bp, Artificial Sequences
  Synthetic
agttggtagttggggggcgagaaagaa

SEQ ID NO: 3716 - DNA, 28 bp, Artificial Sequences
  Synthetic
gttggtagttggggggcgagaaagaagt

SEQ ID NO: 3717 - DNA, 27 bp, Artificial Sequences
  Synthetic
gttggtagttggggggcgagaaagaag

SEQ ID NO: 3718 - DNA, 29 bp, Artificial Sequences
  Synthetic
agttggtagttggggggcgagaaagaagt

SEQ ID NO: 3719 - DNA, 27 bp, Artificial Sequences
  Synthetic
ttttcggcggcggtagggaaatagacg

SEQ ID NO: 3720 - DNA, 28 bp, Artificial Sequences
  Synthetic
ggttgggttttaaattttcggcggcggt

SEQ ID NO: 3721 - DNA, 28 bp, Artificial Sequences
  Synthetic
attttcggcggcggtagggaaatagacg

SEQ ID NO: 3722 - DNA, 27 bp, Artificial Sequences
  Synthetic
ggttgggttttaaattttcggcggcgg

SEQ ID NO: 3723 - DNA, 26 bp, Artificial Sequences
  Synthetic
tttcggcggcggtagggaaatagacg

SEQ ID NO: 3724 - DNA, 27 bp, Artificial Sequences
  Synthetic
gcgttttgtttttcggcgtgggaagga

SEQ ID NO: 3725 - DNA, 28 bp, Artificial Sequences
  Synthetic
gcgtgggaaggatataggtcgtcgaggg

SEQ ID NO: 3726 - DNA, 28 bp, Artificial Sequences
  Synthetic
ggcgtgggaaggatataggtcgtcgagg

SEQ ID NO: 3727 - DNA, 28 bp, Artificial Sequences
  Synthetic
cgtgggaaggatataggtcgtcgagggg

SEQ ID NO: 3728 - DNA, 27 bp, Artificial Sequences
  Synthetic
gcgtgggaaggatataggtcgtcgagg

SEQ ID NO: 3729 - DNA, 27 bp, Artificial Sequences
  Synthetic
tttcggcggcggtagggaaatagacga

SEQ ID NO: 3730 - DNA, 27 bp, Artificial Sequences
  Synthetic
tcggcggcggtagggaaatagacgatt

SEQ ID NO: 3731 - DNA, 27 bp, Artificial Sequences
  Synthetic
ttcggcggcggtagggaaatagacgat

SEQ ID NO: 3732 - DNA, 27 bp, Artificial Sequences
  Synthetic
ttttcggcggcggtagggaaatagacg

SEQ ID NO: 3733 - DNA, 28 bp, Artificial Sequences
  Synthetic
ttttcggcggcggtagggaaatagacga

SEQ ID NO: 3734 - DNA, 27 bp, Artificial Sequences
  Synthetic
gtggtgtgcgggttgtttggttagggc

SEQ ID NO: 3735 - DNA, 27 bp, Artificial Sequences
  Synthetic
agtggtgtgcgggttgtttggttaggg

SEQ ID NO: 3736 - DNA, 26 bp, Artificial Sequences
  Synthetic
tggtgtgcgggttgtttggttagggc

SEQ ID NO: 3737 - DNA, 27 bp, Artificial Sequences
  Synthetic
tggtgtgcgggttgtttggttagggcg

SEQ ID NO: 3738 - DNA, 26 bp, Artificial Sequences
  Synthetic
ggtgtgcgggttgtttggttagggcg

SEQ ID NO: 3739 - DNA, 27 bp, Artificial Sequences
  Synthetic
tcgttgttttgcggggtttgatcgggg

SEQ ID NO: 3740 - DNA, 27 bp, Artificial Sequences
  Synthetic
gtttgatcggggcggcgatttttggga

SEQ ID NO: 3741 - DNA, 27 bp, Artificial Sequences
  Synthetic
tgatcggggcggcgatttttgggattc

SEQ ID NO: 3742 - DNA, 27 bp, Artificial Sequences
  Synthetic
ttgatcggggcggcgatttttgggatt

SEQ ID NO: 3743 - DNA, 27 bp, Artificial Sequences
  Synthetic
tttgatcggggcggcgatttttgggat

SEQ ID NO: 3744 - DNA, 27 bp, Artificial Sequences
  Synthetic
gtggtgtgcgggttgtttggttagggc

SEQ ID NO: 3745 - DNA, 27 bp, Artificial Sequences
  Synthetic
agtggtgtgcgggttgtttggttaggg

SEQ ID NO: 3746 - DNA, 26 bp, Artificial Sequences
  Synthetic
tggtgtgcgggttgtttggttagggc

SEQ ID NO: 3747 - DNA, 27 bp, Artificial Sequences
  Synthetic
tggtgtgcgggttgtttggttagggcg

SEQ ID NO: 3748 - DNA, 26 bp, Artificial Sequences
  Synthetic
ggtgtgcgggttgtttggttagggcg

SEQ ID NO: 3749 - DNA, 27 bp, Artificial Sequences
  Synthetic
tcgttgttttgcggggtttgatcgggg

SEQ ID NO: 3750 - DNA, 27 bp, Artificial Sequences
  Synthetic
gtttgatcggggcggcgatttttggga

SEQ ID NO: 3751 - DNA, 27 bp, Artificial Sequences
  Synthetic
tgatcggggcggcgatttttgggattc

SEQ ID NO: 3752 - DNA, 27 bp, Artificial Sequences
  Synthetic
ttgatcggggcggcgatttttgggatt

SEQ ID NO: 3753 - DNA, 27 bp, Artificial Sequences
  Synthetic
tttgatcggggcggcgatttttgggat

SEQ ID NO: 3754 - DNA, 27 bp, Artificial Sequences
  Synthetic
gtggtgtgcgggttgtttggttagggc

SEQ ID NO: 3755 - DNA, 27 bp, Artificial Sequences
  Synthetic
agtggtgtgcgggttgtttggttaggg

SEQ ID NO: 3756 - DNA, 26 bp, Artificial Sequences
  Synthetic
tggtgtgcgggttgtttggttagggc

SEQ ID NO: 3757 - DNA, 27 bp, Artificial Sequences
  Synthetic
tggtgtgcgggttgtttggttagggcg

SEQ ID NO: 3758 - DNA, 26 bp, Artificial Sequences
  Synthetic
ggtgtgcgggttgtttggttagggcg

SEQ ID NO: 3759 - DNA, 27 bp, Artificial Sequences
  Synthetic
tcgttgttttgcggggtttgatcgggg

SEQ ID NO: 3760 - DNA, 27 bp, Artificial Sequences
  Synthetic
gtttgatcggggcggcgatttttggga

SEQ ID NO: 3761 - DNA, 27 bp, Artificial Sequences
  Synthetic
tgatcggggcggcgatttttgggattc

SEQ ID NO: 3762 - DNA, 27 bp, Artificial Sequences
  Synthetic
ttgatcggggcggcgatttttgggatt

SEQ ID NO: 3763 - DNA, 27 bp, Artificial Sequences
  Synthetic
tttgatcggggcggcgatttttgggat

SEQ ID NO: 3764 - DNA, 27 bp, Artificial Sequences
  Synthetic
tggatagagggaaggggagggaggaga

SEQ ID NO: 3765 - DNA, 28 bp, Artificial Sequences
  Synthetic
ggatagagggaaggggagggaggagagt

SEQ ID NO: 3766 - DNA, 28 bp, Artificial Sequences
  Synthetic
tggatagagggaaggggagggaggagag

SEQ ID NO: 3767 - DNA, 27 bp, Artificial Sequences
  Synthetic
agagggaaggggagggaggagagtttt

SEQ ID NO: 3768 - DNA, 29 bp, Artificial Sequences
  Synthetic
tggatagagggaaggggagggaggagagt

SEQ ID NO: 3769 - DNA, 32 bp, Artificial Sequences
  Synthetic
cgttttttcgagtgttagggtaatcggtttga

SEQ ID NO: 3770 - DNA, 33 bp, Artificial Sequences
  Synthetic
cgagtgttagggtaatcggtttgagttatagcg

SEQ ID NO: 3771 - DNA, 34 bp, Artificial Sequences
  Synthetic
tcgagtgttagggtaatcggtttgagttatagcg

SEQ ID NO: 3772 - DNA, 33 bp, Artificial Sequences
  Synthetic
cgttttttcgagtgttagggtaatcggtttgag

SEQ ID NO: 3773 - DNA, 34 bp, Artificial Sequences
  Synthetic
cgttttttcgagtgttagggtaatcggtttgagt

SEQ ID NO: 3774 - DNA, 27 bp, Artificial Sequences
  Synthetic
agggagtcgttgtggtttaggtcggtt

SEQ ID NO: 3775 - DNA, 28 bp, Artificial Sequences
  Synthetic
gggagtcgttgtggtttaggtcggttgt

SEQ ID NO: 3776 - DNA, 27 bp, Artificial Sequences
  Synthetic
gggagtcgttgtggtttaggtcggttg

SEQ ID NO: 3777 - DNA, 27 bp, Artificial Sequences
  Synthetic
agtgttgggatagggagtcgttgtggt

SEQ ID NO: 3778 - DNA, 28 bp, Artificial Sequences
  Synthetic
agggagtcgttgtggtttaggtcggttg

SEQ ID NO: 3779 - DNA, 28 bp, Artificial Sequences
  Synthetic
ggttgagttggggggagtagaatttggg

SEQ ID NO: 3780 - DNA, 29 bp, Artificial Sequences
  Synthetic
aggttgagttggggggagtagaatttggg

SEQ ID NO: 3781 - DNA, 29 bp, Artificial Sequences
  Synthetic
ggttgagttggggggagtagaatttggga

SEQ ID NO: 3782 - DNA, 30 bp, Artificial Sequences
  Synthetic
aggttgagttggggggagtagaatttggga

SEQ ID NO: 3783 - DNA, 28 bp, Artificial Sequences
  Synthetic
aggttgagttggggggagtagaatttgg

SEQ ID NO: 3784 - DNA, 34 bp, Artificial Sequences
  Synthetic
tgtggtatcggaaatgatttgtttgtggaatgtt

SEQ ID NO: 3785 - DNA, 34 bp, Artificial Sequences
  Synthetic
ttgtggtatcggaaatgatttgtttgtggaatgt

SEQ ID NO: 3786 - DNA, 35 bp, Artificial Sequences
  Synthetic
tgtggtatcggaaatgatttgtttgtggaatgttt

SEQ ID NO: 3787 - DNA, 35 bp, Artificial Sequences
  Synthetic
ttgtggtatcggaaatgatttgtttgtggaatgtt

SEQ ID NO: 3788 - DNA, 35 bp, Artificial Sequences
  Synthetic
tttgtggtatcggaaatgatttgtttgtggaatgt

SEQ ID NO: 3789 - DNA, 27 bp, Artificial Sequences
  Synthetic
gggtaggcggttgttaggggttttggg

SEQ ID NO: 3790 - DNA, 27 bp, Artificial Sequences
  Synthetic
aggggttttgggtggtatttgcggtgt

SEQ ID NO: 3791 - DNA, 27 bp, Artificial Sequences
  Synthetic
ggcggttgttaggggttttgggtggta

SEQ ID NO: 3792 - DNA, 28 bp, Artificial Sequences
  Synthetic
aggcggttgttaggggttttgggtggta

SEQ ID NO: 3793 - DNA, 27 bp, Artificial Sequences
  Synthetic
ggtaggcggttgttaggggttttgggt

SEQ ID NO: 3794 - DNA, 27 bp, Artificial Sequences
  Synthetic
tttttagcggcgtagggggaggggatg

SEQ ID NO: 3795 - DNA, 27 bp, Artificial Sequences
  Synthetic
gtttttagcggcgtagggggaggggat

SEQ ID NO: 3796 - DNA, 27 bp, Artificial Sequences
  Synthetic
cggtcgttggtttaggggtgggggatt

SEQ ID NO: 3797 - DNA, 27 bp, Artificial Sequences
  Synthetic
tagtttttagcggcgtagggggagggg

SEQ ID NO: 3798 - DNA, 27 bp, Artificial Sequences
  Synthetic
tcggtcgttggtttaggggtgggggat

SEQ ID NO: 3799 - DNA, 27 bp, Artificial Sequences
  Synthetic
cgtcgggggaagtggtaggtttcggag

SEQ ID NO: 3800 - DNA, 27 bp, Artificial Sequences
  Synthetic
ttcggagggcgtaggaagagcggtttt

SEQ ID NO: 3801 - DNA, 27 bp, Artificial Sequences
  Synthetic
tcggagggcgtaggaagagcggttttg

SEQ ID NO: 3802 - DNA, 27 bp, Artificial Sequences
  Synthetic
gttcggagggcgtaggaagagcggttt

SEQ ID NO: 3803 - DNA, 27 bp, Artificial Sequences
  Synthetic
gtcgggggaagtggtaggtttcggaga

SEQ ID NO: 3804 - DNA, 27 bp, Artificial Sequences
  Synthetic
gtgttcgggcgaggatggggttgtttg

SEQ ID NO: 3805 - DNA, 27 bp, Artificial Sequences
  Synthetic
ttgagtgagtgttcgggcgaggatggg

SEQ ID NO: 3806 - DNA, 27 bp, Artificial Sequences
  Synthetic
cggtcgttggtttaggggtgggggatt

SEQ ID NO: 3807 - DNA, 27 bp, Artificial Sequences
  Synthetic
agtgttcgggcgaggatggggttgttt

SEQ ID NO: 3808 - DNA, 27 bp, Artificial Sequences
  Synthetic
ggcgaggatggggttgtttgggaagga

SEQ ID NO: 3809 - DNA, 27 bp, Artificial Sequences
  Synthetic
gtcggatgggagaggttggacgggaag

SEQ ID NO: 3810 - DNA, 27 bp, Artificial Sequences
  Synthetic
acgggtagtcggatgggagaggttgga

SEQ ID NO: 3811 - DNA, 27 bp, Artificial Sequences
  Synthetic
tagtcggatgggagaggttggacggga

SEQ ID NO: 3812 - DNA, 27 bp, Artificial Sequences
  Synthetic
tcggatgggagaggttggacgggaaga

SEQ ID NO: 3813 - DNA, 27 bp, Artificial Sequences
  Synthetic
gtagtcggatgggagaggttggacggg

SEQ ID NO: 3814 - DNA, 28 bp, Artificial Sequences
  Synthetic
ggagttaagggcggagagaggattgggg

SEQ ID NO: 3815 - DNA, 27 bp, Artificial Sequences
  Synthetic
agttaagggcggagagaggattgggga

SEQ ID NO: 3816 - DNA, 28 bp, Artificial Sequences
  Synthetic
tgtcgggttgaaggagagagtggttggt

SEQ ID NO: 3817 - DNA, 27 bp, Artificial Sequences
  Synthetic
gagttaagggcggagagaggattgggg

SEQ ID NO: 3818 - DNA, 27 bp, Artificial Sequences
  Synthetic
ggagttaagggcggagagaggattggg

SEQ ID NO: 3819 - DNA, 29 bp, Artificial Sequences
  Synthetic
tggggtagttttggtgttagagggaaggt

SEQ ID NO: 3820 - DNA, 28 bp, Artificial Sequences
  Synthetic
ggggtagttttggtgttagagggaaggt

SEQ ID NO: 3821 - DNA, 28 bp, Artificial Sequences
  Synthetic
tggggtagttttggtgttagagggaagg

SEQ ID NO: 3822 - DNA, 30 bp, Artificial Sequences
  Synthetic
tggggtagttttggtgttagagggaaggtt

SEQ ID NO: 3823 - DNA, 29 bp, Artificial Sequences
  Synthetic
ggggtagttttggtgttagagggaaggtt

SEQ ID NO: 3824 - DNA, 25 bp, Artificial Sequences
  Synthetic
gcgtggcgtgtattgggataggagt

SEQ ID NO: 3825 - DNA, 32 bp, Artificial Sequences
  Synthetic
agttgggttttatgttttggttgttgtcgtga

SEQ ID NO: 3826 - DNA, 33 bp, Artificial Sequences
  Synthetic
agttgggttttatgttttggttgttgtcgtgaa

SEQ ID NO: 3827 - DNA, 34 bp, Artificial Sequences
  Synthetic
agttgggttttatgttttggttgttgtcgtgaat

SEQ ID NO: 3828 - DNA, 34 bp, Artificial Sequences
  Synthetic
tagttgggttttatgttttggttgttgtcgtgaa

SEQ ID NO: 3829 - DNA, 27 bp, Artificial Sequences
  Synthetic
tcgggagttataggcgggtgaatcgga

SEQ ID NO: 3830 - DNA, 28 bp, Artificial Sequences
  Synthetic
gcgggtgaatcggattttgtagagggcg

SEQ ID NO: 3831 - DNA, 28 bp, Artificial Sequences
  Synthetic
ggcgggtgaatcggattttgtagagggc

SEQ ID NO: 3832 - DNA, 27 bp, Artificial Sequences
  Synthetic
tggagatcgggagttataggcgggtga

SEQ ID NO: 3833 - DNA, 27 bp, Artificial Sequences
  Synthetic
gcgggtgaatcggattttgtagagggc

SEQ ID NO: 3834 - DNA, 28 bp, Artificial Sequences
  Synthetic
gcgtagggaagattggagtggtttggcg

SEQ ID NO: 3835 - DNA, 28 bp, Artificial Sequences
  Synthetic
cgtagggaagattggagtggtttggcgg

SEQ ID NO: 3836 - DNA, 29 bp, Artificial Sequences
  Synthetic
cgtagggaagattggagtggtttggcggt

SEQ ID NO: 3837 - DNA, 27 bp, Artificial Sequences
  Synthetic
agggaagattggagtggtttggcggta

SEQ ID NO: 3838 - DNA, 27 bp, Artificial Sequences
  Synthetic
tagggaagattggagtggtttggcggt

SEQ ID NO: 3839 - DNA, 29 bp, Artificial Sequences
  Synthetic
tgcgttttatattggttttgcggtcgtgt

SEQ ID NO: 3840 - DNA, 30 bp, Artificial Sequences
  Synthetic
tgcgttttatattggttttgcggtcgtgtt

SEQ ID NO: 3841 - DNA, 30 bp, Artificial Sequences
  Synthetic
ttgcgttttatattggttttgcggtcgtgt

SEQ ID NO: 3842 - DNA, 30 bp, Artificial Sequences
  Synthetic
cgtttgcgttttatattggttttgcggtcg

SEQ ID NO: 3843 - DNA, 31 bp, Artificial Sequences
  Synthetic
cgtttgcgttttatattggttttgcggtcgt

SEQ ID NO: 3844 - DNA, 27 bp, Artificial Sequences
  Synthetic
cggaggtattggtcgtaggatggggcg

SEQ ID NO: 3845 - DNA, 27 bp, Artificial Sequences
  Synthetic
cgcggaggtattggtcgtaggatgggg

SEQ ID NO: 3846 - DNA, 27 bp, Artificial Sequences
  Synthetic
ggtattggtcgtaggatggggcgtcgg

SEQ ID NO: 3847 - DNA, 27 bp, Artificial Sequences
  Synthetic
gcggaggtattggtcgtaggatggggc

SEQ ID NO: 3848 - DNA, 27 bp, Artificial Sequences
  Synthetic
aggtattggtcgtaggatggggcgtcg

SEQ ID NO: 3849 - DNA, 27 bp, Artificial Sequences
  Synthetic
ttcgtgcgtttgtgtttaatcgtgcgt

SEQ ID NO: 3850 - DNA, 28 bp, Artificial Sequences
  Synthetic
tttcgtgcgtttgtgtttaatcgtgcgt

SEQ ID NO: 3851 - DNA, 27 bp, Artificial Sequences
  Synthetic
tttcgtgcgtttgtgtttaatcgtgcg

SEQ ID NO: 3852 - DNA, 26 bp, Artificial Sequences
  Synthetic
tcgtgcgtttgtgtttaatcgtgcgt

SEQ ID NO: 3853 - DNA, 29 bp, Artificial Sequences
  Synthetic
ttttcgtgcgtttgtgtttaatcgtgcgt

SEQ ID NO: 3854 - DNA, 27 bp, Artificial Sequences
  Synthetic
cggaggtattggtcgtaggatggggcg

SEQ ID NO: 3855 - DNA, 27 bp, Artificial Sequences
  Synthetic
cgcggaggtattggtcgtaggatgggg

SEQ ID NO: 3856 - DNA, 27 bp, Artificial Sequences
  Synthetic
ggtattggtcgtaggatggggcgtcgg

SEQ ID NO: 3857 - DNA, 27 bp, Artificial Sequences
  Synthetic
gcggaggtattggtcgtaggatggggc

SEQ ID NO: 3858 - DNA, 27 bp, Artificial Sequences
  Synthetic
aggtattggtcgtaggatggggcgtcg

SEQ ID NO: 3859 - DNA, 27 bp, Artificial Sequences
  Synthetic
tcgtgcgtttgtgtttaatcgtgcgtt

SEQ ID NO: 3860 - DNA, 27 bp, Artificial Sequences
  Synthetic
ttcgtgcgtttgtgtttaatcgtgcgt

SEQ ID NO: 3861 - DNA, 27 bp, Artificial Sequences
  Synthetic
cgtgcgtttgtgtttaatcgtgcgttt

SEQ ID NO: 3862 - DNA, 28 bp, Artificial Sequences
  Synthetic
tcgtgcgtttgtgtttaatcgtgcgttt

SEQ ID NO: 3863 - DNA, 28 bp, Artificial Sequences
  Synthetic
ttcgtgcgtttgtgtttaatcgtgcgtt

SEQ ID NO: 3864 - DNA, 27 bp, Artificial Sequences
  Synthetic
cggaggtattggtcgtaggatggggcg

SEQ ID NO: 3865 - DNA, 27 bp, Artificial Sequences
  Synthetic
cgcggaggtattggtcgtaggatgggg

SEQ ID NO: 3866 - DNA, 27 bp, Artificial Sequences
  Synthetic
ggtattggtcgtaggatggggcgtcgg

SEQ ID NO: 3867 - DNA, 27 bp, Artificial Sequences
  Synthetic
gcggaggtattggtcgtaggatggggc

SEQ ID NO: 3868 - DNA, 27 bp, Artificial Sequences
  Synthetic
aggtattggtcgtaggatggggcgtcg

SEQ ID NO: 3869 - DNA, 28 bp, Artificial Sequences
  Synthetic
cgtcggcgttttattttgcggttagtgt

SEQ ID NO: 3870 - DNA, 29 bp, Artificial Sequences
  Synthetic
cgtcggcgttttattttgcggttagtgtt

SEQ ID NO: 3871 - DNA, 30 bp, Artificial Sequences
  Synthetic
cgtcggcgttttattttgcggttagtgttt

SEQ ID NO: 3872 - DNA, 30 bp, Artificial Sequences
  Synthetic
cggcgttttattttgcggttagtgttttcg

SEQ ID NO: 3873 - DNA, 31 bp, Artificial Sequences
  Synthetic
cgtcggcgttttattttgcggttagtgtttt

SEQ ID NO: 3874 - DNA, 27 bp, Artificial Sequences
  Synthetic
ttaggcggcggttcgagtgaggttagc

SEQ ID NO: 3875 - DNA, 27 bp, Artificial Sequences
  Synthetic
ttcgagtgaggttagcggggaggggtc

SEQ ID NO: 3876 - DNA, 27 bp, Artificial Sequences
  Synthetic
gttaggcggcggttcgagtgaggttag

SEQ ID NO: 3877 - DNA, 26 bp, Artificial Sequences
  Synthetic
gttcgagtgaggttagcggggagggg

SEQ ID NO: 3878 - DNA, 26 bp, Artificial Sequences
  Synthetic
ggttcgagtgaggttagcggggaggg

SEQ ID NO: 3879 - DNA, 27 bp, Artificial Sequences
  Synthetic
tagattttcggaggagtaggcgggcgg

SEQ ID NO: 3880 - DNA, 26 bp, Artificial Sequences
  Synthetic
agattttcggaggagtaggcgggcgg

SEQ ID NO: 3881 - DNA, 28 bp, Artificial Sequences
  Synthetic
ttagattttcggaggagtaggcgggcgg

SEQ ID NO: 3882 - DNA, 27 bp, Artificial Sequences
  Synthetic
agattttcggaggagtaggcgggcggg

SEQ ID NO: 3883 - DNA, 27 bp, Artificial Sequences
  Synthetic
ttagattttcggaggagtaggcgggcg

SEQ ID NO: 3884 - DNA, 27 bp, Artificial Sequences
  Synthetic
ttaggcggcggttcgagtgaggttagc

SEQ ID NO: 3885 - DNA, 27 bp, Artificial Sequences
  Synthetic
ttcgagtgaggttagcggggaggggtc

SEQ ID NO: 3886 - DNA, 27 bp, Artificial Sequences
  Synthetic
gttaggcggcggttcgagtgaggttag

SEQ ID NO: 3887 - DNA, 26 bp, Artificial Sequences
  Synthetic
gttcgagtgaggttagcggggagggg

SEQ ID NO: 3888 - DNA, 26 bp, Artificial Sequences
  Synthetic
ggttcgagtgaggttagcggggaggg

SEQ ID NO: 3889 - DNA, 27 bp, Artificial Sequences
  Synthetic
ttgaagagggttcggtaggcgttcggg

SEQ ID NO: 3890 - DNA, 27 bp, Artificial Sequences
  Synthetic
tagattttcggaggagtaggcgggcgg

SEQ ID NO: 3891 - DNA, 27 bp, Artificial Sequences
  Synthetic
cggtaggcgttcggggtttttagcgtt

SEQ ID NO: 3892 - DNA, 27 bp, Artificial Sequences
  Synthetic
ttcggtaggcgttcggggtttttagcg

SEQ ID NO: 3893 - DNA, 26 bp, Artificial Sequences
  Synthetic
tgaagagggttcggtaggcgttcggg

SEQ ID NO: 3894 - DNA, 27 bp, Artificial Sequences
  Synthetic
ggaaggagaggggttggggcggttatt

SEQ ID NO: 3895 - DNA, 27 bp, Artificial Sequences
  Synthetic
aggagaggggttggggcggttatttgt

SEQ ID NO: 3896 - DNA, 27 bp, Artificial Sequences
  Synthetic
ggtgagggcgggtcgagagggtttttt

SEQ ID NO: 3897 - DNA, 28 bp, Artificial Sequences
  Synthetic
ggaaggagaggggttggggcggttattt

SEQ ID NO: 3898 - DNA, 27 bp, Artificial Sequences
  Synthetic
ggagaggggttggggcggttatttgtt

SEQ ID NO: 3899 - DNA, 27 bp, Artificial Sequences
  Synthetic
ttgaagagggttcggtaggcgttcggg

SEQ ID NO: 3900 - DNA, 27 bp, Artificial Sequences
  Synthetic
agggttcggtaggcgttcggggttttt

SEQ ID NO: 3901 - DNA, 27 bp, Artificial Sequences
  Synthetic
cggtaggcgttcggggtttttagcgtt

SEQ ID NO: 3902 - DNA, 27 bp, Artificial Sequences
  Synthetic
gagggttcggtaggcgttcggggtttt

SEQ ID NO: 3903 - DNA, 27 bp, Artificial Sequences
  Synthetic
ttcggtaggcgttcggggtttttagcg

SEQ ID NO: 3904 - DNA, 27 bp, Artificial Sequences
  Synthetic
ggggaggattcgggggtgcgagtatag

SEQ ID NO: 3905 - DNA, 27 bp, Artificial Sequences
  Synthetic
ggtgagggcgggtcgagagggtttttt

SEQ ID NO: 3906 - DNA, 27 bp, Artificial Sequences
  Synthetic
cggggaggattcgggggtgcgagtata

SEQ ID NO: 3907 - DNA, 27 bp, Artificial Sequences
  Synthetic
aggtgagggcgggtcgagagggttttt

SEQ ID NO: 3908 - DNA, 27 bp, Artificial Sequences
  Synthetic
aaggtgagggcgggtcgagagggtttt

SEQ ID NO: 3909 - DNA, 27 bp, Artificial Sequences
  Synthetic
ttgggttgggggtgggtgttagggttt

SEQ ID NO: 3910 - DNA, 27 bp, Artificial Sequences
  Synthetic
tttgggttgggggtgggtgttagggtt

SEQ ID NO: 3911 - DNA, 27 bp, Artificial Sequences
  Synthetic
ttttgggttgggggtgggtgttagggt

SEQ ID NO: 3912 - DNA, 27 bp, Artificial Sequences
  Synthetic
tgggttgggggtgggtgttagggttta

SEQ ID NO: 3913 - DNA, 28 bp, Artificial Sequences
  Synthetic
tttgggttgggggtgggtgttagggttt

SEQ ID NO: 3914 - DNA, 29 bp, Artificial Sequences
  Synthetic
aggtggtttagggggttgttagttttggt

SEQ ID NO: 3915 - DNA, 31 bp, Artificial Sequences
  Synthetic
ggtggtttagggggttgttagttttggtagt

SEQ ID NO: 3916 - DNA, 31 bp, Artificial Sequences
  Synthetic
aggtggtttagggggttgttagttttggtag

SEQ ID NO: 3917 - DNA, 32 bp, Artificial Sequences
  Synthetic
aggtggtttagggggttgttagttttggtagt

SEQ ID NO: 3918 - DNA, 31 bp, Artificial Sequences
  Synthetic
ttaggtggtttagggggttgttagttttggt

SEQ ID NO: 3919 - DNA, 27 bp, Artificial Sequences
  Synthetic
atggtatggtttcggggttagcggcgt

SEQ ID NO: 3920 - DNA, 27 bp, Artificial Sequences
  Synthetic
tggtatggtttcggggttagcggcgta

SEQ ID NO: 3921 - DNA, 27 bp, Artificial Sequences
  Synthetic
ggcggttggtttgttcgtgggggtttt

SEQ ID NO: 3922 - DNA, 27 bp, Artificial Sequences
  Synthetic
ttaaggcggttggtttgttcgtggggg

SEQ ID NO: 3923 - DNA, 27 bp, Artificial Sequences
  Synthetic
taaggcggttggtttgttcgtgggggt

SEQ ID NO: 3924 - DNA, 27 bp, Artificial Sequences
  Synthetic
gtagttagggttggtgggggacgggtg

SEQ ID NO: 3925 - DNA, 27 bp, Artificial Sequences
  Synthetic
gaggtcggcggtaagaaggttcgggtt

SEQ ID NO: 3926 - DNA, 27 bp, Artificial Sequences
  Synthetic
acggggggttgtagggtggaggtagat

SEQ ID NO: 3927 - DNA, 27 bp, Artificial Sequences
  Synthetic
aggtcggcggtaagaaggttcgggttt

SEQ ID NO: 3928 - DNA, 27 bp, Artificial Sequences
  Synthetic
gcggggtttagtagggagtagggcgtc

SEQ ID NO: 3929 - DNA, 31 bp, Artificial Sequences
  Synthetic
tgggaggaggtttagttcgtagtaggaatga

SEQ ID NO: 3930 - DNA, 32 bp, Artificial Sequences
  Synthetic
ttgggaggaggtttagttcgtagtaggaatga

SEQ ID NO: 3931 - DNA, 32 bp, Artificial Sequences
  Synthetic
tgggaggaggtttagttcgtagtaggaatgat

SEQ ID NO: 3932 - DNA, 32 bp, Artificial Sequences
  Synthetic
tgtttttgggaggaggtttagttcgtagtagg

SEQ ID NO: 3933 - DNA, 33 bp, Artificial Sequences
  Synthetic
tgtttttgggaggaggtttagttcgtagtagga

SEQ ID NO: 3934 - DNA, 27 bp, Artificial Sequences
  Synthetic
cgggatttttgttggggagggttcggt

SEQ ID NO: 3935 - DNA, 27 bp, Artificial Sequences
  Synthetic
tcgggatttttgttggggagggttcgg

SEQ ID NO: 3936 - DNA, 28 bp, Artificial Sequences
  Synthetic
tcgggatttttgttggggagggttcggt

SEQ ID NO: 3937 - DNA, 28 bp, Artificial Sequences
  Synthetic
gtcgggatttttgttggggagggttcgg

SEQ ID NO: 3938 - DNA, 28 bp, Artificial Sequences
  Synthetic
cgggatttttgttggggagggttcggtt

SEQ ID NO: 3939 - DNA, 28 bp, Artificial Sequences
  Synthetic
tgtagaatcgtgcggttgataggagagc

SEQ ID NO: 3940 - DNA, 29 bp, Artificial Sequences
  Synthetic
ttgtagaatcgtgcggttgataggagagc

SEQ ID NO: 3941 - DNA, 30 bp, Artificial Sequences
  Synthetic
tttgtagaatcgtgcggttgataggagagc

SEQ ID NO: 3942 - DNA, 30 bp, Artificial Sequences
  Synthetic
cgtggagattgggttttatagcgatttggg

SEQ ID NO: 3943 - DNA, 31 bp, Artificial Sequences
  Synthetic
cgtggagattgggttttatagcgatttgggt

SEQ ID NO: 3944 - DNA, 27 bp, Artificial Sequences
  Synthetic
tgggttcggttggtcggttagattcga

SEQ ID NO: 3945 - DNA, 26 bp, Artificial Sequences
  Synthetic
tgggttcggttggtcggttagattcg

SEQ ID NO: 3946 - DNA, 26 bp, Artificial Sequences
  Synthetic
gggttcggttggtcggttagattcga

SEQ ID NO: 3947 - DNA, 28 bp, Artificial Sequences
  Synthetic
gttgcgttttttaggggcgtttttgtgt

SEQ ID NO: 3948 - DNA, 29 bp, Artificial Sequences
  Synthetic
agttgcgttttttaggggcgtttttgtgt

SEQ ID NO: 3949 - DNA, 26 bp, Artificial Sequences
  Synthetic
gaggtcgggcgttggaggagttttcg

SEQ ID NO: 3950 - DNA, 25 bp, Artificial Sequences
  Synthetic
aggtcgggcgttggaggagttttcg

SEQ ID NO: 3951 - DNA, 27 bp, Artificial Sequences
  Synthetic
cggttgataggagagcgttgcgtagaa

SEQ ID NO: 3952 - DNA, 28 bp, Artificial Sequences
  Synthetic
ggagagcgttgcgtagaaaattcgaggt

SEQ ID NO: 3953 - DNA, 27 bp, Artificial Sequences
  Synthetic
ggagagcgttgcgtagaaaattcgagg

SEQ ID NO: 3954 - DNA, 27 bp, Artificial Sequences
  Synthetic
tcgttgggttcggttggtcggttagat

SEQ ID NO: 3955 - DNA, 27 bp, Artificial Sequences
  Synthetic
atcgttgggttcggttggtcggttaga

SEQ ID NO: 3956 - DNA, 27 bp, Artificial Sequences
  Synthetic
tgggttcggttggtcggttagattcga

SEQ ID NO: 3957 - DNA, 27 bp, Artificial Sequences
  Synthetic
gatcgttgggttcggttggtcggttag

SEQ ID NO: 3958 - DNA, 28 bp, Artificial Sequences
  Synthetic
gatcgttgggttcggttggtcggttaga

SEQ ID NO: 3959 - DNA, 26 bp, Artificial Sequences
  Synthetic
gaggtcgggcgttggaggagttttcg

SEQ ID NO: 3960 - DNA, 27 bp, Artificial Sequences
  Synthetic
agaggcgtttttgagaggcgtagttgg

SEQ ID NO: 3961 - DNA, 27 bp, Artificial Sequences
  Synthetic
gaggcgtttttgagaggcgtagttgga

SEQ ID NO: 3962 - DNA, 28 bp, Artificial Sequences
  Synthetic
agaggcgtttttgagaggcgtagttgga

SEQ ID NO: 3963 - DNA, 25 bp, Artificial Sequences
  Synthetic
aggtcgggcgttggaggagttttcg

SEQ ID NO: 3964 - DNA, 28 bp, Artificial Sequences
  Synthetic
agtttttggaggcgttagggatagtggt

SEQ ID NO: 3965 - DNA, 29 bp, Artificial Sequences
  Synthetic
agtttttggaggcgttagggatagtggtt

SEQ ID NO: 3966 - DNA, 29 bp, Artificial Sequences
  Synthetic
aagtttttggaggcgttagggatagtggt

SEQ ID NO: 3967 - DNA, 30 bp, Artificial Sequences
  Synthetic
agtttttggaggcgttagggatagtggttt

SEQ ID NO: 3968 - DNA, 30 bp, Artificial Sequences
  Synthetic
aagtttttggaggcgttagggatagtggtt

SEQ ID NO: 3969 - DNA, 27 bp, Artificial Sequences
  Synthetic
cgagttggtttcgcgtcggggttttgt

SEQ ID NO: 3970 - DNA, 28 bp, Artificial Sequences
  Synthetic
cgagttggtttcgcgtcggggttttgta

SEQ ID NO: 3971 - DNA, 27 bp, Artificial Sequences
  Synthetic
gttggtttcgcgtcggggttttgtagt

SEQ ID NO: 3972 - DNA, 26 bp, Artificial Sequences
  Synthetic
cgagttggtttcgcgtcggggttttg

SEQ ID NO: 3973 - DNA, 27 bp, Artificial Sequences
  Synthetic
tgggggcgattagggtttttgcgtttt

SEQ ID NO: 3974 - DNA, 27 bp, Artificial Sequences
  Synthetic
gtgttttcgggtttgttggcggcgttg

SEQ ID NO: 3975 - DNA, 27 bp, Artificial Sequences
  Synthetic
tcgggtttgttggcggcgttgtaagtt

SEQ ID NO: 3976 - DNA, 27 bp, Artificial Sequences
  Synthetic
ttcgggtttgttggcggcgttgtaagt

SEQ ID NO: 3977 - DNA, 27 bp, Artificial Sequences
  Synthetic
tgttttcgggtttgttggcggcgttgt

SEQ ID NO: 3978 - DNA, 27 bp, Artificial Sequences
  Synthetic
cgggtttgttggcggcgttgtaagttt

SEQ ID NO: 3979 - DNA, 27 bp, Artificial Sequences
  Synthetic
tgggggcgattagggtttttgcgtttt

SEQ ID NO: 3980 - DNA, 27 bp, Artificial Sequences
  Synthetic
ttgggggcgattagggtttttgcgttt

SEQ ID NO: 3981 - DNA, 27 bp, Artificial Sequences
  Synthetic
tttgggggcgattagggtttttgcgtt

SEQ ID NO: 3982 - DNA, 27 bp, Artificial Sequences
  Synthetic
ttttgggggcgattagggtttttgcgt

SEQ ID NO: 3983 - DNA, 28 bp, Artificial Sequences
  Synthetic
tgggggcgattagggtttttgcgttttc

SEQ ID NO: 3984 - DNA, 27 bp, Artificial Sequences
  Synthetic
gtgttttcgggtttgttggcggcgttg

SEQ ID NO: 3985 - DNA, 27 bp, Artificial Sequences
  Synthetic
ggttgggttaattgcgggcgatcgagg

SEQ ID NO: 3986 - DNA, 27 bp, Artificial Sequences
  Synthetic
gggttgggttaattgcgggcgatcgag

SEQ ID NO: 3987 - DNA, 27 bp, Artificial Sequences
  Synthetic
gggagcgagaggggttagtagtcggga

SEQ ID NO: 3988 - DNA, 27 bp, Artificial Sequences
  Synthetic
tggggagcgagaggggttagtagtcgg

SEQ ID NO: 3989 - DNA, 27 bp, Artificial Sequences
  Synthetic
ggcgttttaggtcggggttttttcggt

SEQ ID NO: 3990 - DNA, 28 bp, Artificial Sequences
  Synthetic
aggcgttttaggtcggggttttttcggt

SEQ ID NO: 3991 - DNA, 27 bp, Artificial Sequences
  Synthetic
aggcgttttaggtcggggttttttcgg

SEQ ID NO: 3992 - DNA, 29 bp, Artificial Sequences
  Synthetic
cgaggcgttttaggtcggggttttttcgg

SEQ ID NO: 3993 - DNA, 27 bp, Artificial Sequences
  Synthetic
aggtcggggttttttcggttgttggtt

SEQ ID NO: 3994 - DNA, 27 bp, Artificial Sequences
  Synthetic
aggggtaaacgtaggaagcgggttggg

SEQ ID NO: 3995 - DNA, 27 bp, Artificial Sequences
  Synthetic
ggttgggttaattgcgggcgatcgagg

SEQ ID NO: 3996 - DNA, 27 bp, Artificial Sequences
  Synthetic
gggttgggttaattgcgggcgatcgag

SEQ ID NO: 3997 - DNA, 27 bp, Artificial Sequences
  Synthetic
ggggtaaacgtaggaagcgggttgggt

SEQ ID NO: 3998 - DNA, 27 bp, Artificial Sequences
  Synthetic
gttgggttaattgcgggcgatcgaggc

SEQ ID NO: 3999 - DNA, 27 bp, Artificial Sequences
  Synthetic
ttagtcgagggaggcgcgtgaggattg

SEQ ID NO: 4000 - DNA, 27 bp, Artificial Sequences
  Synthetic
attagtcgagggaggcgcgtgaggatt

SEQ ID NO: 4001 - DNA, 27 bp, Artificial Sequences
  Synthetic
aattagtcgagggaggcgcgtgaggat

SEQ ID NO: 4002 - DNA, 28 bp, Artificial Sequences
  Synthetic
attagtcgagggaggcgcgtgaggattg

SEQ ID NO: 4003 - DNA, 27 bp, Artificial Sequences
  Synthetic
taattagtcgagggaggcgcgtgagga

SEQ ID NO: 4004 - DNA, 27 bp, Artificial Sequences
  Synthetic
gtgggcgttgagatttcgttcggggtt

SEQ ID NO: 4005 - DNA, 27 bp, Artificial Sequences
  Synthetic
ttggtgggcgttgagatttcgttcggg

SEQ ID NO: 4006 - DNA, 27 bp, Artificial Sequences
  Synthetic
tgggcgttgagatttcgttcggggttt

SEQ ID NO: 4007 - DNA, 27 bp, Artificial Sequences
  Synthetic
tggtgggcgttgagatttcgttcgggg

SEQ ID NO: 4008 - DNA, 27 bp, Artificial Sequences
  Synthetic
ggtgggcgttgagatttcgttcggggt

SEQ ID NO: 4009 - DNA, 27 bp, Artificial Sequences
  Synthetic
tggagatcgtgttgtgggtagttggtt

SEQ ID NO: 4010 - DNA, 27 bp, Artificial Sequences
  Synthetic
ttggagatcgtgttgtgggtagttggt

SEQ ID NO: 4011 - DNA, 28 bp, Artificial Sequences
  Synthetic
tggagatcgtgttgtgggtagttggttt

SEQ ID NO: 4012 - DNA, 28 bp, Artificial Sequences
  Synthetic
ttggagatcgtgttgtgggtagttggtt

SEQ ID NO: 4013 - DNA, 28 bp, Artificial Sequences
  Synthetic
tttggagatcgtgttgtgggtagttggt

SEQ ID NO: 4014 - DNA, 27 bp, Artificial Sequences
  Synthetic
ggtgggggtggtttgggtagatcggtc

SEQ ID NO: 4015 - DNA, 27 bp, Artificial Sequences
  Synthetic
tgggggtggtttgggtagatcggtcga

SEQ ID NO: 4016 - DNA, 27 bp, Artificial Sequences
  Synthetic
aggtgggggtggtttgggtagatcggt

SEQ ID NO: 4017 - DNA, 27 bp, Artificial Sequences
  Synthetic
taggtgggggtggtttgggtagatcgg

SEQ ID NO: 4018 - DNA, 26 bp, Artificial Sequences
  Synthetic
ggtgggggtggtttgggtagatcggt

SEQ ID NO: 4019 - DNA, 27 bp, Artificial Sequences
  Synthetic
ggttggcgcggtagggttcgtataggt

SEQ ID NO: 4020 - DNA, 27 bp, Artificial Sequences
  Synthetic
tttaagacgaggggttggcgcggtagg

SEQ ID NO: 4021 - DNA, 27 bp, Artificial Sequences
  Synthetic
gggttggcgcggtagggttcgtatagg

SEQ ID NO: 4022 - DNA, 27 bp, Artificial Sequences
  Synthetic
ggggttggcgcggtagggttcgtatag

SEQ ID NO: 4023 - DNA, 27 bp, Artificial Sequences
  Synthetic
gttttaagacgaggggttggcgcggta

SEQ ID NO: 4024 - DNA, 27 bp, Artificial Sequences
  Synthetic
tcgtttggtggtttttcgggttgcgga

SEQ ID NO: 4025 - DNA, 27 bp, Artificial Sequences
  Synthetic
agtcgtagcgtttaagggcgtggttgc

SEQ ID NO: 4026 - DNA, 27 bp, Artificial Sequences
  Synthetic
gtcgtttggtggtttttcgggttgcgg

SEQ ID NO: 4027 - DNA, 27 bp, Artificial Sequences
  Synthetic
cgtttggtggtttttcgggttgcggag

SEQ ID NO: 4028 - DNA, 28 bp, Artificial Sequences
  Synthetic
tcgtttggtggtttttcgggttgcggag

SEQ ID NO: 4029 - DNA, 27 bp, Artificial Sequences
  Synthetic
ggttggcgcggtagggttcgtataggt

SEQ ID NO: 4030 - DNA, 27 bp, Artificial Sequences
  Synthetic
gggttggcgcggtagggttcgtatagg

SEQ ID NO: 4031 - DNA, 27 bp, Artificial Sequences
  Synthetic
ggggttggcgcggtagggttcgtatag

SEQ ID NO: 4032 - DNA, 27 bp, Artificial Sequences
  Synthetic
aggggttggcgcggtagggttcgtata

SEQ ID NO: 4033 - DNA, 28 bp, Artificial Sequences
  Synthetic
ggttggcgcggtagggttcgtataggtt

SEQ ID NO: 4034 - DNA, 30 bp, Artificial Sequences
  Synthetic
tgttagtcgtttggtggtttttcgggttgt

SEQ ID NO: 4035 - DNA, 29 bp, Artificial Sequences
  Synthetic
gttagtcgtttggtggtttttcgggttgt

SEQ ID NO: 4036 - DNA, 29 bp, Artificial Sequences
  Synthetic
tgttagtcgtttggtggtttttcgggttg

SEQ ID NO: 4037 - DNA, 30 bp, Artificial Sequences
  Synthetic
atgttagtcgtttggtggtttttcgggttg

SEQ ID NO: 4038 - DNA, 31 bp, Artificial Sequences
  Synthetic
atgttagtcgtttggtggtttttcgggttgt

SEQ ID NO: 4039 - DNA, 27 bp, Artificial Sequences
  Synthetic
ttggtataggtcggggaggggttggga

SEQ ID NO: 4040 - DNA, 27 bp, Artificial Sequences
  Synthetic
cggttggtataggtcggggaggggttg

SEQ ID NO: 4041 - DNA, 27 bp, Artificial Sequences
  Synthetic
tggtataggtcggggaggggttgggat

SEQ ID NO: 4042 - DNA, 27 bp, Artificial Sequences
  Synthetic
tataggtcggggaggggttgggatcgg

SEQ ID NO: 4043 - DNA, 27 bp, Artificial Sequences
  Synthetic
gggttgggatcggtggttgcgatgttt

SEQ ID NO: 4044 - DNA, 28 bp, Artificial Sequences
  Synthetic
ggaatttaggttttcgggttttcggggt

SEQ ID NO: 4045 - DNA, 29 bp, Artificial Sequences
  Synthetic
aggaatttaggttttcgggttttcggggt

SEQ ID NO: 4046 - DNA, 29 bp, Artificial Sequences
  Synthetic
ggaatttaggttttcgggttttcggggtt

SEQ ID NO: 4047 - DNA, 30 bp, Artificial Sequences
  Synthetic
aggaatttaggttttcgggttttcggggtt

SEQ ID NO: 4048 - DNA, 32 bp, Artificial Sequences
  Synthetic
cggtaggaatttaggttttcgggttttcgggg

SEQ ID NO: 4049 - DNA, 27 bp, Artificial Sequences
  Synthetic
tgttttgtagagtcgagggaaggcgcg

SEQ ID NO: 4050 - DNA, 28 bp, Artificial Sequences
  Synthetic
tgttttgtagagtcgagggaaggcgcga

SEQ ID NO: 4051 - DNA, 27 bp, Artificial Sequences
  Synthetic
gttttgtagagtcgagggaaggcgcga

SEQ ID NO: 4052 - DNA, 28 bp, Artificial Sequences
  Synthetic
atgttttgtagagtcgagggaaggcgcg

SEQ ID NO: 4053 - DNA, 29 bp, Artificial Sequences
  Synthetic
atgttttgtagagtcgagggaaggcgcga

SEQ ID NO: 4054 - DNA, 31 bp, Artificial Sequences
  Synthetic
gcgttgggaggtagttatttgtttaaagcgt

SEQ ID NO: 4055 - DNA, 31 bp, Artificial Sequences
  Synthetic
agcgttgggaggtagttatttgtttaaagcg

SEQ ID NO: 4056 - DNA, 31 bp, Artificial Sequences
  Synthetic
gtcggttttttaatttagagcgttgggaggt

SEQ ID NO: 4057 - DNA, 32 bp, Artificial Sequences
  Synthetic
agcgttgggaggtagttatttgtttaaagcgt

SEQ ID NO: 4058 - DNA, 32 bp, Artificial Sequences
  Synthetic
agtcggttttttaatttagagcgttgggaggt

SEQ ID NO: 4059 - DNA, 27 bp, Artificial Sequences
  Synthetic
agtgttgcggaaatgggggaagaaggt

SEQ ID NO: 4060 - DNA, 29 bp, Artificial Sequences
  Synthetic
cggaaatgggggaagaaggtttttgggcg

SEQ ID NO: 4061 - DNA, 27 bp, Artificial Sequences
  Synthetic
gtgttgcggaaatgggggaagaaggtt

SEQ ID NO: 4062 - DNA, 27 bp, Artificial Sequences
  Synthetic
tgggggaagaaggtttttgggcgtttt

SEQ ID NO: 4063 - DNA, 29 bp, Artificial Sequences
  Synthetic
gcggaaatgggggaagaaggtttttgggc

SEQ ID NO: 4064 - DNA, 27 bp, Artificial Sequences
  Synthetic
ttcgggtttaggagtcgttgattgcgt

SEQ ID NO: 4065 - DNA, 27 bp, Artificial Sequences
  Synthetic
gggttcgggaattggggttttgtttgt

SEQ ID NO: 4066 - DNA, 28 bp, Artificial Sequences
  Synthetic
agggttcgggaattggggttttgtttgt

SEQ ID NO: 4067 - DNA, 27 bp, Artificial Sequences
  Synthetic
agggttcgggaattggggttttgtttg

SEQ ID NO: 4068 - DNA, 27 bp, Artificial Sequences
  Synthetic
cggagattcgggtttaggagtcgttga

SEQ ID NO: 4069 - DNA, 27 bp, Artificial Sequences
  Synthetic
agaggaggtaagggcgtcgcgagtttt

SEQ ID NO: 4070 - DNA, 27 bp, Artificial Sequences
  Synthetic
aagaggaggtaagggcgtcgcgagttt

SEQ ID NO: 4071 - DNA, 27 bp, Artificial Sequences
  Synthetic
gtaagaggaggtaagggcgtcgcgagt

SEQ ID NO: 4072 - DNA, 27 bp, Artificial Sequences
  Synthetic
taagaggaggtaagggcgtcgcgagtt

SEQ ID NO: 4073 - DNA, 27 bp, Artificial Sequences
  Synthetic
aggaggtaagggcgtcgcgagtttttc

SEQ ID NO: 4074 - DNA, 27 bp, Artificial Sequences
  Synthetic
aggttcgcggaggtagttaggttcggc

SEQ ID NO: 4075 - DNA, 27 bp, Artificial Sequences
  Synthetic
cggagaggttcgcggaggtagttaggt

SEQ ID NO: 4076 - DNA, 28 bp, Artificial Sequences
  Synthetic
gaggttcgcggaggtagttaggttcggc

SEQ ID NO: 4077 - DNA, 27 bp, Artificial Sequences
  Synthetic
gaggttcgcggaggtagttaggttcgg

SEQ ID NO: 4078 - DNA, 28 bp, Artificial Sequences
  Synthetic
agaggttcgcggaggtagttaggttcgg

SEQ ID NO: 4079 - DNA, 27 bp, Artificial Sequences
  Synthetic
agaggaggtaagggcgtcgcgagtttt

SEQ ID NO: 4080 - DNA, 27 bp, Artificial Sequences
  Synthetic
aagaggaggtaagggcgtcgcgagttt

SEQ ID NO: 4081 - DNA, 27 bp, Artificial Sequences
  Synthetic
gtaagaggaggtaagggcgtcgcgagt

SEQ ID NO: 4082 - DNA, 27 bp, Artificial Sequences
  Synthetic
taagaggaggtaagggcgtcgcgagtt

SEQ ID NO: 4083 - DNA, 27 bp, Artificial Sequences
  Synthetic
aggaggtaagggcgtcgcgagtttttc

SEQ ID NO: 4084 - DNA, 27 bp, Artificial Sequences
  Synthetic
agttaggtgggttcggcgcggagattc

SEQ ID NO: 4085 - DNA, 27 bp, Artificial Sequences
  Synthetic
cggagaggttcgcggaggtagttaggt

SEQ ID NO: 4086 - DNA, 26 bp, Artificial Sequences
  Synthetic
agttaggtgggttcggcgcggagatt

SEQ ID NO: 4087 - DNA, 27 bp, Artificial Sequences
  Synthetic
gttaggtgggttcggcgcggagattcg

SEQ ID NO: 4088 - DNA, 26 bp, Artificial Sequences
  Synthetic
gagttaggtgggttcggcgcggagat

SEQ ID NO: 4089 - DNA, 27 bp, Artificial Sequences
  Synthetic
tcgtcggatttggttgttttcgcgggt

SEQ ID NO: 4090 - DNA, 28 bp, Artificial Sequences
  Synthetic
ttcgtcggatttggttgttttcgcgggt

SEQ ID NO: 4091 - DNA, 27 bp, Artificial Sequences
  Synthetic
ttcgtcggatttggttgttttcgcggg

SEQ ID NO: 4092 - DNA, 28 bp, Artificial Sequences
  Synthetic
tttcgtcggatttggttgttttcgcggg

SEQ ID NO: 4093 - DNA, 26 bp, Artificial Sequences
  Synthetic
cgtcggatttggttgttttcgcgggt

SEQ ID NO: 4094 - DNA, 27 bp, Artificial Sequences
  Synthetic
tgcgataggagttaggtgggttcggcg

SEQ ID NO: 4095 - DNA, 27 bp, Artificial Sequences
  Synthetic
agttcgaggttaaaggaggcggtgcgt

SEQ ID NO: 4096 - DNA, 27 bp, Artificial Sequences
  Synthetic
agttaggtgggttcggcgcggagattc

SEQ ID NO: 4097 - DNA, 27 bp, Artificial Sequences
  Synthetic
gagttaggtgggttcggcgcggagatt

SEQ ID NO: 4098 - DNA, 27 bp, Artificial Sequences
  Synthetic
gataggagttaggtgggttcggcgcgg

SEQ ID NO: 4099 - DNA, 30 bp, Artificial Sequences
  Synthetic
tggagattttggagtaggggagatggtggt

SEQ ID NO: 4100 - DNA, 29 bp, Artificial Sequences
  Synthetic
ggagattttggagtaggggagatggtggt

SEQ ID NO: 4101 - DNA, 29 bp, Artificial Sequences
  Synthetic
tggagattttggagtaggggagatggtgg

SEQ ID NO: 4102 - DNA, 28 bp, Artificial Sequences
  Synthetic
ggagattttggagtaggggagatggtgg

SEQ ID NO: 4103 - DNA, 30 bp, Artificial Sequences
  Synthetic
ggagattttggagtaggggagatggtggtt

SEQ ID NO: 4104 - DNA, 29 bp, Artificial Sequences
  Synthetic
cgtgttgggatttgggttaggattagggt

SEQ ID NO: 4105 - DNA, 30 bp, Artificial Sequences
  Synthetic
tcgtgttgggatttgggttaggattagggt

SEQ ID NO: 4106 - DNA, 29 bp, Artificial Sequences
  Synthetic
tcgtgttgggatttgggttaggattaggg

SEQ ID NO: 4107 - DNA, 30 bp, Artificial Sequences
  Synthetic
cgtgttgggatttgggttaggattagggtt

SEQ ID NO: 4108 - DNA, 30 bp, Artificial Sequences
  Synthetic
ttcgtgttgggatttgggttaggattaggg

SEQ ID NO: 4109 - DNA, 27 bp, Artificial Sequences
  Synthetic
tcgtcgtggttttgtggtttttagcga

SEQ ID NO: 4110 - DNA, 28 bp, Artificial Sequences
  Synthetic
cgtcgtggttttgtggtttttagcgagt

SEQ ID NO: 4111 - DNA, 29 bp, Artificial Sequences
  Synthetic
tcgtcgtggttttgtggtttttagcgagt

SEQ ID NO: 4112 - DNA, 28 bp, Artificial Sequences
  Synthetic
tcgtcgtggttttgtggtttttagcgag

SEQ ID NO: 4113 - DNA, 28 bp, Artificial Sequences
  Synthetic
ttcgtcgtggttttgtggtttttagcga

SEQ ID NO: 4114 - DNA, 29 bp, Artificial Sequences
  Synthetic
cgtgttgggatttgggttaggattagggt

SEQ ID NO: 4115 - DNA, 30 bp, Artificial Sequences; identical to SEQ ID NO: 4105
  Synthetic

SEQ ID NO: 4116 - DNA, 29 bp, Artificial Sequences
  Synthetic
tcgtgttgggatttgggttaggattaggg

SEQ ID NO: 4117 - DNA, 30 bp, Artificial Sequences; identical to SEQ ID NO: 4107
  Synthetic

SEQ ID NO: 4118 - DNA, 30 bp, Artificial Sequences; identical to SEQ ID NO: 4108
  Synthetic

SEQ ID NO: 4119 - DNA, 27 bp, Artificial Sequences
  Synthetic
tcgtcgtggttttgtggtttttagcga

SEQ ID NO: 4120 - DNA, 28 bp, Artificial Sequences
  Synthetic
cgtcgtggttttgtggtttttagcgagt

SEQ ID NO: 4121 - DNA, 29 bp, Artificial Sequences
  Synthetic
tcgtcgtggttttgtggtttttagcgagt

SEQ ID NO: 4122 - DNA, 28 bp, Artificial Sequences
  Synthetic
tcgtcgtggttttgtggtttttagcgag

SEQ ID NO: 4123 - DNA, 28 bp, Artificial Sequences
  Synthetic
ttcgtcgtggttttgtggtttttagcga

SEQ ID NO: 4124 - DNA, 27 bp, Artificial Sequences
  Synthetic
tcgggtaaggattcgagtttggcggcg

SEQ ID NO: 4125 - DNA, 26 bp, Artificial Sequences
  Synthetic
cgggtaaggattcgagtttggcggcg

SEQ ID NO: 4126 - DNA, 26 bp, Artificial Sequences
  Synthetic
tcgggtaaggattcgagtttggcggc

SEQ ID NO: 4127 - DNA, 27 bp, Artificial Sequences
  Synthetic
agttgggttttaaggggttgtgggtcg

SEQ ID NO: 4128 - DNA, 27 bp, Artificial Sequences
  Synthetic
gttgggttttaaggggttgtgggtcga

SEQ ID NO: 4129 - DNA, 27 bp, Artificial Sequences
  Synthetic
tgggagtcgtcgttaagttcgggtttt

SEQ ID NO: 4130 - DNA, 27 bp, Artificial Sequences
  Synthetic
ttgggagtcgtcgttaagttcgggttt

SEQ ID NO: 4131 - DNA, 27 bp, Artificial Sequences
  Synthetic
tttgggagtcgtcgttaagttcgggtt

SEQ ID NO: 4132 - DNA, 27 bp, Artificial Sequences
  Synthetic
atttgggagtcgtcgttaagttcgggt

SEQ ID NO: 4133 - DNA, 29 bp, Artificial Sequences
  Synthetic
ggatttgggagtcgtcgttaagttcgggt

SEQ ID NO: 4134 - DNA, 27 bp, Artificial Sequences
  Synthetic
tttcgcgtcgttgggttggatagggac

SEQ ID NO: 4135 - DNA, 27 bp, Artificial Sequences
  Synthetic
gtttcgcgtcgttgggttggataggga

SEQ ID NO: 4136 - DNA, 27 bp, Artificial Sequences
  Synthetic
tttattggggagatacggagcgcgtcg

SEQ ID NO: 4137 - DNA, 28 bp, Artificial Sequences
  Synthetic
gtttcgcgtcgttgggttggatagggac

SEQ ID NO: 4138 - DNA, 26 bp, Artificial Sequences
  Synthetic
cgttgggttggatagggacgagcggg

SEQ ID NO: 4139 - DNA, 27 bp, Artificial Sequences
  Synthetic
atttcgggaagcggacggtggaaggat

SEQ ID NO: 4140 - DNA, 27 bp, Artificial Sequences
  Synthetic
cgggggtagcggagatggttttgggta

SEQ ID NO: 4141 - DNA, 27 bp, Artificial Sequences
  Synthetic
tatttcgggaagcggacggtggaagga

SEQ ID NO: 4142 - DNA, 27 bp, Artificial Sequences
  Synthetic
cggagatggttttgggtacgtgcggga

SEQ ID NO: 4143 - DNA, 27 bp, Artificial Sequences
  Synthetic
tttcgggaagcggacggtggaaggatg

SEQ ID NO: 4144 - DNA, 27 bp, Artificial Sequences
  Synthetic
tcgttgcgtagggggtagtcggttttt

SEQ ID NO: 4145 - DNA, 27 bp, Artificial Sequences
  Synthetic
ttcgttgcgtagggggtagtcggtttt

SEQ ID NO: 4146 - DNA, 27 bp, Artificial Sequences
  Synthetic
tttcgttgcgtagggggtagtcggttt

SEQ ID NO: 4147 - DNA, 27 bp, Artificial Sequences
  Synthetic
atttcgttgcgtagggggtagtcggtt

SEQ ID NO: 4148 - DNA, 27 bp, Artificial Sequences
  Synthetic
cgttgcgtagggggtagtcggtttttg

SEQ ID NO: 4149 - DNA, 27 bp, Artificial Sequences
  Synthetic
cgtagcggggtggggttggtaataggg

SEQ ID NO: 4150 - DNA, 27 bp, Artificial Sequences
  Synthetic
ggggtggggttggtaatagggtgggtg

SEQ ID NO: 4151 - DNA, 27 bp, Artificial Sequences
  Synthetic
atggatggtttcgattgggggtggggt

SEQ ID NO: 4152 - DNA, 27 bp, Artificial Sequences
  Synthetic
cgggaagtggtaaagggggaaggggtt

SEQ ID NO: 4153 - DNA, 27 bp, Artificial Sequences
  Synthetic
gggtggggttggtaatagggtgggtgt

SEQ ID NO: 4154 - DNA, 27 bp, Artificial Sequences
  Synthetic
aggatgagggtggtggtggtttttggg

SEQ ID NO: 4155 - DNA, 27 bp, Artificial Sequences
  Synthetic
ggatgagggtggtggtggtttttggga

SEQ ID NO: 4156 - DNA, 28 bp, Artificial Sequences
  Synthetic
aggatgagggtggtggtggtttttggga

SEQ ID NO: 4157 - DNA, 27 bp, Artificial Sequences
  Synthetic
tgagggtggtggtggtttttgggagaa

SEQ ID NO: 4158 - DNA, 28 bp, Artificial Sequences
  Synthetic
ggatgagggtggtggtggtttttgggag

SEQ ID NO: 4159 - DNA, 27 bp, Artificial Sequences
  Synthetic
gttttgaaaggtagggttcgcggcggt

SEQ ID NO: 4160 - DNA, 27 bp, Artificial Sequences
  Synthetic
agttttgaaaggtagggttcgcggcgg

SEQ ID NO: 4161 - DNA, 28 bp, Artificial Sequences
  Synthetic
agttttgaaaggtagggttcgcggcggt

SEQ ID NO: 4162 - DNA, 26 bp, Artificial Sequences
  Synthetic
ttttgaaaggtagggttcgcggcggt

SEQ ID NO: 4163 - DNA, 28 bp, Artificial Sequences
  Synthetic
tagttttgaaaggtagggttcgcggcgg

SEQ ID NO: 4164 - DNA, 29 bp, Artificial Sequences
  Synthetic
cgtttaggaggtgtcgttcgagttttggt

SEQ ID NO: 4165 - DNA, 28 bp, Artificial Sequences
  Synthetic
cgtttaggaggtgtcgttcgagttttgg

SEQ ID NO: 4166 - DNA, 28 bp, Artificial Sequences
  Synthetic
aggaggtgtcgttcgagttttggttagt

SEQ ID NO: 4167 - DNA, 29 bp, Artificial Sequences
  Synthetic
tcgtttaggaggtgtcgttcgagttttgg

SEQ ID NO: 4168 - DNA, 30 bp, Artificial Sequences
  Synthetic
tcgtttaggaggtgtcgttcgagttttggt

SEQ ID NO: 4169 - DNA, 31 bp, Artificial Sequences
  Synthetic
aggtgggataatgattttgatggaggatggg

SEQ ID NO: 4170 - DNA, 31 bp, Artificial Sequences
  Synthetic
ggtgggataatgattttgatggaggatggga

SEQ ID NO: 4171 - DNA, 32 bp, Artificial Sequences
  Synthetic
aggtgggataatgattttgatggaggatggga

SEQ ID NO: 4172 - DNA, 32 bp, Artificial Sequences
  Synthetic
aaggtgggataatgattttgatggaggatggg

SEQ ID NO: 4173 - DNA, 32 bp, Artificial Sequences
  Synthetic
ggtgggataatgattttgatggaggatgggaa

SEQ ID NO: 4174 - DNA, 27 bp, Artificial Sequences
  Synthetic
ggtggacgtgtgtagaggttgaaggag

SEQ ID NO: 4175 - DNA, 28 bp, Artificial Sequences
  Synthetic
ggtggacgtgtgtagaggttgaaggaga

SEQ ID NO: 4176 - DNA, 29 bp, Artificial Sequences
  Synthetic
ggtggacgtgtgtagaggttgaaggagag

SEQ ID NO: 4177 - DNA, 30 bp, Artificial Sequences
  Synthetic
ggtggacgtgtgtagaggttgaaggagagt

SEQ ID NO: 4178 - DNA, 28 bp, Artificial Sequences
  Synthetic
tggacgtgtgtagaggttgaaggagagt

SEQ ID NO: 4179 - DNA, 27 bp, Artificial Sequences
  Synthetic
cgggggtttcgaggtgttttgaggagg

SEQ ID NO: 4180 - DNA, 27 bp, Artificial Sequences
  Synthetic
gggggtttcgaggtgttttgaggaggg

SEQ ID NO: 4181 - DNA, 28 bp, Artificial Sequences
  Synthetic
acgggggtttcgaggtgttttgaggagg

SEQ ID NO: 4182 - DNA, 28 bp, Artificial Sequences
  Synthetic
gggggtttcgaggtgttttgaggaggga

SEQ ID NO: 4183 - DNA, 27 bp, Artificial Sequences
  Synthetic
acgggggtttcgaggtgttttgaggag

SEQ ID NO: 4184 - DNA, 27 bp, Artificial Sequences
  Synthetic
aagacgggcgttttttgtgcgagaggt

SEQ ID NO: 4185 - DNA, 27 bp, Artificial Sequences
  Synthetic
agacgggcgttttttgtgcgagaggta

SEQ ID NO: 4186 - DNA, 27 bp, Artificial Sequences
  Synthetic
gacgggcgttttttgtgcgagaggtac

SEQ ID NO: 4187 - DNA, 28 bp, Artificial Sequences
  Synthetic
agacgggcgttttttgtgcgagaggtac

SEQ ID NO: 4188 - DNA, 26 bp, Artificial Sequences
  Synthetic
agacgggcgttttttgtgcgagaggt

SEQ ID NO: 4189 - DNA, 27 bp, Artificial Sequences
  Synthetic
gtttttcggtttgcgtttcgtcggggc

SEQ ID NO: 4190 - DNA, 27 bp, Artificial Sequences
  Synthetic
gcgttcgtttttgttggggttggagcg

SEQ ID NO: 4191 - DNA, 27 bp, Artificial Sequences
  Synthetic
gcgagggtaggatttgggcggttaggg

SEQ ID NO: 4192 - DNA, 27 bp, Artificial Sequences
  Synthetic
ggcgagggtaggatttgggcggttagg

SEQ ID NO: 4193 - DNA, 27 bp, Artificial Sequences
  Synthetic
gggcgagggtaggatttgggcggttag

SEQ ID NO: 4194 - DNA, 27 bp, Artificial Sequences
  Synthetic
tcggagggcgtagtagaggttggggtt

SEQ ID NO: 4195 - DNA, 27 bp, Artificial Sequences
  Synthetic
cggagggcgtagtagaggttggggttt

SEQ ID NO: 4196 - DNA, 27 bp, Artificial Sequences
  Synthetic
agtcggagggcgtagtagaggttgggg

SEQ ID NO: 4197 - DNA, 27 bp, Artificial Sequences
  Synthetic
gtcggagggcgtagtagaggttggggt

SEQ ID NO: 4198 - DNA, 27 bp, Artificial Sequences
  Synthetic
aagtcggagggcgtagtagaggttggg

SEQ ID NO: 4199 - DNA, 27 bp, Artificial Sequences
  Synthetic
gtttttcggtttgcgtttcgtcggggc

SEQ ID NO: 4200 - DNA, 27 bp, Artificial Sequences
  Synthetic
gttagggaaagggtagtcgcggggagg

SEQ ID NO: 4201 - DNA, 27 bp, Artificial Sequences
  Synthetic
ggttagggaaagggtagtcgcggggag

SEQ ID NO: 4202 - DNA, 27 bp, Artificial Sequences
  Synthetic
ggaaagggtagtcgcggggaggtagtg

SEQ ID NO: 4203 - DNA, 27 bp, Artificial Sequences
  Synthetic
ttagggaaagggtagtcgcggggaggt

SEQ ID NO: 4204 - DNA, 27 bp, Artificial Sequences
  Synthetic
tcgttttggggtgtaagtttggggtgt

SEQ ID NO: 4205 - DNA, 27 bp, Artificial Sequences
  Synthetic
agagggtttgggatcgtttcgtttcgt

SEQ ID NO: 4206 - DNA, 27 bp, Artificial Sequences
  Synthetic
gagggtttgggatcgtttcgtttcgtt

SEQ ID NO: 4207 - DNA, 27 bp, Artificial Sequences
  Synthetic
ttcggtcgttagaggttggggaagttt

SEQ ID NO: 4208 - DNA, 27 bp, Artificial Sequences
  Synthetic
tttcggtcgttagaggttggggaagtt

SEQ ID NO: 4209 - DNA, 27 bp, Artificial Sequences
  Synthetic
ttttaatttttggcggtcggggggcgg

SEQ ID NO: 4210 - DNA, 27 bp, Artificial Sequences
  Synthetic
tttttaatttttggcggtcggggggcg

SEQ ID NO: 4211 - DNA, 26 bp, Artificial Sequences
  Synthetic
tttaatttttggcggtcggggggcgg

SEQ ID NO: 4212 - DNA, 28 bp, Artificial Sequences
  Synthetic
tttttaatttttggcggtcggggggcgg

SEQ ID NO: 4213 - DNA, 27 bp, Artificial Sequences
  Synthetic
tttaatttttggcggtcggggggcggg

SEQ ID NO: 4214 - DNA, 27 bp, Artificial Sequences
  Synthetic
tcgttttggggtgtaagtttggggtgt

SEQ ID NO: 4215 - DNA, 27 bp, Artificial Sequences
  Synthetic
agagggtttgggatcgtttcgtttcgt

SEQ ID NO: 4216 - DNA, 28 bp, Artificial Sequences
  Synthetic
cgatcgttttggggtgtaagtttggggt

SEQ ID NO: 4217 - DNA, 27 bp, Artificial Sequences
  Synthetic
cgatcgttttggggtgtaagtttgggg

SEQ ID NO: 4218 - DNA, 29 bp, Artificial Sequences
  Synthetic
tcgatcgttttggggtgtaagtttggggt

SEQ ID NO: 4219 - DNA, 27 bp, Artificial Sequences
  Synthetic
ttttaatttttggcggtcggggggcgg

SEQ ID NO: 4220 - DNA, 27 bp, Artificial Sequences
  Synthetic
tcggcgtttaaggggtagtggggagtt

SEQ ID NO: 4221 - DNA, 27 bp, Artificial Sequences
  Synthetic
atcggcgtttaaggggtagtggggagt

SEQ ID NO: 4222 - DNA, 27 bp, Artificial Sequences
  Synthetic
tttttaatttttggcggtcggggggcg

SEQ ID NO: 4223 - DNA, 26 bp, Artificial Sequences
  Synthetic
tttaatttttggcggtcggggggcgg

SEQ ID NO: 4224 - DNA, 27 bp, Artificial Sequences
  Synthetic
tcgttttggggtgtaagtttggggtgt

SEQ ID NO: 4225 - DNA, 28 bp, Artificial Sequences
  Synthetic
cgatcgttttggggtgtaagtttggggt

SEQ ID NO: 4226 - DNA, 27 bp, Artificial Sequences
  Synthetic
cgatcgttttggggtgtaagtttgggg

SEQ ID NO: 4227 - DNA, 29 bp, Artificial Sequences
  Synthetic
tcgatcgttttggggtgtaagtttggggt

SEQ ID NO: 4228 - DNA, 28 bp, Artificial Sequences
  Synthetic
tcgatcgttttggggtgtaagtttgggg

SEQ ID NO: 4229 - DNA, 27 bp, Artificial Sequences
  Synthetic
cgtggagttgttgttagaggtgcggga

SEQ ID NO: 4230 - DNA, 27 bp, Artificial Sequences
  Synthetic
tcgtggagttgttgttagaggtgcggg

SEQ ID NO: 4231 - DNA, 28 bp, Artificial Sequences
  Synthetic
tcgtggagttgttgttagaggtgcggga

SEQ ID NO: 4232 - DNA, 27 bp, Artificial Sequences
  Synthetic
gtcggtgtttgtaggcggttgttgagt

SEQ ID NO: 4233 - DNA, 28 bp, Artificial Sequences
  Synthetic
cgtggagttgttgttagaggtgcgggat

SEQ ID NO: 4234 - DNA, 27 bp, Artificial Sequences
  Synthetic
cgggggttcggtcgtttagttgggttg

SEQ ID NO: 4235 - DNA, 27 bp, Artificial Sequences
  Synthetic
gggggttcggtcgtttagttgggttgg

SEQ ID NO: 4236 - DNA, 27 bp, Artificial Sequences
  Synthetic
ggggttcggtcgtttagttgggttggt

SEQ ID NO: 4237 - DNA, 28 bp, Artificial Sequences
  Synthetic
gggggttcggtcgtttagttgggttggt

SEQ ID NO: 4238 - DNA, 28 bp, Artificial Sequences
  Synthetic
ggggttcggtcgtttagttgggttggtt

SEQ ID NO: 4239 - DNA, 27 bp, Artificial Sequences
  Synthetic
cgtggagttgttgttagaggtgcggga

SEQ ID NO: 4240 - DNA, 27 bp, Artificial Sequences
  Synthetic
tcgtggagttgttgttagaggtgcggg

SEQ ID NO: 4241 - DNA, 28 bp, Artificial Sequences
  Synthetic
tcgtggagttgttgttagaggtgcggga

SEQ ID NO: 4242 - DNA, 28 bp, Artificial Sequences
  Synthetic
tgggcggtcggattttcgtttgagttgt

SEQ ID NO: 4243 - DNA, 27 bp, Artificial Sequences
  Synthetic
gggcggtcggattttcgtttgagttgt

SEQ ID NO: 4244 - DNA, 30 bp, Artificial Sequences
  Synthetic
agggttggaagagtgtaaataggattgcgt

SEQ ID NO: 4245 - DNA, 30 bp, Artificial Sequences
  Synthetic
aggattgcgtgaggtttcgtgtttatgttt

SEQ ID NO: 4246 - DNA, 31 bp, Artificial Sequences
  Synthetic
agggttggaagagtgtaaataggattgcgtg

SEQ ID NO: 4247 - DNA, 31 bp, Artificial Sequences
  Synthetic
gggttggaagagtgtaaataggattgcgtga

SEQ ID NO: 4248 - DNA, 31 bp, Artificial Sequences
  Synthetic
agtgtaaataggattgcgtgaggtttcgtgt

SEQ ID NO: 4249 - DNA, 27 bp, Artificial Sequences
  Synthetic
ggaggaggtcggatcgggggttttagg

SEQ ID NO: 4250 - DNA, 27 bp, Artificial Sequences
  Synthetic
gattggaggaggtcggatcgggggttt

SEQ ID NO: 4251 - DNA, 27 bp, Artificial Sequences
  Synthetic
tcggatagggttggtcggggttgttgt

SEQ ID NO: 4252 - DNA, 27 bp, Artificial Sequences
  Synthetic
attggaggaggtcggatcgggggtttt

SEQ ID NO: 4253 - DNA, 27 bp, Artificial Sequences
  Synthetic
cggatagggttggtcggggttgttgtg

SEQ ID NO: 4254 - DNA, 27 bp, Artificial Sequences
  Synthetic
cgagggttacggaagagcgttcgagtt

SEQ ID NO: 4255 - DNA, 28 bp, Artificial Sequences
  Synthetic
cgagggttacggaagagcgttcgagttt

SEQ ID NO: 4256 - DNA, 26 bp, Artificial Sequences
  Synthetic
cgagggttacggaagagcgttcgagt

SEQ ID NO: 4257 - DNA, 27 bp, Artificial Sequences
  Synthetic
gagggttacggaagagcgttcgagttt

SEQ ID NO: 4258 - DNA, 29 bp, Artificial Sequences
  Synthetic
cgagggttacggaagagcgttcgagtttt

SEQ ID NO: 4259 - DNA, 27 bp, Artificial Sequences
  Synthetic
gtcgtcgagggagatggtggtttagtt

SEQ ID NO: 4260 - DNA, 28 bp, Artificial Sequences
  Synthetic
gtcgtcgagggagatggtggtttagttt

SEQ ID NO: 4261 - DNA, 26 bp, Artificial Sequences
  Synthetic
gtcgtcgagggagatggtggtttagt

SEQ ID NO: 4262 - DNA, 28 bp, Artificial Sequences
  Synthetic
tcgtcgagggagatggtggtttagtttt

SEQ ID NO: 4263 - DNA, 29 bp, Artificial Sequences
  Synthetic
gtcgtcgagggagatggtggtttagtttt

SEQ ID NO: 4264 - DNA, 27 bp, Artificial Sequences
  Synthetic
tggtggaggtttaggtgggagagggaa

SEQ ID NO: 4265 - DNA, 27 bp, Artificial Sequences
  Synthetic
ttggtggaggtttaggtgggagaggga

SEQ ID NO: 4266 - DNA, 28 bp, Artificial Sequences
  Synthetic
ggtggaggtttaggtgggagagggaagg

SEQ ID NO: 4267 - DNA, 27 bp, Artificial Sequences
  Synthetic
tggaggtttaggtgggagagggaaggt

SEQ ID NO: 4268 - DNA, 28 bp, Artificial Sequences
  Synthetic
gtggaggtttaggtgggagagggaaggt

SEQ ID NO: 4269 - DNA, 27 bp, Artificial Sequences
  Synthetic
ttagttcggtgagcgtttcggggggtt

SEQ ID NO: 4270 - DNA, 27 bp, Artificial Sequences
  Synthetic
tttagttcggtgagcgtttcggggggt

SEQ ID NO: 4271 - DNA, 27 bp, Artificial Sequences
  Synthetic
gtgagcgtttcggggggttcgtgtttt

SEQ ID NO: 4272 - DNA, 27 bp, Artificial Sequences
  Synthetic
tagttcggtgagcgtttcggggggttc

SEQ ID NO: 4273 - DNA, 27 bp, Artificial Sequences
  Synthetic
tgagcgtttcggggggttcgtgttttc

SEQ ID NO: 4274 - DNA, 29 bp, Artificial Sequences
  Synthetic
tggtttcggggttggttagttgtttgggt

SEQ ID NO: 4275 - DNA, 28 bp, Artificial Sequences
  Synthetic
ggtttcggggttggttagttgtttgggt

SEQ ID NO: 4276 - DNA, 28 bp, Artificial Sequences
  Synthetic
tggtttcggggttggttagttgtttggg

SEQ ID NO: 4277 - DNA, 27 bp, Artificial Sequences
  Synthetic
tgtcggagttgtatttggtttcggggt

SEQ ID NO: 4278 - DNA, 27 bp, Artificial Sequences
  Synthetic
ggtttcggggttggttagttgtttggg

SEQ ID NO: 4279 - DNA, 27 bp, Artificial Sequences
  Synthetic
ttggcgaagaggttaggggggacgttt

SEQ ID NO: 4280 - DNA, 27 bp, Artificial Sequences
  Synthetic
attggcgaagaggttaggggggacgtt

SEQ ID NO: 4281 - DNA, 27 bp, Artificial Sequences
  Synthetic
tggcgaagaggttaggggggacgttta

SEQ ID NO: 4282 - DNA, 27 bp, Artificial Sequences
  Synthetic
aggggggacgtttaggagttggttgga

SEQ ID NO: 4283 - DNA, 27 bp, Artificial Sequences
  Synthetic
tattggcgaagaggttaggggggacgt

SEQ ID NO: 4284 - DNA, 28 bp, Artificial Sequences
  Synthetic
gcgttacgtggttttgtagtgttggtga

SEQ ID NO: 4285 - DNA, 29 bp, Artificial Sequences
  Synthetic
gcgttacgtggttttgtagtgttggtgaa

SEQ ID NO: 4286 - DNA, 30 bp, Artificial Sequences
  Synthetic
tgcggggaagacgtattggtatttgattgt

SEQ ID NO: 4287 - DNA, 30 bp, Artificial Sequences
  Synthetic
gcgttacgtggttttgtagtgttggtgaat

SEQ ID NO: 4288 - DNA, 30 bp, Artificial Sequences
  Synthetic
agttttgcggggaagacgtattggtatttg

SEQ ID NO: 4289 - DNA, 24 bp, Artificial Sequences
  Synthetic
gtggcgcggtattgtgtggattgc

SEQ ID NO: 4290 - DNA, 29 bp, Artificial Sequences
  Synthetic
agagtagtagttcggtcggtagttgaggt

SEQ ID NO: 4291 - DNA, 30 bp, Artificial Sequences
  Synthetic
gagagtagtagttcggtcggtagttgaggt

SEQ ID NO: 4292 - DNA, 30 bp, Artificial Sequences
  Synthetic
tgagagtagtagttcggtcggtagttgagg

SEQ ID NO: 4293 - DNA, 31 bp, Artificial Sequences
  Synthetic
tgagagtagtagttcggtcggtagttgaggt

SEQ ID NO: 4294 - DNA, 29 bp, Artificial Sequences
  Synthetic
tggagcgtcgtttttgttttttagtgggt

SEQ ID NO: 4295 - DNA, 30 bp, Artificial Sequences
  Synthetic
ttggagcgtcgtttttgttttttagtgggt

SEQ ID NO: 4296 - DNA, 31 bp, Artificial Sequences
  Synthetic
tttggagcgtcgtttttgttttttagtgggt

SEQ ID NO: 4297 - DNA, 31 bp, Artificial Sequences
  Synthetic
ttggagcgtcgtttttgttttttagtgggta

SEQ ID NO: 4298 - DNA, 32 bp, Artificial Sequences
  Synthetic
ttttggagcgtcgtttttgttttttagtgggt

SEQ ID NO: 4299 - DNA, 27 bp, Artificial Sequences
  Synthetic
gcggtattgtgtggattgcgtgtgttt

SEQ ID NO: 4300 - DNA, 28 bp, Artificial Sequences
  Synthetic
gcggtattgtgtggattgcgtgtgtttt

SEQ ID NO: 4301 - DNA, 26 bp, Artificial Sequences
  Synthetic
gcggtattgtgtggattgcgtgtgtt

SEQ ID NO: 4302 - DNA, 28 bp, Artificial Sequences
  Synthetic
agggggatttcggagtgttaggaagagt

SEQ ID NO: 4303 - DNA, 28 bp, Artificial Sequences
  Synthetic
tgtggggtttaaaaagggggatttcgga

SEQ ID NO: 4304 - DNA, 27 bp, Artificial Sequences
  Synthetic
tgggtcgtggaatttgtgtgtgggagg

SEQ ID NO: 4305 - DNA, 28 bp, Artificial Sequences
  Synthetic
tgggtcgtggaatttgtgtgtgggagga

SEQ ID NO: 4306 - DNA, 27 bp, Artificial Sequences
  Synthetic
gggtcgtggaatttgtgtgtgggagga

SEQ ID NO: 4307 - DNA, 28 bp, Artificial Sequences
  Synthetic
ttgggtcgtggaatttgtgtgtgggagg

SEQ ID NO: 4308 - DNA, 29 bp, Artificial Sequences
  Synthetic
ttgggtcgtggaatttgtgtgtgggagga

SEQ ID NO: 4309 - DNA, 27 bp, Artificial Sequences
  Synthetic
aggtggttttgcggggaggtagtaggg

SEQ ID NO: 4310 - DNA, 27 bp, Artificial Sequences
  Synthetic
ggtggttttgcggggaggtagtaggga

SEQ ID NO: 4311 - DNA, 28 bp, Artificial Sequences
  Synthetic
ggtggttttgcggggaggtagtagggag

SEQ ID NO: 4312 - DNA, 28 bp, Artificial Sequences
  Synthetic
gaggtggttttgcggggaggtagtaggg

SEQ ID NO: 4313 - DNA, 27 bp, Artificial Sequences
  Synthetic
tggttttgcggggaggtagtagggagt

SEQ ID NO: 4314 - DNA, 31 bp, Artificial Sequences
  Synthetic
gaggttttgaaagttgtttggggtttagggt

SEQ ID NO: 4315 - DNA, 31 bp, Artificial Sequences
  Synthetic
tgaggttttgaaagttgtttggggtttaggg

SEQ ID NO: 4316 - DNA, 32 bp, Artificial Sequences
  Synthetic
tgaggttttgaaagttgtttggggtttagggt

SEQ ID NO: 4317 - DNA, 32 bp, Artificial Sequences
  Synthetic
ggttttgaaagttgtttggggtttagggttgt

SEQ ID NO: 4318 - DNA, 32 bp, Artificial Sequences
  Synthetic
aggttttgaaagttgtttggggtttagggttg

SEQ ID NO: 4319 - DNA, 27 bp, Artificial Sequences
  Synthetic
gggaataggaagtttcgggtggggagg

SEQ ID NO: 4320 - DNA, 28 bp, Artificial Sequences
  Synthetic
agggaataggaagtttcgggtggggagg

SEQ ID NO: 4321 - DNA, 28 bp, Artificial Sequences
  Synthetic
gggaataggaagtttcgggtggggagga

SEQ ID NO: 4322 - DNA, 29 bp, Artificial Sequences
  Synthetic
agggaataggaagtttcgggtggggagga

SEQ ID NO: 4323 - DNA, 29 bp, Artificial Sequences
  Synthetic
cggatggtggatgaggggtagttttgggt

SEQ ID NO: 4324 - DNA, 27 bp, Artificial Sequences
  Synthetic
tgtgaggtttgacgcgtttggttgttt

SEQ ID NO: 4325 - DNA, 28 bp, Artificial Sequences
  Synthetic
tgtttttgaggtttgtggtcgtcggtgt

SEQ ID NO: 4326 - DNA, 27 bp, Artificial Sequences
  Synthetic
atgtgaggtttgacgcgtttggttgtt

SEQ ID NO: 4327 - DNA, 27 bp, Artificial Sequences
  Synthetic
gtttttgaggtttgtggtcgtcggtgt

SEQ ID NO: 4328 - DNA, 27 bp, Artificial Sequences
  Synthetic
tgtttttgaggtttgtggtcgtcggtg

SEQ ID NO: 4329 - DNA, 27 bp, Artificial Sequences
  Synthetic
agtttcgggtggggaggaagtatcggc

SEQ ID NO: 4330 - DNA, 27 bp, Artificial Sequences
  Synthetic
gggtggggaggaagtatcggcggttat

SEQ ID NO: 4331 - DNA, 27 bp, Artificial Sequences
  Synthetic
gtttcgggtggggaggaagtatcggcg

SEQ ID NO: 4332 - DNA, 26 bp, Artificial Sequences
  Synthetic
tttcgggtggggaggaagtatcggcg

SEQ ID NO: 4333 - DNA, 28 bp, Artificial Sequences
  Synthetic
aagtttcgggtggggaggaagtatcggc

SEQ ID NO: 4334 - DNA, 27 bp, Artificial Sequences
  Synthetic
cggggtcggtgttttggggtttaggga

SEQ ID NO: 4335 - DNA, 27 bp, Artificial Sequences
  Synthetic
gggtcggtgttttggggtttagggagg

SEQ ID NO: 4336 - DNA, 27 bp, Artificial Sequences
  Synthetic
ggggtcggtgttttggggtttagggag

SEQ ID NO: 4337 - DNA, 28 bp, Artificial Sequences
  Synthetic
gggtcggtgttttggggtttagggaggt

SEQ ID NO: 4338 - DNA, 28 bp, Artificial Sequences
  Synthetic
ggggtcggtgttttggggtttagggagg

SEQ ID NO: 4339 - DNA, 27 bp, Artificial Sequences
  Synthetic
attggggttcgggaggcggtattggtt

SEQ ID NO: 4340 - DNA, 27 bp, Artificial Sequences
  Synthetic
aggattggggttcgggaggcggtattg

SEQ ID NO: 4341 - DNA, 27 bp, Artificial Sequences
  Synthetic
ttggggttcgggaggcggtattggttt

SEQ ID NO: 4342 - DNA, 27 bp, Artificial Sequences
  Synthetic
ttttaggattggggttcgggaggcggt

SEQ ID NO: 4343 - DNA, 27 bp, Artificial Sequences
  Synthetic
gattggggttcgggaggcggtattggt

SEQ ID NO: 4344 - DNA, 27 bp, Artificial Sequences
  Synthetic
tttttgtcggtcgtatgtgatgggggg

SEQ ID NO: 4345 - DNA, 28 bp, Artificial Sequences
  Synthetic
ttttttgtcggtcgtatgtgatgggggg

SEQ ID NO: 4346 - DNA, 27 bp, Artificial Sequences
  Synthetic
acggttagtttcgaggaaggttgtggt

SEQ ID NO: 4347 - DNA, 26 bp, Artificial Sequences
  Synthetic
ttttgtcggtcgtatgtgatgggggg

SEQ ID NO: 4348 - DNA, 28 bp, Artificial Sequences
  Synthetic
acggttagtttcgaggaaggttgtggtt

SEQ ID NO: 4349 - DNA, 28 bp, Artificial Sequences
  Synthetic
gggcgggtaggtttatgttgttttgggt

SEQ ID NO: 4350 - DNA, 27 bp, Artificial Sequences
  Synthetic
gggcgggtaggtttatgttgttttggg

SEQ ID NO: 4351 - DNA, 29 bp, Artificial Sequences
  Synthetic
agggcgggtaggtttatgttgttttgggt

SEQ ID NO: 4352 - DNA, 28 bp, Artificial Sequences
  Synthetic
agggcgggtaggtttatgttgttttggg

SEQ ID NO: 4353 - DNA, 30 bp, Artificial Sequences
  Synthetic
cgtgttttgttgtgtttagggcgggtaggt

SEQ ID NO: 4354 - DNA, 27 bp, Artificial Sequences
  Synthetic
tggggtgtagcgtggattggagatagt

SEQ ID NO: 4355 - DNA, 27 bp, Artificial Sequences
  Synthetic
tttttggggtgtagcgtggattggaga

SEQ ID NO: 4356 - DNA, 27 bp, Artificial Sequences
  Synthetic
ttttggggtgtagcgtggattggagat

SEQ ID NO: 4357 - DNA, 28 bp, Artificial Sequences
  Synthetic
tggggtgtagcgtggattggagatagtt

SEQ ID NO: 4358 - DNA, 28 bp, Artificial Sequences
  Synthetic
ttggggtgtagcgtggattggagatagt

SEQ ID NO: 4359 - DNA, 27 bp, Artificial Sequences
  Synthetic
ggttgggaggttcggttggaggtgtga

SEQ ID NO: 4360 - DNA, 27 bp, Artificial Sequences
  Synthetic
ggcgtggcgagggttgtgttgtttagg

SEQ ID NO: 4361 - DNA, 27 bp, Artificial Sequences
  Synthetic
aggcgtggcgagggttgtgttgtttag

SEQ ID NO: 4362 - DNA, 27 bp, Artificial Sequences
  Synthetic
gcgtggcgagggttgtgttgtttagga

SEQ ID NO: 4363 - DNA, 27 bp, Artificial Sequences
  Synthetic
tagggttgggaggttcggttggaggtg

SEQ ID NO: 4364 - DNA, 27 bp, Artificial Sequences
  Synthetic
gcgtggtaggatgggattttgcgcgtt

SEQ ID NO: 4365 - DNA, 27 bp, Artificial Sequences
  Synthetic
cgtggcgtggtaggatgggattttgcg

SEQ ID NO: 4366 - DNA, 27 bp, Artificial Sequences
  Synthetic
tcgtggcgtggtaggatgggattttgc

SEQ ID NO: 4367 - DNA, 26 bp, Artificial Sequences
  Synthetic
gcgtggtaggatgggattttgcgcgt

SEQ ID NO: 4368 - DNA, 27 bp, Artificial Sequences
  Synthetic
ttttgaggttgaagcgaggcgtagggg

SEQ ID NO: 4369 - DNA, 30 bp, Artificial Sequences
  Synthetic
gagtttcgggttttagttttaggagtcgcg

SEQ ID NO: 4370 - DNA, 35 bp, Artificial Sequences
  Synthetic
ggggattcgaggtttttgaggattttaaattgtcg

SEQ ID NO: 4371 - DNA, 36 bp, Artificial Sequences
  Synthetic
ggggattcgaggtttttgaggattttaaattgtcgt

SEQ ID NO: 4372 - DNA, 36 bp, Artificial Sequences
  Synthetic
aggggattcgaggtttttgaggattttaaattgtcg

SEQ ID NO: 4373 - DNA, 35 bp, Artificial Sequences
  Synthetic
gggattcgaggtttttgaggattttaaattgtcgt

SEQ ID NO: 4374 - DNA, 27 bp, Artificial Sequences
  Synthetic
gcggtttttggaattggggttcggggt

SEQ ID NO: 4375 - DNA, 27 bp, Artificial Sequences
  Synthetic
acgcggtttttggaattggggttcggg

SEQ ID NO: 4376 - DNA, 27 bp, Artificial Sequences
  Synthetic
cgcggtttttggaattggggttcgggg

SEQ ID NO: 4377 - DNA, 27 bp, Artificial Sequences
  Synthetic
gacgcggtttttggaattggggttcgg

SEQ ID NO: 4378 - DNA, 28 bp, Artificial Sequences
  Synthetic
agacgcggtttttggaattggggttcgg

SEQ ID NO: 4379 - DNA, 27 bp, Artificial Sequences
  Synthetic
ggaggggtgaagtcgaggggtggtttt

SEQ ID NO: 4380 - DNA, 27 bp, Artificial Sequences
  Synthetic
gagagagtagggtttcgggcgttcggg

SEQ ID NO: 4381 - DNA, 27 bp, Artificial Sequences
  Synthetic
tgagagagtagggtttcgggcgttcgg

SEQ ID NO: 4382 - DNA, 27 bp, Artificial Sequences
  Synthetic
aggaggggtgaagtcgaggggtggttt

SEQ ID NO: 4383 - DNA, 27 bp, Artificial Sequences
  Synthetic
gaggaggggtgaagtcgaggggtggtt

SEQ ID NO: 4384 - DNA, 27 bp, Artificial Sequences
  Synthetic
ggtttgggggcggtcggtttgttgttt

SEQ ID NO: 4385 - DNA, 27 bp, Artificial Sequences
  Synthetic
gtttgggggcggtcggtttgttgtttt

SEQ ID NO: 4386 - DNA, 26 bp, Artificial Sequences
  Synthetic
ggtttgggggcggtcggtttgttgtt

SEQ ID NO: 4387 - DNA, 28 bp, Artificial Sequences
  Synthetic
ggtttgggggcggtcggtttgttgtttt

SEQ ID NO: 4388 - DNA, 27 bp, Artificial Sequences
  Synthetic
ttgggggcggtcggtttgttgtttttt

SEQ ID NO: 4389 - DNA, 27 bp, Artificial Sequences
  Synthetic
gggggagggggtagtaggtcgatcgtt

SEQ ID NO: 4390 - DNA, 27 bp, Artificial Sequences
  Synthetic
gtgggggagggggtagtaggtcgatcg

SEQ ID NO: 4391 - DNA, 27 bp, Artificial Sequences
  Synthetic
cgtgggggagggggtagtaggtcgatc

SEQ ID NO: 4392 - DNA, 26 bp, Artificial Sequences
  Synthetic
tgggggagggggtagtaggtcgatcg

SEQ ID NO: 4393 - DNA, 26 bp, Artificial Sequences
  Synthetic
gggggagggggtagtaggtcgatcgt

SEQ ID NO: 4394 - DNA, 27 bp, Artificial Sequences
  Synthetic
atggacgggggtttcgatcggtttggg

SEQ ID NO: 4395 - DNA, 27 bp, Artificial Sequences
  Synthetic
aatggacgggggtttcgatcggtttgg

SEQ ID NO: 4396 - DNA, 28 bp, Artificial Sequences
  Synthetic
aaatggacgggggtttcgatcggtttgg

SEQ ID NO: 4397 - DNA, 28 bp, Artificial Sequences
  Synthetic
aatggacgggggtttcgatcggtttggg

SEQ ID NO: 4398 - DNA, 26 bp, Artificial Sequences
  Synthetic
tggacgggggtttcgatcggtttggg

SEQ ID NO: 4399 - DNA, 27 bp, Artificial Sequences
  Synthetic
gggggagggggtagtaggtcgatcgtt

SEQ ID NO: 4400 - DNA, 27 bp, Artificial Sequences
  Synthetic
gaggttcggatgtgttgacgttgcggt

SEQ ID NO: 4401 - DNA, 27 bp, Artificial Sequences
  Synthetic
gtgggggagggggtagtaggtcgatcg

SEQ ID NO: 4402 - DNA, 27 bp, Artificial Sequences
  Synthetic
cgtgggggagggggtagtaggtcgatc

SEQ ID NO: 4403 - DNA, 27 bp, Artificial Sequences
  Synthetic
aggttcggatgtgttgacgttgcggtt

SEQ ID NO: 4404 - DNA, 27 bp, Artificial Sequences
  Synthetic
gaggttcggatgtgttgacgttgcggt

SEQ ID NO: 4405 - DNA, 27 bp, Artificial Sequences
  Synthetic
aggttcggatgtgttgacgttgcggtt

SEQ ID NO: 4406 - DNA, 28 bp, Artificial Sequences
  Synthetic
gaggttcggatgtgttgacgttgcggtt

SEQ ID NO: 4407 - DNA, 26 bp, Artificial Sequences
  Synthetic
aggttcggatgtgttgacgttgcggt

SEQ ID NO: 4408 - DNA, 27 bp, Artificial Sequences
  Synthetic
ggttcggatgtgttgacgttgcggtta

SEQ ID NO: 4409 - DNA, 28 bp, Artificial Sequences
  Synthetic
gggttttagcggggtaggtagggttcgg

SEQ ID NO: 4410 - DNA, 27 bp, Artificial Sequences
  Synthetic
ggttttagcggggtaggtagggttcgg

SEQ ID NO: 4411 - DNA, 27 bp, Artificial Sequences
  Synthetic
gggttttagcggggtaggtagggttcg

SEQ ID NO: 4412 - DNA, 28 bp, Artificial Sequences
  Synthetic
agggttttagcggggtaggtagggttcg

SEQ ID NO: 4413 - DNA, 28 bp, Artificial Sequences
  Synthetic
ggttttagcggggtaggtagggttcgga

SEQ ID NO: 4414 - DNA, 27 bp, Artificial Sequences
  Synthetic
gtcgttcggtcgggtagtgggaagtcg

SEQ ID NO: 4415 - DNA, 27 bp, Artificial Sequences
  Synthetic
gttcggtcgggtagtgggaagtcggtg

SEQ ID NO: 4416 - DNA, 27 bp, Artificial Sequences
  Synthetic
ttcggtcgggtagtgggaagtcggtgt

SEQ ID NO: 4417 - DNA, 27 bp, Artificial Sequences
  Synthetic
tcggtcgggtagtgggaagtcggtgtc

SEQ ID NO: 4418 - DNA, 26 bp, Artificial Sequences
  Synthetic
cggtcgggtagtgggaagtcggtgtc

SEQ ID NO: 4419 - DNA, 27 bp, Artificial Sequences
  Synthetic
tttgggaggggcgggtcgggattagag

SEQ ID NO: 4420 - DNA, 27 bp, Artificial Sequences
  Synthetic
gtttgggaggggcgggtcgggattaga

SEQ ID NO: 4421 - DNA, 26 bp, Artificial Sequences
  Synthetic
gtttgggaggggcgggtcgggattag

SEQ ID NO: 4422 - DNA, 26 bp, Artificial Sequences
  Synthetic
tttgggaggggcgggtcgggattaga

SEQ ID NO: 4423 - DNA, 25 bp, Artificial Sequences
  Synthetic
tttgggaggggcgggtcgggattag

SEQ ID NO: 4424 - DNA, 27 bp, Artificial Sequences
  Synthetic
gcgcgcgtgtatttgttttggttatcg

SEQ ID NO: 4425 - DNA, 28 bp, Artificial Sequences
  Synthetic
gcgcgcgtgtatttgttttggttatcga

SEQ ID NO: 4426 - DNA, 30 bp, Artificial Sequences
  Synthetic
gcgcgcgtgtatttgttttggttatcgagg

SEQ ID NO: 4427 - DNA, 31 bp, Artificial Sequences
  Synthetic
gcgcgcgtgtatttgttttggttatcgaggt

SEQ ID NO: 4428 - DNA, 29 bp, Artificial Sequences
  Synthetic
gcgcgcgtgtatttgttttggttatcgag

SEQ ID NO: 4429 - DNA, 27 bp, Artificial Sequences
  Synthetic
cgacgggggagtttcggtgattagggt

SEQ ID NO: 4430 - DNA, 27 bp, Artificial Sequences
  Synthetic
tacgttcgggaaaggggggtagggaac

SEQ ID NO: 4431 - DNA, 26 bp, Artificial Sequences
  Synthetic
acgttcgggaaaggggggtagggaac

SEQ ID NO: 4432 - DNA, 27 bp, Artificial Sequences
  Synthetic
ttacgttcgggaaaggggggtagggaa

SEQ ID NO: 4433 - DNA, 27 bp, Artificial Sequences
  Synthetic
attacgttcgggaaaggggggtaggga

SEQ ID NO: 4434 - DNA, 27 bp, Artificial Sequences
  Synthetic
gcgtagtttcggtcgtgttttcggggt

SEQ ID NO: 4435 - DNA, 28 bp, Artificial Sequences
  Synthetic
gcgtagtttcggtcgtgttttcggggtt

SEQ ID NO: 4436 - DNA, 27 bp, Artificial Sequences
  Synthetic
gtttcggtcgtgttttcggggtttcgt

SEQ ID NO: 4437 - DNA, 28 bp, Artificial Sequences
  Synthetic
agtttcggtcgtgttttcggggtttcgt

SEQ ID NO: 4438 - DNA, 27 bp, Artificial Sequences
  Synthetic
agtttcggtcgtgttttcggggtttcg

SEQ ID NO: 4439 - DNA, 27 bp, Artificial Sequences
  Synthetic
cgacgggggagtttcggtgattagggt

SEQ ID NO: 4440 - DNA, 27 bp, Artificial Sequences
  Synthetic
tacgttcgggaaaggggggtagggaac

SEQ ID NO: 4441 - DNA, 26 bp, Artificial Sequences
  Synthetic
acgttcgggaaaggggggtagggaac

SEQ ID NO: 4442 - DNA, 27 bp, Artificial Sequences
  Synthetic
ttacgttcgggaaaggggggtagggaa

SEQ ID NO: 4443 - DNA, 27 bp, Artificial Sequences
  Synthetic
attacgttcgggaaaggggggtaggga

SEQ ID NO: 4444 - DNA, 27 bp, Artificial Sequences
  Synthetic
gcgtagtttcggtcgtgttttcggggt

SEQ ID NO: 4445 - DNA, 28 bp, Artificial Sequences
  Synthetic
gcgtagtttcggtcgtgttttcggggtt

SEQ ID NO: 4446 - DNA, 27 bp, Artificial Sequences
  Synthetic
gtttcggtcgtgttttcggggtttcgt

SEQ ID NO: 4447 - DNA, 28 bp, Artificial Sequences
  Synthetic
agtttcggtcgtgttttcggggtttcgt

SEQ ID NO: 4448 - DNA, 27 bp, Artificial Sequences
  Synthetic
agtttcggtcgtgttttcggggtttcg

SEQ ID NO: 4449 - DNA, 27 bp, Artificial Sequences
  Synthetic
cgacgggggagtttcggtgattagggt

SEQ ID NO: 4450 - DNA, 26 bp, Artificial Sequences
  Synthetic
acgttcgggaaaggggggtagggaac

SEQ ID NO: 4451 - DNA, 26 bp, Artificial Sequences
  Synthetic
gttcgggaaaggggggtagggaacga

SEQ ID NO: 4452 - DNA, 28 bp, Artificial Sequences
  Synthetic
cgacgggggagtttcggtgattagggta

SEQ ID NO: 4453 - DNA, 26 bp, Artificial Sequences
  Synthetic
cgacgggggagtttcggtgattaggg

SEQ ID NO: 4454 - DNA, 27 bp, Artificial Sequences
  Synthetic
gcgtagtttcggtcgtgttttcggggt

SEQ ID NO: 4455 - DNA, 28 bp, Artificial Sequences
  Synthetic
gcgtagtttcggtcgtgttttcggggtt

SEQ ID NO: 4456 - DNA, 27 bp, Artificial Sequences
  Synthetic
agtttcggtcgtgttttcggggtttcg

SEQ ID NO: 4457 - DNA, 27 bp, Artificial Sequences
  Synthetic
cgtagtttcggtcgtgttttcggggtt

SEQ ID NO: 4458 - DNA, 29 bp, Artificial Sequences
  Synthetic
gcgtagtttcggtcgtgttttcggggttt

SEQ ID NO: 4459 - DNA, 26 bp, Artificial Sequences
  Synthetic
gtaggcggagtttcgggggtacggtc

SEQ ID NO: 4460 - DNA, 27 bp, Artificial Sequences
  Synthetic
gtaggcggagtttcgggggtacggtcg

SEQ ID NO: 4461 - DNA, 27 bp, Artificial Sequences
  Synthetic
cgtaggcggagtttcgggggtacggtc

SEQ ID NO: 4462 - DNA, 25 bp, Artificial Sequences
  Synthetic
gtaggcggagtttcgggggtacggt

SEQ ID NO: 4463 - DNA, 25 bp, Artificial Sequences
  Synthetic
taggcggagtttcgggggtacggtc

SEQ ID NO: 4464 - DNA, 28 bp, Artificial Sequences
  Synthetic
cgacggcgttttaggttagagttgtggg

SEQ ID NO: 4465 - DNA, 29 bp, Artificial Sequences
  Synthetic
cgacggcgttttaggttagagttgtgggt

SEQ ID NO: 4466 - DNA, 27 bp, Artificial Sequences
  Synthetic
acggcgttttaggttagagttgtgggt

SEQ ID NO: 4467 - DNA, 27 bp, Artificial Sequences
  Synthetic
cgacggcgttttaggttagagttgtgg

SEQ ID NO: 4468 - DNA, 28 bp, Artificial Sequences
  Synthetic
gacggcgttttaggttagagttgtgggt

SEQ ID NO: 4469 - DNA, 28 bp, Artificial Sequences
  Synthetic
tgggtcgggcgttgtagattaagtacgt

SEQ ID NO: 4470 - DNA, 27 bp, Artificial Sequences
  Synthetic
gggtcgggcgttgtagattaagtacgt

SEQ ID NO: 4471 - DNA, 27 bp, Artificial Sequences
  Synthetic
tgggtcgggcgttgtagattaagtacg

SEQ ID NO: 4472 - DNA, 29 bp, Artificial Sequences
  Synthetic
gtgggtcgggcgttgtagattaagtacgt

SEQ ID NO: 4473 - DNA, 28 bp, Artificial Sequences
  Synthetic
gtgggtcgggcgttgtagattaagtacg

SEQ ID NO: 4474 - DNA, 27 bp, Artificial Sequences
  Synthetic
cgttgtagtgtttgggaggttgcgcgt

SEQ ID NO: 4475 - DNA, 27 bp, Artificial Sequences
  Synthetic
tcgttgtagtgtttgggaggttgcgcg

SEQ ID NO: 4476 - DNA, 27 bp, Artificial Sequences
  Synthetic
cgggtgcgttgtttttggttttcgggt

SEQ ID NO: 4477 - DNA, 28 bp, Artificial Sequences
  Synthetic
tcgggtgcgttgtttttggttttcgggt

SEQ ID NO: 4478 - DNA, 27 bp, Artificial Sequences
  Synthetic
tcgggtgcgttgtttttggttttcggg

SEQ ID NO: 4479 - DNA, 27 bp, Artificial Sequences
  Synthetic
ttcgggattaagaggaggtcgttgcgc

SEQ ID NO: 4480 - DNA, 28 bp, Artificial Sequences
  Synthetic
attcgggattaagaggaggtcgttgcgc

SEQ ID NO: 4481 - DNA, 26 bp, Artificial Sequences
  Synthetic
tcgggattaagaggaggtcgttgcgc

SEQ ID NO: 4482 - DNA, 27 bp, Artificial Sequences
  Synthetic
attcgggattaagaggaggtcgttgcg

SEQ ID NO: 4483 - DNA, 28 bp, Artificial Sequences
  Synthetic
tgggtcgggcgttgtagattaagtacgt

SEQ ID NO: 4484 - DNA, 27 bp, Artificial Sequences
  Synthetic
cgttgtagtgtttgggaggttgcgcgt

SEQ ID NO: 4485 - DNA, 27 bp, Artificial Sequences
  Synthetic
tcgttgtagtgtttgggaggttgcgcg

SEQ ID NO: 4486 - DNA, 28 bp, Artificial Sequences
  Synthetic
ttcgttgtagtgtttgggaggttgcgcg

SEQ ID NO: 4487 - DNA, 27 bp, Artificial Sequences
  Synthetic
agggaggacggataagggttgaagggt

SEQ ID NO: 4488 - DNA, 27 bp, Artificial Sequences
  Synthetic
tgtagtgtttgggaggttgcgcgtagt

SEQ ID NO: 4489 - DNA, 32 bp, Artificial Sequences
  Synthetic
cgggagttggagttgggttttatttttaggtg

SEQ ID NO: 4490 - DNA, 33 bp, Artificial Sequences
  Synthetic
cgggagttggagttgggttttatttttaggtgt

SEQ ID NO: 4491 - DNA, 34 bp, Artificial Sequences
  Synthetic
cgggagttggagttgggttttatttttaggtgtt

SEQ ID NO: 4492 - DNA, 35 bp, Artificial Sequences
  Synthetic
cgggagttggagttgggttttatttttaggtgttt

SEQ ID NO: 4493 - DNA, 34 bp, Artificial Sequences
  Synthetic
gggagttggagttgggttttatttttaggtgttt

SEQ ID NO: 4494 - DNA, 27 bp, Artificial Sequences
  Synthetic
cggtttcggatcggcgttgatagttgt

SEQ ID NO: 4495 - DNA, 27 bp, Artificial Sequences
  Synthetic
tcgtttgggttgaggtagcgagtgatt

SEQ ID NO: 4496 - DNA, 27 bp, Artificial Sequences
  Synthetic
ttcgtttgggttgaggtagcgagtgat

SEQ ID NO: 4497 - DNA, 27 bp, Artificial Sequences
  Synthetic
attcgtttgggttgaggtagcgagtga

SEQ ID NO: 4498 - DNA, 28 bp, Artificial Sequences
  Synthetic
cggtttcggatcggcgttgatagttgta

SEQ ID NO: 4499 - DNA, 27 bp, Artificial Sequences
  Synthetic
tttttggcggggcgtttcgtgtaggtt

SEQ ID NO: 4500 - DNA, 27 bp, Artificial Sequences
  Synthetic
ttttttggcggggcgtttcgtgtaggt

SEQ ID NO: 4501 - DNA, 27 bp, Artificial Sequences
  Synthetic
gcggtagttgcgtaggtggagagcgtt

SEQ ID NO: 4502 - DNA, 27 bp, Artificial Sequences
  Synthetic
cggagtcggagcgcgggaattattcgt

SEQ ID NO: 4503 - DNA, 27 bp, Artificial Sequences
  Synthetic
ttttggcggggcgtttcgtgtaggtta

SEQ ID NO: 4504 - DNA, 27 bp, Artificial Sequences
  Synthetic
aaggtggtcgtaaaggtgttggtgcgc

SEQ ID NO: 4505 - DNA, 27 bp, Artificial Sequences
  Synthetic
ggaggaggagtcggcggcgtttaagtt

SEQ ID NO: 4506 - DNA, 27 bp, Artificial Sequences
  Synthetic
gaggaggaggagtcggcggcgtttaag

SEQ ID NO: 4507 - DNA, 26 bp, Artificial Sequences
  Synthetic
gaggaggaggagtcggcggcgtttaa

SEQ ID NO: 4508 - DNA, 28 bp, Artificial Sequences
  Synthetic
gaaggtggtcgtaaaggtgttggtgcgc

SEQ ID NO: 4509 - DNA, 27 bp, Artificial Sequences
  Synthetic
cgttttttgcgtggtttgggcgtcgtc

SEQ ID NO: 4510 - DNA, 27 bp, Artificial Sequences
  Synthetic
cgggttcggataggtagcgttggtggt

SEQ ID NO: 4511 - DNA, 28 bp, Artificial Sequences
  Synthetic
cgggttcggataggtagcgttggtggtt

SEQ ID NO: 4512 - DNA, 26 bp, Artificial Sequences
  Synthetic
cgttttttgcgtggtttgggcgtcgt

SEQ ID NO: 4513 - DNA, 27 bp, Artificial Sequences
  Synthetic
gcgttttttgcgtggtttgggcgtcgt

SEQ ID NO: 4514 - DNA, 27 bp, Artificial Sequences
  Synthetic
ggaggaggagtcggcggcgtttaagtt

SEQ ID NO: 4515 - DNA, 27 bp, Artificial Sequences
  Synthetic
gaggaggaggagtcggcggcgtttaag

SEQ ID NO: 4516 - DNA, 26 bp, Artificial Sequences
  Synthetic
gaggaggaggagtcggcggcgtttaa

SEQ ID NO: 4517 - DNA, 26 bp, Artificial Sequences
  Synthetic
aggaggaggagtcggcggcgtttaag

SEQ ID NO: 4518 - DNA, 27 bp, Artificial Sequences
  Synthetic
aggaggaggagtcggcggcgtttaagt

SEQ ID NO: 4519 - DNA, 27 bp, Artificial Sequences
  Synthetic
atcgcgtcggtttggtcgtttcgttcg

SEQ ID NO: 4520 - DNA, 27 bp, Artificial Sequences
  Synthetic
ggtatcgcgtcggtttggtcgtttcgt

SEQ ID NO: 4521 - DNA, 27 bp, Artificial Sequences
  Synthetic
aggtatcgcgtcggtttggtcgtttcg

SEQ ID NO: 4522 - DNA, 27 bp, Artificial Sequences
  Synthetic
cggttcgcgacggtagtttttggaggt

SEQ ID NO: 4523 - DNA, 26 bp, Artificial Sequences
  Synthetic
tcgcgtcggtttggtcgtttcgttcg

SEQ ID NO: 4524 - DNA, 27 bp, Artificial Sequences
  Synthetic
acgttggtttggttgtcgtcgcggttt

SEQ ID NO: 4525 - DNA, 27 bp, Artificial Sequences
  Synthetic
gggtttcgggggtttttggtcgtcgtc

SEQ ID NO: 4526 - DNA, 27 bp, Artificial Sequences
  Synthetic
agaggggggtttcgggggtttttggtc

SEQ ID NO: 4527 - DNA, 27 bp, Artificial Sequences
  Synthetic
tagaggggggtttcgggggtttttggt

SEQ ID NO: 4528 - DNA, 27 bp, Artificial Sequences
  Synthetic
tacgttggtttggttgtcgtcgcggtt

SEQ ID NO: 4529 - DNA, 26 bp, Artificial Sequences
  Synthetic
cgggttcgggttttgggagcgttagg

SEQ ID NO: 4530 - DNA, 27 bp, Artificial Sequences
  Synthetic
gtcgtttgagcgcggtttttattcggc

SEQ ID NO: 4531 - DNA, 25 bp, Artificial Sequences
  Synthetic
tggtttgttgcgtggtgggcgtgtg

SEQ ID NO: 4532 - DNA, 24 bp, Artificial Sequences
  Synthetic
tggtttgttgcgtggtgggcgtgt

SEQ ID NO: 4533 - DNA, 24 bp, Artificial Sequences
  Synthetic
ggtttgttgcgtggtgggcgtgtg

SEQ ID NO: 4534 - DNA, 27 bp, Artificial Sequences
  Synthetic
atttttgggtggagagggttgcgggga

SEQ ID NO: 4535 - DNA, 27 bp, Artificial Sequences
  Synthetic
gggtttcgggggtttttggtcgtcgtt

SEQ ID NO: 4536 - DNA, 27 bp, Artificial Sequences
  Synthetic
agaggggggtttcgggggtttttggtc

SEQ ID NO: 4537 - DNA, 27 bp, Artificial Sequences
  Synthetic
tagaggggggtttcgggggtttttggt

SEQ ID NO: 4538 - DNA, 27 bp, Artificial Sequences
  Synthetic
tttttgggtggagagggttgcggggag

SEQ ID NO: 4539 - DNA, 27 bp, Artificial Sequences
  Synthetic
gcggtttttattcggcggcggttaggg

SEQ ID NO: 4540 - DNA, 27 bp, Artificial Sequences
  Synthetic
ggcggcggttagggattttcgaggttt

SEQ ID NO: 4541 - DNA, 27 bp, Artificial Sequences
  Synthetic
cggtttttattcggcggcggttaggga

SEQ ID NO: 4542 - DNA, 27 bp, Artificial Sequences
  Synthetic
attcggcggcggttagggattttcgag

SEQ ID NO: 4543 - DNA, 27 bp, Artificial Sequences
  Synthetic
ttcggcggcggttagggattttcgagg

SEQ ID NO: 4544 - DNA, 27 bp, Artificial Sequences
  Synthetic
ggggaaggagggtttgggtggaaaggt

SEQ ID NO: 4545 - DNA, 27 bp, Artificial Sequences
  Synthetic
tggggaaggagggtttgggtggaaagg

SEQ ID NO: 4546 - DNA, 27 bp, Artificial Sequences
  Synthetic
atttttgggtggagagggttgcgggga

SEQ ID NO: 4547 - DNA, 27 bp, Artificial Sequences
  Synthetic
attgagtggggggtttcgagggttggg

SEQ ID NO: 4548 - DNA, 27 bp, Artificial Sequences
  Synthetic
gggtggagagggttgcggggagatttt

SEQ ID NO: 4549 - DNA, 28 bp, Artificial Sequences
  Synthetic
tgtttggggaggtggaagagtggtgtgt

SEQ ID NO: 4550 - DNA, 27 bp, Artificial Sequences
  Synthetic
gtttggggaggtggaagagtggtgtgt

SEQ ID NO: 4551 - DNA, 27 bp, Artificial Sequences
  Synthetic
tgtttggggaggtggaagagtggtgtg

SEQ ID NO: 4552 - DNA, 27 bp, Artificial Sequences
  Synthetic
tttggggaggtggaagagtggtgtgtt

SEQ ID NO: 4553 - DNA, 27 bp, Artificial Sequences
  Synthetic
ttgtttggggaggtggaagagtggtgt

SEQ ID NO: 4554 - DNA, 31 bp, Artificial Sequences
  Synthetic
tcggagaagatagaacgtggggatagtttgt

SEQ ID NO: 4555 - DNA, 31 bp, Artificial Sequences
  Synthetic
cggagaagatagaacgtggggatagtttgtt

SEQ ID NO: 4556 - DNA, 32 bp, Artificial Sequences
  Synthetic
tcggagaagatagaacgtggggatagtttgtt

SEQ ID NO: 4557 - DNA, 32 bp, Artificial Sequences
  Synthetic
cggagaagatagaacgtggggatagtttgttt

SEQ ID NO: 4558 - DNA, 33 bp, Artificial Sequences
  Synthetic
tcggagaagatagaacgtggggatagtttgttt

SEQ ID NO: 4559 - DNA, 27 bp, Artificial Sequences
  Synthetic
cgtttattggttgttggggaggcgcgt

SEQ ID NO: 4560 - DNA, 27 bp, Artificial Sequences
  Synthetic
gttggggaggcgcgtggtttcgtttta

SEQ ID NO: 4561 - DNA, 27 bp, Artificial Sequences
  Synthetic
aagtcgggcggggatgtcgttttaggt

SEQ ID NO: 4562 - DNA, 27 bp, Artificial Sequences
  Synthetic
tcgggcggggatgtcgttttaggtgtt

SEQ ID NO: 4563 - DNA, 27 bp, Artificial Sequences
  Synthetic
cggtgtcgtcgtttaagtagtcgcgcg

SEQ ID NO: 4564 - DNA, 27 bp, Artificial Sequences
  Synthetic
gacggttggaagggttgaagagggggt

SEQ ID NO: 4565 - DNA, 27 bp, Artificial Sequences
  Synthetic
tggacggttggaagggttgaagagggg

SEQ ID NO: 4566 - DNA, 27 bp, Artificial Sequences
  Synthetic
aggaagggagtatgttggggtggggga

SEQ ID NO: 4567 - DNA, 27 bp, Artificial Sequences
  Synthetic
aggtgaggaagttggcgaaggaacggt

SEQ ID NO: 4568 - DNA, 27 bp, Artificial Sequences
  Synthetic
acggttggaagggttgaagagggggtt

SEQ ID NO: 4569 - DNA, 27 bp, Artificial Sequences
  Synthetic
gagcgggttgggtcgagaaggtaagat

SEQ ID NO: 4570 - DNA, 27 bp, Artificial Sequences
  Synthetic
agcgggttgggtcgagaaggtaagatt

SEQ ID NO: 4571 - DNA, 27 bp, Artificial Sequences
  Synthetic
ttttggtatttgggagcgggttgggtc

SEQ ID NO: 4572 - DNA, 27 bp, Artificial Sequences
  Synthetic
attttggtatttgggagcgggttgggt

SEQ ID NO: 4573 - DNA, 28 bp, Artificial Sequences
  Synthetic
gagcgggttgggtcgagaaggtaagatt

SEQ ID NO: 4574 - DNA, 27 bp, Artificial Sequences
  Synthetic
ggggtgttcggggtaggcgttggttaa

SEQ ID NO: 4575 - DNA, 27 bp, Artificial Sequences
  Synthetic
ttgagtttcgttggaggtttcgcgggg

SEQ ID NO: 4576 - DNA, 27 bp, Artificial Sequences
  Synthetic
tttcgttggaggtttcgcgggggtgtt

SEQ ID NO: 4577 - DNA, 27 bp, Artificial Sequences
  Synthetic
tgagtttcgttggaggtttcgcggggg

SEQ ID NO: 4578 - DNA, 27 bp, Artificial Sequences
  Synthetic
gagtttcgttggaggtttcgcgggggt

SEQ ID NO: 4579 - DNA, 28 bp, Artificial Sequences
  Synthetic
gcgtttgtttcggatattttcgcggggt

SEQ ID NO: 4580 - DNA, 27 bp, Artificial Sequences
  Synthetic
gcgtttgtttcggatattttcgcgggg

SEQ ID NO: 4581 - DNA, 29 bp, Artificial Sequences
  Synthetic
ggtttttagcggggtttaaattggcggcg

SEQ ID NO: 4582 - DNA, 27 bp, Artificial Sequences
  Synthetic
tttttagcggggtttaaattggcggcg

SEQ ID NO: 4583 - DNA, 29 bp, Artificial Sequences
  Synthetic
gggtttttagcggggtttaaattggcggc

SEQ ID NO: 4584 - DNA, 27 bp, Artificial Sequences
  Synthetic
ttgagtttcgttggaggtttcgcgggg

SEQ ID NO: 4585 - DNA, 27 bp, Artificial Sequences
  Synthetic
ttcgttggaggtttcgcgggggtgttt

SEQ ID NO: 4586 - DNA, 27 bp, Artificial Sequences
  Synthetic
tttcgttggaggtttcgcgggggtgtt

SEQ ID NO: 4587 - DNA, 27 bp, Artificial Sequences
  Synthetic
tgagtttcgttggaggtttcgcggggg

SEQ ID NO: 4588 - DNA, 27 bp, Artificial Sequences
  Synthetic
gagtttcgttggaggtttcgcgggggt

SEQ ID NO: 4589 - DNA, 27 bp, Artificial Sequences
  Synthetic
gtgttgggaaacgtcggggttgcgaat

SEQ ID NO: 4590 - DNA, 27 bp, Artificial Sequences
  Synthetic
gtttagtagggggcgaggggtgttggg

SEQ ID NO: 4591 - DNA, 27 bp, Artificial Sequences
  Synthetic
ggtttagtagggggcgaggggtgttgg

SEQ ID NO: 4592 - DNA, 27 bp, Artificial Sequences
  Synthetic
acgtcggaatttggcgtcggtttggtt

SEQ ID NO: 4593 - DNA, 27 bp, Artificial Sequences
  Synthetic
agcggggtttaaattggcggcggttta

SEQ ID NO: 4594 - DNA, 27 bp, Artificial Sequences
  Synthetic
cgagttgtttagggatagtcgggcgcg

SEQ ID NO: 4595 - DNA, 27 bp, Artificial Sequences
  Synthetic
cgcgttggttaaggaggttttcgggga

SEQ ID NO: 4596 - DNA, 27 bp, Artificial Sequences
  Synthetic
tcgcgttggttaaggaggttttcgggg

SEQ ID NO: 4597 - DNA, 28 bp, Artificial Sequences
  Synthetic
tcgcgttggttaaggaggttttcgggga

SEQ ID NO: 4598 - DNA, 28 bp, Artificial Sequences
  Synthetic
cgagttgtttagggatagtcgggcgcgt

SEQ ID NO: 4599 - DNA, 27 bp, Artificial Sequences
  Synthetic
tgtagcgtgagttttgtagttcggggg

SEQ ID NO: 4600 - DNA, 28 bp, Artificial Sequences
  Synthetic
tgtagcgtgagttttgtagttcggggga

SEQ ID NO: 4601 - DNA, 27 bp, Artificial Sequences
  Synthetic
tagcgtgagttttgtagttcgggggac

SEQ ID NO: 4602 - DNA, 27 bp, Artificial Sequences
  Synthetic
gtagcgtgagttttgtagttcggggga

SEQ ID NO: 4603 - DNA, 28 bp, Artificial Sequences
  Synthetic
gtgtagcgtgagttttgtagttcggggg

SEQ ID NO: 4604 - DNA, 27 bp, Artificial Sequences
  Synthetic
gggcgttgttaggatggtaggagcggt

SEQ ID NO: 4605 - DNA, 27 bp, Artificial Sequences
  Synthetic
ttaggaggttgaggtcgggagggaggg

SEQ ID NO: 4606 - DNA, 27 bp, Artificial Sequences
  Synthetic
agggcgttgttaggatggtaggagcgg

SEQ ID NO: 4607 - DNA, 27 bp, Artificial Sequences
  Synthetic
gtcgggagggagggcgttgttaggatg

SEQ ID NO: 4608 - DNA, 27 bp, Artificial Sequences
  Synthetic
gggagggagggcgttgttaggatggta

SEQ ID NO: 4609 - DNA, 27 bp, Artificial Sequences
  Synthetic
tcgggaaggcgagatagggataggcga

SEQ ID NO: 4610 - DNA, 27 bp, Artificial Sequences
  Synthetic
gtcgggaaggcgagatagggataggcg

SEQ ID NO: 4611 - DNA, 27 bp, Artificial Sequences
  Synthetic
cgggaaggcgagatagggataggcgag

SEQ ID NO: 4612 - DNA, 27 bp, Artificial Sequences
  Synthetic
attagaggggatcgagtcgggaaggcg

SEQ ID NO: 4613 - DNA, 27 bp, Artificial Sequences
  Synthetic
gggggacgttgtagtgtgatgtggtgg

SEQ ID NO: 4614 - DNA, 27 bp, Artificial Sequences
  Synthetic
ttaggaggttgaggtcgggagggaggg

SEQ ID NO: 4615 - DNA, 27 bp, Artificial Sequences
  Synthetic
tggcgaattaggaggttgaggtcggga

SEQ ID NO: 4616 - DNA, 27 bp, Artificial Sequences
  Synthetic
ggcgggaatgttagagttggaaggcgt

SEQ ID NO: 4617 - DNA, 26 bp, Artificial Sequences
  Synthetic
taggaggttgaggtcgggagggaggg

SEQ ID NO: 4618 - DNA, 28 bp, Artificial Sequences
  Synthetic
attaggaggttgaggtcgggagggaggg

SEQ ID NO: 4619 - DNA, 27 bp, Artificial Sequences
  Synthetic
tcgggaaggcgagatagggataggcga

SEQ ID NO: 4620 - DNA, 27 bp, Artificial Sequences
  Synthetic
gtcgggaaggcgagatagggataggcg

SEQ ID NO: 4621 - DNA, 27 bp, Artificial Sequences
  Synthetic
agcgtgtatttcgggttgtcggggaga

SEQ ID NO: 4622 - DNA, 27 bp, Artificial Sequences
  Synthetic
cgggaaggcgagatagggataggcgag

SEQ ID NO: 4623 - DNA, 27 bp, Artificial Sequences
  Synthetic
gcgtgtatttcgggttgtcggggagag

SEQ ID NO: 4624 - DNA, 29 bp, Artificial Sequences
  Synthetic
tcgtttttatgggcgttcggttttttcgt

SEQ ID NO: 4625 - DNA, 29 bp, Artificial Sequences
  Synthetic
tcgttttttcgtttttatgggcgttcggt

SEQ ID NO: 4626 - DNA, 29 bp, Artificial Sequences
  Synthetic
cgtttttatgggcgttcggttttttcgtt

SEQ ID NO: 4627 - DNA, 29 bp, Artificial Sequences
  Synthetic
cgttttttcgtttttatgggcgttcggtt

SEQ ID NO: 4628 - DNA, 30 bp, Artificial Sequences
  Synthetic
tcgtttttatgggcgttcggttttttcgtt

SEQ ID NO: 4629 - DNA, 27 bp, Artificial Sequences
  Synthetic
tttagtttaggtaggggtcggggcgcg

SEQ ID NO: 4630 - DNA, 27 bp, Artificial Sequences
  Synthetic
tcggggaattacggttggatgggggtg

SEQ ID NO: 4631 - DNA, 27 bp, Artificial Sequences
  Synthetic
agcgtggtggaattcgggtgtttgtcg

SEQ ID NO: 4632 - DNA, 27 bp, Artificial Sequences
  Synthetic
gcgtggtggaattcgggtgtttgtcga

SEQ ID NO: 4633 - DNA, 27 bp, Artificial Sequences
  Synthetic
agcgtgtatttcgggttgtcggggaga

SEQ ID NO: 4634 - DNA, 27 bp, Artificial Sequences
  Synthetic
gcgtgtagttatcggggatttgcgcgg

SEQ ID NO: 4635 - DNA, 27 bp, Artificial Sequences
  Synthetic
gaggttcgggtggggggtagtcgtaag

SEQ ID NO: 4636 - DNA, 27 bp, Artificial Sequences
  Synthetic
gtttttgtaaggggtttcggggggcgc

SEQ ID NO: 4637 - DNA, 27 bp, Artificial Sequences
  Synthetic
agtttttgtaaggggtttcggggggcg

SEQ ID NO: 4638 - DNA, 27 bp, Artificial Sequences
  Synthetic
ggaggttcgggtggggggtagtcgtaa

SEQ ID NO: 4639 - DNA, 27 bp, Artificial Sequences
  Synthetic
gggtcgcgcggttggataggaggttta

SEQ ID NO: 4640 - DNA, 28 bp, Artificial Sequences
  Synthetic
gggtcgcgcggttggataggaggtttat

SEQ ID NO: 4641 - DNA, 27 bp, Artificial Sequences
  Synthetic
ggtcgcgcggttggataggaggtttat

SEQ ID NO: 4642 - DNA, 26 bp, Artificial Sequences
  Synthetic
gggtcgcgcggttggataggaggttt

SEQ ID NO: 4643 - DNA, 27 bp, Artificial Sequences
  Synthetic
ttggcgatgggttttggttgcgttagt

SEQ ID NO: 4644 - DNA, 27 bp, Artificial Sequences
  Synthetic
tgtgcgcgttgttggtgttgttgttgt

SEQ ID NO: 4645 - DNA, 28 bp, Artificial Sequences
  Synthetic
tgcgcgttgttggtgttgttgttgttgt

SEQ ID NO: 4646 - DNA, 28 bp, Artificial Sequences
  Synthetic
tgtgcgcgttgttggtgttgttgttgtt

SEQ ID NO: 4647 - DNA, 28 bp, Artificial Sequences
  Synthetic
ttgtgcgcgttgttggtgttgttgttgt

SEQ ID NO: 4648 - DNA, 27 bp, Artificial Sequences
  Synthetic
gcgcgttgttggtgttgttgttgttgt

SEQ ID NO: 4649 - DNA, 27 bp, Artificial Sequences
  Synthetic
cggtcgcgggtttttgaattgggtgga

SEQ ID NO: 4650 - DNA, 27 bp, Artificial Sequences
  Synthetic
ggaggagcggagattggaggagcgaag

SEQ ID NO: 4651 - DNA, 27 bp, Artificial Sequences
  Synthetic
gggtcgcgcggttggataggaggttta

SEQ ID NO: 4652 - DNA, 27 bp, Artificial Sequences
  Synthetic
gaggagcggagattggaggagcgaaga

SEQ ID NO: 4653 - DNA, 27 bp, Artificial Sequences
  Synthetic
tggaggagcggagattggaggagcgaa

SEQ ID NO: 4654 - DNA, 32 bp, Artificial Sequences
  Synthetic
tggggagagatgagtgtagataaaaggagtgt

SEQ ID NO: 4655 - DNA, 32 bp, Artificial Sequences
  Synthetic
tgagttttttgttagtggggagagatgagtgt

SEQ ID NO: 4656 - DNA, 32 bp, Artificial Sequences
  Synthetic
agtggggagagatgagtgtagataaaaggagt

SEQ ID NO: 4657 - DNA, 33 bp, Artificial Sequences
  Synthetic
gtggggagagatgagtgtagataaaaggagtgt

SEQ ID NO: 4658 - DNA, 33 bp, Artificial Sequences
  Synthetic
agtggggagagatgagtgtagataaaaggagtg

SEQ ID NO: 4659 - DNA, 27 bp, Artificial Sequences
  Synthetic
gtggaaagaagaggttgggggaggggg

SEQ ID NO: 4660 - DNA, 27 bp, Artificial Sequences
  Synthetic
gtggggagggtggttaggaggagttgc

SEQ ID NO: 4661 - DNA, 27 bp, Artificial Sequences
  Synthetic
tggtggggagggtggttaggaggagtt

SEQ ID NO: 4662 - DNA, 27 bp, Artificial Sequences
  Synthetic
ttggtggggagggtggttaggaggagt

SEQ ID NO: 4663 - DNA, 27 bp, Artificial Sequences
  Synthetic
gggagggtggttaggaggagttgcgtg

SEQ ID NO: 4664 - DNA, 28 bp, Artificial Sequences
  Synthetic
gagggttgcgtgttttagaaaagtcggt

SEQ ID NO: 4665 - DNA, 29 bp, Artificial Sequences
  Synthetic
agagggttgcgtgttttagaaaagtcggt

SEQ ID NO: 4666 - DNA, 30 bp, Artificial Sequences
  Synthetic
agagggttgcgtgttttagaaaagtcggta

SEQ ID NO: 4667 - DNA, 30 bp, Artificial Sequences
  Synthetic
tagagggttgcgtgttttagaaaagtcggt

SEQ ID NO: 4668 - DNA, 31 bp, Artificial Sequences
  Synthetic
ttagagggttgcgtgttttagaaaagtcggt

SEQ ID NO: 4669 - DNA, 31 bp, Artificial Sequences
  Synthetic
tcgagtaggaaatgttttgtggtttgggaga

SEQ ID NO: 4670 - DNA, 31 bp, Artificial Sequences
  Synthetic
cgagtaggaaatgttttgtggtttgggagag

SEQ ID NO: 4671 - DNA, 32 bp, Artificial Sequences
  Synthetic
cgagtaggaaatgttttgtggtttgggagaga

SEQ ID NO: 4672 - DNA, 32 bp, Artificial Sequences
  Synthetic
tcgagtaggaaatgttttgtggtttgggagag

SEQ ID NO: 4673 - DNA, 32 bp, Artificial Sequences
  Synthetic
ttcgagtaggaaatgttttgtggtttgggaga

SEQ ID NO: 4674 - DNA, 27 bp, Artificial Sequences
  Synthetic
agcgtgggggtggtttgtcgtaatgtg

SEQ ID NO: 4675 - DNA, 27 bp, Artificial Sequences
  Synthetic
gcgtgggggtggtttgtcgtaatgtga

SEQ ID NO: 4676 - DNA, 27 bp, Artificial Sequences
  Synthetic
aagcgtgggggtggtttgtcgtaatgt

SEQ ID NO: 4677 - DNA, 28 bp, Artificial Sequences
  Synthetic
agcgtgggggtggtttgtcgtaatgtga

SEQ ID NO: 4678 - DNA, 28 bp, Artificial Sequences
  Synthetic
gggagaggtaggggaggagagaagtcgg

SEQ ID NO: 4679 - DNA, 27 bp, Artificial Sequences
  Synthetic
ttgaggaggtcggggaggggtgatgat

SEQ ID NO: 4680 - DNA, 27 bp, Artificial Sequences
  Synthetic
aggaggaggtcgaggttgaggaggtcg

SEQ ID NO: 4681 - DNA, 27 bp, Artificial Sequences
  Synthetic
tgaggaggtcggggaggggtgatgatg

SEQ ID NO: 4682 - DNA, 27 bp, Artificial Sequences
  Synthetic
ggtcggggaggggtgatgatggtgtta

SEQ ID NO: 4683 - DNA, 27 bp, Artificial Sequences
  Synthetic
gttgaggaggtcggggaggggtgatga

SEQ ID NO: 4684 - DNA, 27 bp, Artificial Sequences
  Synthetic
aggtagtttttcggggagttgtgcggt

SEQ ID NO: 4685 - DNA, 27 bp, Artificial Sequences
  Synthetic
ggtagtttttcggggagttgtgcggtt

SEQ ID NO: 4686 - DNA, 28 bp, Artificial Sequences
  Synthetic
aggtagtttttcggggagttgtgcggtt

SEQ ID NO: 4687 - DNA, 28 bp, Artificial Sequences
  Synthetic
taggtagtttttcggggagttgtgcggt

SEQ ID NO: 4688 - DNA, 27 bp, Artificial Sequences
  Synthetic
taggtagtttttcggggagttgtgcgg

SEQ ID NO: 4689 - DNA, 27 bp, Artificial Sequences
  Synthetic
gcgtagttgggggaggagaggggtttc

SEQ ID NO: 4690 - DNA, 27 bp, Artificial Sequences
  Synthetic
tagttgggggaggagaggggtttcggt

SEQ ID NO: 4691 - DNA, 27 bp, Artificial Sequences
  Synthetic
cggttttcgttgcgtagttgggggagg

SEQ ID NO: 4692 - DNA, 27 bp, Artificial Sequences
  Synthetic
cgtagttgggggaggagaggggtttcg

SEQ ID NO: 4693 - DNA, 27 bp, Artificial Sequences
  Synthetic
ttcgttgcgtagttgggggaggagagg

SEQ ID NO: 4694 - DNA, 27 bp, Artificial Sequences
  Synthetic
gcgtagttgggggaggagaggggtttc

SEQ ID NO: 4695 - DNA, 27 bp, Artificial Sequences
  Synthetic
tagttgggggaggagaggggtttcggt

SEQ ID NO: 4696 - DNA, 27 bp, Artificial Sequences
  Synthetic
ttgcgtgttgggttggttgttgggagg

SEQ ID NO: 4697 - DNA, 27 bp, Artificial Sequences
  Synthetic
gttgggaggtgtagtgggtagtggcgg

SEQ ID NO: 4698 - DNA, 27 bp, Artificial Sequences
  Synthetic
cggttttcgttgcgtagttgggggagg

SEQ ID NO: 4699 - DNA, 27 bp, Artificial Sequences
  Synthetic
gcgtagttgggggaggagaggggtttc

SEQ ID NO: 4700 - DNA, 27 bp, Artificial Sequences
  Synthetic
tagttgggggaggagaggggtttcggt

SEQ ID NO: 4701 - DNA, 27 bp, Artificial Sequences
  Synthetic
ttgcgtgttgggttggttgttgggagg

SEQ ID NO: 4702 - DNA, 27 bp, Artificial Sequences
  Synthetic
gttgggaggtgtagtgggtagtggcgg

SEQ ID NO: 4703 - DNA, 27 bp, Artificial Sequences
  Synthetic
cggttttcgttgcgtagttgggggagg

SEQ ID NO: 4704 - DNA, 27 bp, Artificial Sequences
  Synthetic
taaggggaggggaagttggaggcggta

SEQ ID NO: 4705 - DNA, 27 bp, Artificial Sequences
  Synthetic
gttaaggggaggggaagttggaggcgg

SEQ ID NO: 4706 - DNA, 27 bp, Artificial Sequences
  Synthetic
tgttaaggggaggggaagttggaggcg

SEQ ID NO: 4707 - DNA, 27 bp, Artificial Sequences
  Synthetic
ttaaggggaggggaagttggaggcggt

SEQ ID NO: 4708 - DNA, 27 bp, Artificial Sequences
  Synthetic
aaggggaggggaagttggaggcggtag

SEQ ID NO: 4709 - DNA, 28 bp, Artificial Sequences
  Synthetic
tcgggttattgggatcgtaatttcgggt

SEQ ID NO: 4710 - DNA, 29 bp, Artificial Sequences
  Synthetic
cgggttattgggatcgtaatttcgggtgt

SEQ ID NO: 4711 - DNA, 30 bp, Artificial Sequences
  Synthetic
tcgggttattgggatcgtaatttcgggtgt

SEQ ID NO: 4712 - DNA, 29 bp, Artificial Sequences
  Synthetic
tcgggttattgggatcgtaatttcgggtg

SEQ ID NO: 4713 - DNA, 29 bp, Artificial Sequences
  Synthetic
ttcgggttattgggatcgtaatttcgggt

SEQ ID NO: 4714 - DNA, 27 bp, Artificial Sequences
  Synthetic
ggacgttcggggaggggtcgtattgaa

SEQ ID NO: 4715 - DNA, 27 bp, Artificial Sequences
  Synthetic
cggacgttcggggaggggtcgtattga

SEQ ID NO: 4716 - DNA, 28 bp, Artificial Sequences
  Synthetic
ggacgttcggggaggggtcgtattgaat

SEQ ID NO: 4717 - DNA, 28 bp, Artificial Sequences
  Synthetic
cgggagtagtttgagtgtgaaagcgcgg

SEQ ID NO: 4718 - DNA, 26 bp, Artificial Sequences
  Synthetic
ggacgttcggggaggggtcgtattga

SEQ ID NO: 4719 - DNA, 28 bp, Artificial Sequences
  Synthetic
tgttttcggtagcgggaagttttaagcg

SEQ ID NO: 4720 - DNA, 28 bp, Artificial Sequences
  Synthetic
tcgggttattgggatcgtaatttcgggt

SEQ ID NO: 4721 - DNA, 29 bp, Artificial Sequences
  Synthetic
cgggttattgggatcgtaatttcgggtgt

SEQ ID NO: 4722 - DNA, 30 bp, Artificial Sequences; identical to SEQ ID NO: 4711
  Synthetic

SEQ ID NO: 4723 - DNA, 29 bp, Artificial Sequences
  Synthetic
tcgggttattgggatcgtaatttcgggtg

SEQ ID NO: 4724 - DNA, 27 bp, Artificial Sequences
  Synthetic
atttggacgttacgaggagggagcgcg

SEQ ID NO: 4725 - DNA, 28 bp, Artificial Sequences
  Synthetic
tatttggacgttacgaggagggagcgcg

SEQ ID NO: 4726 - DNA, 28 bp, Artificial Sequences
  Synthetic
cgtattcggaggggtttgacgtcgaggt

SEQ ID NO: 4727 - DNA, 27 bp, Artificial Sequences
  Synthetic
cgtattcggaggggtttgacgtcgagg

SEQ ID NO: 4728 - DNA, 27 bp, Artificial Sequences
  Synthetic
gttcggcgggtagtagtgcgtaggttt

SEQ ID NO: 4729 - DNA, 28 bp, Artificial Sequences
  Synthetic
ggattttgattcgggtgttggggaaagt

SEQ ID NO: 4730 - DNA, 29 bp, Artificial Sequences
  Synthetic
aggattttgattcgggtgttggggaaagt

SEQ ID NO: 4731 - DNA, 29 bp, Artificial Sequences
  Synthetic
tgggttgtttggcggtaggataaaaagga

SEQ ID NO: 4732 - DNA, 29 bp, Artificial Sequences
  Synthetic
ggattttgattcgggtgttggggaaagtt

SEQ ID NO: 4733 - DNA, 30 bp, Artificial Sequences
  Synthetic
tgggttgtttggcggtaggataaaaaggag

SEQ ID NO: 4734 - DNA, 33 bp, Artificial Sequences
  Synthetic
gggagttttggttagcgggttatttttagtgtt

SEQ ID NO: 4735 - DNA, 34 bp, Artificial Sequences
  Synthetic
gggagttttggttagcgggttatttttagtgttt

SEQ ID NO: 4736 - DNA, 35 bp, Artificial Sequences
  Synthetic
gggagttttggttagcgggttatttttagtgtttg

SEQ ID NO: 4737 - DNA, 36 bp, Artificial Sequences
  Synthetic
gggagttttggttagcgggttatttttagtgtttgt

SEQ ID NO: 4738 - DNA, 35 bp, Artificial Sequences
  Synthetic
ggagttttggttagcgggttatttttagtgtttgt

SEQ ID NO: 4739 - DNA, 27 bp, Artificial Sequences
  Synthetic
aggtcgggtaggtaaatgcgtgacgtt

SEQ ID NO: 4740 - DNA, 27 bp, Artificial Sequences
  Synthetic
taggtcgggtaggtaaatgcgtgacgt

SEQ ID NO: 4741 - DNA, 26 bp, Artificial Sequences
  Synthetic
aggtcgggtaggtaaatgcgtgacgt

SEQ ID NO: 4742 - DNA, 27 bp, Artificial Sequences
  Synthetic
ggtcgggtaggtaaatgcgtgacgtta

SEQ ID NO: 4743 - DNA, 28 bp, Artificial Sequences
  Synthetic
aggtcgggtaggtaaatgcgtgacgtta

SEQ ID NO: 4744 - DNA, 34 bp, Artificial Sequences
  Synthetic
ggtgaattggtagttttgttttttggtaggtggt

SEQ ID NO: 4745 - DNA, 34 bp, Artificial Sequences
  Synthetic
tggtgaattggtagttttgttttttggtaggtgg

SEQ ID NO: 4746 - DNA, 35 bp, Artificial Sequences
  Synthetic
tggtgaattggtagttttgttttttggtaggtggt

SEQ ID NO: 4747 - DNA, 35 bp, Artificial Sequences
  Synthetic
ggtgaattggtagttttgttttttggtaggtggtt

SEQ ID NO: 4748 - DNA, 35 bp, Artificial Sequences
  Synthetic
ttggtgaattggtagttttgttttttggtaggtgg

SEQ ID NO: 4749 - DNA, 27 bp, Artificial Sequences
  Synthetic
aggtcgggtaggtaaatgcgtgacgtt

SEQ ID NO: 4750 - DNA, 27 bp, Artificial Sequences
  Synthetic
taggtcgggtaggtaaatgcgtgacgt

SEQ ID NO: 4751 - DNA, 27 bp, Artificial Sequences
  Synthetic
agtggagtagggaggtggtgttggtag

SEQ ID NO: 4752 - DNA, 27 bp, Artificial Sequences
  Synthetic
gtggagtagggaggtggtgttggtaga

SEQ ID NO: 4753 - DNA, 26 bp, Artificial Sequences
  Synthetic
aggtcgggtaggtaaatgcgtgacgt

SEQ ID NO: 4754 - DNA, 27 bp, Artificial Sequences
  Synthetic
cggggtgaagttgtcggggagattcgt

SEQ ID NO: 4755 - DNA, 27 bp, Artificial Sequences
  Synthetic
agcggggtgaagttgtcggggagattc

SEQ ID NO: 4756 - DNA, 27 bp, Artificial Sequences
  Synthetic
tagcggggtgaagttgtcggggagatt

SEQ ID NO: 4757 - DNA, 27 bp, Artificial Sequences
  Synthetic
atagcggggtgaagttgtcggggagat

SEQ ID NO: 4758 - DNA, 27 bp, Artificial Sequences
  Synthetic
gcggggtgaagttgtcggggagattcg

SEQ ID NO: 4759 - DNA, 27 bp, Artificial Sequences
  Synthetic
ggtattacggggagtgtgcgtggggaa

SEQ ID NO: 4760 - DNA, 27 bp, Artificial Sequences
  Synthetic
taggtattacggggagtgtgcgtgggg

SEQ ID NO: 4761 - DNA, 27 bp, Artificial Sequences
  Synthetic
aggtattacggggagtgtgcgtgggga

SEQ ID NO: 4762 - DNA, 27 bp, Artificial Sequences
  Synthetic
gtattacggggagtgtgcgtggggaac

SEQ ID NO: 4763 - DNA, 28 bp, Artificial Sequences
  Synthetic
gtaggtattacggggagtgtgcgtgggg

SEQ ID NO: 4764 - DNA, 29 bp, Artificial Sequences
  Synthetic
cgagggttgttgatataggtagagcgggg

SEQ ID NO: 4765 - DNA, 30 bp, Artificial Sequences
  Synthetic
cgagggttgttgatataggtagagcgggga

SEQ ID NO: 4766 - DNA, 30 bp, Artificial Sequences
  Synthetic
tcgagggttgttgatataggtagagcgggg

SEQ ID NO: 4767 - DNA, 28 bp, Artificial Sequences
  Synthetic
agggttgttgatataggtagagcgggga

SEQ ID NO: 4768 - DNA, 31 bp, Artificial Sequences
  Synthetic
tcgagggttgttgatataggtagagcgggga

SEQ ID NO: 4769 - DNA, 31 bp, Artificial Sequences
  Synthetic
gcggtgggtagtttattgaatgtgatttggg

SEQ ID NO: 4770 - DNA, 32 bp, Artificial Sequences
  Synthetic
agcggtgggtagtttattgaatgtgatttggg

SEQ ID NO: 4771 - DNA, 32 bp, Artificial Sequences
  Synthetic
gcggtgggtagtttattgaatgtgatttggga

SEQ ID NO: 4772 - DNA, 33 bp, Artificial Sequences
  Synthetic
agcggtgggtagtttattgaatgtgatttggga

SEQ ID NO: 4773 - DNA, 33 bp, Artificial Sequences
  Synthetic
aagcggtgggtagtttattgaatgtgatttggg

SEQ ID NO: 4774 - DNA, 27 bp, Artificial Sequences
  Synthetic
tgtttaggattgtgtgcgagggggttt

SEQ ID NO: 4775 - DNA, 27 bp, Artificial Sequences
  Synthetic
ttgtttaggattgtgtgcgagggggtt

SEQ ID NO: 4776 - DNA, 27 bp, Artificial Sequences
  Synthetic
tttgtttaggattgtgtgcgagggggt

SEQ ID NO: 4777 - DNA, 28 bp, Artificial Sequences
  Synthetic
tgtttaggattgtgtgcgagggggtttc

SEQ ID NO: 4778 - DNA, 27 bp, Artificial Sequences
  Synthetic
gtttaggattgtgtgcgagggggtttc

SEQ ID NO: 4779 - DNA, 29 bp, Artificial Sequences
  Synthetic
tttcgttgagagtttgtagtagtgcggga

SEQ ID NO: 4780 - DNA, 29 bp, Artificial Sequences
  Synthetic
tcgttgagagtttgtagtagtgcgggatt

SEQ ID NO: 4781 - DNA, 29 bp, Artificial Sequences
  Synthetic
ttcgttgagagtttgtagtagtgcgggat

SEQ ID NO: 4782 - DNA, 29 bp, Artificial Sequences
  Synthetic
aatggttcgttgatgttgggatttgacgt

SEQ ID NO: 4783 - DNA, 30 bp, Artificial Sequences
  Synthetic
ttttcgttgagagtttgtagtagtgcggga

SEQ ID NO: 4784 - DNA, 27 bp, Artificial Sequences
  Synthetic
gcgttgaggttagtgaggtttgggcgt

SEQ ID NO: 4785 - DNA, 27 bp, Artificial Sequences
  Synthetic
tgcgttgaggttagtgaggtttgggcg

SEQ ID NO: 4786 - DNA, 28 bp, Artificial Sequences
  Synthetic
gtgcgttgaggttagtgaggtttgggcg

SEQ ID NO: 4787 - DNA, 28 bp, Artificial Sequences
  Synthetic
tgcgttgaggttagtgaggtttgggcgt

SEQ ID NO: 4788 - DNA, 27 bp, Artificial Sequences
  Synthetic
gcggtagtgcgttgaggttagtgaggt

SEQ ID NO: 4789 - DNA, 27 bp, Artificial Sequences
  Synthetic
gaagaatttaagtgggggagggcgcgg

SEQ ID NO: 4790 - DNA, 27 bp, Artificial Sequences
  Synthetic
ggaagaatttaagtgggggagggcgcg

SEQ ID NO: 4791 - DNA, 27 bp, Artificial Sequences
  Synthetic
gaatttaagtgggggagggcgcgggaa

SEQ ID NO: 4792 - DNA, 27 bp, Artificial Sequences
  Synthetic
aatttaagtgggggagggcgcgggaag

SEQ ID NO: 4793 - DNA, 27 bp, Artificial Sequences
  Synthetic
aagaatttaagtgggggagggcgcggg

SEQ ID NO: 4794 - DNA, 27 bp, Artificial Sequences
  Synthetic
cgggttgtcggttttggggtttggtgt

SEQ ID NO: 4795 - DNA, 27 bp, Artificial Sequences
  Synthetic
tcgggttgtcggttttggggtttggtg

SEQ ID NO: 4796 - DNA, 27 bp, Artificial Sequences
  Synthetic
ttcgggttgtcggttttggggtttggt

SEQ ID NO: 4797 - DNA, 28 bp, Artificial Sequences
  Synthetic
cgggttgtcggttttggggtttggtgtt

SEQ ID NO: 4798 - DNA, 28 bp, Artificial Sequences
  Synthetic
ttcgggttgtcggttttggggtttggtg

SEQ ID NO: 4799 - DNA, 27 bp, Artificial Sequences
  Synthetic
gtggagggaaacggaagggttgggagt

SEQ ID NO: 4800 - DNA, 27 bp, Artificial Sequences
  Synthetic
tggagggaaacggaagggttgggagtg

SEQ ID NO: 4801 - DNA, 27 bp, Artificial Sequences
  Synthetic
gtggggtaggggggtagtggcgatttt

SEQ ID NO: 4802 - DNA, 27 bp, Artificial Sequences
  Synthetic
gtataaagtcggttcggggagggggcg

SEQ ID NO: 4803 - DNA, 27 bp, Artificial Sequences
  Synthetic
aaacggaagggttgggagtggggtagg

SEQ ID NO: 4804 - DNA, 27 bp, Artificial Sequences
  Synthetic
tcgggtcggttttgtgtagttggggtt

SEQ ID NO: 4805 - DNA, 27 bp, Artificial Sequences
  Synthetic
ttcgggtcggttttgtgtagttggggt

SEQ ID NO: 4806 - DNA, 27 bp, Artificial Sequences
  Synthetic
cgggtcggttttgtgtagttggggttt

SEQ ID NO: 4807 - DNA, 28 bp, Artificial Sequences
  Synthetic
tcgggtcggttttgtgtagttggggttt

SEQ ID NO: 4808 - DNA, 28 bp, Artificial Sequences
  Synthetic
ttcgggtcggttttgtgtagttggggtt

SEQ ID NO: 4809 - DNA, 27 bp, Artificial Sequences
  Synthetic
gggagattcgcgaggggttttggaggt

SEQ ID NO: 4810 - DNA, 27 bp, Artificial Sequences
  Synthetic
aggaagttaggagtggggttcgtgcgt

SEQ ID NO: 4811 - DNA, 27 bp, Artificial Sequences
  Synthetic
ggagattcgcgaggggttttggaggtt

SEQ ID NO: 4812 - DNA, 28 bp, Artificial Sequences
  Synthetic
gggagattcgcgaggggttttggaggtt

SEQ ID NO: 4813 - DNA, 27 bp, Artificial Sequences
  Synthetic
ggaagttaggagtggggttcgtgcgtt

SEQ ID NO: 4814 - DNA, 27 bp, Artificial Sequences
  Synthetic
gatgtggcggggtttgggaaatgcgtt

SEQ ID NO: 4815 - DNA, 26 bp, Artificial Sequences
  Synthetic
atgtggcggggtttgggaaatgcgtt

SEQ ID NO: 4816 - DNA, 26 bp, Artificial Sequences
  Synthetic
gatgtggcggggtttgggaaatgcgt

SEQ ID NO: 4817 - DNA, 27 bp, Artificial Sequences
  Synthetic
cgatgtggcggggtttgggaaatgcgt

SEQ ID NO: 4818 - DNA, 26 bp, Artificial Sequences
  Synthetic
cgatgtggcggggtttgggaaatgcg

SEQ ID NO: 4819 - DNA, 27 bp, Artificial Sequences
  Synthetic
gggagattcgcgaggggttttggaggt

SEQ ID NO: 4820 - DNA, 27 bp, Artificial Sequences
  Synthetic
aggggttttggaggttttcggttcgcg

SEQ ID NO: 4821 - DNA, 27 bp, Artificial Sequences
  Synthetic
cgcgaggggttttggaggttttcggtt

SEQ ID NO: 4822 - DNA, 27 bp, Artificial Sequences
  Synthetic
ttcgcgaggggttttggaggttttcgg

SEQ ID NO: 4823 - DNA, 27 bp, Artificial Sequences
  Synthetic
tcgcgaggggttttggaggttttcggt

SEQ ID NO: 4824 - DNA, 27 bp, Artificial Sequences
  Synthetic
gatgtggcggggtttgggaaatgcgtt

SEQ ID NO: 4825 - DNA, 26 bp, Artificial Sequences
  Synthetic
atgtggcggggtttgggaaatgcgtt

SEQ ID NO: 4826 - DNA, 26 bp, Artificial Sequences
  Synthetic
gatgtggcggggtttgggaaatgcgt

SEQ ID NO: 4827 - DNA, 27 bp, Artificial Sequences
  Synthetic
cgatgtggcggggtttgggaaatgcgt

SEQ ID NO: 4828 - DNA, 26 bp, Artificial Sequences
  Synthetic
cgatgtggcggggtttgggaaatgcg

SEQ ID NO: 4829 - DNA, 27 bp, Artificial Sequences
  Synthetic
ggcgcggggagaggggagtataattcg

SEQ ID NO: 4830 - DNA, 27 bp, Artificial Sequences
  Synthetic
gcgttttttggtaagggagggcggagg

SEQ ID NO: 4831 - DNA, 27 bp, Artificial Sequences
  Synthetic
ggcgttttttggtaagggagggcggag

SEQ ID NO: 4832 - DNA, 27 bp, Artificial Sequences
  Synthetic
gcgcggggagaggggagtataattcgt

SEQ ID NO: 4833 - DNA, 27 bp, Artificial Sequences
  Synthetic
agtcggcgttttttggtaagggagggc

SEQ ID NO: 4834 - DNA, 33 bp, Artificial Sequences
  Synthetic
cgcgttttttcgtcgtttttgttgttagtttga

SEQ ID NO: 4835 - DNA, 34 bp, Artificial Sequences
  Synthetic
cgcgttttttcgtcgtttttgttgttagtttgaa

SEQ ID NO: 4836 - DNA, 35 bp, Artificial Sequences
  Synthetic
cgcgttttttcgtcgtttttgttgttagtttgaac

SEQ ID NO: 4837 - DNA, 27 bp, Artificial Sequences
  Synthetic
ggcgcggggagaggggagtataattcg

SEQ ID NO: 4838 - DNA, 27 bp, Artificial Sequences
  Synthetic
gcgcggggagaggggagtataattcgt

SEQ ID NO: 4839 - DNA, 27 bp, Artificial Sequences
  Synthetic
aggcgcggggagaggggagtataattc

SEQ ID NO: 4840 - DNA, 28 bp, Artificial Sequences
  Synthetic
gcgcggggagaggggagtataattcgtc

SEQ ID NO: 4841 - DNA, 27 bp, Artificial Sequences
  Synthetic
gtaggcgcggggagaggggagtataat

SEQ ID NO: 4842 - DNA, 27 bp, Artificial Sequences
  Synthetic
cgggttagtcggggttggagttgggaa

SEQ ID NO: 4843 - DNA, 27 bp, Artificial Sequences
  Synthetic
agtcggggttggagttgggaagggttg

SEQ ID NO: 4844 - DNA, 27 bp, Artificial Sequences
  Synthetic
tgtcgggttagtcggggttggagttgg

SEQ ID NO: 4845 - DNA, 27 bp, Artificial Sequences
  Synthetic
tcggggttggagttgggaagggttgtg

SEQ ID NO: 4846 - DNA, 27 bp, Artificial Sequences
  Synthetic
gtcggggttggagttgggaagggttgt

SEQ ID NO: 4847 - DNA, 26 bp, Artificial Sequences
  Synthetic
gaggagcgggggtagtttcgggtgtc

SEQ ID NO: 4848 - DNA, 25 bp, Artificial Sequences
  Synthetic
aggagcgggggtagtttcgggtgtc

SEQ ID NO: 4849 - DNA, 25 bp, Artificial Sequences
  Synthetic
gaggagcgggggtagtttcgggtgt

SEQ ID NO: 4850 - DNA, 25 bp, Artificial Sequences
  Synthetic
gcggcggcgggtgagtttaatttcg

SEQ ID NO: 4851 - DNA, 27 bp, Artificial Sequences
  Synthetic
gattgatagtagaggcggcgaaggagc

SEQ ID NO: 4852 - DNA, 27 bp, Artificial Sequences
  Synthetic
cgggttagtcggggttggagttgggaa

SEQ ID NO: 4853 - DNA, 27 bp, Artificial Sequences
  Synthetic
agtcggggttggagttgggaagggttg

SEQ ID NO: 4854 - DNA, 27 bp, Artificial Sequences
  Synthetic
tgtcgggttagtcggggttggagttgg

SEQ ID NO: 4855 - DNA, 27 bp, Artificial Sequences
  Synthetic
tcggggttggagttgggaagggttgtg

SEQ ID NO: 4856 - DNA, 27 bp, Artificial Sequences
  Synthetic
gtcggggttggagttgggaagggttgt

SEQ ID NO: 4857 - DNA, 27 bp, Artificial Sequences
  Synthetic
gcggcggcgggtgagtttaatttcgta

SEQ ID NO: 4858 - DNA, 28 bp, Artificial Sequences
  Synthetic
gcggcggcgggtgagtttaatttcgtat

SEQ ID NO: 4859 - DNA, 26 bp, Artificial Sequences
  Synthetic
gcggcggcgggtgagtttaatttcgt

SEQ ID NO: 4860 - DNA, 27 bp, Artificial Sequences
  Synthetic
cggcggcgggtgagtttaatttcgtat

SEQ ID NO: 4861 - DNA, 27 bp, Artificial Sequences
  Synthetic
cggttggttcggtatttttcggagggt

SEQ ID NO: 4862 - DNA, 25 bp, Artificial Sequences
  Synthetic
gttcgtcggggcgttggttcgtaga

SEQ ID NO: 4863 - DNA, 24 bp, Artificial Sequences
  Synthetic
ttcgtcggggcgttggttcgtaga

SEQ ID NO: 4864 - DNA, 24 bp, Artificial Sequences
  Synthetic
gttcgtcggggcgttggttcgtag

SEQ ID NO: 4865 - DNA, 23 bp, Artificial Sequences
  Synthetic
tcgtcggggcgttggttcgtaga

SEQ ID NO: 4866 - DNA, 23 bp, Artificial Sequences
  Synthetic
gttcgtcggggcgttggttcgta

SEQ ID NO: 4867 - DNA, 27 bp, Artificial Sequences
  Synthetic
gcggcggcgggtgagtttaatttcgta

SEQ ID NO: 4868 - DNA, 28 bp, Artificial Sequences
  Synthetic
gcggcggcgggtgagtttaatttcgtat

SEQ ID NO: 4869 - DNA, 26 bp, Artificial Sequences
  Synthetic
gcggcggcgggtgagtttaatttcgt

SEQ ID NO: 4870 - DNA, 27 bp, Artificial Sequences
  Synthetic
cggcggcgggtgagtttaatttcgtat

SEQ ID NO: 4871 - DNA, 27 bp, Artificial Sequences
  Synthetic
cggttggttcggtatttttcggagggt

SEQ ID NO: 4872 - DNA, 27 bp, Artificial Sequences
  Synthetic
tcggcgaggtgttgtgtagtgtcgagt

SEQ ID NO: 4873 - DNA, 27 bp, Artificial Sequences
  Synthetic
agttcggcgaggtgttgtgtagtgtcg

SEQ ID NO: 4874 - DNA, 27 bp, Artificial Sequences
  Synthetic
gttcggcgaggtgttgtgtagtgtcga

SEQ ID NO: 4875 - DNA, 27 bp, Artificial Sequences
  Synthetic
ggagttcggcgaggtgttgtgtagtgt

SEQ ID NO: 4876 - DNA, 28 bp, Artificial Sequences
  Synthetic
ttcggcgaggtgttgtgtagtgtcgagt

SEQ ID NO: 4877 - DNA, 27 bp, Artificial Sequences
  Synthetic
gtttcggcgggcgggaagatgatgatg

SEQ ID NO: 4878 - DNA, 27 bp, Artificial Sequences
  Synthetic
ttcggcgggcgggaagatgatgatgat

SEQ ID NO: 4879 - DNA, 27 bp, Artificial Sequences
  Synthetic
tttcggcgggcgggaagatgatgatga

SEQ ID NO: 4880 - DNA, 27 bp, Artificial Sequences
  Synthetic
tcggcgggcgggaagatgatgatgatg

SEQ ID NO: 4881 - DNA, 27 bp, Artificial Sequences
  Synthetic
cggcgggcgggaagatgatgatgatgt

SEQ ID NO: 4882 - DNA, 27 bp, Artificial Sequences
  Synthetic
tcgagttgttgggggagttggtcgagg

SEQ ID NO: 4883 - DNA, 27 bp, Artificial Sequences
  Synthetic
tcggcgaggtgttgtgtagtgtcgagt

SEQ ID NO: 4884 - DNA, 27 bp, Artificial Sequences
  Synthetic
cgagttgttgggggagttggtcgaggg

SEQ ID NO: 4885 - DNA, 27 bp, Artificial Sequences
  Synthetic
gagttgttgggggagttggtcgagggc

SEQ ID NO: 4886 - DNA, 27 bp, Artificial Sequences
  Synthetic
tgttcgagttgttgggggagttggtcg

SEQ ID NO: 4887 - DNA, 27 bp, Artificial Sequences
  Synthetic
gtttcggcgggcgggaagatgatgatg

SEQ ID NO: 4888 - DNA, 27 bp, Artificial Sequences
  Synthetic
ttcggcgggcgggaagatgatgatgat

SEQ ID NO: 4889 - DNA, 27 bp, Artificial Sequences
  Synthetic
tttcggcgggcgggaagatgatgatga

SEQ ID NO: 4890 - DNA, 27 bp, Artificial Sequences
  Synthetic
tcggcgggcgggaagatgatgatgatg

SEQ ID NO: 4891 - DNA, 27 bp, Artificial Sequences
  Synthetic
cggcgggcgggaagatgatgatgatgt

SEQ ID NO: 4892 - DNA, 27 bp, Artificial Sequences
  Synthetic
tcgagttgttgggggagttggtcgagg

SEQ ID NO: 4893 - DNA, 27 bp, Artificial Sequences
  Synthetic
cgagttgttgggggagttggtcgaggg

SEQ ID NO: 4894 - DNA, 27 bp, Artificial Sequences
  Synthetic
gagttgttgggggagttggtcgagggc

SEQ ID NO: 4895 - DNA, 27 bp, Artificial Sequences
  Synthetic
tgttcgagttgttgggggagttggtcg

SEQ ID NO: 4896 - DNA, 28 bp, Artificial Sequences
  Synthetic
tgttcgagttgttgggggagttggtcga

SEQ ID NO: 4897 - DNA, 27 bp, Artificial Sequences
  Synthetic
cgtcgggtttttcggtttttatcgcgt

SEQ ID NO: 4898 - DNA, 28 bp, Artificial Sequences
  Synthetic
tcgtcgggtttttcggtttttatcgcgt

SEQ ID NO: 4899 - DNA, 27 bp, Artificial Sequences
  Synthetic
tcgtcgggtttttcggtttttatcgcg

SEQ ID NO: 4900 - DNA, 27 bp, Artificial Sequences
  Synthetic
acggcggtagtttgtacgtggagttta

SEQ ID NO: 4901 - DNA, 28 bp, Artificial Sequences
  Synthetic
cgtcgggtttttcggtttttatcgcgtt

SEQ ID NO: 4902 - DNA, 27 bp, Artificial Sequences
  Synthetic
gagttgttgggggagttggtcgagggt

SEQ ID NO: 4903 - DNA, 27 bp, Artificial Sequences
  Synthetic
tcgagttgttgggggagttggtcgagg

SEQ ID NO: 4904 - DNA, 27 bp, Artificial Sequences
  Synthetic
cgagttgttgggggagttggtcgaggg

SEQ ID NO: 4905 - DNA, 27 bp, Artificial Sequences
  Synthetic
tgttcgagttgttgggggagttggtcg

SEQ ID NO: 4906 - DNA, 28 bp, Artificial Sequences
  Synthetic
tgttcgagttgttgggggagttggtcga

SEQ ID NO: 4907 - DNA, 27 bp, Artificial Sequences
  Synthetic
cgtcgggtttttcggtttttatcgcgt

SEQ ID NO: 4908 - DNA, 28 bp, Artificial Sequences
  Synthetic
tcgtcgggtttttcggtttttatcgcgt

SEQ ID NO: 4909 - DNA, 27 bp, Artificial Sequences
  Synthetic
tcgtcgggtttttcggtttttatcgcg

SEQ ID NO: 4910 - DNA, 24 bp, Artificial Sequences
  Synthetic
gagtaacgttggtggtggcggcgg

SEQ ID NO: 4911 - DNA, 27 bp, Artificial Sequences
  Synthetic
acggcggtagtttgtacgtggagttta

SEQ ID NO: 4912 - DNA, 27 bp, Artificial Sequences
  Synthetic
cgtatcggtggggttggaagataggtt

SEQ ID NO: 4913 - DNA, 28 bp, Artificial Sequences
  Synthetic
cggtggggttggaagataggtttttcgt

SEQ ID NO: 4914 - DNA, 27 bp, Artificial Sequences
  Synthetic
cggtggggttggaagataggtttttcg

SEQ ID NO: 4915 - DNA, 29 bp, Artificial Sequences
  Synthetic
tcggtggggttggaagataggtttttcgt

SEQ ID NO: 4916 - DNA, 28 bp, Artificial Sequences
  Synthetic
tcggtggggttggaagataggtttttcg

SEQ ID NO: 4917 - DNA, 27 bp, Artificial Sequences
  Synthetic
cggtggttggtaggaggtggtcgttgt

SEQ ID NO: 4918 - DNA, 27 bp, Artificial Sequences
  Synthetic
tcggtggttggtaggaggtggtcgttg

SEQ ID NO: 4919 - DNA, 27 bp, Artificial Sequences
  Synthetic
ttcggtggttggtaggaggtggtcgtt

SEQ ID NO: 4920 - DNA, 27 bp, Artificial Sequences
  Synthetic
tttcggtggttggtaggaggtggtcgt

SEQ ID NO: 4921 - DNA, 28 bp, Artificial Sequences
  Synthetic
ttcggtggttggtaggaggtggtcgttg

SEQ ID NO: 4922 - DNA, 27 bp, Artificial Sequences
  Synthetic
tgcgtgtaggtgaaggatcgttgcgtt

SEQ ID NO: 4923 - DNA, 27 bp, Artificial Sequences
  Synthetic
ttgcgtgtaggtgaaggatcgttgcgt

SEQ ID NO: 4924 - DNA, 28 bp, Artificial Sequences
  Synthetic
tgcgtgtaggtgaaggatcgttgcgttt

SEQ ID NO: 4925 - DNA, 28 bp, Artificial Sequences
  Synthetic
ttgcgtgtaggtgaaggatcgttgcgtt

SEQ ID NO: 4926 - DNA, 28 bp, Artificial Sequences
  Synthetic
tttgcgtgtaggtgaaggatcgttgcgt

SEQ ID NO: 4927 - DNA, 27 bp, Artificial Sequences
  Synthetic
aggttatcgaggtagacgggggcgaag

SEQ ID NO: 4928 - DNA, 27 bp, Artificial Sequences
  Synthetic
ggttatcgaggtagacgggggcgaaga

SEQ ID NO: 4929 - DNA, 28 bp, Artificial Sequences
  Synthetic
aggttatcgaggtagacgggggcgaaga

SEQ ID NO: 4930 - DNA, 28 bp, Artificial Sequences
  Synthetic
ggttatcgaggtagacgggggcgaagag

SEQ ID NO: 4931 - DNA, 27 bp, Artificial Sequences
  Synthetic
taggttatcgaggtagacgggggcgaa

SEQ ID NO: 4932 - DNA, 27 bp, Artificial Sequences
  Synthetic
gaaggaggtgttggagtaggtcggcgt

SEQ ID NO: 4933 - DNA, 27 bp, Artificial Sequences
  Synthetic
tgaaggaggtgttggagtaggtcggcg

SEQ ID NO: 4934 - DNA, 27 bp, Artificial Sequences
  Synthetic
aggtgttggagtaggtcggcgtttgga

SEQ ID NO: 4935 - DNA, 27 bp, Artificial Sequences
  Synthetic
aggaggtgttggagtaggtcggcgttt

SEQ ID NO: 4936 - DNA, 27 bp, Artificial Sequences
  Synthetic
aaggaggtgttggagtaggtcggcgtt

SEQ ID NO: 4937 - DNA, 27 bp, Artificial Sequences
  Synthetic
aggttatcgaggtagacgggggcgaag

SEQ ID NO: 4938 - DNA, 27 bp, Artificial Sequences
  Synthetic
ggttatcgaggtagacgggggcgaaga

SEQ ID NO: 4939 - DNA, 28 bp, Artificial Sequences
  Synthetic
aggttatcgaggtagacgggggcgaaga

SEQ ID NO: 4940 - DNA, 28 bp, Artificial Sequences
  Synthetic
ggttatcgaggtagacgggggcgaagag

SEQ ID NO: 4941 - DNA, 27 bp, Artificial Sequences
  Synthetic
taggttatcgaggtagacgggggcgaa

SEQ ID NO: 4942 - DNA, 27 bp, Artificial Sequences
  Synthetic
gaaggaggtgttggagtaggtcggcgt

SEQ ID NO: 4943 - DNA, 27 bp, Artificial Sequences
  Synthetic
tgaaggaggtgttggagtaggtcggcg

SEQ ID NO: 4944 - DNA, 27 bp, Artificial Sequences
  Synthetic
aggtgttggagtaggtcggcgtttgga

SEQ ID NO: 4945 - DNA, 27 bp, Artificial Sequences
  Synthetic
aggaggtgttggagtaggtcggcgttt

SEQ ID NO: 4946 - DNA, 27 bp, Artificial Sequences
  Synthetic
aaggaggtgttggagtaggtcggcgtt

SEQ ID NO: 4947 - DNA, 27 bp, Artificial Sequences
  Synthetic
aggtagtagtgcgaggcgaggaagagt

SEQ ID NO: 4948 - DNA, 27 bp, Artificial Sequences
  Synthetic
tgcgtttgtaggagaagtcgggttggt

SEQ ID NO: 4949 - DNA, 28 bp, Artificial Sequences
  Synthetic
tgcgaggcgaggaagagtagtagtagcg

SEQ ID NO: 4950 - DNA, 27 bp, Artificial Sequences
  Synthetic
gcgaggcgaggaagagtagtagtagcg

SEQ ID NO: 4951 - DNA, 29 bp, Artificial Sequences
  Synthetic
gggttggttaaagaggaagagttcgcgcg

SEQ ID NO: 4952 - DNA, 27 bp, Artificial Sequences
  Synthetic
tcgtattgttgtttgggttcggcgcgc

SEQ ID NO: 4953 - DNA, 27 bp, Artificial Sequences
  Synthetic
ttcgtattgttgtttgggttcggcgcg

SEQ ID NO: 4954 - DNA, 26 bp, Artificial Sequences
  Synthetic
gtattgttgtttgggttcggcgcgcg

SEQ ID NO: 4955 - DNA, 26 bp, Artificial Sequences
  Synthetic
cgtattgttgtttgggttcggcgcgc

SEQ ID NO: 4956 - DNA, 27 bp, Artificial Sequences
  Synthetic
gtattgttgtttgggttcggcgcgcgg

SEQ ID NO: 4957 - DNA, 29 bp, Artificial Sequences
  Synthetic
cggtggggatatcgcgtgttaagtttggc

SEQ ID NO: 4958 - DNA, 28 bp, Artificial Sequences
  Synthetic
ggtggggatatcgcgtgttaagtttggc

SEQ ID NO: 4959 - DNA, 28 bp, Artificial Sequences
  Synthetic
cggtggggatatcgcgtgttaagtttgg

SEQ ID NO: 4960 - DNA, 29 bp, Artificial Sequences
  Synthetic
tcggtggggatatcgcgtgttaagtttgg

SEQ ID NO: 4961 - DNA, 27 bp, Artificial Sequences
  Synthetic
agcgtcgattgggtagttttgtggagt

SEQ ID NO: 4962 - DNA, 27 bp, Artificial Sequences
  Synthetic
tagggagttgtcgggtgagggagtcgt

SEQ ID NO: 4963 - DNA, 27 bp, Artificial Sequences
  Synthetic
gggagttgtcgggtgagggagtcgttg

SEQ ID NO: 4964 - DNA, 27 bp, Artificial Sequences
  Synthetic
ggagttgtcgggtgagggagtcgttga

SEQ ID NO: 4965 - DNA, 27 bp, Artificial Sequences
  Synthetic
tcgggtgagggagtcgttgaagcgttg

SEQ ID NO: 4966 - DNA, 27 bp, Artificial Sequences
  Synthetic
ttgtcgggtgagggagtcgttgaagcg

SEQ ID NO: 4967 - DNA, 28 bp, Artificial Sequences
  Synthetic
ggaggtattggagtcgggttgtaggcgt

SEQ ID NO: 4968 - DNA, 27 bp, Artificial Sequences
  Synthetic
ggaggtattggagtcgggttgtaggcg

SEQ ID NO: 4969 - DNA, 28 bp, Artificial Sequences
  Synthetic
aggaggtattggagtcgggttgtaggcg

SEQ ID NO: 4970 - DNA, 27 bp, Artificial Sequences
  Synthetic
gaggtattggagtcgggttgtaggcgt

SEQ ID NO: 4971 - DNA, 29 bp, Artificial Sequences
  Synthetic
aggaggtattggagtcgggttgtaggcgt

SEQ ID NO: 4972 - DNA, 27 bp, Artificial Sequences
  Synthetic
agggaggcggataaagtttcggtgggt

SEQ ID NO: 4973 - DNA, 27 bp, Artificial Sequences
  Synthetic
tttttggcgggcgttgggatttcgtcg

SEQ ID NO: 4974 - DNA, 27 bp, Artificial Sequences
  Synthetic
ggcgggcgttgggatttcgtcgttttt

SEQ ID NO: 4975 - DNA, 27 bp, Artificial Sequences
  Synthetic
gggaggcggataaagtttcggtgggtg

SEQ ID NO: 4976 - DNA, 27 bp, Artificial Sequences
  Synthetic
gcgggcgttgggatttcgtcgtttttt

SEQ ID NO: 4977 - DNA, 27 bp, Artificial Sequences
  Synthetic
tttgcgcgtcggtgatttgaattcgag

SEQ ID NO: 4978 - DNA, 27 bp, Artificial Sequences
  Synthetic
cgagtttagtttttgcgcgtcggtgat

SEQ ID NO: 4979 - DNA, 27 bp, Artificial Sequences
  Synthetic
ttttgcgcgtcggtgatttgaattcga

SEQ ID NO: 4980 - DNA, 28 bp, Artificial Sequences
  Synthetic
ttttgcgcgtcggtgatttgaattcgag

SEQ ID NO: 4981 - DNA, 24 bp, Artificial Sequences
  Synthetic
gagggtgtgtgtgtagggcggggg

SEQ ID NO: 4982 - DNA, 27 bp, Artificial Sequences
  Synthetic
tttttggcgggcgttgggatttcgtcg

SEQ ID NO: 4983 - DNA, 27 bp, Artificial Sequences
  Synthetic
ggcgggcgttgggatttcgtcgttttt

SEQ ID NO: 4984 - DNA, 27 bp, Artificial Sequences
  Synthetic
gcgggcgttgggatttcgtcgtttttt

SEQ ID NO: 4985 - DNA, 27 bp, Artificial Sequences
  Synthetic
ttttttggcgggcgttgggatttcgtc

SEQ ID NO: 4986 - DNA, 27 bp, Artificial Sequences
  Synthetic
tggcgggcgttgggatttcgtcgtttt

SEQ ID NO: 4987 - DNA, 24 bp, Artificial Sequences
  Synthetic
gagggtgtgtgtgtagggcggggg

SEQ ID NO: 4988 - DNA, 24 bp, Artificial Sequences
  Synthetic
tcggcgcgagggtgtgtgtgtagg

SEQ ID NO: 4989 - DNA, 24 bp, Artificial Sequences
  Synthetic
cgagggtgtgtgtgtagggcgggg

SEQ ID NO: 4990 - DNA, 23 bp, Artificial Sequences
  Synthetic
cgcgagggtgtgtgtgtagggcg

SEQ ID NO: 4991 - DNA, 23 bp, Artificial Sequences
  Synthetic
cggcgcgagggtgtgtgtgtagg

SEQ ID NO: 4992 - DNA, 27 bp, Artificial Sequences
  Synthetic
aggtttcgggtttaaattatcggcgcg

SEQ ID NO: 4993 - DNA, 29 bp, Artificial Sequences
  Synthetic
ggtgtttaggagcgtagagaggtttcggg

SEQ ID NO: 4994 - DNA, 30 bp, Artificial Sequences
  Synthetic
ggtgtttaggagcgtagagaggtttcgggt

SEQ ID NO: 4995 - DNA, 28 bp, Artificial Sequences
  Synthetic
tgtttaggagcgtagagaggtttcgggt

SEQ ID NO: 4996 - DNA, 27 bp, Artificial Sequences
  Synthetic
gtttaggagcgtagagaggtttcgggt

SEQ ID NO: 4997 - DNA, 27 bp, Artificial Sequences
  Synthetic
ttcggttgggttaggtgaggaggatga

SEQ ID NO: 4998 - DNA, 27 bp, Artificial Sequences
  Synthetic
tgttttcggttgggttaggtgaggagg

SEQ ID NO: 4999 - DNA, 27 bp, Artificial Sequences
  Synthetic
agtagggtttggtgagaggacgtttcg

SEQ ID NO: 5000 - DNA, 28 bp, Artificial Sequences
  Synthetic
tttcggttgggttaggtgaggaggatga

SEQ ID NO: 5001 - DNA, 30 bp, Artificial Sequences
  Synthetic
cggttgggttaggtgaggaggatgataggg

SEQ ID NO: 5002 - DNA, 27 bp, Artificial Sequences
  Synthetic
tcgtgcggttgttgtagttgttgcgga

SEQ ID NO: 5003 - DNA, 27 bp, Artificial Sequences
  Synthetic
cgtgcggttgttgtagttgttgcggag

SEQ ID NO: 5004 - DNA, 28 bp, Artificial Sequences
  Synthetic
cgtgcggttgttgtagttgttgcggaga

SEQ ID NO: 5005 - DNA, 28 bp, Artificial Sequences
  Synthetic
tcgtgcggttgttgtagttgttgcggag

SEQ ID NO: 5006 - DNA, 27 bp, Artificial Sequences
  Synthetic
ttcgtgcggttgttgtagttgttgcgg

SEQ ID NO: 5007 - DNA, 27 bp, Artificial Sequences
  Synthetic
agtagggtttggtgagaggacgtttcg

SEQ ID NO: 5008 - DNA, 24 bp, Artificial Sequences
  Synthetic
ttcggtgttgaaaggtcgaggcgc

SEQ ID NO: 5009 - DNA, 28 bp, Artificial Sequences
  Synthetic
tagtagggtttggtgagaggacgtttcg

SEQ ID NO: 5010 - DNA, 29 bp, Artificial Sequences
  Synthetic
atagtagggtttggtgagaggacgtttcg

SEQ ID NO: 5011 - DNA, 23 bp, Artificial Sequences
  Synthetic
tcggtgttgaaaggtcgaggcgc

SEQ ID NO: 5012 - DNA, 28 bp, Artificial Sequences
  Synthetic
gcgcggcgttgagaaagtatagttcggg

SEQ ID NO: 5013 - DNA, 27 bp, Artificial Sequences
  Synthetic
gagatttcgggttttcggggttgtcgc

SEQ ID NO: 5014 - DNA, 28 bp, Artificial Sequences
  Synthetic
cgcggcgttgagaaagtatagttcgggg

SEQ ID NO: 5015 - DNA, 27 bp, Artificial Sequences
  Synthetic
gcgcggcgttgagaaagtatagttcgg

SEQ ID NO: 5016 - DNA, 28 bp, Artificial Sequences
  Synthetic
tgcgcggcgttgagaaagtatagttcgg

SEQ ID NO: 5017 - DNA, 24 bp, Artificial Sequences
  Synthetic
gtttacggtggtgcggggtgtcgg

SEQ ID NO: 5018 - DNA, 25 bp, Artificial Sequences
  Synthetic
gtttacggtggtgcggggtgtcggg

SEQ ID NO: 5019 - DNA, 24 bp, Artificial Sequences
  Synthetic
tttacggtggtgcggggtgtcggg

SEQ ID NO: 5020 - DNA, 23 bp, Artificial Sequences
  Synthetic
tttacggtggtgcggggtgtcgg

SEQ ID NO: 5021 - DNA, 26 bp, Artificial Sequences
  Synthetic
gtttacggtggtgcggggtgtcgggc

SEQ ID NO: 5022 - DNA, 27 bp, Artificial Sequences
  Synthetic
tagagaggggtaggtagtttcgggcgc

SEQ ID NO: 5023 - DNA, 27 bp, Artificial Sequences
  Synthetic
agagaggggtaggtagtttcgggcgcg

SEQ ID NO: 5024 - DNA, 28 bp, Artificial Sequences
  Synthetic
gcgcggcgttgagaaagtatagttcggg

SEQ ID NO: 5025 - DNA, 26 bp, Artificial Sequences
  Synthetic
gagaggggtaggtagtttcgggcgcg

SEQ ID NO: 5026 - DNA, 28 bp, Artificial Sequences
  Synthetic
tagagaggggtaggtagtttcgggcgcg

SEQ ID NO: 5027 - DNA, 33 bp, Artificial Sequences
  Synthetic
tgttgttacgtagatggtttggttttggttgtt

SEQ ID NO: 5028 - DNA, 33 bp, Artificial Sequences
  Synthetic
ttgttgttacgtagatggtttggttttggttgt

SEQ ID NO: 5029 - DNA, 34 bp, Artificial Sequences
  Synthetic
tgttgttacgtagatggtttggttttggttgttt

SEQ ID NO: 5030 - DNA, 34 bp, Artificial Sequences
  Synthetic
ttgttgttacgtagatggtttggttttggttgtt

SEQ ID NO: 5031 - DNA, 34 bp, Artificial Sequences
  Synthetic
tttgttgttacgtagatggtttggttttggttgt

SEQ ID NO: 5032 - DNA, 33 bp, Artificial Sequences
  Synthetic
cggagagtttgaggattcgtgttttaagtttcg

SEQ ID NO: 5033 - DNA, 34 bp, Artificial Sequences
  Synthetic
cggagagtttgaggattcgtgttttaagtttcgt

SEQ ID NO: 5034 - DNA, 34 bp, Artificial Sequences
  Synthetic
tcggagagtttgaggattcgtgttttaagtttcg

SEQ ID NO: 5035 - DNA, 35 bp, Artificial Sequences
  Synthetic
tcggagagtttgaggattcgtgttttaagtttcgt

SEQ ID NO: 5036 - DNA, 35 bp, Artificial Sequences
  Synthetic
cggagagtttgaggattcgtgttttaagtttcgtt

SEQ ID NO: 5037 - DNA, 28 bp, Artificial Sequences
  Synthetic
ggtggaggtggaggtgaaatgtcgaggt

SEQ ID NO: 5038 - DNA, 27 bp, Artificial Sequences
  Synthetic
ggtggaggtggaggtgaaatgtcgagg

SEQ ID NO: 5039 - DNA, 27 bp, Artificial Sequences
  Synthetic
ggaggtggaggtggaggtgaaatgtcg

SEQ ID NO: 5040 - DNA, 28 bp, Artificial Sequences
  Synthetic
aggtggaggtggaggtgaaatgtcgagg

SEQ ID NO: 5041 - DNA, 28 bp, Artificial Sequences
  Synthetic
aggaggtggaggtggaggtgaaatgtcg

SEQ ID NO: 5042 - DNA, 27 bp, Artificial Sequences
  Synthetic
ggggcgggggttgtggtttggttttat

SEQ ID NO: 5043 - DNA, 27 bp, Artificial Sequences
  Synthetic
tggggcgggggttgtggtttggtttta

SEQ ID NO: 5044 - DNA, 26 bp, Artificial Sequences
  Synthetic
tttatgtgtgttggcggtggtggggc

SEQ ID NO: 5045 - DNA, 28 bp, Artificial Sequences
  Synthetic
ggggcgggggttgtggtttggttttatt

SEQ ID NO: 5046 - DNA, 26 bp, Artificial Sequences
  Synthetic
ggggcgggggttgtggtttggtttta

SEQ ID NO: 5047 - DNA, 28 bp, Artificial Sequences
  Synthetic
aggtgagggtaggggttttttgaaaggt

SEQ ID NO: 5048 - DNA, 31 bp, Artificial Sequences
  Synthetic
aggtgagggtaggggttttttgaaaggtatt

SEQ ID NO: 5049 - DNA, 33 bp, Artificial Sequences
  Synthetic
aggtgagggtaggggttttttgaaaggtattag

SEQ ID NO: 5050 - DNA, 33 bp, Artificial Sequences
  Synthetic
ggtgagggtaggggttttttgaaaggtattaga

SEQ ID NO: 5051 - DNA, 34 bp, Artificial Sequences
  Synthetic
aggtgagggtaggggttttttgaaaggtattaga

SEQ ID NO: 5052 - DNA, 28 bp, Artificial Sequences
  Synthetic
ggatgcggagtggttttttggtggtcgt

SEQ ID NO: 5053 - DNA, 27 bp, Artificial Sequences
  Synthetic
ggatgcggagtggttttttggtggtcg

SEQ ID NO: 5054 - DNA, 28 bp, Artificial Sequences
  Synthetic
aggatgcggagtggttttttggtggtcg

SEQ ID NO: 5055 - DNA, 27 bp, Artificial Sequences
  Synthetic
gatgcggagtggttttttggtggtcgt

SEQ ID NO: 5056 - DNA, 27 bp, Artificial Sequences
  Synthetic
aggatgcggagtggttttttggtggtc

SEQ ID NO: 5057 - DNA, 29 bp, Artificial Sequences
  Synthetic
cgtaggttagcgagggtagtttgagtcgt

SEQ ID NO: 5058 - DNA, 28 bp, Artificial Sequences
  Synthetic
cgtaggttagcgagggtagtttgagtcg

SEQ ID NO: 5059 - DNA, 27 bp, Artificial Sequences
  Synthetic
gttgggttgtcgggtgcgttgtggaat

SEQ ID NO: 5060 - DNA, 27 bp, Artificial Sequences
  Synthetic
ggttgtcgggtgcgttgtggaatcgtt

SEQ ID NO: 5061 - DNA, 27 bp, Artificial Sequences
  Synthetic
ttgggttgtcgggtgcgttgtggaatc

SEQ ID NO: 5062 - DNA, 26 bp, Artificial Sequences
  Synthetic
gttgggttgtcgggtgcgttgtggaa

SEQ ID NO: 5063 - DNA, 28 bp, Artificial Sequences
  Synthetic
ggttgtcgggtgcgttgtggaatcgttt

SEQ ID NO: 5064 - DNA, 29 bp, Artificial Sequences
  Synthetic
cgtaggttagcgagggtagtttgagtcgt

SEQ ID NO: 5065 - DNA, 28 bp, Artificial Sequences
  Synthetic
cgtaggttagcgagggtagtttgagtcg

SEQ ID NO: 5066 - DNA, 31 bp, Artificial Sequences
  Synthetic
cgtcgttagttcgttgttttagtaggaggcg

SEQ ID NO: 5067 - DNA, 32 bp, Artificial Sequences
  Synthetic
tcgtcgttagttcgttgttttagtaggaggcg

SEQ ID NO: 5068 - DNA, 31 bp, Artificial Sequences
  Synthetic
tcgtcgttagttcgttgttttagtaggaggc

SEQ ID NO: 5069 - DNA, 27 bp, Artificial Sequences
  Synthetic
gttgggttgtcgggtgcgttgtggaat

SEQ ID NO: 5070 - DNA, 27 bp, Artificial Sequences
  Synthetic
ggttgtcgggtgcgttgtggaatcgtt

SEQ ID NO: 5071 - DNA, 27 bp, Artificial Sequences
  Synthetic
ttgggttgtcgggtgcgttgtggaatc

SEQ ID NO: 5072 - DNA, 26 bp, Artificial Sequences
  Synthetic
gttgggttgtcgggtgcgttgtggaa

SEQ ID NO: 5073 - DNA, 28 bp, Artificial Sequences
  Synthetic
ggttgtcgggtgcgttgtggaatcgttt

SEQ ID NO: 5074 - DNA, 29 bp, Artificial Sequences
  Synthetic
cgtaggttagcgagggtagtttgagtcgt

SEQ ID NO: 5075 - DNA, 28 bp, Artificial Sequences
  Synthetic
cgtaggttagcgagggtagtttgagtcg

SEQ ID NO: 5076 - DNA, 30 bp, Artificial Sequences
  Synthetic
cgtaggttagcgagggtagtttgagtcgtt

SEQ ID NO: 5077 - DNA, 29 bp, Artificial Sequences
  Synthetic
aggttagcgagggtagtttgagtcgtttt

SEQ ID NO: 5078 - DNA, 29 bp, Artificial Sequences
  Synthetic
gtaggttagcgagggtagtttgagtcgtt

SEQ ID NO: 5079 - DNA, 27 bp, Artificial Sequences
  Synthetic
tttcgggtttttgtcggggagttacgg

SEQ ID NO: 5080 - DNA, 26 bp, Artificial Sequences
  Synthetic
ttcgggtttttgtcggggagttacgg

SEQ ID NO: 5081 - DNA, 27 bp, Artificial Sequences
  Synthetic
ggtattcgcgcgtagttgttttttggc

SEQ ID NO: 5082 - DNA, 28 bp, Artificial Sequences
  Synthetic
cgtagagggttaaaaggtattcgcgcgt

SEQ ID NO: 5083 - DNA, 27 bp, Artificial Sequences
  Synthetic
cgtagagggttaaaaggtattcgcgcg

SEQ ID NO: 5084 - DNA, 27 bp, Artificial Sequences
  Synthetic
agggagtagttgcgcgcggatgttttt

SEQ ID NO: 5085 - DNA, 27 bp, Artificial Sequences
  Synthetic
cgttagggagtagttgcgcgcggatgt

SEQ ID NO: 5086 - DNA, 27 bp, Artificial Sequences
  Synthetic
gttagggagtagttgcgcgcggatgtt

SEQ ID NO: 5087 - DNA, 27 bp, Artificial Sequences
  Synthetic
tagggagtagttgcgcgcggatgtttt

SEQ ID NO: 5088 - DNA, 27 bp, Artificial Sequences
  Synthetic
ttagggagtagttgcgcgcggatgttt

SEQ ID NO: 5089 - DNA, 27 bp, Artificial Sequences
  Synthetic
cggggtagtataggggcgcggagaaat

SEQ ID NO: 5090 - DNA, 26 bp, Artificial Sequences
  Synthetic
cggggtagtataggggcgcggagaaa

SEQ ID NO: 5091 - DNA, 28 bp, Artificial Sequences
  Synthetic
cggggtagtataggggcgcggagaaata

SEQ ID NO: 5092 - DNA, 27 bp, Artificial Sequences
  Synthetic
tttcgggtttttgtcggggagttacgg

SEQ ID NO: 5093 - DNA, 25 bp, Artificial Sequences
  Synthetic
cggggtagtataggggcgcggagaa

SEQ ID NO: 5094 - DNA, 27 bp, Artificial Sequences
  Synthetic
gtttgggtgaagacggaggcgggtttt

SEQ ID NO: 5095 - DNA, 27 bp, Artificial Sequences
  Synthetic
tttgggtgaagacggaggcgggtttta

SEQ ID NO: 5096 - DNA, 26 bp, Artificial Sequences
  Synthetic
gtttgggtgaagacggaggcgggttt

SEQ ID NO: 5097 - DNA, 27 bp, Artificial Sequences
  Synthetic
ttgggtgaagacggaggcgggttttat

SEQ ID NO: 5098 - DNA, 28 bp, Artificial Sequences
  Synthetic
gtttgggtgaagacggaggcgggtttta

SEQ ID NO: 5099 - DNA, 27 bp, Artificial Sequences
  Synthetic
atttttgcgcggagaggttgaggtcgg

SEQ ID NO: 5100 - DNA, 27 bp, Artificial Sequences
  Synthetic
cgcggagaggttgaggtcggttttgga

SEQ ID NO: 5101 - DNA, 27 bp, Artificial Sequences
  Synthetic
ttgcgcggagaggttgaggtcggtttt

SEQ ID NO: 5102 - DNA, 27 bp, Artificial Sequences
  Synthetic
tttgcgcggagaggttgaggtcggttt

SEQ ID NO: 5103 - DNA, 27 bp, Artificial Sequences
  Synthetic
ttttgcgcggagaggttgaggtcggtt

SEQ ID NO: 5104 - DNA, 27 bp, Artificial Sequences
  Synthetic
tggtagggaatggaggtttcgggcgtt

SEQ ID NO: 5105 - DNA, 27 bp, Artificial Sequences
  Synthetic
ttggtagggaatggaggtttcgggcgt

SEQ ID NO: 5106 - DNA, 28 bp, Artificial Sequences
  Synthetic
tggtagggaatggaggtttcgggcgttt

SEQ ID NO: 5107 - DNA, 28 bp, Artificial Sequences
  Synthetic
ttggtagggaatggaggtttcgggcgtt

SEQ ID NO: 5108 - DNA, 28 bp, Artificial Sequences
  Synthetic
tttggtagggaatggaggtttcgggcgt

SEQ ID NO: 5109 - DNA, 27 bp, Artificial Sequences
  Synthetic
tggtagggaatggaggtttcgggcgtt

SEQ ID NO: 5110 - DNA, 27 bp, Artificial Sequences
  Synthetic
ttggtagggaatggaggtttcgggcgt

SEQ ID NO: 5111 - DNA, 28 bp, Artificial Sequences
  Synthetic
tggtagggaatggaggtttcgggcgttt

SEQ ID NO: 5112 - DNA, 28 bp, Artificial Sequences
  Synthetic
ttggtagggaatggaggtttcgggcgtt

SEQ ID NO: 5113 - DNA, 28 bp, Artificial Sequences
  Synthetic
tttggtagggaatggaggtttcgggcgt

SEQ ID NO: 5114 - DNA, 28 bp, Artificial Sequences
  Synthetic
cgcgaggttgggattaggtattttcgga

SEQ ID NO: 5115 - DNA, 28 bp, Artificial Sequences
  Synthetic
tcgcgaggttgggattaggtattttcgg

SEQ ID NO: 5116 - DNA, 29 bp, Artificial Sequences
  Synthetic
tcgcgaggttgggattaggtattttcgga

SEQ ID NO: 5117 - DNA, 29 bp, Artificial Sequences
  Synthetic
cgcgaggttgggattaggtattttcggag

SEQ ID NO: 5118 - DNA, 30 bp, Artificial Sequences
  Synthetic
cgcgaggttgggattaggtattttcggagt

SEQ ID NO: 5119 - DNA, 27 bp, Artificial Sequences
  Synthetic
tagagggggagagtagttcggtcgcgg

SEQ ID NO: 5120 - DNA, 28 bp, Artificial Sequences
  Synthetic
atagagggggagagtagttcggtcgcgg

SEQ ID NO: 5121 - DNA, 27 bp, Artificial Sequences
  Synthetic
atagagggggagagtagttcggtcgcg

SEQ ID NO: 5122 - DNA, 27 bp, Artificial Sequences
  Synthetic
tggtgtttgggcgtatagagggggaga

SEQ ID NO: 5123 - DNA, 28 bp, Artificial Sequences
  Synthetic
gcgattggtgtttgggcgtatagagggg

SEQ ID NO: 5124 - DNA, 27 bp, Artificial Sequences
  Synthetic
gcggtggcgtttggttggtttaagagt

SEQ ID NO: 5125 - DNA, 28 bp, Artificial Sequences
  Synthetic
gcggtggcgtttggttggtttaagagtt

SEQ ID NO: 5126 - DNA, 30 bp, Artificial Sequences
  Synthetic
cggtggcgtttggttggtttaagagttcgg

SEQ ID NO: 5127 - DNA, 29 bp, Artificial Sequences
  Synthetic
gcggtggcgtttggttggtttaagagttc

SEQ ID NO: 5128 - DNA, 29 bp, Artificial Sequences
  Synthetic
cggtggcgtttggttggtttaagagttcg

SEQ ID NO: 5129 - DNA, 27 bp, Artificial Sequences
  Synthetic
gtggtgggagggtggtagaagcggaaa

SEQ ID NO: 5130 - DNA, 27 bp, Artificial Sequences
  Synthetic
gtatagacgtaggtgggcgggtggtgg

SEQ ID NO: 5131 - DNA, 27 bp, Artificial Sequences
  Synthetic
tggtgggagggtggtagaagcggaaag

SEQ ID NO: 5132 - DNA, 27 bp, Artificial Sequences
  Synthetic
ggtgggagggtggtagaagcggaaaga

SEQ ID NO: 5133 - DNA, 27 bp, Artificial Sequences
  Synthetic
tgggagggtggtagaagcggaaagagg

SEQ ID NO: 5134 - DNA, 29 bp, Artificial Sequences
  Synthetic
tggtcggaaggagattgtatgggttgtgt

SEQ ID NO: 5135 - DNA, 28 bp, Artificial Sequences
  Synthetic
ggtcggaaggagattgtatgggttgtgt

SEQ ID NO: 5136 - DNA, 28 bp, Artificial Sequences
  Synthetic
tggtcggaaggagattgtatgggttgtg

SEQ ID NO: 5137 - DNA, 28 bp, Artificial Sequences
  Synthetic
ttggtcggaaggagattgtatgggttgt

SEQ ID NO: 5138 - DNA, 30 bp, Artificial Sequences
  Synthetic
tggtcggaaggagattgtatgggttgtgtt

SEQ ID NO: 5139 - DNA, 28 bp, Artificial Sequences
  Synthetic
gggtgaggtttgggggagggtagtaagg

SEQ ID NO: 5140 - DNA, 27 bp, Artificial Sequences
  Synthetic
agggtgaggtttgggggagggtagtaa

SEQ ID NO: 5141 - DNA, 27 bp, Artificial Sequences
  Synthetic
ttagggtgaggtttgggggagggtagt

SEQ ID NO: 5142 - DNA, 29 bp, Artificial Sequences
  Synthetic
agggtgaggtttgggggagggtagtaagg

SEQ ID NO: 5143 - DNA, 28 bp, Artificial Sequences
  Synthetic
ggtgaggtttgggggagggtagtaaggt

SEQ ID NO: 5144 - DNA, 27 bp, Artificial Sequences
  Synthetic
tggtaaggagtaggacggtcgggaggg

SEQ ID NO: 5145 - DNA, 27 bp, Artificial Sequences
  Synthetic
ggtaaggagtaggacggtcgggaggga

SEQ ID NO: 5146 - DNA, 28 bp, Artificial Sequences
  Synthetic
ttggtaaggagtaggacggtcgggaggg

SEQ ID NO: 5147 - DNA, 27 bp, Artificial Sequences
  Synthetic
ttggtaaggagtaggacggtcgggagg

SEQ ID NO: 5148 - DNA, 28 bp, Artificial Sequences
  Synthetic
tggtaaggagtaggacggtcgggaggga

SEQ ID NO: 5149 - DNA, 33 bp, Artificial Sequences
  Synthetic
gttcggatttacggggatttgtaggggtttatg

SEQ ID NO: 5150 - DNA, 27 bp, Artificial Sequences
  Synthetic
tggtaaggagtaggacggtcgggaggg

SEQ ID NO: 5151 - DNA, 27 bp, Artificial Sequences
  Synthetic
ggtaaggagtaggacggtcgggaggga

SEQ ID NO: 5152 - DNA, 28 bp, Artificial Sequences
  Synthetic
ttggtaaggagtaggacggtcgggaggg

SEQ ID NO: 5153 - DNA, 28 bp, Artificial Sequences
  Synthetic
ggtaaggagtaggacggtcgggagggat

SEQ ID NO: 5154 - DNA, 27 bp, Artificial Sequences
  Synthetic
ttggtaaggagtaggacggtcgggagg

SEQ ID NO: 5155 - DNA, 27 bp, Artificial Sequences
  Synthetic
aaaggttgcggcgggagttttcggttt

SEQ ID NO: 5156 - DNA, 27 bp, Artificial Sequences
  Synthetic
aaaaggttgcggcgggagttttcggtt

SEQ ID NO: 5157 - DNA, 27 bp, Artificial Sequences
  Synthetic
aaggttgcggcgggagttttcggtttg

SEQ ID NO: 5158 - DNA, 27 bp, Artificial Sequences
  Synthetic
taaaaggttgcggcgggagttttcggt

SEQ ID NO: 5159 - DNA, 28 bp, Artificial Sequences
  Synthetic
aaaaggttgcggcgggagttttcggttt

SEQ ID NO: 5160 - DNA, 27 bp, Artificial Sequences
  Synthetic
cgttcgttaggtcgggggttttcgtcg

SEQ ID NO: 5161 - DNA, 27 bp, Artificial Sequences
  Synthetic
gttcgttaggtcgggggttttcgtcgt

SEQ ID NO: 5162 - DNA, 28 bp, Artificial Sequences
  Synthetic
tcgttcgttaggtcgggggttttcgtcg

SEQ ID NO: 5163 - DNA, 27 bp, Artificial Sequences
  Synthetic
tcgttcgttaggtcgggggttttcgtc

SEQ ID NO: 5164 - DNA, 28 bp, Artificial Sequences
  Synthetic
cgttcgttaggtcgggggttttcgtcgt

SEQ ID NO: 5165 - DNA, 27 bp, Artificial Sequences
  Synthetic
aaaggttgcggcgggagttttcggttt

SEQ ID NO: 5166 - DNA, 27 bp, Artificial Sequences
  Synthetic
aaaaggttgcggcgggagttttcggtt

SEQ ID NO: 5167 - DNA, 27 bp, Artificial Sequences
  Synthetic
aaggttgcggcgggagttttcggtttg

SEQ ID NO: 5168 - DNA, 27 bp, Artificial Sequences
  Synthetic
agggtttggatcgggttttgaggggga

SEQ ID NO: 5169 - DNA, 27 bp, Artificial Sequences
  Synthetic
taaaaggttgcggcgggagttttcggt

SEQ ID NO: 5170 - DNA, 27 bp, Artificial Sequences
  Synthetic
cgcgggggattttggtggtttaggggt

SEQ ID NO: 5171 - DNA, 27 bp, Artificial Sequences
  Synthetic
acgcgggggattttggtggtttagggg

SEQ ID NO: 5172 - DNA, 26 bp, Artificial Sequences
  Synthetic
cgcgggggattttggtggtttagggg

SEQ ID NO: 5173 - DNA, 27 bp, Artificial Sequences
  Synthetic
tacgcgggggattttggtggtttaggg

SEQ ID NO: 5174 - DNA, 28 bp, Artificial Sequences
  Synthetic
tacgcgggggattttggtggtttagggg

SEQ ID NO: 5175 - DNA, 27 bp, Artificial Sequences
  Synthetic
gagacgtaggattgttttgcgggcggg

SEQ ID NO: 5176 - DNA, 27 bp, Artificial Sequences
  Synthetic
ggagacgtaggattgttttgcgggcgg

SEQ ID NO: 5177 - DNA, 27 bp, Artificial Sequences
  Synthetic
gggcgggcggttttggagggatttatt

SEQ ID NO: 5178 - DNA, 27 bp, Artificial Sequences
  Synthetic
cgggcgggcggttttggagggatttat

SEQ ID NO: 5179 - DNA, 27 bp, Artificial Sequences
  Synthetic
agacgtaggattgttttgcgggcgggc

SEQ ID NO: 5180 - DNA, 27 bp, Artificial Sequences
  Synthetic
gcgggggattttggtggtttaggggtt

SEQ ID NO: 5181 - DNA, 27 bp, Artificial Sequences
  Synthetic
cgcgggggattttggtggtttaggggt

SEQ ID NO: 5182 - DNA, 27 bp, Artificial Sequences
  Synthetic
acgcgggggattttggtggtttagggg

SEQ ID NO: 5183 - DNA, 26 bp, Artificial Sequences
  Synthetic
cgcgggggattttggtggtttagggg

SEQ ID NO: 5184 - DNA, 27 bp, Artificial Sequences
  Synthetic
tacgcgggggattttggtggtttaggg

SEQ ID NO: 5185 - DNA, 27 bp, Artificial Sequences
  Synthetic
gagacgtaggattgttttgcgggcggg

SEQ ID NO: 5186 - DNA, 27 bp, Artificial Sequences
  Synthetic
ggagacgtaggattgttttgcgggcgg

SEQ ID NO: 5187 - DNA, 27 bp, Artificial Sequences
  Synthetic
ttaaggattacgggagcggttcggggg

SEQ ID NO: 5188 - DNA, 27 bp, Artificial Sequences
  Synthetic
agacgtaggattgttttgcgggcgggt

SEQ ID NO: 5189 - DNA, 28 bp, Artificial Sequences
  Synthetic
tttaaggattacgggagcggttcggggg

SEQ ID NO: 5190 - DNA, 29 bp, Artificial Sequences
  Synthetic
ggtttaggtttaggcggtggaggtttcgg

SEQ ID NO: 5191 - DNA, 27 bp, Artificial Sequences
  Synthetic
tttaggtttaggcggtggaggtttcgg

SEQ ID NO: 5192 - DNA, 24 bp, Artificial Sequences
  Synthetic
cggtggaggtttcggcgtggtagc

SEQ ID NO: 5193 - DNA, 24 bp, Artificial Sequences
  Synthetic
gcggtggaggtttcggcgtggtag

SEQ ID NO: 5194 - DNA, 30 bp, Artificial Sequences
  Synthetic
aggtttaggtttaggcggtggaggtttcgg

SEQ ID NO: 5195 - DNA, 33 bp, Artificial Sequences
  Synthetic
cggagagggggtttttgaatttggatttttggg

SEQ ID NO: 5196 - DNA, 34 bp, Artificial Sequences
  Synthetic
cggagagggggtttttgaatttggatttttggga

SEQ ID NO: 5197 - DNA, 34 bp, Artificial Sequences
  Synthetic
tcggagagggggtttttgaatttggatttttggg

SEQ ID NO: 5198 - DNA, 32 bp, Artificial Sequences
  Synthetic
cggagagggggtttttgaatttggatttttgg

SEQ ID NO: 5199 - DNA, 32 bp, Artificial Sequences
  Synthetic
ggagagggggtttttgaatttggatttttggg

SEQ ID NO: 5200 - DNA, 27 bp, Artificial Sequences
  Synthetic
gcgtggtagcgtcgggtttgtttatgt

SEQ ID NO: 5201 - DNA, 28 bp, Artificial Sequences
  Synthetic
gcgtggtagcgtcgggtttgtttatgtt

SEQ ID NO: 5202 - DNA, 29 bp, Artificial Sequences
  Synthetic
ggtttaggtttaggcggtggaggtttcgg

SEQ ID NO: 5203 - DNA, 27 bp, Artificial Sequences
  Synthetic
tttaggtttaggcggtggaggtttcgg

SEQ ID NO: 5204 - DNA, 24 bp, Artificial Sequences
  Synthetic
gcggtggaggtttcggcgtggtag

SEQ ID NO: 5205 - DNA, 27 bp, Artificial Sequences
  Synthetic
ttttttgcgtttgaggcgggcgggttt

SEQ ID NO: 5206 - DNA, 27 bp, Artificial Sequences
  Synthetic
tttttgcgtttgaggcgggcgggtttc

SEQ ID NO: 5207 - DNA, 26 bp, Artificial Sequences
  Synthetic
tttttgcgtttgaggcgggcgggttt

SEQ ID NO: 5208 - DNA, 26 bp, Artificial Sequences
  Synthetic
ttttttgcgtttgaggcgggcgggtt

SEQ ID NO: 5209 - DNA, 26 bp, Artificial Sequences
  Synthetic
ttttgcgtttgaggcgggcgggtttc

SEQ ID NO: 5210 - DNA, 27 bp, Artificial Sequences
  Synthetic
ttgtcgtcggttttgggtagggcgagt

SEQ ID NO: 5211 - DNA, 27 bp, Artificial Sequences
  Synthetic
ggtttgtcgtcggttttgggtagggcg

SEQ ID NO: 5212 - DNA, 27 bp, Artificial Sequences
  Synthetic
gcgtttgtagttggggcgttttggggt

SEQ ID NO: 5213 - DNA, 27 bp, Artificial Sequences
  Synthetic
gggtttgtcgtcggttttgggtagggc

SEQ ID NO: 5214 - DNA, 27 bp, Artificial Sequences
  Synthetic
ggaaaggcgcgggttaggggtgtagtt

SEQ ID NO: 5215 - DNA, 27 bp, Artificial Sequences
  Synthetic
ttcgggtttttgggacgttcgttgggg

SEQ ID NO: 5216 - DNA, 27 bp, Artificial Sequences
  Synthetic
tcgggtttttgggacgttcgttggggg

SEQ ID NO: 5217 - DNA, 28 bp, Artificial Sequences
  Synthetic
tttcgggtttttgggacgttcgttgggg

SEQ ID NO: 5218 - DNA, 26 bp, Artificial Sequences
  Synthetic
cgggtttttgggacgttcgttggggg

SEQ ID NO: 5219 - DNA, 26 bp, Artificial Sequences
  Synthetic
tcgggtttttgggacgttcgttgggg

SEQ ID NO: 5220 - DNA, 27 bp, Artificial Sequences
  Synthetic
ttgtcgtcggttttgggtagggcgagt

SEQ ID NO: 5221 - DNA, 27 bp, Artificial Sequences
  Synthetic
ggtttgtcgtcggttttgggtagggcg

SEQ ID NO: 5222 - DNA, 27 bp, Artificial Sequences
  Synthetic
gcgtttgtagttggggcgttttggggt

SEQ ID NO: 5223 - DNA, 27 bp, Artificial Sequences
  Synthetic
gggtttgtcgtcggttttgggtagggc

SEQ ID NO: 5224 - DNA, 27 bp, Artificial Sequences
  Synthetic
ggaaaggcgcgggttaggggtgtagtt

SEQ ID NO: 5225 - DNA, 27 bp, Artificial Sequences
  Synthetic
ttcgggtttttgggacgttcgttgggg

SEQ ID NO: 5226 - DNA, 27 bp, Artificial Sequences
  Synthetic
tcgggtttttgggacgttcgttggggg

SEQ ID NO: 5227 - DNA, 28 bp, Artificial Sequences
  Synthetic
tttcgggtttttgggacgttcgttgggg

SEQ ID NO: 5228 - DNA, 26 bp, Artificial Sequences
  Synthetic
cgggtttttgggacgttcgttggggg

SEQ ID NO: 5229 - DNA, 27 bp, Artificial Sequences
  Synthetic
cgggtttttgggacgttcgttgggggt

SEQ ID NO: 5230 - DNA, 29 bp, Artificial Sequences
  Synthetic
tggggtatggaagtttgacgggaagaggg

SEQ ID NO: 5231 - DNA, 28 bp, Artificial Sequences
  Synthetic
ggggtatggaagtttgacgggaagaggg

SEQ ID NO: 5232 - DNA, 29 bp, Artificial Sequences
  Synthetic
ggggtatggaagtttgacgggaagaggga

SEQ ID NO: 5233 - DNA, 30 bp, Artificial Sequences
  Synthetic
tggggtatggaagtttgacgggaagaggga

SEQ ID NO: 5234 - DNA, 28 bp, Artificial Sequences
  Synthetic
tggggtatggaagtttgacgggaagagg

SEQ ID NO: 5235 - DNA, 27 bp, Artificial Sequences
  Synthetic
agtgcgtgcggtttttggtattggggt

SEQ ID NO: 5236 - DNA, 28 bp, Artificial Sequences
  Synthetic
gagtgcgtgcggtttttggtattggggt

SEQ ID NO: 5237 - DNA, 27 bp, Artificial Sequences
  Synthetic
gagtgcgtgcggtttttggtattgggg

SEQ ID NO: 5238 - DNA, 27 bp, Artificial Sequences
  Synthetic
ggagtgcgtgcggtttttggtattggg

SEQ ID NO: 5239 - DNA, 27 bp, Artificial Sequences
  Synthetic
gtgcgtgcggtttttggtattggggtt

SEQ ID NO: 5240 - DNA, 27 bp, Artificial Sequences
  Synthetic
tttgtcgggtggtttttgcgtggttga

SEQ ID NO: 5241 - DNA, 28 bp, Artificial Sequences
  Synthetic
gggtaatgaagttggaggtaggcgtgcg

SEQ ID NO: 5242 - DNA, 28 bp, Artificial Sequences
  Synthetic
cgggtaatgaagttggaggtaggcgtgc

SEQ ID NO: 5243 - DNA, 27 bp, Artificial Sequences
  Synthetic
tgtcgggtggtttttgcgtggttgatt

SEQ ID NO: 5244 - DNA, 27 bp, Artificial Sequences
  Synthetic
ttgtcgggtggtttttgcgtggttgat

SEQ ID NO: 5245 - DNA, 27 bp, Artificial Sequences
  Synthetic
gtagagcggttcgatgaggggttgtgt

SEQ ID NO: 5246 - DNA, 28 bp, Artificial Sequences
  Synthetic
agtagagcggttcgatgaggggttgtgt

SEQ ID NO: 5247 - DNA, 27 bp, Artificial Sequences
  Synthetic
agtagagcggttcgatgaggggttgtg

SEQ ID NO: 5248 - DNA, 27 bp, Artificial Sequences
  Synthetic
agagcggttcgatgaggggttgtgtta

SEQ ID NO: 5249 - DNA, 27 bp, Artificial Sequences
  Synthetic
tagagcggttcgatgaggggttgtgtt

SEQ ID NO: 5250 - DNA, 27 bp, Artificial Sequences
  Synthetic
tagatgggttagtcgggatgcggtgcg

SEQ ID NO: 5251 - DNA, 28 bp, Artificial Sequences
  Synthetic
atagatgggttagtcgggatgcggtgcg

SEQ ID NO: 5252 - DNA, 26 bp, Artificial Sequences
  Synthetic
agatgggttagtcgggatgcggtgcg

SEQ ID NO: 5253 - DNA, 27 bp, Artificial Sequences
  Synthetic
atagatgggttagtcgggatgcggtgc

SEQ ID NO: 5254 - DNA, 25 bp, Artificial Sequences
  Synthetic
gatgggttagtcgggatgcggtgcg

SEQ ID NO: 5255 - DNA, 27 bp, Artificial Sequences
  Synthetic
acgaggggttgaggttgtggtgggaag

SEQ ID NO: 5256 - DNA, 27 bp, Artificial Sequences
  Synthetic
gggttgaggttgtggtgggaagcgaga

SEQ ID NO: 5257 - DNA, 27 bp, Artificial Sequences
  Synthetic
ggtgggaagcgagaaagaggaggtggt

SEQ ID NO: 5258 - DNA, 27 bp, Artificial Sequences
  Synthetic
tggtgggaagcgagaaagaggaggtgg

SEQ ID NO: 5259 - DNA, 27 bp, Artificial Sequences
  Synthetic
ttttgcggtgtgaggtgtgaacgaggg

SEQ ID NO: 5260 - DNA, 26 bp, Artificial Sequences
  Synthetic
ggtgcgcgcgtttgagggtaaaggac

SEQ ID NO: 5261 - DNA, 25 bp, Artificial Sequences
  Synthetic
ggtgcgcgcgtttgagggtaaagga

SEQ ID NO: 5262 - DNA, 27 bp, Artificial Sequences
  Synthetic
cggtgcgcgcgtttgagggtaaaggac

SEQ ID NO: 5263 - DNA, 26 bp, Artificial Sequences
  Synthetic
cggtgcgcgcgtttgagggtaaagga

SEQ ID NO: 5264 - DNA, 25 bp, Artificial Sequences
  Synthetic
cggtgcgcgcgtttgagggtaaagg

SEQ ID NO: 5265 - DNA, 27 bp, Artificial Sequences
  Synthetic
tattcgtagcggggttggtttcgggcg

SEQ ID NO: 5266 - DNA, 27 bp, Artificial Sequences
  Synthetic
atattcgtagcggggttggtttcgggc

SEQ ID NO: 5267 - DNA, 27 bp, Artificial Sequences
  Synthetic
gcgcgagtggggaaaggtttaggagtt

SEQ ID NO: 5268 - DNA, 28 bp, Artificial Sequences
  Synthetic
atattcgtagcggggttggtttcgggcg

SEQ ID NO: 5269 - DNA, 28 bp, Artificial Sequences
  Synthetic
aatattcgtagcggggttggtttcgggc

SEQ ID NO: 5270 - DNA, 27 bp, Artificial Sequences
  Synthetic
ttttgaaggtgtttgttgcggcgcgtg

SEQ ID NO: 5271 - DNA, 27 bp, Artificial Sequences
  Synthetic
tttttgaaggtgtttgttgcggcgcgt

SEQ ID NO: 5272 - DNA, 27 bp, Artificial Sequences
  Synthetic
tttgaaggtgtttgttgcggcgcgtgg

SEQ ID NO: 5273 - DNA, 28 bp, Artificial Sequences
  Synthetic
tttttgaaggtgtttgttgcggcgcgtg

SEQ ID NO: 5274 - DNA, 26 bp, Artificial Sequences
  Synthetic
tttgaaggtgtttgttgcggcgcgtg

SEQ ID NO: 5275 - DNA, 27 bp, Artificial Sequences
  Synthetic
tattcgtagcggggttggtttcgggcg

SEQ ID NO: 5276 - DNA, 27 bp, Artificial Sequences
  Synthetic
atattcgtagcggggttggtttcgggc

SEQ ID NO: 5277 - DNA, 27 bp, Artificial Sequences
  Synthetic
gcgcgagtggggaaaggtttaggagtt

SEQ ID NO: 5278 - DNA, 28 bp, Artificial Sequences
  Synthetic
atattcgtagcggggttggtttcgggcg

SEQ ID NO: 5279 - DNA, 28 bp, Artificial Sequences
  Synthetic
aatattcgtagcggggttggtttcgggc

SEQ ID NO: 5280 - DNA, 27 bp, Artificial Sequences
  Synthetic
ttttgaaggtgtttgttgcggcgcgtg

SEQ ID NO: 5281 - DNA, 27 bp, Artificial Sequences
  Synthetic
tttttgaaggtgtttgttgcggcgcgt

SEQ ID NO: 5282 - DNA, 27 bp, Artificial Sequences
  Synthetic
tttgaaggtgtttgttgcggcgcgtgg

SEQ ID NO: 5283 - DNA, 28 bp, Artificial Sequences
  Synthetic
tttttgaaggtgtttgttgcggcgcgtg

SEQ ID NO: 5284 - DNA, 26 bp, Artificial Sequences
  Synthetic
tttgaaggtgtttgttgcggcgcgtg

SEQ ID NO: 5285 - DNA, 27 bp, Artificial Sequences
  Synthetic
tattcgtagcggggttggtttcgggcg

SEQ ID NO: 5286 - DNA, 27 bp, Artificial Sequences
  Synthetic
atattcgtagcggggttggtttcgggc

SEQ ID NO: 5287 - DNA, 27 bp, Artificial Sequences
  Synthetic
gcgcgagtggggaaaggtttaggagtt

SEQ ID NO: 5288 - DNA, 28 bp, Artificial Sequences
  Synthetic
atattcgtagcggggttggtttcgggcg

SEQ ID NO: 5289 - DNA, 28 bp, Artificial Sequences
  Synthetic
aatattcgtagcggggttggtttcgggc

SEQ ID NO: 5290 - DNA, 26 bp, Artificial Sequences
  Synthetic
cgttttgaaggtttcgcgtcgggttc

SEQ ID NO: 5291 - DNA, 27 bp, Artificial Sequences
  Synthetic
gttttttgaaggtgtttgttgcggcgt

SEQ ID NO: 5292 - DNA, 28 bp, Artificial Sequences
  Synthetic
agttttttgaaggtgtttgttgcggcgt

SEQ ID NO: 5293 - DNA, 27 bp, Artificial Sequences
  Synthetic
agttttttgaaggtgtttgttgcggcg

SEQ ID NO: 5294 - DNA, 29 bp, Artificial Sequences
  Synthetic
aagttttttgaaggtgtttgttgcggcgt

SEQ ID NO: 5295 - DNA, 27 bp, Artificial Sequences
  Synthetic
tgttagcgaggatgtgggttgtcggga

SEQ ID NO: 5296 - DNA, 28 bp, Artificial Sequences
  Synthetic
gcgaggatgtgggttgtcgggaaaaacg

SEQ ID NO: 5297 - DNA, 27 bp, Artificial Sequences
  Synthetic
ttgttagcgaggatgtgggttgtcggg

SEQ ID NO: 5298 - DNA, 27 bp, Artificial Sequences
  Synthetic
agcgaggatgtgggttgtcgggaaaaa

SEQ ID NO: 5299 - DNA, 28 bp, Artificial Sequences
  Synthetic
cgaggatgtgggttgtcgggaaaaacgg

SEQ ID NO: 5300 - DNA, 27 bp, Artificial Sequences
  Synthetic
gtcgggaagggcgggttataggttggg

SEQ ID NO: 5301 - DNA, 27 bp, Artificial Sequences
  Synthetic
ggaagggcgggttataggttgggggtg

SEQ ID NO: 5302 - DNA, 27 bp, Artificial Sequences
  Synthetic
agtcgggaagggcgggttataggttgg

SEQ ID NO: 5303 - DNA, 27 bp, Artificial Sequences
  Synthetic
gttataggttgggggtgcgagcggagg

SEQ ID NO: 5304 - DNA, 27 bp, Artificial Sequences
  Synthetic
ggttataggttgggggtgcgagcggag

SEQ ID NO: 5305 - DNA, 28 bp, Artificial Sequences
  Synthetic
cgtcgtcgcggttgttatttcgtttttc

SEQ ID NO: 5306 - DNA, 27 bp, Artificial Sequences
  Synthetic
gtgcgagcgggtagggaggattcgatt

SEQ ID NO: 5307 - DNA, 27 bp, Artificial Sequences
  Synthetic
tgcgagcgggtagggaggattcgattt

SEQ ID NO: 5308 - DNA, 26 bp, Artificial Sequences
  Synthetic
gtgcgagcgggtagggaggattcgat

SEQ ID NO: 5309 - DNA, 28 bp, Artificial Sequences
  Synthetic
gtgcgagcgggtagggaggattcgattt

SEQ ID NO: 5310 - DNA, 26 bp, Artificial Sequences
  Synthetic
tgcgagcgggtagggaggattcgatt

SEQ ID NO: 5311 - DNA, 27 bp, Artificial Sequences
  Synthetic
cggagtcgttgtggggaattttttcgc

SEQ ID NO: 5312 - DNA, 28 bp, Artificial Sequences
  Synthetic
cgtcgtcgcggttgttatttcgtttttc

SEQ ID NO: 5313 - DNA, 29 bp, Artificial Sequences
  Synthetic
cggagttttagtaataatttcggcgcggc

SEQ ID NO: 5314 - DNA, 27 bp, Artificial Sequences
  Synthetic
gtgcgagcgggtagggaggattcgatt

SEQ ID NO: 5315 - DNA, 27 bp, Artificial Sequences
  Synthetic
ggggttatcggagggttttcggtcggt

SEQ ID NO: 5316 - DNA, 27 bp, Artificial Sequences
  Synthetic
aggggttatcggagggttttcggtcgg

SEQ ID NO: 5317 - DNA, 27 bp, Artificial Sequences
  Synthetic
tcgaggggttaggggttatcggagggt

SEQ ID NO: 5318 - DNA, 27 bp, Artificial Sequences
  Synthetic
tgcgagcgggtagggaggattcgattt

SEQ ID NO: 5319 - DNA, 27 bp, Artificial Sequences
  Synthetic
cggagtcgttgtggggaattttttcgc

SEQ ID NO: 5320 - DNA, 27 bp, Artificial Sequences
  Synthetic
attttttcgcgttttgtttgggtcggg

SEQ ID NO: 5321 - DNA, 31 bp, Artificial Sequences
  Synthetic
gggaattttttcgcgttttgtttgggtcggg

SEQ ID NO: 5322 - DNA, 28 bp, Artificial Sequences
  Synthetic
aattttttcgcgttttgtttgggtcggg

SEQ ID NO: 5323 - DNA, 26 bp, Artificial Sequences
  Synthetic
cgcgttttgtttgggtcgggtttttt

SEQ ID NO: 5324 - DNA, 27 bp, Artificial Sequences
  Synthetic
ggggttatcggagggttttcggtcggt

SEQ ID NO: 5325 - DNA, 27 bp, Artificial Sequences
  Synthetic
aggggttatcggagggttttcggtcgg

SEQ ID NO: 5326 - DNA, 27 bp, Artificial Sequences
  Synthetic
tcgaggggttaggggttatcggagggt

SEQ ID NO: 5327 - DNA, 27 bp, Artificial Sequences
  Synthetic
cgaggggttaggggttatcggagggtt

SEQ ID NO: 5328 - DNA, 27 bp, Artificial Sequences
  Synthetic
gcgtttcgaggggttaggggttatcgg

SEQ ID NO: 5329 - DNA, 27 bp, Artificial Sequences
  Synthetic
cgttgtcggtcggggatttttcggtgg

SEQ ID NO: 5330 - DNA, 27 bp, Artificial Sequences
  Synthetic
ggcgttgtggatgttgttggcgtaggt

SEQ ID NO: 5331 - DNA, 27 bp, Artificial Sequences
  Synthetic
gtttggcggcgttgtggatgttgttgg

SEQ ID NO: 5332 - DNA, 27 bp, Artificial Sequences
  Synthetic
ggtttggcggcgttgtggatgttgttg

SEQ ID NO: 5333 - DNA, 27 bp, Artificial Sequences
  Synthetic
cggtagcgtttgggagttcgagcgttt

SEQ ID NO: 5334 - DNA, 27 bp, Artificial Sequences
  Synthetic
ggagaggagtcgcgggggattcgtttt

SEQ ID NO: 5335 - DNA, 27 bp, Artificial Sequences
  Synthetic
gcgttggtgggagcgttcgggatttat

SEQ ID NO: 5336 - DNA, 26 bp, Artificial Sequences
  Synthetic
ggagaggagtcgcgggggattcgttt

SEQ ID NO: 5337 - DNA, 27 bp, Artificial Sequences
  Synthetic
aggagcgtttcgaggggttaggggtta

SEQ ID NO: 5338 - DNA, 27 bp, Artificial Sequences
  Synthetic
taggagcgtttcgaggggttaggggtt

SEQ ID NO: 5339 - DNA, 27 bp, Artificial Sequences
  Synthetic
tttcgcgtgtgatgggggttgtttggg

SEQ ID NO: 5340 - DNA, 27 bp, Artificial Sequences
  Synthetic
aggtgggtgaggagtttttaggcgcgt

SEQ ID NO: 5341 - DNA, 27 bp, Artificial Sequences
  Synthetic
gtgatgggggttgtttgggtggggttg

SEQ ID NO: 5342 - DNA, 27 bp, Artificial Sequences
  Synthetic
tgatgggggttgtttgggtggggttgt

SEQ ID NO: 5343 - DNA, 27 bp, Artificial Sequences
  Synthetic
tgtgatgggggttgtttgggtggggtt

SEQ ID NO: 5344 - DNA, 28 bp, Artificial Sequences
  Synthetic
tgagtgttcggggtttgggtagtgttgt

SEQ ID NO: 5345 - DNA, 27 bp, Artificial Sequences
  Synthetic
gagtgttcggggtttgggtagtgttgt

SEQ ID NO: 5346 - DNA, 27 bp, Artificial Sequences
  Synthetic
tgagtgttcggggtttgggtagtgttg

SEQ ID NO: 5347 - DNA, 29 bp, Artificial Sequences
  Synthetic
tggttggtatttggtcgtttgtaggcggt

SEQ ID NO: 5348 - DNA, 28 bp, Artificial Sequences
  Synthetic
ggttggtatttggtcgtttgtaggcggt

SEQ ID NO: 5349 - DNA, 27 bp, Artificial Sequences
  Synthetic
tttcgcgtgtgatgggggttgtttggg

SEQ ID NO: 5350 - DNA, 27 bp, Artificial Sequences
  Synthetic
aggtgggtgaggagtttttaggcgcgt

SEQ ID NO: 5351 - DNA, 27 bp, Artificial Sequences
  Synthetic
gtgatgggggttgtttgggtggggttg

SEQ ID NO: 5352 - DNA, 27 bp, Artificial Sequences
  Synthetic
tgatgggggttgtttgggtggggttgt

SEQ ID NO: 5353 - DNA, 27 bp, Artificial Sequences
  Synthetic
tgtgatgggggttgtttgggtggggtt

SEQ ID NO: 5354 - DNA, 28 bp, Artificial Sequences
  Synthetic
acggttggggtgttttggcgttaagagc

SEQ ID NO: 5355 - DNA, 27 bp, Artificial Sequences
  Synthetic
cggttggggtgttttggcgttaagagc

SEQ ID NO: 5356 - DNA, 27 bp, Artificial Sequences
  Synthetic
ggacggttggggtgttttggcgttaag

SEQ ID NO: 5357 - DNA, 28 bp, Artificial Sequences
  Synthetic
ggacggttggggtgttttggcgttaaga

SEQ ID NO: 5358 - DNA, 27 bp, Artificial Sequences
  Synthetic
acggttggggtgttttggcgttaagag

SEQ ID NO: 5359 - DNA, 26 bp, Artificial Sequences
  Synthetic
gattttagatcgcgggggtgtggggc

SEQ ID NO: 5360 - DNA, 25 bp, Artificial Sequences
  Synthetic
attttagatcgcgggggtgtggggc

SEQ ID NO: 5361 - DNA, 28 bp, Artificial Sequences
  Synthetic
cgtcggggatttgttatttgggttcggt

SEQ ID NO: 5362 - DNA, 27 bp, Artificial Sequences
  Synthetic
cgtcggggatttgttatttgggttcgg

SEQ ID NO: 5363 - DNA, 29 bp, Artificial Sequences
  Synthetic
tcgtcggggatttgttatttgggttcggt

SEQ ID NO: 5364 - DNA, 26 bp, Artificial Sequences
  Synthetic
gcggttttgggcggcgtttgtttttt

SEQ ID NO: 5365 - DNA, 25 bp, Artificial Sequences
  Synthetic
gcggttttgggcggcgtttgttttt

SEQ ID NO: 5366 - DNA, 27 bp, Artificial Sequences
  Synthetic
ggtttaaggtcggtagcgattttgggg

SEQ ID NO: 5367 - DNA, 28 bp, Artificial Sequences
  Synthetic
ggtttaaggtcggtagcgattttgggga

SEQ ID NO: 5368 - DNA, 24 bp, Artificial Sequences
  Synthetic
gcggttttgggcggcgtttgtttt

SEQ ID NO: 5369 - DNA, 27 bp, Artificial Sequences
  Synthetic
gtggggcgtcggggaaggagatagaag

SEQ ID NO: 5370 - DNA, 27 bp, Artificial Sequences
  Synthetic
tatttggggttgcgttttgggtgggcg

SEQ ID NO: 5371 - DNA, 27 bp, Artificial Sequences
  Synthetic
tagggtcgcggggatatttggggttgc

SEQ ID NO: 5372 - DNA, 27 bp, Artificial Sequences
  Synthetic
tgtggggcgtcggggaaggagatagaa

SEQ ID NO: 5373 - DNA, 27 bp, Artificial Sequences
  Synthetic
ggggcgtcggggaaggagatagaagga

SEQ ID NO: 5374 - DNA, 28 bp, Artificial Sequences
  Synthetic
ggttttcggttagggggagttagggcgt

SEQ ID NO: 5375 - DNA, 27 bp, Artificial Sequences
  Synthetic
ggttttcggttagggggagttagggcg

SEQ ID NO: 5376 - DNA, 27 bp, Artificial Sequences
  Synthetic
gttttcggttagggggagttagggcgt

SEQ ID NO: 5377 - DNA, 29 bp, Artificial Sequences
  Synthetic
ggttttcggttagggggagttagggcgta

SEQ ID NO: 5378 - DNA, 27 bp, Artificial Sequences
  Synthetic
ttttcggttagggggagttagggcgta

SEQ ID NO: 5379 - DNA, 27 bp, Artificial Sequences
  Synthetic
gggcgggttggaagtgggggatttttt

SEQ ID NO: 5380 - DNA, 27 bp, Artificial Sequences
  Synthetic
cgggcgggttggaagtgggggattttt

SEQ ID NO: 5381 - DNA, 26 bp, Artificial Sequences
  Synthetic
gggcgggttggaagtgggggattttt

SEQ ID NO: 5382 - DNA, 28 bp, Artificial Sequences
  Synthetic
gggcgggttggaagtgggggatttttta

SEQ ID NO: 5383 - DNA, 26 bp, Artificial Sequences
  Synthetic
cgggcgggttggaagtgggggatttt

SEQ ID NO: 5384 - DNA, 27 bp, Artificial Sequences
  Synthetic
agcgttgcgtcgtttggagaggggtta

SEQ ID NO: 5385 - DNA, 27 bp, Artificial Sequences
  Synthetic
tagcgttgcgtcgtttggagaggggtt

SEQ ID NO: 5386 - DNA, 27 bp, Artificial Sequences
  Synthetic
gcgttgcgtcgtttggagaggggttat

SEQ ID NO: 5387 - DNA, 27 bp, Artificial Sequences
  Synthetic
gtagcgttgcgtcgtttggagaggggt

SEQ ID NO: 5388 - DNA, 26 bp, Artificial Sequences
  Synthetic
tagcgttgcgtcgtttggagaggggt

SEQ ID NO: 5389 - DNA, 27 bp, Artificial Sequences
  Synthetic
gggaagtagggggtaggggagaggtcg

SEQ ID NO: 5390 - DNA, 27 bp, Artificial Sequences
  Synthetic
tattggatgggtcggtgggatgtggcg

SEQ ID NO: 5391 - DNA, 27 bp, Artificial Sequences
  Synthetic
tgggaagtagggggtaggggagaggtc

SEQ ID NO: 5392 - DNA, 27 bp, Artificial Sequences
  Synthetic
cgtgagttgggaagtagggggtagggg

SEQ ID NO: 5393 - DNA, 27 bp, Artificial Sequences
  Synthetic
ttgggaagtagggggtaggggagaggt

SEQ ID NO: 5394 - DNA, 27 bp, Artificial Sequences
  Synthetic
tggaagtggcggttatagtttcgggtt

SEQ ID NO: 5395 - DNA, 28 bp, Artificial Sequences
  Synthetic
tgtttagttagttcgggcgcgtttaggg

SEQ ID NO: 5396 - DNA, 27 bp, Artificial Sequences
  Synthetic
gtttagttagttcgggcgcgtttaggg

SEQ ID NO: 5397 - DNA, 28 bp, Artificial Sequences
  Synthetic
tggaagtggcggttatagtttcgggttt

SEQ ID NO: 5398 - DNA, 29 bp, Artificial Sequences
  Synthetic
ttgtttagttagttcgggcgcgtttaggg

SEQ ID NO: 5399 - DNA, 27 bp, Artificial Sequences
  Synthetic
gggaagtagggggtaggggagaggtcg

SEQ ID NO: 5400 - DNA, 27 bp, Artificial Sequences
  Synthetic
tattggatgggtcggtgggatgtggcg

SEQ ID NO: 5401 - DNA, 27 bp, Artificial Sequences
  Synthetic
tgggaagtagggggtaggggagaggtc

SEQ ID NO: 5402 - DNA, 27 bp, Artificial Sequences
  Synthetic
cgtgagttgggaagtagggggtagggg

SEQ ID NO: 5403 - DNA, 27 bp, Artificial Sequences
  Synthetic
ttgggaagtagggggtaggggagaggt

SEQ ID NO: 5404 - DNA, 27 bp, Artificial Sequences
  Synthetic
ggagcgagggtttggaagtggcggtta

SEQ ID NO: 5405 - DNA, 27 bp, Artificial Sequences
  Synthetic
gagcgagggtttggaagtggcggttat

SEQ ID NO: 5406 - DNA, 28 bp, Artificial Sequences
  Synthetic
ggagcgagggtttggaagtggcggttat

SEQ ID NO: 5407 - DNA, 27 bp, Artificial Sequences
  Synthetic
agcgagggtttggaagtggcggttata

SEQ ID NO: 5408 - DNA, 26 bp, Artificial Sequences
  Synthetic
gagcgagggtttggaagtggcggtta

SEQ ID NO: 5409 - DNA, 27 bp, Artificial Sequences
  Synthetic
tggttgagtagtggagcgggaaagggc

SEQ ID NO: 5410 - DNA, 27 bp, Artificial Sequences
  Synthetic
ggttgagtagtggagcgggaaagggcg

SEQ ID NO: 5411 - DNA, 27 bp, Artificial Sequences
  Synthetic
gttgagtagtggagcgggaaagggcgc

SEQ ID NO: 5412 - DNA, 28 bp, Artificial Sequences
  Synthetic
ttggttgagtagtggagcgggaaagggc

SEQ ID NO: 5413 - DNA, 26 bp, Artificial Sequences
  Synthetic
ttgagtagtggagcgggaaagggcgc

SEQ ID NO: 5414 - DNA, 27 bp, Artificial Sequences
  Synthetic
ggagcgagggtttggaagtggcggtta

SEQ ID NO: 5415 - DNA, 27 bp, Artificial Sequences
  Synthetic
gagcgagggtttggaagtggcggttat

SEQ ID NO: 5416 - DNA, 28 bp, Artificial Sequences
  Synthetic
ggagcgagggtttggaagtggcggttat

SEQ ID NO: 5417 - DNA, 27 bp, Artificial Sequences
  Synthetic
agcgagggtttggaagtggcggttata

SEQ ID NO: 5418 - DNA, 27 bp, Artificial Sequences
  Synthetic
cgagggcgggatagatagggagaggat

SEQ ID NO: 5419 - DNA, 27 bp, Artificial Sequences
  Synthetic
ttaggttggtttggggtacgtgcgggg

SEQ ID NO: 5420 - DNA, 27 bp, Artificial Sequences
  Synthetic
attaggttggtttggggtacgtgcggg

SEQ ID NO: 5421 - DNA, 26 bp, Artificial Sequences
  Synthetic
gtttggggtacgtgcggggttggttg

SEQ ID NO: 5422 - DNA, 26 bp, Artificial Sequences
  Synthetic
gttggtttggggtacgtgcggggttg

SEQ ID NO: 5423 - DNA, 26 bp, Artificial Sequences
  Synthetic
taggttggtttggggtacgtgcgggg

SEQ ID NO: 5424 - DNA, 27 bp, Artificial Sequences
  Synthetic
cgtcggtaagaggtttttcgaggcgtt

SEQ ID NO: 5425 - DNA, 28 bp, Artificial Sequences
  Synthetic
cgtcggtaagaggtttttcgaggcgttc

SEQ ID NO: 5426 - DNA, 28 bp, Artificial Sequences
  Synthetic
tgggatgtcgtggttgtttgtttggtgt

SEQ ID NO: 5427 - DNA, 27 bp, Artificial Sequences
  Synthetic
gggatgtcgtggttgtttgtttggtgt

SEQ ID NO: 5428 - DNA, 27 bp, Artificial Sequences
  Synthetic
tgggatgtcgtggttgtttgtttggtg

SEQ ID NO: 5429 - DNA, 27 bp, Artificial Sequences
  Synthetic
cggcgggcgtttcgggaggttttttat

SEQ ID NO: 5430 - DNA, 27 bp, Artificial Sequences
  Synthetic
tcggcgggcgtttcgggaggtttttta

SEQ ID NO: 5431 - DNA, 27 bp, Artificial Sequences
  Synthetic
gcgtttcgggaggttttttatcggcgg

SEQ ID NO: 5432 - DNA, 27 bp, Artificial Sequences
  Synthetic
ggcgtttcgggaggttttttatcggcg

SEQ ID NO: 5433 - DNA, 27 bp, Artificial Sequences
  Synthetic
gcgggcgtttcgggaggttttttatcg

SEQ ID NO: 5434 - DNA, 27 bp, Artificial Sequences
  Synthetic
tttcgtttgttcgcgtaggtgtcgtcg

SEQ ID NO: 5435 - DNA, 28 bp, Artificial Sequences
  Synthetic
ttttcgtttgttcgcgtaggtgtcgtcg

SEQ ID NO: 5436 - DNA, 26 bp, Artificial Sequences
  Synthetic
ttcgtttgttcgcgtaggtgtcgtcg

SEQ ID NO: 5437 - DNA, 28 bp, Artificial Sequences
  Synthetic
tgggatgtcgtggttgtttgtttggtgt

SEQ ID NO: 5438 - DNA, 27 bp, Artificial Sequences
  Synthetic
ttttcgtttgttcgcgtaggtgtcgtc

SEQ ID NO: 5439 - DNA, 27 bp, Artificial Sequences
  Synthetic
cggcgggcgtttcgggaggttttttat

SEQ ID NO: 5440 - DNA, 27 bp, Artificial Sequences
  Synthetic
tcggcgggcgtttcgggaggtttttta

SEQ ID NO: 5441 - DNA, 27 bp, Artificial Sequences
  Synthetic
ggtaggcgggaggtgggggagagaatc

SEQ ID NO: 5442 - DNA, 27 bp, Artificial Sequences
  Synthetic
gcgtttcgggaggttttttatcggcgg

SEQ ID NO: 5443 - DNA, 27 bp, Artificial Sequences
  Synthetic
ggcgtttcgggaggttttttatcggcg

SEQ ID NO: 5444 - DNA, 27 bp, Artificial Sequences
  Synthetic
ggagaggggcgtagggattcgtaggga

SEQ ID NO: 5445 - DNA, 27 bp, Artificial Sequences
  Synthetic
gaggttggagaggggcgtagggattcg

SEQ ID NO: 5446 - DNA, 27 bp, Artificial Sequences
  Synthetic
cgaggttggagaggggcgtagggattc

SEQ ID NO: 5447 - DNA, 27 bp, Artificial Sequences
  Synthetic
agaggggcgtagggattcgtagggagt

SEQ ID NO: 5448 - DNA, 27 bp, Artificial Sequences
  Synthetic
tggagaggggcgtagggattcgtaggg

SEQ ID NO: 5449 - DNA, 27 bp, Artificial Sequences
  Synthetic
ggtaggcgggaggtgggggagagaatc

SEQ ID NO: 5450 - DNA, 26 bp, Artificial Sequences
  Synthetic
gtaggcgggaggtgggggagagaatc

SEQ ID NO: 5451 - DNA, 26 bp, Artificial Sequences
  Synthetic
ggtaggcgggaggtgggggagagaat

SEQ ID NO: 5452 - DNA, 27 bp, Artificial Sequences
  Synthetic
gggtaggcgggaggtgggggagagaat

SEQ ID NO: 5453 - DNA, 25 bp, Artificial Sequences
  Synthetic
gtaggcgggaggtgggggagagaat

SEQ ID NO: 5454 - DNA, 27 bp, Artificial Sequences
  Synthetic
agttgtttttggggcgcgttgaggagg

SEQ ID NO: 5455 - DNA, 27 bp, Artificial Sequences
  Synthetic
cgagttgtttttggggcgcgttgagga

SEQ ID NO: 5456 - DNA, 27 bp, Artificial Sequences
  Synthetic
gtggtgggggtggggggttaattggag

SEQ ID NO: 5457 - DNA, 27 bp, Artificial Sequences
  Synthetic
tttttggggcgcgttgaggagggagaa

SEQ ID NO: 5458 - DNA, 27 bp, Artificial Sequences
  Synthetic
gcgttgaggagggagaagcgaattggg

SEQ ID NO: 5459 - DNA, 27 bp, Artificial Sequences
  Synthetic
cgcgagtttggagattttggtggtcgt

SEQ ID NO: 5460 - DNA, 28 bp, Artificial Sequences
  Synthetic
tcgcgagtttggagattttggtggtcgt

SEQ ID NO: 5461 - DNA, 27 bp, Artificial Sequences
  Synthetic
tcgcgagtttggagattttggtggtcg

SEQ ID NO: 5462 - DNA, 28 bp, Artificial Sequences
  Synthetic
atcgcgagtttggagattttggtggtcg

SEQ ID NO: 5463 - DNA, 29 bp, Artificial Sequences
  Synthetic
atcgcgagtttggagattttggtggtcgt

SEQ ID NO: 5464 - DNA, 27 bp, Artificial Sequences
  Synthetic
ggttggcggtgcgtagttttggagtgt

SEQ ID NO: 5465 - DNA, 27 bp, Artificial Sequences
  Synthetic
gtggttggcggtgcgtagttttggagt

SEQ ID NO: 5466 - DNA, 27 bp, Artificial Sequences
  Synthetic
tggttggcggtgcgtagttttggagtg

SEQ ID NO: 5467 - DNA, 27 bp, Artificial Sequences
  Synthetic
agtggttggcggtgcgtagttttggag

SEQ ID NO: 5468 - DNA, 28 bp, Artificial Sequences
  Synthetic
gtggttggcggtgcgtagttttggagtg

SEQ ID NO: 5469 - DNA, 30 bp, Artificial Sequences
  Synthetic
agattttggtggtcgtagttggtaagtggt

SEQ ID NO: 5470 - DNA, 30 bp, Artificial Sequences
  Synthetic
cgggcgcgggtttaatattttataagtggt

SEQ ID NO: 5471 - DNA, 31 bp, Artificial Sequences
  Synthetic
tcgggcgcgggtttaatattttataagtggt

SEQ ID NO: 5472 - DNA, 31 bp, Artificial Sequences
  Synthetic
gagattttggtggtcgtagttggtaagtggt

SEQ ID NO: 5473 - DNA, 31 bp, Artificial Sequences
  Synthetic
agattttggtggtcgtagttggtaagtggtt

SEQ ID NO: 5474 - DNA, 27 bp, Artificial Sequences
  Synthetic
ggtcggggtttaaggaggcggacgaat

SEQ ID NO: 5475 - DNA, 27 bp, Artificial Sequences
  Synthetic
ggttggcggtgcgtagttttggagtgt

SEQ ID NO: 5476 - DNA, 27 bp, Artificial Sequences
  Synthetic
gtggttggcggtgcgtagttttggagt

SEQ ID NO: 5477 - DNA, 27 bp, Artificial Sequences
  Synthetic
ttagtcggtcggggtttaaggaggcgg

SEQ ID NO: 5478 - DNA, 27 bp, Artificial Sequences
  Synthetic
tggttggcggtgcgtagttttggagtg

SEQ ID NO: 5479 - DNA, 34 bp, Artificial Sequences
  Synthetic
cgatcggttgaatagtttagtgattatttcggcg

SEQ ID NO: 5480 - DNA, 35 bp, Artificial Sequences
  Synthetic
tcgatcggttgaatagtttagtgattatttcggcg

SEQ ID NO: 5481 - DNA, 36 bp, Artificial Sequences
  Synthetic
ttcgatcggttgaatagtttagtgattatttcggcg

SEQ ID NO: 5482 - DNA, 35 bp, Artificial Sequences
  Synthetic
tgttttttgcgcgatttgtatagtattacgatggt

SEQ ID NO: 5483 - DNA, 36 bp, Artificial Sequences
  Synthetic
tgttttttgcgcgatttgtatagtattacgatggtt

SEQ ID NO: 5484 - DNA, 36 bp, Artificial Sequences
  Synthetic
ttgttttttgcgcgatttgtatagtattacgatggt

SEQ ID NO: 5485 - DNA, 36 bp, Artificial Sequences
  Synthetic
tgcgcgatttgtatagtattacgatggttattaggt

SEQ ID NO: 5486 - DNA, 27 bp, Artificial Sequences
  Synthetic
ttcggggtggtgggtaatttggtggtt

SEQ ID NO: 5487 - DNA, 29 bp, Artificial Sequences
  Synthetic
ggcggtgatgtttattttcggggtggtgg

SEQ ID NO: 5488 - DNA, 28 bp, Artificial Sequences
  Synthetic
tttcggggtggtgggtaatttggtggtt

SEQ ID NO: 5489 - DNA, 28 bp, Artificial Sequences
  Synthetic
gcggtgatgtttattttcggggtggtgg

SEQ ID NO: 5490 - DNA, 27 bp, Artificial Sequences
  Synthetic
agggttaatggttcgggggttagtcgt

SEQ ID NO: 5491 - DNA, 27 bp, Artificial Sequences
  Synthetic
agcggttggttttcgggttattggttt

SEQ ID NO: 5492 - DNA, 29 bp, Artificial Sequences
  Synthetic
ggcgtagatgatgttgaggtcggataggt

SEQ ID NO: 5493 - DNA, 29 bp, Artificial Sequences
  Synthetic
tggcgtagatgatgttgaggtcggatagg

SEQ ID NO: 5494 - DNA, 30 bp, Artificial Sequences
  Synthetic
tggcgtagatgatgttgaggtcggataggt

SEQ ID NO: 5495 - DNA, 28 bp, Artificial Sequences
  Synthetic
ggcgtagatgatgttgaggtcggatagg

SEQ ID NO: 5496 - DNA, 27 bp, Artificial Sequences
  Synthetic
agggttaatggttcgggggttagtcgt

SEQ ID NO: 5497 - DNA, 27 bp, Artificial Sequences
  Synthetic
taatggttcgggggttagtcgttgtgc

SEQ ID NO: 5498 - DNA, 27 bp, Artificial Sequences
  Synthetic
gggttaatggttcgggggttagtcgtt

SEQ ID NO: 5499 - DNA, 28 bp, Artificial Sequences
  Synthetic
agggttaatggttcgggggttagtcgtt

SEQ ID NO: 5500 - DNA, 28 bp, Artificial Sequences
  Synthetic
aagggttaatggttcgggggttagtcgt

SEQ ID NO: 5501 - DNA, 29 bp, Artificial Sequences
  Synthetic
aggtatggttgatggttaggtagcgttcg

SEQ ID NO: 5502 - DNA, 29 bp, Artificial Sequences
  Synthetic
ggtatggttgatggttaggtagcgttcga

SEQ ID NO: 5503 - DNA, 30 bp, Artificial Sequences
  Synthetic
aggtatggttgatggttaggtagcgttcga

SEQ ID NO: 5504 - DNA, 30 bp, Artificial Sequences
  Synthetic
ggtatggttgatggttaggtagcgttcgat

SEQ ID NO: 5505 - DNA, 31 bp, Artificial Sequences
  Synthetic
aggtatggttgatggttaggtagcgttcgat

SEQ ID NO: 5506 - DNA, 27 bp, Artificial Sequences
  Synthetic
tcgttcgtggtgagtgatcggggttgg

SEQ ID NO: 5507 - DNA, 27 bp, Artificial Sequences
  Synthetic
ttgtgtgcggcgcgttgtttcgtatgt

SEQ ID NO: 5508 - DNA, 27 bp, Artificial Sequences
  Synthetic
gcggtcgtttcggttgtttttcggggt

SEQ ID NO: 5509 - DNA, 27 bp, Artificial Sequences
  Synthetic
tgtgtgcggcgcgttgtttcgtatgta

SEQ ID NO: 5510 - DNA, 27 bp, Artificial Sequences
  Synthetic
tgtttgtgtgcggcgcgttgtttcgta

SEQ ID NO: 5511 - DNA, 27 bp, Artificial Sequences
  Synthetic
cggtcgcgtggtgttgttcggtgttta

SEQ ID NO: 5512 - DNA, 27 bp, Artificial Sequences
  Synthetic
ggtagcggggtggtttcgggaggtaat

SEQ ID NO: 5513 - DNA, 27 bp, Artificial Sequences
  Synthetic
tagcggggtggtttcgggaggtaatcg

SEQ ID NO: 5514 - DNA, 27 bp, Artificial Sequences
  Synthetic
gggaaagtagggagcggggaatggacg

SEQ ID NO: 5515 - DNA, 27 bp, Artificial Sequences
  Synthetic
ggacggtggcgagaatgaggaaggagt

SEQ ID NO: 5516 - DNA, 27 bp, Artificial Sequences
  Synthetic
cgggcgggtcggtaagcgagtttttag

SEQ ID NO: 5517 - DNA, 27 bp, Artificial Sequences
  Synthetic
gggcgggtcggtaagcgagtttttagt

SEQ ID NO: 5518 - DNA, 27 bp, Artificial Sequences
  Synthetic
tgttttgagtatttcgggcgggcgagt

SEQ ID NO: 5519 - DNA, 27 bp, Artificial Sequences
  Synthetic
gcgggcgggtcggtaagcgagttttta

SEQ ID NO: 5520 - DNA, 28 bp, Artificial Sequences
  Synthetic
cgggcgggtcggtaagcgagtttttagt

SEQ ID NO: 5521 - DNA, 27 bp, Artificial Sequences
  Synthetic
tgtttggcggagatgggtttcgttgcg

SEQ ID NO: 5522 - DNA, 27 bp, Artificial Sequences
  Synthetic
gtggggtcgtagggttggttgtttggc

SEQ ID NO: 5523 - DNA, 27 bp, Artificial Sequences
  Synthetic
cgtgagcgttgggttggaggttcgttt

SEQ ID NO: 5524 - DNA, 27 bp, Artificial Sequences
  Synthetic
gatgggtttcgttgcggggtaaggagc

SEQ ID NO: 5525 - DNA, 27 bp, Artificial Sequences
  Synthetic
agggttggttgtttggcggagatgggt

SEQ ID NO: 5526 - DNA, 27 bp, Artificial Sequences
  Synthetic
cgggcgggtcggtaagcgagtttttag

SEQ ID NO: 5527 - DNA, 27 bp, Artificial Sequences
  Synthetic
gggcgggtcggtaagcgagtttttagt

SEQ ID NO: 5528 - DNA, 27 bp, Artificial Sequences
  Synthetic
gcgggcgggtcggtaagcgagttttta

SEQ ID NO: 5529 - DNA, 28 bp, Artificial Sequences
  Synthetic
cgggcgggtcggtaagcgagtttttagt

SEQ ID NO: 5530 - DNA, 26 bp, Artificial Sequences
  Synthetic
cgggcgggtcggtaagcgagttttta

SEQ ID NO: 5531 - DNA, 27 bp, Artificial Sequences
  Synthetic
gcgggtttgcggcgtagtaggttcgta

SEQ ID NO: 5532 - DNA, 27 bp, Artificial Sequences
  Synthetic
cgggtttgcggcgtagtaggttcgtaa

SEQ ID NO: 5533 - DNA, 28 bp, Artificial Sequences
  Synthetic
cgggtttgcggcgtagtaggttcgtaag

SEQ ID NO: 5534 - DNA, 28 bp, Artificial Sequences
  Synthetic
gcgggtttgcggcgtagtaggttcgtaa

SEQ ID NO: 5535 - DNA, 26 bp, Artificial Sequences
  Synthetic
cgggtttgcggcgtagtaggttcgta

SEQ ID NO: 5536 - DNA, 29 bp, Artificial Sequences
  Synthetic
acgggttttagttttcgtgtgattcgggt

SEQ ID NO: 5537 - DNA, 28 bp, Artificial Sequences
  Synthetic
cgggttttagttttcgtgtgattcgggt

SEQ ID NO: 5538 - DNA, 28 bp, Artificial Sequences
  Synthetic
acgggttttagttttcgtgtgattcggg

SEQ ID NO: 5539 - DNA, 29 bp, Artificial Sequences
  Synthetic
gacgggttttagttttcgtgtgattcggg

SEQ ID NO: 5540 - DNA, 30 bp, Artificial Sequences
  Synthetic
gacgggttttagttttcgtgtgattcgggt

SEQ ID NO: 5541 - DNA, 34 bp, Artificial Sequences
  Synthetic
agttttgttattgggttgttgttgttggagttgt

SEQ ID NO: 5542 - DNA, 35 bp, Artificial Sequences
  Synthetic
agttttgttattgggttgttgttgttggagttgtt

SEQ ID NO: 5543 - DNA, 35 bp, Artificial Sequences
  Synthetic
tagttttgttattgggttgttgttgttggagttgt

SEQ ID NO: 5544 - DNA, 36 bp, Artificial Sequences
  Synthetic
tagttttgttattgggttgttgttgttggagttgtt

SEQ ID NO: 5545 - DNA, 36 bp, Artificial Sequences
  Synthetic
gttttgttattgggttgttgttgttggagttgtttt

SEQ ID NO: 5546 - DNA, 27 bp, Artificial Sequences
  Synthetic
tgtgagtggttttggggtcgggtaggg

SEQ ID NO: 5547 - DNA, 27 bp, Artificial Sequences
  Synthetic
gggaatgcgagggggaaggagacgtag

SEQ ID NO: 5548 - DNA, 27 bp, Artificial Sequences
  Synthetic
gtagggaatgcgagggggaaggagacg

SEQ ID NO: 5549 - DNA, 27 bp, Artificial Sequences
  Synthetic
ttttggggtcgggtagggaatgcgagg

SEQ ID NO: 5550 - DNA, 27 bp, Artificial Sequences
  Synthetic
ggaatgcgagggggaaggagacgtagc

SEQ ID NO: 5551 - DNA, 27 bp, Artificial Sequences
  Synthetic
cggcgtcgggtagtttgtttttcgggg

SEQ ID NO: 5552 - DNA, 27 bp, Artificial Sequences
  Synthetic
atgggtaggggggtaaggatgaggggt

SEQ ID NO: 5553 - DNA, 27 bp, Artificial Sequences
  Synthetic
ggcgtcgggtagtttgtttttcggggt

SEQ ID NO: 5554 - DNA, 27 bp, Artificial Sequences
  Synthetic
ttcggggtatgggtaggggggtaagga

SEQ ID NO: 5555 - DNA, 27 bp, Artificial Sequences
  Synthetic
tcggggtatgggtaggggggtaaggat

SEQ ID NO: 5556 - DNA, 27 bp, Artificial Sequences
  Synthetic
ggcgagtagtttggtggttttggcggt

SEQ ID NO: 5557 - DNA, 27 bp, Artificial Sequences
  Synthetic
tcggacgaggcgagtagtttggtggtt

SEQ ID NO: 5558 - DNA, 27 bp, Artificial Sequences
  Synthetic
ttcggacgaggcgagtagtttggtggt

SEQ ID NO: 5559 - DNA, 27 bp, Artificial Sequences
  Synthetic
aggcgagtagtttggtggttttggcgg

SEQ ID NO: 5560 - DNA, 28 bp, Artificial Sequences
  Synthetic
cgaggcgagtagtttggtggttttggcg

SEQ ID NO: 5561 - DNA, 27 bp, Artificial Sequences
  Synthetic
gcggagtttagggcgtacggttgtgtc

SEQ ID NO: 5562 - DNA, 27 bp, Artificial Sequences
  Synthetic
cggagtttagggcgtacggttgtgtcg

SEQ ID NO: 5563 - DNA, 27 bp, Artificial Sequences
  Synthetic
tgtgtcgttcgggtttgttttcggagc

SEQ ID NO: 5564 - DNA, 27 bp, Artificial Sequences
  Synthetic
gtttagcggtggtagtcgggagttcgt

SEQ ID NO: 5565 - DNA, 26 bp, Artificial Sequences
  Synthetic
gcggagtttagggcgtacggttgtgt

SEQ ID NO: 5566 - DNA, 31 bp, Artificial Sequences
  Synthetic
aggtatagaggaggtcgttttgtttttgcga

SEQ ID NO: 5567 - DNA, 32 bp, Artificial Sequences
  Synthetic
aaggtatagaggaggtcgttttgtttttgcga

SEQ ID NO: 5568 - DNA, 32 bp, Artificial Sequences
  Synthetic
aaaggtatagaggaggtcgttttgtttttgcg

SEQ ID NO: 5569 - DNA, 33 bp, Artificial Sequences
  Synthetic
aaaggtatagaggaggtcgttttgtttttgcga

SEQ ID NO: 5570 - DNA, 34 bp, Artificial Sequences
  Synthetic
taaaggtatagaggaggtcgttttgtttttgcga

SEQ ID NO: 5571 - DNA, 27 bp, Artificial Sequences
  Synthetic
gtgggggcgggaggtggttttgttttt

SEQ ID NO: 5572 - DNA, 27 bp, Artificial Sequences
  Synthetic
gggggcgggaggtggttttgttttttg

SEQ ID NO: 5573 - DNA, 28 bp, Artificial Sequences
  Synthetic
tgggggcgggaggtggttttgttttttg

SEQ ID NO: 5574 - DNA, 26 bp, Artificial Sequences
  Synthetic
gtgggggcgggaggtggttttgtttt

SEQ ID NO: 5575 - DNA, 27 bp, Artificial Sequences
  Synthetic
aacgtttgaatttcggcggttggaggc

SEQ ID NO: 5576 - DNA, 27 bp, Artificial Sequences
  Synthetic
cgtcggggtttaggcgtttgtgaaaga

SEQ ID NO: 5577 - DNA, 28 bp, Artificial Sequences
  Synthetic
cgtcggggtttaggcgtttgtgaaagat

SEQ ID NO: 5578 - DNA, 24 bp, Artificial Sequences
  Synthetic
gcgttaggtcggtgtaggagggcg

SEQ ID NO: 5579 - DNA, 26 bp, Artificial Sequences
  Synthetic
cgtcggggtttaggcgtttgtgaaag

SEQ ID NO: 5580 - DNA, 29 bp, Artificial Sequences
  Synthetic
cgtcggggtttaggcgtttgtgaaagata

SEQ ID NO: 5581 - DNA, 27 bp, Artificial Sequences
  Synthetic
tgtcgggtaggggtggtaggtcgagtt

SEQ ID NO: 5582 - DNA, 27 bp, Artificial Sequences
  Synthetic
atgtcgggtaggggtggtaggtcgagt

SEQ ID NO: 5583 - DNA, 27 bp, Artificial Sequences
  Synthetic
tggcgttggagagagcgttcgttggat

SEQ ID NO: 5584 - DNA, 27 bp, Artificial Sequences
  Synthetic
ggtttggcgttggagagagcgttcgtt

SEQ ID NO: 5585 - DNA, 27 bp, Artificial Sequences
  Synthetic
tttggcgttggagagagcgttcgttgg

SEQ ID NO: 5586 - DNA, 27 bp, Artificial Sequences
  Synthetic
aggagggcgttggggttcggtttgtta

SEQ ID NO: 5587 - DNA, 27 bp, Artificial Sequences
  Synthetic
taggagggcgttggggttcggtttgtt

SEQ ID NO: 5588 - DNA, 27 bp, Artificial Sequences
  Synthetic
gttaggtcggtgtaggagggcgttggg

SEQ ID NO: 5589 - DNA, 27 bp, Artificial Sequences
  Synthetic
cgttaggtcggtgtaggagggcgttgg

SEQ ID NO: 5590 - DNA, 27 bp, Artificial Sequences
  Synthetic
tgtaggagggcgttggggttcggtttg

SEQ ID NO: 5591 - DNA, 27 bp, Artificial Sequences
  Synthetic
cgcgggtttgatttcgtcggttcggat

SEQ ID NO: 5592 - DNA, 27 bp, Artificial Sequences
  Synthetic
gcggcgtgcggttttttcgttcgaatg

SEQ ID NO: 5593 - DNA, 27 bp, Artificial Sequences
  Synthetic
gatttcgtcggttcggatggatgggcg

SEQ ID NO: 5594 - DNA, 27 bp, Artificial Sequences
  Synthetic
gtttgtggcgcgggtttgatttcgtcg

SEQ ID NO: 5595 - DNA, 27 bp, Artificial Sequences
  Synthetic
ttcgagacgggtatgcgggaggaggaa

SEQ ID NO: 5596 - DNA, 28 bp, Artificial Sequences
  Synthetic
tgttgggttcgggtttggtttagagcgt

SEQ ID NO: 5597 - DNA, 27 bp, Artificial Sequences
  Synthetic
gttgggttcgggtttggtttagagcgt

SEQ ID NO: 5598 - DNA, 27 bp, Artificial Sequences
  Synthetic
tgttgggttcgggtttggtttagagcg

SEQ ID NO: 5599 - DNA, 25 bp, Artificial Sequences
  Synthetic
cgtattcgggcggggaggtcgtacg

SEQ ID NO: 5600 - DNA, 27 bp, Artificial Sequences
  Synthetic
agggttgttgggttcgggtttggttta

SEQ ID NO: 5601 - DNA, 27 bp, Artificial Sequences
  Synthetic
tcgggaggtatttggttggttcggagt

SEQ ID NO: 5602 - DNA, 27 bp, Artificial Sequences
  Synthetic
agtcgggaggtatttggttggttcgga

SEQ ID NO: 5603 - DNA, 25 bp, Artificial Sequences
  Synthetic
cgggttcggaggagaggttcgggtg

SEQ ID NO: 5604 - DNA, 25 bp, Artificial Sequences
  Synthetic
gggttcggaggagaggttcgggtgc

SEQ ID NO: 5605 - DNA, 28 bp, Artificial Sequences
  Synthetic
ggttcggggtttcgtattagtcgggagg

SEQ ID NO: 5606 - DNA, 28 bp, Artificial Sequences
  Synthetic
tgttgggttcgggtttggtttagagcgt

SEQ ID NO: 5607 - DNA, 27 bp, Artificial Sequences
  Synthetic
gttgggttcgggtttggtttagagcgt

SEQ ID NO: 5608 - DNA, 27 bp, Artificial Sequences
  Synthetic
tgttgggttcgggtttggtttagagcg

SEQ ID NO: 5609 - DNA, 25 bp, Artificial Sequences
  Synthetic
cgtattcgggcggggaggtcgtacg

SEQ ID NO: 5610 - DNA, 27 bp, Artificial Sequences
  Synthetic
agggttgttgggttcgggtttggttta

SEQ ID NO: 5611 - DNA, 27 bp, Artificial Sequences
  Synthetic
tcgggaggtatttggttggttcggagt

SEQ ID NO: 5612 - DNA, 27 bp, Artificial Sequences
  Synthetic
agtcgggaggtatttggttggttcgga

SEQ ID NO: 5613 - DNA, 28 bp, Artificial Sequences
  Synthetic
ggttcggggtttcgtattagtcgggagg

SEQ ID NO: 5614 - DNA, 29 bp, Artificial Sequences
  Synthetic
ggttcggggtttcgtattagtcgggaggt

SEQ ID NO: 5615 - DNA, 28 bp, Artificial Sequences
  Synthetic
gtcgggaggtatttggttggttcggagt

SEQ ID NO: 5616 - DNA, 27 bp, Artificial Sequences
  Synthetic
gggtagtggggagggggcgttaagagt

SEQ ID NO: 5617 - DNA, 27 bp, Artificial Sequences
  Synthetic
atatttggtcgggtagtggggaggggg

SEQ ID NO: 5618 - DNA, 27 bp, Artificial Sequences
  Synthetic
tatttggtcgggtagtggggagggggc

SEQ ID NO: 5619 - DNA, 28 bp, Artificial Sequences
  Synthetic
gggtagtggggagggggcgttaagagta

SEQ ID NO: 5620 - DNA, 26 bp, Artificial Sequences
  Synthetic
gggtagtggggagggggcgttaagag

SEQ ID NO: 5621 - DNA, 27 bp, Artificial Sequences
  Synthetic
tcgtggttagttgcgttcggtcgtttt

SEQ ID NO: 5622 - DNA, 27 bp, Artificial Sequences
  Synthetic
ttcgtggttagttgcgttcggtcgttt

SEQ ID NO: 5623 - DNA, 27 bp, Artificial Sequences
  Synthetic
attcgtggttagttgcgttcggtcgtt

SEQ ID NO: 5624 - DNA, 27 bp, Artificial Sequences
  Synthetic
cgtggttagttgcgttcggtcgttttc

SEQ ID NO: 5625 - DNA, 28 bp, Artificial Sequences
  Synthetic
tcgtggttagttgcgttcggtcgttttc

SEQ ID NO: 5626 - DNA, 27 bp, Artificial Sequences
  Synthetic
ttggtttgtttggattgtcgggtcggc

SEQ ID NO: 5627 - DNA, 28 bp, Artificial Sequences
  Synthetic
gcggtttggtttgtttggattgtcgggt

SEQ ID NO: 5628 - DNA, 27 bp, Artificial Sequences
  Synthetic
gcggtttggtttgtttggattgtcggg

SEQ ID NO: 5629 - DNA, 28 bp, Artificial Sequences
  Synthetic
agcggtttggtttgtttggattgtcggg

SEQ ID NO: 5630 - DNA, 29 bp, Artificial Sequences
  Synthetic
agcggtttggtttgtttggattgtcgggt

SEQ ID NO: 5631 - DNA, 27 bp, Artificial Sequences
  Synthetic
tttcggtggtttggttttttcgcgcgg

SEQ ID NO: 5632 - DNA, 28 bp, Artificial Sequences
  Synthetic
gtttcggtggtttggttttttcgcgcgg

SEQ ID NO: 5633 - DNA, 28 bp, Artificial Sequences
  Synthetic
cgtttcggtggtttggttttttcgcgcg

SEQ ID NO: 5634 - DNA, 27 bp, Artificial Sequences
  Synthetic
gtttcggtggtttggttttttcgcgcg

SEQ ID NO: 5635 - DNA, 27 bp, Artificial Sequences
  Synthetic
cgtttcggtggtttggttttttcgcgc

SEQ ID NO: 5636 - DNA, 27 bp, Artificial Sequences
  Synthetic
cgcggaggagttagattatcggggcgt

SEQ ID NO: 5637 - DNA, 27 bp, Artificial Sequences
  Synthetic
tcgcgcggaggagttagattatcgggg

SEQ ID NO: 5638 - DNA, 28 bp, Artificial Sequences
  Synthetic
gtcgcgcggaggagttagattatcgggg

SEQ ID NO: 5639 - DNA, 27 bp, Artificial Sequences
  Synthetic
gtcgcgcggaggagttagattatcggg

SEQ ID NO: 5640 - DNA, 28 bp, Artificial Sequences
  Synthetic
cgcggaggagttagattatcggggcgta

SEQ ID NO: 5641 - DNA, 27 bp, Artificial Sequences
  Synthetic
aagcgggagttggttggggagtagtcg

SEQ ID NO: 5642 - DNA, 27 bp, Artificial Sequences
  Synthetic
ggttggggagtagtcgtatcgtcgcgt

SEQ ID NO: 5643 - DNA, 27 bp, Artificial Sequences
  Synthetic
tggttggggagtagtcgtatcgtcgcg

SEQ ID NO: 5644 - DNA, 27 bp, Artificial Sequences
  Synthetic
gcgggagttggttggggagtagtcgta

SEQ ID NO: 5645 - DNA, 27 bp, Artificial Sequences
  Synthetic
tgaagcgggagttggttggggagtagt

SEQ ID NO: 5646 - DNA, 27 bp, Artificial Sequences
  Synthetic
tggcgttgaagagtaggaaaggatcgt

SEQ ID NO: 5647 - DNA, 29 bp, Artificial Sequences
  Synthetic
ggttggcgttgaagagtaggaaaggatcg

SEQ ID NO: 5648 - DNA, 30 bp, Artificial Sequences
  Synthetic
ggttggcgttgaagagtaggaaaggatcgt

SEQ ID NO: 5649 - DNA, 28 bp, Artificial Sequences
  Synthetic
ttggcgttgaagagtaggaaaggatcgt

SEQ ID NO: 5650 - DNA, 30 bp, Artificial Sequences
  Synthetic
aggttggcgttgaagagtaggaaaggatcg

SEQ ID NO: 5651 - DNA, 27 bp, Artificial Sequences
  Synthetic
aggtgggattttgtgcggggggtagag

SEQ ID NO: 5652 - DNA, 27 bp, Artificial Sequences
  Synthetic
aggttggaagtcggggcgttgggtatt

SEQ ID NO: 5653 - DNA, 27 bp, Artificial Sequences
  Synthetic
tttaggttggaagtcggggcgttgggt

SEQ ID NO: 5654 - DNA, 27 bp, Artificial Sequences
  Synthetic
aagcgggagttggttggggagtagtcg

SEQ ID NO: 5655 - DNA, 27 bp, Artificial Sequences
  Synthetic
aaggtgggattttgtgcggggggtaga

SEQ ID NO: 5656 - DNA, 27 bp, Artificial Sequences
  Synthetic
cggtcggcggtgaaggtgaattggttt

SEQ ID NO: 5657 - DNA, 27 bp, Artificial Sequences
  Synthetic
tcggtcggcggtgaaggtgaattggtt

SEQ ID NO: 5658 - DNA, 27 bp, Artificial Sequences
  Synthetic
ttgcgtagtgtagttgcggtcggtcgg

SEQ ID NO: 5659 - DNA, 27 bp, Artificial Sequences
  Synthetic
gtcggtcggcggtgaaggtgaattggt

SEQ ID NO: 5660 - DNA, 26 bp, Artificial Sequences
  Synthetic
gtcggtcggcggtgaaggtgaattgg

SEQ ID NO: 5661 - DNA, 27 bp, Artificial Sequences
  Synthetic
gcgtggggagaattggagcggttgttc

SEQ ID NO: 5662 - DNA, 27 bp, Artificial Sequences
  Synthetic
tggggagaattggagcggttgttcgga

SEQ ID NO: 5663 - DNA, 27 bp, Artificial Sequences
  Synthetic
ggttgtggggaggtggtgtgggagtac

SEQ ID NO: 5664 - DNA, 27 bp, Artificial Sequences
  Synthetic
cgtggggagaattggagcggttgttcg

SEQ ID NO: 5665 - DNA, 27 bp, Artificial Sequences
  Synthetic
gaggtggtgtgggagtacggtcgttgt

SEQ ID NO: 5666 - DNA, 27 bp, Artificial Sequences
  Synthetic
cgggggcgttcgggtagtcgttttagt

SEQ ID NO: 5667 - DNA, 27 bp, Artificial Sequences
  Synthetic
aaagtattcgggattagggcgggggcg

SEQ ID NO: 5668 - DNA, 27 bp, Artificial Sequences
  Synthetic
gagggggttggggggtgagtggaaata

SEQ ID NO: 5669 - DNA, 27 bp, Artificial Sequences
  Synthetic
gtattcgggattagggcgggggcgttc

SEQ ID NO: 5670 - DNA, 27 bp, Artificial Sequences
  Synthetic
agggggttggggggtgagtggaaataa

SEQ ID NO: 5671 - DNA, 27 bp, Artificial Sequences
  Synthetic
gcgtggggagaattggagcggttgttc

SEQ ID NO: 5672 - DNA, 27 bp, Artificial Sequences
  Synthetic
tggggagaattggagcggttgttcgga

SEQ ID NO: 5673 - DNA, 27 bp, Artificial Sequences
  Synthetic
ggttgtggggaggtggtgtgggagtac

SEQ ID NO: 5674 - DNA, 27 bp, Artificial Sequences
  Synthetic
cgtggggagaattggagcggttgttcg

SEQ ID NO: 5675 - DNA, 27 bp, Artificial Sequences
  Synthetic
gaggtggtgtgggagtacggtcgttgt

SEQ ID NO: 5676 - DNA, 27 bp, Artificial Sequences
  Synthetic
gtttcggggagggcgcgatgtgttttt

SEQ ID NO: 5677 - DNA, 27 bp, Artificial Sequences
  Synthetic
tttcggggagggcgcgatgtgtttttt

SEQ ID NO: 5678 - DNA, 27 bp, Artificial Sequences
  Synthetic
gagggggttggggggtgagtggaaata

SEQ ID NO: 5679 - DNA, 27 bp, Artificial Sequences
  Synthetic
gtttggaattaggacggcgggaggggg

SEQ ID NO: 5680 - DNA, 27 bp, Artificial Sequences
  Synthetic
ggtttggaattaggacggcgggagggg

SEQ ID NO: 5681 - DNA, 27 bp, Artificial Sequences
  Synthetic
aggttgtcggggagggggtatatcgcg

SEQ ID NO: 5682 - DNA, 27 bp, Artificial Sequences
  Synthetic
taggttgtcggggagggggtatatcgc

SEQ ID NO: 5683 - DNA, 26 bp, Artificial Sequences
  Synthetic
ggttgtcggggagggggtatatcgcg

SEQ ID NO: 5684 - DNA, 27 bp, Artificial Sequences
  Synthetic
tcggtttggttgtagtcgcgtggatgt

SEQ ID NO: 5685 - DNA, 28 bp, Artificial Sequences
  Synthetic
taggttgtcggggagggggtatatcgcg

SEQ ID NO: 5686 - DNA, 27 bp, Artificial Sequences
  Synthetic
gacgacggggtagtggagggatgttcg

SEQ ID NO: 5687 - DNA, 27 bp, Artificial Sequences
  Synthetic
gaggagacgacggggtagtggagggat

SEQ ID NO: 5688 - DNA, 27 bp, Artificial Sequences
  Synthetic
agagagtggaaggaggagacgacgggg

SEQ ID NO: 5689 - DNA, 27 bp, Artificial Sequences
  Synthetic
gtttcggggagggcgcgatgtgttttt

SEQ ID NO: 5690 - DNA, 27 bp, Artificial Sequences
  Synthetic
tttcggggagggcgcgatgtgtttttt

SEQ ID NO: 5691 - DNA, 27 bp, Artificial Sequences
  Synthetic
tcgtggggagcgttcgagtaggtaggg

SEQ ID NO: 5692 - DNA, 27 bp, Artificial Sequences
  Synthetic
gtggggagcgttcgagtaggtagggtt

SEQ ID NO: 5693 - DNA, 27 bp, Artificial Sequences
  Synthetic
cgtggggagcgttcgagtaggtagggt

SEQ ID NO: 5694 - DNA, 27 bp, Artificial Sequences
  Synthetic
aggttgtcggggagggggtatatcgcg

SEQ ID NO: 5695 - DNA, 26 bp, Artificial Sequences
  Synthetic
cgtggggagcgttcgagtaggtaggg

SEQ ID NO: 5696 - DNA, 27 bp, Artificial Sequences
  Synthetic
gacgacggggtagtggagggatgttcg

SEQ ID NO: 5697 - DNA, 27 bp, Artificial Sequences
  Synthetic
gaggagacgacggggtagtggagggat

SEQ ID NO: 5698 - DNA, 27 bp, Artificial Sequences
  Synthetic
agagagtggaaggaggagacgacgggg

SEQ ID NO: 5699 - DNA, 27 bp, Artificial Sequences
  Synthetic
ggaaggaggagacgacggggtagtgga

SEQ ID NO: 5700 - DNA, 27 bp, Artificial Sequences
  Synthetic
aaggaggagacgacggggtagtggagg

SEQ ID NO: 5701 - DNA, 27 bp, Artificial Sequences
  Synthetic
ggggcggtgggtaggattgcgtttttt

SEQ ID NO: 5702 - DNA, 27 bp, Artificial Sequences
  Synthetic
tatagatttggggtagtggggggcgcg

SEQ ID NO: 5703 - DNA, 27 bp, Artificial Sequences
  Synthetic
tagtttcgggagggggttggggagtgt

SEQ ID NO: 5704 - DNA, 27 bp, Artificial Sequences
  Synthetic
gttagtttcgggagggggttggggagt

SEQ ID NO: 5705 - DNA, 27 bp, Artificial Sequences
  Synthetic
ttagtttcgggagggggttggggagtg

SEQ ID NO: 5706 - DNA, 27 bp, Artificial Sequences
  Synthetic
cgcgggattttgaggagacgttttgga

SEQ ID NO: 5707 - DNA, 27 bp, Artificial Sequences
  Synthetic
tcgcgggattttgaggagacgttttgg

SEQ ID NO: 5708 - DNA, 28 bp, Artificial Sequences
  Synthetic
tcgcgggattttgaggagacgttttgga

SEQ ID NO: 5709 - DNA, 28 bp, Artificial Sequences
  Synthetic
cgcgggattttgaggagacgttttggag

SEQ ID NO: 5710 - DNA, 29 bp, Artificial Sequences
  Synthetic
cgcgggattttgaggagacgttttggagt

SEQ ID NO: 5711 - DNA, 27 bp, Artificial Sequences
  Synthetic
ggggcggtgggtaggattgcgtttttt

SEQ ID NO: 5712 - DNA, 27 bp, Artificial Sequences
  Synthetic
gcggggttaggagaaggatttggcggt

SEQ ID NO: 5713 - DNA, 27 bp, Artificial Sequences
  Synthetic
tagtttcgggagggggttggggagtgt

SEQ ID NO: 5714 - DNA, 27 bp, Artificial Sequences
  Synthetic
gttagtttcgggagggggttggggagt

SEQ ID NO: 5715 - DNA, 27 bp, Artificial Sequences
  Synthetic
ttagtttcgggagggggttggggagtg

SEQ ID NO: 5716 - DNA, 27 bp, Artificial Sequences
  Synthetic
aaggggttgtagtatcgcgtttggggc

SEQ ID NO: 5717 - DNA, 28 bp, Artificial Sequences
  Synthetic
gaaggggttgtagtatcgcgtttggggc

SEQ ID NO: 5718 - DNA, 28 bp, Artificial Sequences
  Synthetic
cgaaggggttgtagtatcgcgtttgggg

SEQ ID NO: 5719 - DNA, 29 bp, Artificial Sequences
  Synthetic
tcgaaggggttgtagtatcgcgtttgggg

SEQ ID NO: 5720 - DNA, 26 bp, Artificial Sequences
  Synthetic
aggggttgtagtatcgcgtttggggc

SEQ ID NO: 5721 - DNA, 27 bp, Artificial Sequences
  Synthetic
gcggggttaggagaaggatttggcggt

SEQ ID NO: 5722 - DNA, 27 bp, Artificial Sequences
  Synthetic
cgcggggttaggagaaggatttggcgg

SEQ ID NO: 5723 - DNA, 27 bp, Artificial Sequences
  Synthetic
ttcgcggggttaggagaaggatttggc

SEQ ID NO: 5724 - DNA, 27 bp, Artificial Sequences
  Synthetic
cggggttaggagaaggatttggcggtt

SEQ ID NO: 5725 - DNA, 26 bp, Artificial Sequences
  Synthetic
cgcggggttaggagaaggatttggcg

SEQ ID NO: 5726 - DNA, 27 bp, Artificial Sequences
  Synthetic
cggttgggtggagcgcgggataaaaaa

SEQ ID NO: 5727 - DNA, 27 bp, Artificial Sequences
  Synthetic
aaggggttgtagtatcgcgtttggggc

SEQ ID NO: 5728 - DNA, 28 bp, Artificial Sequences
  Synthetic
cggttgggtggagcgcgggataaaaaat

SEQ ID NO: 5729 - DNA, 26 bp, Artificial Sequences
  Synthetic
cggttgggtggagcgcgggataaaaa

SEQ ID NO: 5730 - DNA, 28 bp, Artificial Sequences
  Synthetic
gaaggggttgtagtatcgcgtttggggc

SEQ ID NO: 5731 - DNA, 27 bp, Artificial Sequences
  Synthetic
ttttggttcgttcgtgcgttttaggcg

SEQ ID NO: 5732 - DNA, 27 bp, Artificial Sequences
  Synthetic
agttggttttttggttcgttcgtgcgt

SEQ ID NO: 5733 - DNA, 28 bp, Artificial Sequences
  Synthetic
tttttggttcgttcgtgcgttttaggcg

SEQ ID NO: 5734 - DNA, 28 bp, Artificial Sequences
  Synthetic
gagttggttttttggttcgttcgtgcgt

SEQ ID NO: 5735 - DNA, 28 bp, Artificial Sequences
  Synthetic
tgagttggttttttggttcgttcgtgcg

SEQ ID NO: 5736 - DNA, 27 bp, Artificial Sequences
  Synthetic
cggttgggtggagcgcgggataaaaaa

SEQ ID NO: 5737 - DNA, 28 bp, Artificial Sequences
  Synthetic
cggttgggtggagcgcgggataaaaaat

SEQ ID NO: 5738 - DNA, 26 bp, Artificial Sequences
  Synthetic
cggttgggtggagcgcgggataaaaa

SEQ ID NO: 5739 - DNA, 27 bp, Artificial Sequences
  Synthetic
ggttgggtggagcgcgggataaaaaat

SEQ ID NO: 5740 - DNA, 29 bp, Artificial Sequences
  Synthetic
cggttgggtggagcgcgggataaaaaatt

SEQ ID NO: 5741 - DNA, 27 bp, Artificial Sequences
  Synthetic
ttttggttcgttcgtgcgttttaggcg

SEQ ID NO: 5742 - DNA, 27 bp, Artificial Sequences
  Synthetic
agttggttttttggttcgttcgtgcgt

SEQ ID NO: 5743 - DNA, 28 bp, Artificial Sequences
  Synthetic
tttttggttcgttcgtgcgttttaggcg

SEQ ID NO: 5744 - DNA, 28 bp, Artificial Sequences
  Synthetic
gagttggttttttggttcgttcgtgcgt

SEQ ID NO: 5745 - DNA, 28 bp, Artificial Sequences
  Synthetic
tgagttggttttttggttcgttcgtgcg

SEQ ID NO: 5746 - DNA, 27 bp, Artificial Sequences
  Synthetic
attagtatgtaaatcggcggcggggag

SEQ ID NO: 5747 - DNA, 27 bp, Artificial Sequences
  Synthetic
aattagtatgtaaatcggcggcgggga

SEQ ID NO: 5748 - DNA, 28 bp, Artificial Sequences
  Synthetic
aattagtatgtaaatcggcggcggggag

SEQ ID NO: 5749 - DNA, 26 bp, Artificial Sequences
  Synthetic
ttagtatgtaaatcggcggcggggag

SEQ ID NO: 5750 - DNA, 26 bp, Artificial Sequences
  Synthetic
attagtatgtaaatcggcggcgggga

SEQ ID NO: 5751 - DNA, 27 bp, Artificial Sequences
  Synthetic
tggggttttgtttttgtcgcgggagaa

SEQ ID NO: 5752 - DNA, 27 bp, Artificial Sequences
  Synthetic
ttggggttttgtttttgtcgcgggaga

SEQ ID NO: 5753 - DNA, 29 bp, Artificial Sequences
  Synthetic
cggttttggggttttgtttttgtcgcggg

SEQ ID NO: 5754 - DNA, 28 bp, Artificial Sequences
  Synthetic
cggttttggggttttgtttttgtcgcgg

SEQ ID NO: 5755 - DNA, 28 bp, Artificial Sequences
  Synthetic
ggttttggggttttgtttttgtcgcggg

SEQ ID NO: 5756 - DNA, 27 bp, Artificial Sequences
  Synthetic
ggtttggttgttgacgtagggtttcgg

SEQ ID NO: 5757 - DNA, 27 bp, Artificial Sequences
  Synthetic
ttggttgttgacgtagggtttcggagt

SEQ ID NO: 5758 - DNA, 28 bp, Artificial Sequences
  Synthetic
aggtttggttgttgacgtagggtttcgg

SEQ ID NO: 5759 - DNA, 28 bp, Artificial Sequences
  Synthetic
ggtttggttgttgacgtagggtttcgga

SEQ ID NO: 5760 - DNA, 29 bp, Artificial Sequences
  Synthetic
aggtttggttgttgacgtagggtttcgga

SEQ ID NO: 5761 - DNA, 29 bp, Artificial Sequences
  Synthetic
gggagaagtcgcgggaatgtttttattgg

SEQ ID NO: 5762 - DNA, 32 bp, Artificial Sequences
  Synthetic
gggagaagtcgcgggaatgtttttattggacg

SEQ ID NO: 5763 - DNA, 30 bp, Artificial Sequences
  Synthetic
gggagaagtcgcgggaatgtttttattgga

SEQ ID NO: 5764 - DNA, 29 bp, Artificial Sequences
  Synthetic
agaagtcgcgggaatgtttttattggacg

SEQ ID NO: 5765 - DNA, 31 bp, Artificial Sequences
  Synthetic
ggagaagtcgcgggaatgtttttattggacg

SEQ ID NO: 5766 - DNA, 27 bp, Artificial Sequences
  Synthetic
cgtttcgtcgtagcgttcggaggtgtt

SEQ ID NO: 5767 - DNA, 28 bp, Artificial Sequences
  Synthetic
cgtttcgtcgtagcgttcggaggtgttt

SEQ ID NO: 5768 - DNA, 26 bp, Artificial Sequences
  Synthetic
cgtttcgtcgtagcgttcggaggtgt

SEQ ID NO: 5769 - DNA, 27 bp, Artificial Sequences
  Synthetic
gtttcgtcgtagcgttcggaggtgttt

SEQ ID NO: 5770 - DNA, 29 bp, Artificial Sequences
  Synthetic
cgtttcgtcgtagcgttcggaggtgtttt

SEQ ID NO: 5771 - DNA, 27 bp, Artificial Sequences
  Synthetic
ggttgggggtattttcgagcgttgcgg

SEQ ID NO: 5772 - DNA, 27 bp, Artificial Sequences
  Synthetic
gggttgggggtattttcgagcgttgcg

SEQ ID NO: 5773 - DNA, 27 bp, Artificial Sequences
  Synthetic
tgggttgggggtattttcgagcgttgc

SEQ ID NO: 5774 - DNA, 27 bp, Artificial Sequences
  Synthetic
gttgggggtattttcgagcgttgcggc

SEQ ID NO: 5775 - DNA, 26 bp, Artificial Sequences
  Synthetic
ttgggggtattttcgagcgttgcggc

SEQ ID NO: 5776 - DNA, 27 bp, Artificial Sequences
  Synthetic
cgttcgttcgttcgttcgttcgggtag

SEQ ID NO: 5777 - DNA, 28 bp, Artificial Sequences
  Synthetic
cgttcgttcgttcgttcgttcgggtagt

SEQ ID NO: 5778 - DNA, 27 bp, Artificial Sequences
  Synthetic
gttcgttcgttcgttcgttcgggtagt

SEQ ID NO: 5779 - DNA, 26 bp, Artificial Sequences
  Synthetic
cgttcgttcgttcgttcgttcgggta

SEQ ID NO: 5780 - DNA, 29 bp, Artificial Sequences
  Synthetic
cgttcgttcgttcgttcgttcgggtagta

SEQ ID NO: 5781 - DNA, 27 bp, Artificial Sequences
  Synthetic
ggttgggggtattttcgagcgttgcgg

SEQ ID NO: 5782 - DNA, 27 bp, Artificial Sequences
  Synthetic
gggttgggggtattttcgagcgttgcg

SEQ ID NO: 5783 - DNA, 27 bp, Artificial Sequences
  Synthetic
tgggttgggggtattttcgagcgttgc

SEQ ID NO: 5784 - DNA, 27 bp, Artificial Sequences
  Synthetic
gttgggggtattttcgagcgttgcggc

SEQ ID NO: 5785 - DNA, 26 bp, Artificial Sequences
  Synthetic
ttgggggtattttcgagcgttgcggc

SEQ ID NO: 5786 - DNA, 27 bp, Artificial Sequences
  Synthetic
cgttcgttcgttcgttcgttcgggtag

SEQ ID NO: 5787 - DNA, 28 bp, Artificial Sequences
  Synthetic
cgttcgttcgttcgttcgttcgggtagt

SEQ ID NO: 5788 - DNA, 27 bp, Artificial Sequences
  Synthetic
gttcgttcgttcgttcgttcgggtagt

SEQ ID NO: 5789 - DNA, 28 bp, Artificial Sequences
  Synthetic
tggttcgggattttagtcgtggtttcgc

SEQ ID NO: 5790 - DNA, 26 bp, Artificial Sequences
  Synthetic
cgttcgttcgttcgttcgttcgggta

SEQ ID NO: 5791 - DNA, 27 bp, Artificial Sequences
  Synthetic
ggttgggggtattttcgagcgttgcgg

SEQ ID NO: 5792 - DNA, 27 bp, Artificial Sequences
  Synthetic
gggttgggggtattttcgagcgttgcg

SEQ ID NO: 5793 - DNA, 27 bp, Artificial Sequences
  Synthetic
tgggttgggggtattttcgagcgttgc

SEQ ID NO: 5794 - DNA, 27 bp, Artificial Sequences
  Synthetic
gttgggggtattttcgagcgttgcggc

SEQ ID NO: 5795 - DNA, 26 bp, Artificial Sequences
  Synthetic
ttgggggtattttcgagcgttgcggc

SEQ ID NO: 5796 - DNA, 27 bp, Artificial Sequences
  Synthetic
tgggtaggagagagggtcgttcgttgt

SEQ ID NO: 5797 - DNA, 27 bp, Artificial Sequences
  Synthetic
agtgggtaggagagagggtcgttcgtt

SEQ ID NO: 5798 - DNA, 27 bp, Artificial Sequences
  Synthetic
aagtgggtaggagagagggtcgttcgt

SEQ ID NO: 5799 - DNA, 27 bp, Artificial Sequences
  Synthetic
ggagaagtgggtaggagagagggtcgt

SEQ ID NO: 5800 - DNA, 28 bp, Artificial Sequences
  Synthetic
gtgggtaggagagagggtcgttcgttgt

SEQ ID NO: 5801 - DNA, 29 bp, Artificial Sequences
  Synthetic
tgggggacgtaatttgtttttcgagaggc

SEQ ID NO: 5802 - DNA, 28 bp, Artificial Sequences
  Synthetic
gggggacgtaatttgtttttcgagaggc

SEQ ID NO: 5803 - DNA, 30 bp, Artificial Sequences
  Synthetic
ttgggggacgtaatttgtttttcgagaggc

SEQ ID NO: 5804 - DNA, 32 bp, Artificial Sequences
  Synthetic
ggttgggggacgtaatttgtttttcgagaggc

SEQ ID NO: 5805 - DNA, 31 bp, Artificial Sequences
  Synthetic
gttgggggacgtaatttgtttttcgagaggc

SEQ ID NO: 5806 - DNA, 31 bp, Artificial Sequences
  Synthetic
gcgttcgttcggtttgtatttgtttgaggcg

SEQ ID NO: 5807 - DNA, 31 bp, Artificial Sequences
  Synthetic
cgcgttcgttcggtttgtatttgtttgaggc

SEQ ID NO: 5808 - DNA, 32 bp, Artificial Sequences
  Synthetic
gcgttcgttcggtttgtatttgtttgaggcga

SEQ ID NO: 5809 - DNA, 30 bp, Artificial Sequences
  Synthetic
gcgttcgttcggtttgtatttgtttgaggc

SEQ ID NO: 5810 - DNA, 30 bp, Artificial Sequences
  Synthetic
cgttcgttcggtttgtatttgtttgaggcg

SEQ ID NO: 5811 - DNA, 27 bp, Artificial Sequences
  Synthetic
ttttaggtaggtgtaggtcgggcgggc

SEQ ID NO: 5812 - DNA, 28 bp, Artificial Sequences
  Synthetic
cgttttaggtaggtgtaggtcgggcggg

SEQ ID NO: 5813 - DNA, 28 bp, Artificial Sequences
  Synthetic
gttttaggtaggtgtaggtcgggcgggc

SEQ ID NO: 5814 - DNA, 27 bp, Artificial Sequences
  Synthetic
tttaggtaggtgtaggtcgggcgggcg

SEQ ID NO: 5815 - DNA, 26 bp, Artificial Sequences
  Synthetic
tttaggtaggtgtaggtcgggcgggc

SEQ ID NO: 5816 - DNA, 32 bp, Artificial Sequences
  Synthetic
agcgtcgttttagagataaatagatgtgcggt

SEQ ID NO: 5817 - DNA, 33 bp, Artificial Sequences
  Synthetic
agcgtcgttttagagataaatagatgtgcggtt

SEQ ID NO: 5818 - DNA, 33 bp, Artificial Sequences
  Synthetic
tagcgtcgttttagagataaatagatgtgcggt

SEQ ID NO: 5819 - DNA, 33 bp, Artificial Sequences
  Synthetic
gcgtcgttttagagataaatagatgtgcggttt

SEQ ID NO: 5820 - DNA, 34 bp, Artificial Sequences
  Synthetic
agcgtcgttttagagataaatagatgtgcggttt

SEQ ID NO: 5821 - DNA, 27 bp, Artificial Sequences
  Synthetic
ggggcggggtaggggcgttattttttg

SEQ ID NO: 5822 - DNA, 27 bp, Artificial Sequences
  Synthetic
ttttaggtaggtgtaggtcgggcgggc

SEQ ID NO: 5823 - DNA, 27 bp, Artificial Sequences
  Synthetic
tggggcggggtaggggcgttatttttt

SEQ ID NO: 5824 - DNA, 27 bp, Artificial Sequences
  Synthetic
gggcggggtaggggcgttattttttga

SEQ ID NO: 5825 - DNA, 27 bp, Artificial Sequences
  Synthetic
gtggggcggggtaggggcgttattttt

SEQ ID NO: 5826 - DNA, 27 bp, Artificial Sequences
  Synthetic
tatttagacggaggaggggcgggaggt

SEQ ID NO: 5827 - DNA, 27 bp, Artificial Sequences
  Synthetic
aggaggggcgggaggttttgttttcga

SEQ ID NO: 5828 - DNA, 27 bp, Artificial Sequences
  Synthetic
gaggaggggcgggaggttttgttttcg

SEQ ID NO: 5829 - DNA, 27 bp, Artificial Sequences
  Synthetic
gcgttttaggatggggtgcgtagtggg

SEQ ID NO: 5830 - DNA, 27 bp, Artificial Sequences
  Synthetic
tggggtgcgtagtgggtagttaagcgt

SEQ ID NO: 5831 - DNA, 27 bp, Artificial Sequences
  Synthetic
aaggagaaaatagggtcgtcggggcgg

SEQ ID NO: 5832 - DNA, 27 bp, Artificial Sequences
  Synthetic
aaaatagggtcgtcggggcggtaggtg

SEQ ID NO: 5833 - DNA, 27 bp, Artificial Sequences
  Synthetic
gaaaatagggtcgtcggggcggtaggt

SEQ ID NO: 5834 - DNA, 27 bp, Artificial Sequences
  Synthetic
agaaaatagggtcgtcggggcggtagg

SEQ ID NO: 5835 - DNA, 27 bp, Artificial Sequences
  Synthetic
ggagaaaatagggtcgtcggggcggta

SEQ ID NO: 5836 - DNA, 27 bp, Artificial Sequences
  Synthetic
gcgacgcggagttttggggtttaggtg

SEQ ID NO: 5837 - DNA, 27 bp, Artificial Sequences
  Synthetic
agcgacgcggagttttggggtttaggt

SEQ ID NO: 5838 - DNA, 27 bp, Artificial Sequences
  Synthetic
cgcggagttttggggtttaggtgtcgt

SEQ ID NO: 5839 - DNA, 27 bp, Artificial Sequences
  Synthetic
acgcggagttttggggtttaggtgtcg

SEQ ID NO: 5840 - DNA, 27 bp, Artificial Sequences
  Synthetic
cgacgcggagttttggggtttaggtgt

SEQ ID NO: 5841 - DNA, 27 bp, Artificial Sequences
  Synthetic
aaggagaaaatagggtcgtcggggcgg

SEQ ID NO: 5842 - DNA, 27 bp, Artificial Sequences
  Synthetic
aaaatagggtcgtcggggcggtaggtg

SEQ ID NO: 5843 - DNA, 27 bp, Artificial Sequences
  Synthetic
tcggggcggtaggtgaagttttcggag

SEQ ID NO: 5844 - DNA, 27 bp, Artificial Sequences
  Synthetic
ttcggaggcggttgggttattggggtt

SEQ ID NO: 5845 - DNA, 27 bp, Artificial Sequences
  Synthetic
tttcggaggcggttgggttattggggt

SEQ ID NO: 5846 - DNA, 27 bp, Artificial Sequences
  Synthetic
gcgacgcggagttttggggtttaggtg

SEQ ID NO: 5847 - DNA, 27 bp, Artificial Sequences
  Synthetic
agcgacgcggagttttggggtttaggt

SEQ ID NO: 5848 - DNA, 27 bp, Artificial Sequences
  Synthetic
cggattaagggttgttcggaggcggtg

SEQ ID NO: 5849 - DNA, 27 bp, Artificial Sequences
  Synthetic
cgcggagttttggggtttaggtgtcgt

SEQ ID NO: 5850 - DNA, 27 bp, Artificial Sequences
  Synthetic
acgcggagttttggggtttaggtgtcg

SEQ ID NO: 5851 - DNA, 27 bp, Artificial Sequences
  Synthetic
aaggagaaaatagggtcgtcggggcgg

SEQ ID NO: 5852 - DNA, 27 bp, Artificial Sequences
  Synthetic
aaaatagggtcgtcggggcggtaggtg

SEQ ID NO: 5853 - DNA, 27 bp, Artificial Sequences
  Synthetic
ttcggaggcggttgggttattggggtt

SEQ ID NO: 5854 - DNA, 27 bp, Artificial Sequences
  Synthetic
tttcggaggcggttgggttattggggt

SEQ ID NO: 5855 - DNA, 27 bp, Artificial Sequences
  Synthetic
gaaaatagggtcgtcggggcggtaggt

SEQ ID NO: 5856 - DNA, 27 bp, Artificial Sequences
  Synthetic
cggattaagggttgttcggaggcggtg

SEQ ID NO: 5857 - DNA, 27 bp, Artificial Sequences
  Synthetic
ttggcggattaagggttgttcggaggc

SEQ ID NO: 5858 - DNA, 27 bp, Artificial Sequences
  Synthetic
tggcggattaagggttgttcggaggcg

SEQ ID NO: 5859 - DNA, 27 bp, Artificial Sequences
  Synthetic
gcggattaagggttgttcggaggcggt

SEQ ID NO: 5860 - DNA, 27 bp, Artificial Sequences
  Synthetic
ggtgttcgggagcgttttttgtcgtcg

SEQ ID NO: 5861 - DNA, 27 bp, Artificial Sequences
  Synthetic
tttgggggatcgggtaggtaggggacg

SEQ ID NO: 5862 - DNA, 27 bp, Artificial Sequences
  Synthetic
tgggggatcgggtaggtaggggacgta

SEQ ID NO: 5863 - DNA, 26 bp, Artificial Sequences
  Synthetic
gggggatcgggtaggtaggggacgta

SEQ ID NO: 5864 - DNA, 26 bp, Artificial Sequences
  Synthetic
ttgggggatcgggtaggtaggggacg

SEQ ID NO: 5865 - DNA, 27 bp, Artificial Sequences
  Synthetic
ttgggggatcgggtaggtaggggacgt

SEQ ID NO: 5866 - DNA, 32 bp, Artificial Sequences
  Synthetic
tcgtatgtataatttgaacgcggttttggacg

SEQ ID NO: 5867 - DNA, 33 bp, Artificial Sequences
  Synthetic
atcgtatgtataatttgaacgcggttttggacg

SEQ ID NO: 5868 - DNA, 34 bp, Artificial Sequences
  Synthetic
aatcgtatgtataatttgaacgcggttttggacg

SEQ ID NO: 5869 - DNA, 35 bp, Artificial Sequences
  Synthetic
taatcgtatgtataatttgaacgcggttttggacg

SEQ ID NO: 5870 - DNA, 35 bp, Artificial Sequences
  Synthetic
cgtaatcgtatgtataatttgaacgcggttttgga

SEQ ID NO: 5871 - DNA, 27 bp, Artificial Sequences
  Synthetic
ttggtgagtttggtgtcgtcggggaac

SEQ ID NO: 5872 - DNA, 27 bp, Artificial Sequences
  Synthetic
tttggtgagtttggtgtcgtcggggaa

SEQ ID NO: 5873 - DNA, 27 bp, Artificial Sequences
  Synthetic
ttttggtgagtttggtgtcgtcgggga

SEQ ID NO: 5874 - DNA, 28 bp, Artificial Sequences
  Synthetic
tttggtgagtttggtgtcgtcggggaac

SEQ ID NO: 5875 - DNA, 26 bp, Artificial Sequences
  Synthetic
tggtgagtttggtgtcgtcggggaac

SEQ ID NO: 5876 - DNA, 27 bp, Artificial Sequences
  Synthetic
cgtcggttcgtaggggcgcgtttaata

SEQ ID NO: 5877 - DNA, 27 bp, Artificial Sequences
  Synthetic
tataggacgacgagtaggagaggcggc

SEQ ID NO: 5878 - DNA, 26 bp, Artificial Sequences
  Synthetic
cgtcggttcgtaggggcgcgtttaat

SEQ ID NO: 5879 - DNA, 28 bp, Artificial Sequences
  Synthetic
gtataggacgacgagtaggagaggcggc

SEQ ID NO: 5880 - DNA, 27 bp, Artificial Sequences
  Synthetic
gttgtattcgttgcgtaggagtcggcg

SEQ ID NO: 5881 - DNA, 27 bp, Artificial Sequences
  Synthetic
gggaggcggaggttgtagtgagtcgag

SEQ ID NO: 5882 - DNA, 27 bp, Artificial Sequences
  Synthetic
ttcgggaggcggaggttgtagtgagtc

SEQ ID NO: 5883 - DNA, 27 bp, Artificial Sequences
  Synthetic
cgtttgaattcgggaggcggaggttgt

SEQ ID NO: 5884 - DNA, 27 bp, Artificial Sequences
  Synthetic
tcgtttgaattcgggaggcggaggttg

SEQ ID NO: 5885 - DNA, 27 bp, Artificial Sequences
  Synthetic
attcgggaggcggaggttgtagtgagt

SEQ ID NO: 5886 - DNA, 27 bp, Artificial Sequences
  Synthetic
ggggaggggcgggggttagaatgtttt

SEQ ID NO: 5887 - DNA, 27 bp, Artificial Sequences
  Synthetic
gggaggggcgggggttagaatgttttt

SEQ ID NO: 5888 - DNA, 26 bp, Artificial Sequences
  Synthetic
ggggaggggcgggggttagaatgttt

SEQ ID NO: 5889 - DNA, 28 bp, Artificial Sequences
  Synthetic
ggggaggggcgggggttagaatgttttt

SEQ ID NO: 5890 - DNA, 27 bp, Artificial Sequences
  Synthetic
cggggaggggcgggggttagaatgttt

SEQ ID NO: 5891 - DNA, 30 bp, Artificial Sequences
  Synthetic
tcggtttagagtttgttatggcgaatcggt

SEQ ID NO: 5892 - DNA, 30 bp, Artificial Sequences
  Synthetic
cggtttagagtttgttatggcgaatcggtt

SEQ ID NO: 5893 - DNA, 32 bp, Artificial Sequences
  Synthetic
cgcggaatatcggtttagagtttgttatggcg

SEQ ID NO: 5894 - DNA, 31 bp, Artificial Sequences
  Synthetic
tcggtttagagtttgttatggcgaatcggtt

SEQ ID NO: 5895 - DNA, 31 bp, Artificial Sequences
  Synthetic
atcggtttagagtttgttatggcgaatcggt

SEQ ID NO: 5896 - DNA, 29 bp, Artificial Sequences
  Synthetic
cgcgttgtagtcgattcgttatggtaggt

SEQ ID NO: 5897 - DNA, 29 bp, Artificial Sequences
  Synthetic
tcgcgttgtagtcgattcgttatggtagg

SEQ ID NO: 5898 - DNA, 30 bp, Artificial Sequences
  Synthetic
tcgcgttgtagtcgattcgttatggtaggt

SEQ ID NO: 5899 - DNA, 30 bp, Artificial Sequences
  Synthetic
cgcgttgtagtcgattcgttatggtaggtt

SEQ ID NO: 5900 - DNA, 31 bp, Artificial Sequences
  Synthetic
tcgcgttgtagtcgattcgttatggtaggtt

SEQ ID NO: 5901 - DNA, 30 bp, Artificial Sequences; identical to SEQ ID NO: 5891
  Synthetic

SEQ ID NO: 5902 - DNA, 30 bp, Artificial Sequences; identical to SEQ ID NO: 5892
  Synthetic

SEQ ID NO: 5903 - DNA, 32 bp, Artificial Sequences; identical to SEQ ID NO: 5893
  Synthetic

SEQ ID NO: 5904 - DNA, 31 bp, Artificial Sequences; identical to SEQ ID NO: 5894
  Synthetic

SEQ ID NO: 5905 - DNA, 31 bp, Artificial Sequences; identical to SEQ ID NO: 5895
  Synthetic

SEQ ID NO: 5906 - DNA, 31 bp, Artificial Sequences
  Synthetic
cggatttgtttggttcggaattttcgtagcg

SEQ ID NO: 5907 - DNA, 32 bp, Artificial Sequences
  Synthetic
cggatttgtttggttcggaattttcgtagcgt

SEQ ID NO: 5908 - DNA, 32 bp, Artificial Sequences
  Synthetic
tcggatttgtttggttcggaattttcgtagcg

SEQ ID NO: 5909 - DNA, 33 bp, Artificial Sequences
  Synthetic
tcggatttgtttggttcggaattttcgtagcgt

SEQ ID NO: 5910 - DNA, 31 bp, Artificial Sequences
  Synthetic
ggatttgtttggttcggaattttcgtagcgt

SEQ ID NO: 5911 - DNA, 27 bp, Artificial Sequences
  Synthetic
cgttgcgggggtttcgggttaggtaga

SEQ ID NO: 5912 - DNA, 27 bp, Artificial Sequences
  Synthetic
gacgttgcgggggtttcgggttaggta

SEQ ID NO: 5913 - DNA, 27 bp, Artificial Sequences
  Synthetic
acgttgcgggggtttcgggttaggtag

SEQ ID NO: 5914 - DNA, 27 bp, Artificial Sequences
  Synthetic
ttttttggggacgttgcgggggtttcg

SEQ ID NO: 5915 - DNA, 26 bp, Artificial Sequences
  Synthetic
acgttgcgggggtttcgggttaggta

SEQ ID NO: 5916 - DNA, 29 bp, Artificial Sequences
  Synthetic
cgcgtttcgttagttttcggggttttagt

SEQ ID NO: 5917 - DNA, 30 bp, Artificial Sequences
  Synthetic
cgcgtttcgttagttttcggggttttagtt

SEQ ID NO: 5918 - DNA, 31 bp, Artificial Sequences
  Synthetic
cgcgtttcgttagttttcggggttttagttt

SEQ ID NO: 5919 - DNA, 32 bp, Artificial Sequences
  Synthetic
cgcgtttcgttagttttcggggttttagtttt

SEQ ID NO: 5920 - DNA, 33 bp, Artificial Sequences
  Synthetic
cgcgtttcgttagttttcggggttttagtttta

SEQ ID NO: 5921 - DNA, 27 bp, Artificial Sequences
  Synthetic
cgttgcgggggtttcgggttaggtaga

SEQ ID NO: 5922 - DNA, 27 bp, Artificial Sequences
  Synthetic
gacgttgcgggggtttcgggttaggta

SEQ ID NO: 5923 - DNA, 27 bp, Artificial Sequences
  Synthetic
acgttgcgggggtttcgggttaggtag

SEQ ID NO: 5924 - DNA, 27 bp, Artificial Sequences
  Synthetic
gggttggagtttcgggagttggcgaag

SEQ ID NO: 5925 - DNA, 27 bp, Artificial Sequences
  Synthetic
tttggggttggagtttcgggagttggc

SEQ ID NO: 5926 - DNA, 33 bp, Artificial Sequences
  Synthetic
attttgtttgtcgtgattaagttgtcgtttcgc

SEQ ID NO: 5927 - DNA, 35 bp, Artificial Sequences
  Synthetic
tcggtttattttgtttgtcgtgattaagttgtcgt

SEQ ID NO: 5928 - DNA, 36 bp, Artificial Sequences
  Synthetic
tcggtttattttgtttgtcgtgattaagttgtcgtt

SEQ ID NO: 5929 - DNA, 36 bp, Artificial Sequences
  Synthetic
ttcggtttattttgtttgtcgtgattaagttgtcgt

SEQ ID NO: 5930 - DNA, 36 bp, Artificial Sequences
  Synthetic
tttattttgtttgtcgtgattaagttgtcgtttcgc

SEQ ID NO: 5931 - DNA, 27 bp, Artificial Sequences
  Synthetic
gggttggagtttcgggagttggcgaag

SEQ ID NO: 5932 - DNA, 27 bp, Artificial Sequences
  Synthetic
tttggggttggagtttcgggagttggc

SEQ ID NO: 5933 - DNA, 27 bp, Artificial Sequences
  Synthetic
ggggttggagtttcgggagttggcgaa

SEQ ID NO: 5934 - DNA, 27 bp, Artificial Sequences
  Synthetic
ttggggttggagtttcgggagttggcg

SEQ ID NO: 5935 - DNA, 26 bp, Artificial Sequences
  Synthetic
ggggttggagtttcgggagttggcga

SEQ ID NO: 5936 - DNA, 35 bp, Artificial Sequences; identical to SEQ ID NO: 5927
  Synthetic

SEQ ID NO: 5937 - DNA, 36 bp, Artificial Sequences; identical to SEQ ID NO: 5928
  Synthetic

SEQ ID NO: 5938 - DNA, 36 bp, Artificial Sequences; identical to SEQ ID NO: 5929
  Synthetic

SEQ ID NO: 5939 - DNA, 27 bp, Artificial Sequences
  Synthetic
aggtgggtgttggaagaagggcggaat

SEQ ID NO: 5940 - DNA, 27 bp, Artificial Sequences
  Synthetic
ggtggggatttgagtgcggcgtgttag

SEQ ID NO: 5941 - DNA, 27 bp, Artificial Sequences
  Synthetic
atcggttcgttgtgggggtggggattt

SEQ ID NO: 5942 - DNA, 27 bp, Artificial Sequences
  Synthetic
aggtagaagaggagatttcggcgcggg

SEQ ID NO: 5943 - DNA, 27 bp, Artificial Sequences
  Synthetic
gaggtgggtgttggaagaagggcggaa

SEQ ID NO: 5944 - DNA, 27 bp, Artificial Sequences
  Synthetic
gggggtgcgggggtaaaggagagttta

SEQ ID NO: 5945 - DNA, 27 bp, Artificial Sequences
  Synthetic
aagtttttcggggcgtttcgggtaggt

SEQ ID NO: 5946 - DNA, 26 bp, Artificial Sequences
  Synthetic
gggggtgcgggggtaaaggagagttt

SEQ ID NO: 5947 - DNA, 27 bp, Artificial Sequences
  Synthetic
tgggggtgcgggggtaaaggagagttt

SEQ ID NO: 5948 - DNA, 28 bp, Artificial Sequences
  Synthetic
gggggtgcgggggtaaaggagagtttat

SEQ ID NO: 5949 - DNA, 27 bp, Artificial Sequences
  Synthetic
gagtgggagggaatgcgggaggtgatt

SEQ ID NO: 5950 - DNA, 27 bp, Artificial Sequences
  Synthetic
aggtagaagaggagatttcggcgcggg

SEQ ID NO: 5951 - DNA, 27 bp, Artificial Sequences
  Synthetic
agcgtttcggagggttttacgggagga

SEQ ID NO: 5952 - DNA, 27 bp, Artificial Sequences
  Synthetic
agtgggagggaatgcgggaggtgattt

SEQ ID NO: 5953 - DNA, 27 bp, Artificial Sequences
  Synthetic
gcgtttcggagggttttacgggaggag

SEQ ID NO: 5954 - DNA, 27 bp, Artificial Sequences
  Synthetic
cggggagatgggagagtaggcgagtga

SEQ ID NO: 5955 - DNA, 27 bp, Artificial Sequences
  Synthetic
gggggtgcgggggtaaaggagagttta

SEQ ID NO: 5956 - DNA, 27 bp, Artificial Sequences
  Synthetic
atttttaggtagcgggggtgggggtgc

SEQ ID NO: 5957 - DNA, 27 bp, Artificial Sequences
  Synthetic
agggaggggagttgagtttgcgatgga

SEQ ID NO: 5958 - DNA, 27 bp, Artificial Sequences
  Synthetic
aaggagggaggggagttgagtttgcga

SEQ ID NO: 5959 - DNA, 27 bp, Artificial Sequences
  Synthetic
gatggagggcgagaggggatttgggag

SEQ ID NO: 5960 - DNA, 27 bp, Artificial Sequences
  Synthetic
tgtattgtgagtttgggggtcggcggt

SEQ ID NO: 5961 - DNA, 27 bp, Artificial Sequences
  Synthetic
ggagggcgagaggggatttgggagttg

SEQ ID NO: 5962 - DNA, 27 bp, Artificial Sequences
  Synthetic
gtattgtgagtttgggggtcggcggtg

SEQ ID NO: 5963 - DNA, 27 bp, Artificial Sequences
  Synthetic
agatggagggcgagaggggatttggga

SEQ ID NO: 5964 - DNA, 29 bp, Artificial Sequences
  Synthetic
gggtgacgttagtagggttgggaatgggg

SEQ ID NO: 5965 - DNA, 29 bp, Artificial Sequences
  Synthetic
ggggtgacgttagtagggttgggaatggg

SEQ ID NO: 5966 - DNA, 29 bp, Artificial Sequences
  Synthetic
ggtgacgttagtagggttgggaatggggt

SEQ ID NO: 5967 - DNA, 28 bp, Artificial Sequences
  Synthetic
ggtgacgttagtagggttgggaatgggg

SEQ ID NO: 5968 - DNA, 28 bp, Artificial Sequences
  Synthetic
gggtgacgttagtagggttgggaatggg

SEQ ID NO: 5969 - DNA, 27 bp, Artificial Sequences
  Synthetic
ggtttttggaagtttaggtcgcggcgt

SEQ ID NO: 5970 - DNA, 28 bp, Artificial Sequences
  Synthetic
aggtttttggaagtttaggtcgcggcgt

SEQ ID NO: 5971 - DNA, 27 bp, Artificial Sequences
  Synthetic
aggtttttggaagtttaggtcgcggcg

SEQ ID NO: 5972 - DNA, 28 bp, Artificial Sequences
  Synthetic
ggtttttggaagtttaggtcgcggcgtt

SEQ ID NO: 5973 - DNA, 28 bp, Artificial Sequences
  Synthetic
tggacgttttgtagtggtggggtttcgt

SEQ ID NO: 5974 - DNA, 27 bp, Artificial Sequences
  Synthetic
gcggggattgttcgtggcgttaaggtt

SEQ ID NO: 5975 - DNA, 27 bp, Artificial Sequences
  Synthetic
gtgcggggattgttcgtggcgttaagg

SEQ ID NO: 5976 - DNA, 27 bp, Artificial Sequences
  Synthetic
ggtgcggggattgttcgtggcgttaag

SEQ ID NO: 5977 - DNA, 27 bp, Artificial Sequences
  Synthetic
taaggttacgggattgcggcgggagaa

SEQ ID NO: 5978 - DNA, 27 bp, Artificial Sequences
  Synthetic
ttaaggttacgggattgcggcgggaga

SEQ ID NO: 5979 - DNA, 27 bp, Artificial Sequences
  Synthetic
ggtttttggaagtttaggtcgcggcgt

SEQ ID NO: 5980 - DNA, 28 bp, Artificial Sequences
  Synthetic
aggtttttggaagtttaggtcgcggcgt

SEQ ID NO: 5981 - DNA, 27 bp, Artificial Sequences
  Synthetic
aggtttttggaagtttaggtcgcggcg

SEQ ID NO: 5982 - DNA, 28 bp, Artificial Sequences
  Synthetic
ggtttttggaagtttaggtcgcggcgtt

SEQ ID NO: 5983 - DNA, 29 bp, Artificial Sequences
  Synthetic
aggtttttggaagtttaggtcgcggcgtt

SEQ ID NO: 5984 - DNA, 27 bp, Artificial Sequences
  Synthetic
agataaggggttcggtgcggggattgt

SEQ ID NO: 5985 - DNA, 27 bp, Artificial Sequences
  Synthetic
taaggggttcggtgcggggattgttcg

SEQ ID NO: 5986 - DNA, 27 bp, Artificial Sequences
  Synthetic
ataaggggttcggtgcggggattgttc

SEQ ID NO: 5987 - DNA, 27 bp, Artificial Sequences
  Synthetic
gataaggggttcggtgcggggattgtt

SEQ ID NO: 5988 - DNA, 28 bp, Artificial Sequences
  Synthetic
agataaggggttcggtgcggggattgtt

SEQ ID NO: 5989 - DNA, 27 bp, Artificial Sequences
  Synthetic
tttcgttgttttggggaatcgcgtcgc

SEQ ID NO: 5990 - DNA, 28 bp, Artificial Sequences
  Synthetic
ttttcgttgttttggggaatcgcgtcgc

SEQ ID NO: 5991 - DNA, 26 bp, Artificial Sequences
  Synthetic
ttcgttgttttggggaatcgcgtcgc

SEQ ID NO: 5992 - DNA, 27 bp, Artificial Sequences
  Synthetic
ttttcgttgttttggggaatcgcgtcg

SEQ ID NO: 5993 - DNA, 29 bp, Artificial Sequences
  Synthetic
attttcgttgttttggggaatcgcgtcgc

SEQ ID NO: 5994 - DNA, 28 bp, Artificial Sequences
  Synthetic
gcgtttaagttgcggggtaaatggttcg

SEQ ID NO: 5995 - DNA, 31 bp, Artificial Sequences
  Synthetic
ggggtaaatggttcgcgggttgatttatggc

SEQ ID NO: 5996 - DNA, 30 bp, Artificial Sequences
  Synthetic
gggtaaatggttcgcgggttgatttatggc

SEQ ID NO: 5997 - DNA, 26 bp, Artificial Sequences
  Synthetic
ggggtaaatggttcgcgggttgattt

SEQ ID NO: 5998 - DNA, 30 bp, Artificial Sequences
  Synthetic
ggggtaaatggttcgcgggttgatttatgg

SEQ ID NO: 5999 - DNA, 27 bp, Artificial Sequences
  Synthetic
aggggaatcggggataggaggaggtgg

SEQ ID NO: 6000 - DNA, 27 bp, Artificial Sequences
  Synthetic
ggggaatcggggataggaggaggtggt

SEQ ID NO: 6001 - DNA, 27 bp, Artificial Sequences
  Synthetic
ggaggtggtagaaggaaaggtcggggt

SEQ ID NO: 6002 - DNA, 28 bp, Artificial Sequences
  Synthetic
ggaaggggaatcggggataggaggaggt

SEQ ID NO: 6003 - DNA, 28 bp, Artificial Sequences
  Synthetic
tggaaggggaatcggggataggaggagg

SEQ ID NO: 6004 - DNA, 27 bp, Artificial Sequences
  Synthetic
ggggttttttcgttcggggttaggcgt

SEQ ID NO: 6005 - DNA, 27 bp, Artificial Sequences
  Synthetic
tggggttttttcgttcggggttaggcg

SEQ ID NO: 6006 - DNA, 28 bp, Artificial Sequences
  Synthetic
ttggggttttttcgttcggggttaggcg

SEQ ID NO: 6007 - DNA, 28 bp, Artificial Sequences
  Synthetic
tggggttttttcgttcggggttaggcgt

SEQ ID NO: 6008 - DNA, 28 bp, Artificial Sequences
  Synthetic
ggggttttttcgttcggggttaggcgta

SEQ ID NO: 6009 - DNA, 27 bp, Artificial Sequences
  Synthetic
tttcggatttttaaaggggcggcgggg

SEQ ID NO: 6010 - DNA, 27 bp, Artificial Sequences
  Synthetic
cggatttttaaaggggcggcggggttt

SEQ ID NO: 6011 - DNA, 27 bp, Artificial Sequences
  Synthetic
tcggatttttaaaggggcggcggggtt

SEQ ID NO: 6012 - DNA, 27 bp, Artificial Sequences
  Synthetic
ttcggatttttaaaggggcggcggggt

SEQ ID NO: 6013 - DNA, 28 bp, Artificial Sequences
  Synthetic
ttttcggatttttaaaggggcggcgggg

SEQ ID NO: 6014 - DNA, 27 bp, Artificial Sequences
  Synthetic
agggtgcggggggtttagaattcgagg

SEQ ID NO: 6015 - DNA, 27 bp, Artificial Sequences
  Synthetic
taggggttcgggagggtggagagaagg

SEQ ID NO: 6016 - DNA, 27 bp, Artificial Sequences
  Synthetic
gaaggggcgggagttaggatgagggtg

SEQ ID NO: 6017 - DNA, 27 bp, Artificial Sequences
  Synthetic
agaaggggcgggagttaggatgagggt

SEQ ID NO: 6018 - DNA, 27 bp, Artificial Sequences
  Synthetic
gagttaggatgagggtgcggggggttt

SEQ ID NO: 6019 - DNA, 27 bp, Artificial Sequences
  Synthetic
agaggatagaggttaggacggtggcga

SEQ ID NO: 6020 - DNA, 27 bp, Artificial Sequences
  Synthetic
gaggatagaggttaggacggtggcgaa

SEQ ID NO: 6021 - DNA, 28 bp, Artificial Sequences
  Synthetic
agaggatagaggttaggacggtggcgaa

SEQ ID NO: 6022 - DNA, 27 bp, Artificial Sequences
  Synthetic
aggatagaggttaggacggtggcgaaa

SEQ ID NO: 6023 - DNA, 28 bp, Artificial Sequences
  Synthetic
gaggatagaggttaggacggtggcgaaa

SEQ ID NO: 6024 - DNA, 27 bp, Artificial Sequences
  Synthetic
ggtcgggttgagtcgggttggtttcga

SEQ ID NO: 6025 - DNA, 27 bp, Artificial Sequences
  Synthetic
tcggtcgggttgagtcgggttggtttc

SEQ ID NO: 6026 - DNA, 27 bp, Artificial Sequences
  Synthetic
gtcggtcgggttgagtcgggttggttt

SEQ ID NO: 6027 - DNA, 26 bp, Artificial Sequences
  Synthetic
tcggtcgggttgagtcgggttggttt

SEQ ID NO: 6028 - DNA, 27 bp, Artificial Sequences
  Synthetic
cggtcgggttgagtcgggttggtttcg

SEQ ID NO: 6029 - DNA, 27 bp, Artificial Sequences
  Synthetic
agtcgagggtagggttttgttgtgcgt

SEQ ID NO: 6030 - DNA, 28 bp, Artificial Sequences
  Synthetic
ggagtcgagggtagggttttgttgtgcg

SEQ ID NO: 6031 - DNA, 29 bp, Artificial Sequences
  Synthetic
ggagtcgagggtagggttttgttgtgcgt

SEQ ID NO: 6032 - DNA, 28 bp, Artificial Sequences
  Synthetic
gagtcgagggtagggttttgttgtgcgt

SEQ ID NO: 6033 - DNA, 27 bp, Artificial Sequences
  Synthetic
gagtcgagggtagggttttgttgtgcg

SEQ ID NO: 6034 - DNA, 27 bp, Artificial Sequences
  Synthetic
ggcgcggagatgggttagagttcggtt

SEQ ID NO: 6035 - DNA, 27 bp, Artificial Sequences
  Synthetic
ggtgagggggtaaagtcggttcggagt

SEQ ID NO: 6036 - DNA, 27 bp, Artificial Sequences
  Synthetic
aggtgagggggtaaagtcggttcggag

SEQ ID NO: 6037 - DNA, 27 bp, Artificial Sequences
  Synthetic
gacggcgcggagatgggttagagttcg

SEQ ID NO: 6038 - DNA, 27 bp, Artificial Sequences
  Synthetic
cgacggcgcggagatgggttagagttc

SEQ ID NO: 6039 - DNA, 27 bp, Artificial Sequences
  Synthetic
gtcgagggtttgttggaattcgcgggg

SEQ ID NO: 6040 - DNA, 27 bp, Artificial Sequences
  Synthetic
cgagggtttgttggaattcgcggggtt

SEQ ID NO: 6041 - DNA, 27 bp, Artificial Sequences
  Synthetic
cgtcgagggtttgttggaattcgcggg

SEQ ID NO: 6042 - DNA, 27 bp, Artificial Sequences
  Synthetic
tcgagggtttgttggaattcgcggggt

SEQ ID NO: 6043 - DNA, 28 bp, Artificial Sequences
  Synthetic
cgagggtttgttggaattcgcggggttt

SEQ ID NO: 6044 - DNA, 27 bp, Artificial Sequences
  Synthetic
aagtcggttcggagttttcgggggtgt

SEQ ID NO: 6045 - DNA, 27 bp, Artificial Sequences
  Synthetic
cggttcggagttttcgggggtgtagga

SEQ ID NO: 6046 - DNA, 27 bp, Artificial Sequences
  Synthetic
tcggttcggagttttcgggggtgtagg

SEQ ID NO: 6047 - DNA, 27 bp, Artificial Sequences
  Synthetic
tagagggttttcgttcgtaggggcgcg

SEQ ID NO: 6048 - DNA, 27 bp, Artificial Sequences
  Synthetic
ttttcgggggtgtaggaggggtttcgc

SEQ ID NO: 6049 - DNA, 27 bp, Artificial Sequences
  Synthetic
tgagtggttcggtcgggcgtagagttt

SEQ ID NO: 6050 - DNA, 27 bp, Artificial Sequences
  Synthetic
ttgagtggttcggtcgggcgtagagtt

SEQ ID NO: 6051 - DNA, 27 bp, Artificial Sequences
  Synthetic
tttgagtggttcggtcgggcgtagagt

SEQ ID NO: 6052 - DNA, 27 bp, Artificial Sequences
  Synthetic
ggagttttgagtggttcggtcgggcgt

SEQ ID NO: 6053 - DNA, 27 bp, Artificial Sequences
  Synthetic
ttcggtcgggcgtagagttttagggga

SEQ ID NO: 6054 - DNA, 27 bp, Artificial Sequences
  Synthetic
tagagggttttcgttcgtaggggcgcg

SEQ ID NO: 6055 - DNA, 27 bp, Artificial Sequences
  Synthetic
agggttttcgttcgtaggggcgcgttc

SEQ ID NO: 6056 - DNA, 27 bp, Artificial Sequences
  Synthetic
gagggttttcgttcgtaggggcgcgtt

SEQ ID NO: 6057 - DNA, 27 bp, Artificial Sequences
  Synthetic
ttagagggttttcgttcgtaggggcgc

SEQ ID NO: 6058 - DNA, 26 bp, Artificial Sequences
  Synthetic
gggttttcgttcgtaggggcgcgttc

SEQ ID NO: 6059 - DNA, 27 bp, Artificial Sequences
  Synthetic
tgagtggttcggtcgggcgtagagttt

SEQ ID NO: 6060 - DNA, 27 bp, Artificial Sequences
  Synthetic
ttgagtggttcggtcgggcgtagagtt

SEQ ID NO: 6061 - DNA, 27 bp, Artificial Sequences
  Synthetic
tttgagtggttcggtcgggcgtagagt

SEQ ID NO: 6062 - DNA, 27 bp, Artificial Sequences
  Synthetic
atttggagttcgaagtgggtgtgcggg

SEQ ID NO: 6063 - DNA, 27 bp, Artificial Sequences
  Synthetic
ggagttttgagtggttcggtcgggcgt

SEQ ID NO: 6064 - DNA, 27 bp, Artificial Sequences
  Synthetic
gggtcgtggagggtttcgggttgtttt

SEQ ID NO: 6065 - DNA, 27 bp, Artificial Sequences
  Synthetic
ggggtcgtggagggtttcgggttgttt

SEQ ID NO: 6066 - DNA, 27 bp, Artificial Sequences
  Synthetic
tcgtcgcgtcggtttttcggttttgtt

SEQ ID NO: 6067 - DNA, 28 bp, Artificial Sequences
  Synthetic
gggtcgtggagggtttcgggttgttttt

SEQ ID NO: 6068 - DNA, 26 bp, Artificial Sequences
  Synthetic
ggggtcgtggagggtttcgggttgtt

SEQ ID NO: 6069 - DNA, 27 bp, Artificial Sequences
  Synthetic
cgtcgggggattcgttggggtttttcg

SEQ ID NO: 6070 - DNA, 27 bp, Artificial Sequences
  Synthetic
gcggaggtttggcgtttcggaggatag

SEQ ID NO: 6071 - DNA, 27 bp, Artificial Sequences
  Synthetic
ggcggaggtttggcgtttcggaggata

SEQ ID NO: 6072 - DNA, 27 bp, Artificial Sequences
  Synthetic
gtcgggggattcgttggggtttttcgt

SEQ ID NO: 6073 - DNA, 27 bp, Artificial Sequences
  Synthetic
gtcgtcgggggattcgttggggttttt

SEQ ID NO: 6074 - DNA, 27 bp, Artificial Sequences
  Synthetic
cgggaggtcgtttgggttcggttttgg

SEQ ID NO: 6075 - DNA, 27 bp, Artificial Sequences
  Synthetic
gggaggtcgtttgggttcggttttgga

SEQ ID NO: 6076 - DNA, 28 bp, Artificial Sequences
  Synthetic
cgggaggtcgtttgggttcggttttgga

SEQ ID NO: 6077 - DNA, 28 bp, Artificial Sequences
  Synthetic
gggaggtcgtttgggttcggttttggat

SEQ ID NO: 6078 - DNA, 27 bp, Artificial Sequences
  Synthetic
gatcgtcgcgtcggtttttcggttttg

SEQ ID NO: 6079 - DNA, 27 bp, Artificial Sequences
  Synthetic
cgatagggaggatttcggcggggagtt

SEQ ID NO: 6080 - DNA, 27 bp, Artificial Sequences
  Synthetic
gggttttgggagttgggttgagcgagg

SEQ ID NO: 6081 - DNA, 27 bp, Artificial Sequences
  Synthetic
tgggttttgggagttgggttgagcgag

SEQ ID NO: 6082 - DNA, 27 bp, Artificial Sequences
  Synthetic
ggggtttcggtttatagggcgcggagg

SEQ ID NO: 6083 - DNA, 27 bp, Artificial Sequences
  Synthetic
gcggggttgattcggtagagcggttag

SEQ ID NO: 6084 - DNA, 27 bp, Artificial Sequences
  Synthetic
aaggtcggggcggagtgggttgtttaa

SEQ ID NO: 6085 - DNA, 27 bp, Artificial Sequences
  Synthetic
gaagttagaaggtcggggcggagtggg

SEQ ID NO: 6086 - DNA, 27 bp, Artificial Sequences
  Synthetic
cgggaagttttgggtaggcgttcgtgg

SEQ ID NO: 6087 - DNA, 27 bp, Artificial Sequences
  Synthetic
ggtcggggcggagtgggttgtttaaga

SEQ ID NO: 6088 - DNA, 27 bp, Artificial Sequences
  Synthetic
gaaggtcggggcggagtgggttgttta

SEQ ID NO: 6089 - DNA, 27 bp, Artificial Sequences
  Synthetic
acgggcgtttgtttagggtttttcggt

SEQ ID NO: 6090 - DNA, 28 bp, Artificial Sequences
  Synthetic
acgggcgtttgtttagggtttttcggtt

SEQ ID NO: 6091 - DNA, 27 bp, Artificial Sequences
  Synthetic
cgggcgtttgtttagggtttttcggtt

SEQ ID NO: 6092 - DNA, 28 bp, Artificial Sequences
  Synthetic
cgggcgtttgtttagggtttttcggttg

SEQ ID NO: 6093 - DNA, 29 bp, Artificial Sequences
  Synthetic
cgggcgtttgtttagggtttttcggttgt

SEQ ID NO: 6094 - DNA, 27 bp, Artificial Sequences
  Synthetic
cggggtttagatcgtttcgggcgggta

SEQ ID NO: 6095 - DNA, 27 bp, Artificial Sequences
  Synthetic
ggaggtgtcggaggatggtaagagcgt

SEQ ID NO: 6096 - DNA, 27 bp, Artificial Sequences
  Synthetic
tggaggtgtcggaggatggtaagagcg

SEQ ID NO: 6097 - DNA, 27 bp, Artificial Sequences
  Synthetic
aggtgtcggaggatggtaagagcgtgt

SEQ ID NO: 6098 - DNA, 28 bp, Artificial Sequences
  Synthetic
cggggtttagatcgtttcgggcgggtat

SEQ ID NO: 6099 - DNA, 27 bp, Artificial Sequences
  Synthetic
gagaatcgttgcgggtggttaggcgtc

SEQ ID NO: 6100 - DNA, 27 bp, Artificial Sequences
  Synthetic
agaatcgttgcgggtggttaggcgtcg

SEQ ID NO: 6101 - DNA, 26 bp, Artificial Sequences
  Synthetic
gaatcgttgcgggtggttaggcgtcg

SEQ ID NO: 6102 - DNA, 27 bp, Artificial Sequences
  Synthetic
gaatcgttgcgggtggttaggcgtcgg

SEQ ID NO: 6103 - DNA, 26 bp, Artificial Sequences
  Synthetic
agaatcgttgcgggtggttaggcgtc

SEQ ID NO: 6104 - DNA, 27 bp, Artificial Sequences
  Synthetic
ggaggtgtcggaggatggtaagagcgt

SEQ ID NO: 6105 - DNA, 27 bp, Artificial Sequences
  Synthetic
tggaggtgtcggaggatggtaagagcg

SEQ ID NO: 6106 - DNA, 27 bp, Artificial Sequences
  Synthetic
aggtgtcggaggatggtaagagcgtgt

SEQ ID NO: 6107 - DNA, 28 bp, Artificial Sequences
  Synthetic
ggaggtgtcggaggatggtaagagcgtg

SEQ ID NO: 6108 - DNA, 28 bp, Artificial Sequences
  Synthetic
tggaggtgtcggaggatggtaagagcgt

SEQ ID NO: 6109 - DNA, 27 bp, Artificial Sequences
  Synthetic
gtagtcggtcgtagggtttaggcgcgt

SEQ ID NO: 6110 - DNA, 27 bp, Artificial Sequences
  Synthetic
gtcggtcgtagggtttaggcgcgtagg

SEQ ID NO: 6111 - DNA, 27 bp, Artificial Sequences
  Synthetic
agtcggtcgtagggtttaggcgcgtag

SEQ ID NO: 6112 - DNA, 27 bp, Artificial Sequences
  Synthetic
agtagtcggtcgtagggtttaggcgcg

SEQ ID NO: 6113 - DNA, 27 bp, Artificial Sequences
  Synthetic
gagaatcgttgcgggtggttaggcgtc

SEQ ID NO: 6114 - DNA, 28 bp, Artificial Sequences
  Synthetic
cgttgagtttggagcggtttttcgtcgg

SEQ ID NO: 6115 - DNA, 27 bp, Artificial Sequences
  Synthetic
gcgttgagtttggagcggtttttcgtc

SEQ ID NO: 6116 - DNA, 29 bp, Artificial Sequences
  Synthetic
gcgttgagtttggagcggtttttcgtcgg

SEQ ID NO: 6117 - DNA, 27 bp, Artificial Sequences
  Synthetic
gttgagtttggagcggtttttcgtcgg

SEQ ID NO: 6118 - DNA, 27 bp, Artificial Sequences
  Synthetic
tcgttggtttttgggcgtttgtttggt

SEQ ID NO: 6119 - DNA, 27 bp, Artificial Sequences
  Synthetic
cggtcgtagggtttaggcgcgtaggtt

SEQ ID NO: 6120 - DNA, 27 bp, Artificial Sequences
  Synthetic
gtagtcggtcgtagggtttaggcgcgt

SEQ ID NO: 6121 - DNA, 27 bp, Artificial Sequences
  Synthetic
gtcggtcgtagggtttaggcgcgtagg

SEQ ID NO: 6122 - DNA, 27 bp, Artificial Sequences
  Synthetic
agtcggtcgtagggtttaggcgcgtag

SEQ ID NO: 6123 - DNA, 27 bp, Artificial Sequences
  Synthetic
agtagtcggtcgtagggtttaggcgcg

SEQ ID NO: 6124 - DNA, 27 bp, Artificial Sequences
  Synthetic
gcggtcggttattgggtgttggggttg

SEQ ID NO: 6125 - DNA, 27 bp, Artificial Sequences
  Synthetic
tttgcggtcggttattgggtgttgggg

SEQ ID NO: 6126 - DNA, 27 bp, Artificial Sequences
  Synthetic
tgcggtcggttattgggtgttggggtt

SEQ ID NO: 6127 - DNA, 27 bp, Artificial Sequences
  Synthetic
ttgcggtcggttattgggtgttggggt

SEQ ID NO: 6128 - DNA, 27 bp, Artificial Sequences
  Synthetic
cggtcggttattgggtgttggggttgt

SEQ ID NO: 6129 - DNA, 22 bp, Artificial Sequences
  Synthetic
cgtttaggcgtcgcgggggtac

SEQ ID NO: 6130 - DNA, 22 bp, Artificial Sequences
  Synthetic
gcggtgcggggttaggacgaag

SEQ ID NO: 6131 - DNA, 21 bp, Artificial Sequences
  Synthetic
gcggtgcggggttaggacgaa

SEQ ID NO: 6132 - DNA, 21 bp, Artificial Sequences
  Synthetic
cgtttaggcgtcgcgggggta

SEQ ID NO: 6133 - DNA, 20 bp, Artificial Sequences
  Synthetic
cgtttaggcgtcgcgggggt

SEQ ID NO: 6134 - DNA, 27 bp, Artificial Sequences
  Synthetic
gcggtcggttattgggtgttggggttg

SEQ ID NO: 6135 - DNA, 27 bp, Artificial Sequences
  Synthetic
tttgcggtcggttattgggtgttgggg

SEQ ID NO: 6136 - DNA, 27 bp, Artificial Sequences
  Synthetic
tgcggtcggttattgggtgttggggtt

SEQ ID NO: 6137 - DNA, 27 bp, Artificial Sequences
  Synthetic
ttgcggtcggttattgggtgttggggt

SEQ ID NO: 6138 - DNA, 27 bp, Artificial Sequences
  Synthetic
cggtcggttattgggtgttggggttgt

SEQ ID NO: 6139 - DNA, 28 bp, Artificial Sequences
  Synthetic
tggaaggtgaagatgtgggagtcgtcgg

SEQ ID NO: 6140 - DNA, 27 bp, Artificial Sequences
  Synthetic
ggaaggtgaagatgtgggagtcgtcgg

SEQ ID NO: 6141 - DNA, 28 bp, Artificial Sequences
  Synthetic
ggaaggtgaagatgtgggagtcgtcgga

SEQ ID NO: 6142 - DNA, 27 bp, Artificial Sequences
  Synthetic
aggtgtcgtggaaggtgaagatgtggg

SEQ ID NO: 6143 - DNA, 27 bp, Artificial Sequences
  Synthetic
ggtgtcgtggaaggtgaagatgtggga

SEQ ID NO: 6144 - DNA, 27 bp, Artificial Sequences
  Synthetic
gcggtcggttattgggtgttggggttg

SEQ ID NO: 6145 - DNA, 27 bp, Artificial Sequences
  Synthetic
tttgcggtcggttattgggtgttgggg

SEQ ID NO: 6146 - DNA, 27 bp, Artificial Sequences
  Synthetic
tgcggtcggttattgggtgttggggtt

SEQ ID NO: 6147 - DNA, 27 bp, Artificial Sequences
  Synthetic
ttgcggtcggttattgggtgttggggt

SEQ ID NO: 6148 - DNA, 27 bp, Artificial Sequences
  Synthetic
cggtcggttattgggtgttggggttgt

SEQ ID NO: 6149 - DNA, 28 bp, Artificial Sequences
  Synthetic
tggaaggtgaagatgtgggagtcgtcgg

SEQ ID NO: 6150 - DNA, 27 bp, Artificial Sequences
  Synthetic
ggaaggtgaagatgtgggagtcgtcgg

SEQ ID NO: 6151 - DNA, 28 bp, Artificial Sequences
  Synthetic
ggaaggtgaagatgtgggagtcgtcgga

SEQ ID NO: 6152 - DNA, 27 bp, Artificial Sequences
  Synthetic
aggtgtcgtggaaggtgaagatgtggg

SEQ ID NO: 6153 - DNA, 27 bp, Artificial Sequences
  Synthetic
ggtgtcgtggaaggtgaagatgtggga

SEQ ID NO: 6154 - DNA, 27 bp, Artificial Sequences
  Synthetic
agcgggtagatggttaggggattcgga

SEQ ID NO: 6155 - DNA, 27 bp, Artificial Sequences
  Synthetic
tcggtagcgggtagatggttaggggat

SEQ ID NO: 6156 - DNA, 27 bp, Artificial Sequences
  Synthetic
atcggtagcgggtagatggttagggga

SEQ ID NO: 6157 - DNA, 27 bp, Artificial Sequences
  Synthetic
cgtcgtcgtgggttttgggtttgaagt

SEQ ID NO: 6158 - DNA, 27 bp, Artificial Sequences
  Synthetic
tggttaggggattcggatgttcgtcgt

SEQ ID NO: 6159 - DNA, 24 bp, Artificial Sequences
  Synthetic
gcggttgcgttgtttgaggtttcg

SEQ ID NO: 6160 - DNA, 27 bp, Artificial Sequences
  Synthetic
cggggaagaatttggttaagggtcgga

SEQ ID NO: 6161 - DNA, 27 bp, Artificial Sequences
  Synthetic
tcggggaagaatttggttaagggtcgg

SEQ ID NO: 6162 - DNA, 28 bp, Artificial Sequences
  Synthetic
tcggggaagaatttggttaagggtcgga

SEQ ID NO: 6163 - DNA, 28 bp, Artificial Sequences
  Synthetic
ttcggggaagaatttggttaagggtcgg

SEQ ID NO: 6164 - DNA, 28 bp, Artificial Sequences
  Synthetic
cggggaagaatttggttaagggtcggat

SEQ ID NO: 6165 - DNA, 27 bp, Artificial Sequences
  Synthetic
tcgaattgttgggggtgcggagtgttt

SEQ ID NO: 6166 - DNA, 27 bp, Artificial Sequences
  Synthetic
ttcgaattgttgggggtgcggagtgtt

SEQ ID NO: 6167 - DNA, 27 bp, Artificial Sequences
  Synthetic
tttcgaattgttgggggtgcggagtgt

SEQ ID NO: 6168 - DNA, 27 bp, Artificial Sequences
  Synthetic
tgtttcgaattgttgggggtgcggagt

SEQ ID NO: 6169 - DNA, 27 bp, Artificial Sequences
  Synthetic
agggcggcgtttagaagttgtaggtgg

SEQ ID NO: 6170 - DNA, 27 bp, Artificial Sequences
  Synthetic
cggggaagaatttggttaagggtcgga

SEQ ID NO: 6171 - DNA, 27 bp, Artificial Sequences
  Synthetic
tcggggaagaatttggttaagggtcgg

SEQ ID NO: 6172 - DNA, 28 bp, Artificial Sequences
  Synthetic
tcggggaagaatttggttaagggtcgga

SEQ ID NO: 6173 - DNA, 28 bp, Artificial Sequences
  Synthetic
ttcggggaagaatttggttaagggtcgg

SEQ ID NO: 6174 - DNA, 28 bp, Artificial Sequences
  Synthetic
cggggaagaatttggttaagggtcggat

SEQ ID NO: 6175 - DNA, 27 bp, Artificial Sequences
  Synthetic
tcgaattgttgggggtgcggagtgttt

SEQ ID NO: 6176 - DNA, 27 bp, Artificial Sequences
  Synthetic
ttcgaattgttgggggtgcggagtgtt

SEQ ID NO: 6177 - DNA, 27 bp, Artificial Sequences
  Synthetic
tttcgaattgttgggggtgcggagtgt

SEQ ID NO: 6178 - DNA, 27 bp, Artificial Sequences
  Synthetic
tgtttcgaattgttgggggtgcggagt

SEQ ID NO: 6179 - DNA, 28 bp, Artificial Sequences
  Synthetic
gtttcgaattgttgggggtgcggagtgt

SEQ ID NO: 6180 - DNA, 27 bp, Artificial Sequences
  Synthetic
gtaattcggggtatggagtcggcgggg

SEQ ID NO: 6181 - DNA, 27 bp, Artificial Sequences
  Synthetic
agtaattcggggtatggagtcggcggg

SEQ ID NO: 6182 - DNA, 27 bp, Artificial Sequences
  Synthetic
cggtcggggtttggagaagtagcgttg

SEQ ID NO: 6183 - DNA, 27 bp, Artificial Sequences
  Synthetic
gcggtcggggtttggagaagtagcgtt

SEQ ID NO: 6184 - DNA, 28 bp, Artificial Sequences
  Synthetic
cggtcggggtttggagaagtagcgttga

SEQ ID NO: 6185 - DNA, 27 bp, Artificial Sequences
  Synthetic
cggagtcgtcggtttaagtcgggagcg

SEQ ID NO: 6186 - DNA, 27 bp, Artificial Sequences
  Synthetic
tttaagaggggtttggtgggcggtgtc

SEQ ID NO: 6187 - DNA, 27 bp, Artificial Sequences
  Synthetic
ttttaagaggggtttggtgggcggtgt

SEQ ID NO: 6188 - DNA, 28 bp, Artificial Sequences
  Synthetic
ttttaagaggggtttggtgggcggtgtc

SEQ ID NO: 6189 - DNA, 26 bp, Artificial Sequences
  Synthetic
ggagtcgtcggtttaagtcgggagcg

SEQ ID NO: 6190 - DNA, 27 bp, Artificial Sequences
  Synthetic
cggtcggggtttggagaagtagcgttg

SEQ ID NO: 6191 - DNA, 27 bp, Artificial Sequences
  Synthetic
gcggtcggggtttggagaagtagcgtt

SEQ ID NO: 6192 - DNA, 28 bp, Artificial Sequences
  Synthetic
cggtcggggtttggagaagtagcgttga

SEQ ID NO: 6193 - DNA, 27 bp, Artificial Sequences
  Synthetic
ggtcggggtttggagaagtagcgttga

SEQ ID NO: 6194 - DNA, 26 bp, Artificial Sequences
  Synthetic
gcggtcggggtttggagaagtagcgt

SEQ ID NO: 6195 - DNA, 27 bp, Artificial Sequences
  Synthetic
cggagtcgtcggtttaagtcgggagcg

SEQ ID NO: 6196 - DNA, 26 bp, Artificial Sequences
  Synthetic
ggagtcgtcggtttaagtcgggagcg

SEQ ID NO: 6197 - DNA, 26 bp, Artificial Sequences
  Synthetic
cggagtcgtcggtttaagtcgggagc

SEQ ID NO: 6198 - DNA, 24 bp, Artificial Sequences
  Synthetic
gtttaagtcgggagcgcggcggag

SEQ ID NO: 6199 - DNA, 25 bp, Artificial Sequences
  Synthetic
ggtttaagtcgggagcgcggcggag

SEQ ID NO: 6200 - DNA, 27 bp, Artificial Sequences
  Synthetic
gcgtgtatttgtttcgtttcgtcgcgt

SEQ ID NO: 6201 - DNA, 27 bp, Artificial Sequences
  Synthetic
tcgcgtgtatttgtttcgtttcgtcgc

SEQ ID NO: 6202 - DNA, 28 bp, Artificial Sequences
  Synthetic
gcgtgtatttgtttcgtttcgtcgcgtt

SEQ ID NO: 6203 - DNA, 28 bp, Artificial Sequences
  Synthetic
ttcgcgtgtatttgtttcgtttcgtcgc

SEQ ID NO: 6204 - DNA, 29 bp, Artificial Sequences
  Synthetic
gttcgcgtgtatttgtttcgtttcgtcgc

SEQ ID NO: 6205 - DNA, 27 bp, Artificial Sequences
  Synthetic
cggagtcgtcggtttaagtcgggagcg

SEQ ID NO: 6206 - DNA, 26 bp, Artificial Sequences
  Synthetic
ggagtcgtcggtttaagtcgggagcg

SEQ ID NO: 6207 - DNA, 26 bp, Artificial Sequences
  Synthetic
cggagtcgtcggtttaagtcgggagc

SEQ ID NO: 6208 - DNA, 27 bp, Artificial Sequences
  Synthetic
tggggagaattgggtttttgcgtttgt

SEQ ID NO: 6209 - DNA, 27 bp, Artificial Sequences
  Synthetic
agtttggggagaattgggtttttgcgt

SEQ ID NO: 6210 - DNA, 27 bp, Artificial Sequences
  Synthetic
ttggttggggttgggataggcgtaggg

SEQ ID NO: 6211 - DNA, 27 bp, Artificial Sequences
  Synthetic
gaaagtcgtaggggcgcgtcggtttac

SEQ ID NO: 6212 - DNA, 27 bp, Artificial Sequences
  Synthetic
ggaaagtcgtaggggcgcgtcggttta

SEQ ID NO: 6213 - DNA, 27 bp, Artificial Sequences
  Synthetic
ggttggggttgggataggcgtagggat

SEQ ID NO: 6214 - DNA, 27 bp, Artificial Sequences
  Synthetic
tggttggggttgggataggcgtaggga

SEQ ID NO: 6215 - DNA, 34 bp, Artificial Sequences
  Synthetic
tcggttttgaaattgacggtgtagagttttttga

SEQ ID NO: 6216 - DNA, 34 bp, Artificial Sequences
  Synthetic
tgaaattgacggtgtagagttttttgaattcggt

SEQ ID NO: 6217 - DNA, 34 bp, Artificial Sequences
  Synthetic
gtcggttttgaaattgacggtgtagagttttttg

SEQ ID NO: 6218 - DNA, 35 bp, Artificial Sequences
  Synthetic
gtcggttttgaaattgacggtgtagagttttttga

SEQ ID NO: 6219 - DNA, 35 bp, Artificial Sequences
  Synthetic
tcggttttgaaattgacggtgtagagttttttgaa

SEQ ID NO: 6220 - DNA, 29 bp, Artificial Sequences
  Synthetic
tgttgtgaattggggacggttgattgtgt

SEQ ID NO: 6221 - DNA, 28 bp, Artificial Sequences
  Synthetic
gttgtgaattggggacggttgattgtgt

SEQ ID NO: 6222 - DNA, 28 bp, Artificial Sequences
  Synthetic
tgttgtgaattggggacggttgattgtg

SEQ ID NO: 6223 - DNA, 28 bp, Artificial Sequences
  Synthetic
ttgtgaattggggacggttgattgtgtc

SEQ ID NO: 6224 - DNA, 29 bp, Artificial Sequences
  Synthetic
gttgtgaattggggacggttgattgtgtc

SEQ ID NO: 6225 - DNA, 34 bp, Artificial Sequences
  Synthetic
tgtgtgttaggtattgttttgagtgttgggaaga

SEQ ID NO: 6226 - DNA, 34 bp, Artificial Sequences
  Synthetic
ttgtgtgttaggtattgttttgagtgttgggaag

SEQ ID NO: 6227 - DNA, 35 bp, Artificial Sequences
  Synthetic
ttgtgtgttaggtattgttttgagtgttgggaaga

SEQ ID NO: 6228 - DNA, 35 bp, Artificial Sequences
  Synthetic
tgtgtgttaggtattgttttgagtgttgggaagat

SEQ ID NO: 6229 - DNA, 35 bp, Artificial Sequences
  Synthetic
tttgtgtgttaggtattgttttgagtgttgggaag

SEQ ID NO: 6230 - DNA, 27 bp, Artificial Sequences
  Synthetic
cgaggcgggggttatcgttttgaaggg

SEQ ID NO: 6231 - DNA, 27 bp, Artificial Sequences
  Synthetic
gaggcgggggttatcgttttgaagggt

SEQ ID NO: 6232 - DNA, 28 bp, Artificial Sequences
  Synthetic
cgaggcgggggttatcgttttgaagggt

SEQ ID NO: 6233 - DNA, 29 bp, Artificial Sequences
  Synthetic
cgaggcgggggttatcgttttgaagggta

SEQ ID NO: 6234 - DNA, 27 bp, Artificial Sequences
  Synthetic
aggcgggggttatcgttttgaagggta

SEQ ID NO: 6235 - DNA, 27 bp, Artificial Sequences
  Synthetic
gggaatatggttgttcgggaggggcga

SEQ ID NO: 6236 - DNA, 27 bp, Artificial Sequences
  Synthetic
tcgggaatatggttgttcgggaggggc

SEQ ID NO: 6237 - DNA, 27 bp, Artificial Sequences
  Synthetic
tggttgttcgggaggggcgatttttgt

SEQ ID NO: 6238 - DNA, 27 bp, Artificial Sequences
  Synthetic
cgggaatatggttgttcgggaggggcg

SEQ ID NO: 6239 - DNA, 28 bp, Artificial Sequences
  Synthetic
gggaatatggttgttcgggaggggcgat

SEQ ID NO: 6240 - DNA, 27 bp, Artificial Sequences
  Synthetic
taaaagttgagcggcgggaggaggagg

SEQ ID NO: 6241 - DNA, 27 bp, Artificial Sequences
  Synthetic
gcgggaggaggaggaggaggaggaaat

SEQ ID NO: 6242 - DNA, 27 bp, Artificial Sequences
  Synthetic
agggataaaagttgagcggcgggagga

SEQ ID NO: 6243 - DNA, 27 bp, Artificial Sequences
  Synthetic
ggataaaagttgagcggcgggaggagg

SEQ ID NO: 6244 - DNA, 27 bp, Artificial Sequences
  Synthetic
gggataaaagttgagcggcgggaggag

SEQ ID NO: 6245 - DNA, 27 bp, Artificial Sequences
  Synthetic
cgggttcgtcggttttagggcggaaag

SEQ ID NO: 6246 - DNA, 28 bp, Artificial Sequences
  Synthetic
ggcgttcgggttgttttgggtcgttagg

SEQ ID NO: 6247 - DNA, 27 bp, Artificial Sequences
  Synthetic
gggttcgtcggttttagggcggaaaga

SEQ ID NO: 6248 - DNA, 28 bp, Artificial Sequences
  Synthetic
gcgttcgggttgttttgggtcgttaggt

SEQ ID NO: 6249 - DNA, 27 bp, Artificial Sequences
  Synthetic
gcgttcgggttgttttgggtcgttagg

SEQ ID NO: 6250 - DNA, 26 bp, Artificial Sequences
  Synthetic
cgggcgcgcggttgtggttatttttt

SEQ ID NO: 6251 - DNA, 27 bp, Artificial Sequences
  Synthetic
gcgggcgcgcggttgtggttatttttt

SEQ ID NO: 6252 - DNA, 27 bp, Artificial Sequences
  Synthetic
gaggcgcgggattggaaggataggtat

SEQ ID NO: 6253 - DNA, 27 bp, Artificial Sequences
  Synthetic
aggcgcgggattggaaggataggtatt

SEQ ID NO: 6254 - DNA, 26 bp, Artificial Sequences
  Synthetic
gcgggcgcgcggttgtggttattttt

SEQ ID NO: 6255 - DNA, 28 bp, Artificial Sequences
  Synthetic
ggcgttcgggttgttttgggtcgttagg

SEQ ID NO: 6256 - DNA, 28 bp, Artificial Sequences
  Synthetic
gcgttcgggttgttttgggtcgttaggt

SEQ ID NO: 6257 - DNA, 27 bp, Artificial Sequences
  Synthetic
gcgttcgggttgttttgggtcgttagg

SEQ ID NO: 6258 - DNA, 27 bp, Artificial Sequences
  Synthetic
ggcgttcgggttgttttgggtcgttag

SEQ ID NO: 6259 - DNA, 27 bp, Artificial Sequences
  Synthetic
cgttcgggttgttttgggtcgttaggt

SEQ ID NO: 6260 - DNA, 27 bp, Artificial Sequences
  Synthetic
gcgttagggcggggaagaaagggtgaa

SEQ ID NO: 6261 - DNA, 27 bp, Artificial Sequences
  Synthetic
tgggcgtcggtttggttttcggtagtt

SEQ ID NO: 6262 - DNA, 27 bp, Artificial Sequences
  Synthetic
ttgggcgtcggtttggttttcggtagt

SEQ ID NO: 6263 - DNA, 27 bp, Artificial Sequences
  Synthetic
cgttagggcggggaagaaagggtgaat

SEQ ID NO: 6264 - DNA, 26 bp, Artificial Sequences
  Synthetic
cgggcgcgcggttgtggttatttttt

SEQ ID NO: 6265 - DNA, 27 bp, Artificial Sequences
  Synthetic
gggtcgggggattgaggtgttcggttt

SEQ ID NO: 6266 - DNA, 27 bp, Artificial Sequences
  Synthetic
gttgggggtcgggggattgaggtgttc

SEQ ID NO: 6267 - DNA, 27 bp, Artificial Sequences
  Synthetic
ggtcgggggattgaggtgttcggtttt

SEQ ID NO: 6268 - DNA, 26 bp, Artificial Sequences
  Synthetic
ttgggggtcgggggattgaggtgttc

SEQ ID NO: 6269 - DNA, 26 bp, Artificial Sequences
  Synthetic
gggtcgggggattgaggtgttcggtt

SEQ ID NO: 6270 - DNA, 27 bp, Artificial Sequences
  Synthetic
gcgttagggcggggaagaaagggtgaa

SEQ ID NO: 6271 - DNA, 27 bp, Artificial Sequences
  Synthetic
tgggcgtcggtttggttttcggtagtt

SEQ ID NO: 6272 - DNA, 27 bp, Artificial Sequences
  Synthetic
ttgggcgtcggtttggttttcggtagt

SEQ ID NO: 6273 - DNA, 27 bp, Artificial Sequences
  Synthetic
cgttagggcggggaagaaagggtgaat

SEQ ID NO: 6274 - DNA, 26 bp, Artificial Sequences
  Synthetic
gcgttagggcggggaagaaagggtga

SEQ ID NO: 6275 - DNA, 27 bp, Artificial Sequences
  Synthetic
gggtcgggggattgaggtgttcggttt

SEQ ID NO: 6276 - DNA, 27 bp, Artificial Sequences
  Synthetic
gttgggggtcgggggattgaggtgttc

SEQ ID NO: 6277 - DNA, 27 bp, Artificial Sequences
  Synthetic
ggtcgggggattgaggtgttcggtttt

SEQ ID NO: 6278 - DNA, 26 bp, Artificial Sequences
  Synthetic
ttgggggtcgggggattgaggtgttc

SEQ ID NO: 6279 - DNA, 26 bp, Artificial Sequences
  Synthetic
gggtcgggggattgaggtgttcggtt

SEQ ID NO: 6280 - DNA, 27 bp, Artificial Sequences
  Synthetic
ggaagagcgaggcgggttttgcgtttt

SEQ ID NO: 6281 - DNA, 27 bp, Artificial Sequences
  Synthetic
taggaagagcgaggcgggttttgcgtt

SEQ ID NO: 6282 - DNA, 27 bp, Artificial Sequences
  Synthetic
ttgtaggaagagcgaggcgggttttgc

SEQ ID NO: 6283 - DNA, 27 bp, Artificial Sequences
  Synthetic
tgtaggaagagcgaggcgggttttgcg

SEQ ID NO: 6284 - DNA, 27 bp, Artificial Sequences
  Synthetic
gtaggaagagcgaggcgggttttgcgt

SEQ ID NO: 6285 - DNA, 30 bp, Artificial Sequences
  Synthetic
tcgttgtaaggtgaattcggaggtttgaga

SEQ ID NO: 6286 - DNA, 30 bp, Artificial Sequences
  Synthetic
ggtgaattcggaggtttgagaaggtttacg

SEQ ID NO: 6287 - DNA, 31 bp, Artificial Sequences
  Synthetic
ggtgaattcggaggtttgagaaggtttacgt

SEQ ID NO: 6288 - DNA, 30 bp, Artificial Sequences
  Synthetic
tgtaaggtgaattcggaggtttgagaaggt

SEQ ID NO: 6289 - DNA, 31 bp, Artificial Sequences
  Synthetic
aggtgaattcggaggtttgagaaggtttacg

SEQ ID NO: 6290 - DNA, 27 bp, Artificial Sequences
  Synthetic
cggttgaatcgggttggaggtttggcg

SEQ ID NO: 6291 - DNA, 27 bp, Artificial Sequences
  Synthetic
ggttgaatcgggttggaggtttggcgt

SEQ ID NO: 6292 - DNA, 27 bp, Artificial Sequences
  Synthetic
tcggttgaatcgggttggaggtttggc

SEQ ID NO: 6293 - DNA, 28 bp, Artificial Sequences
  Synthetic
ggttgaatcgggttggaggtttggcgtc

SEQ ID NO: 6294 - DNA, 28 bp, Artificial Sequences
  Synthetic
ttcggttgaatcgggttggaggtttggc

SEQ ID NO: 6295 - DNA, 27 bp, Artificial Sequences
  Synthetic
gtggaaacgggggttgaaatggggtgg

SEQ ID NO: 6296 - DNA, 27 bp, Artificial Sequences
  Synthetic
ggtggaaacgggggttgaaatggggtg

SEQ ID NO: 6297 - DNA, 27 bp, Artificial Sequences
  Synthetic
aggtggaaacgggggttgaaatggggt

SEQ ID NO: 6298 - DNA, 27 bp, Artificial Sequences
  Synthetic
gggtggtagaggatggagggcggtttt

SEQ ID NO: 6299 - DNA, 27 bp, Artificial Sequences
  Synthetic
acgggggttgaaatggggtggtagagg

SEQ ID NO: 6300 - DNA, 33 bp, Artificial Sequences
  Synthetic
tgcgggtttggaaaggtcgttttttattttttg

SEQ ID NO: 6301 - DNA, 34 bp, Artificial Sequences
  Synthetic
ttgcgggtttggaaaggtcgttttttattttttg

SEQ ID NO: 6302 - DNA, 35 bp, Artificial Sequences
  Synthetic
tttgcgggtttggaaaggtcgttttttattttttg

SEQ ID NO: 6303 - DNA, 36 bp, Artificial Sequences
  Synthetic
ttttcgttgtttcgcgtttaatagattttcggtttc

SEQ ID NO: 6304 - DNA, 27 bp, Artificial Sequences
  Synthetic
cgggggcggtagtttagagtcggtagg

SEQ ID NO: 6305 - DNA, 27 bp, Artificial Sequences
  Synthetic
gggggcggtagtttagagtcggtaggt

SEQ ID NO: 6306 - DNA, 27 bp, Artificial Sequences
  Synthetic
tcgggggcggtagtttagagtcggtag

SEQ ID NO: 6307 - DNA, 28 bp, Artificial Sequences
  Synthetic
tcgggggcggtagtttagagtcggtagg

SEQ ID NO: 6308 - DNA, 27 bp, Artificial Sequences
  Synthetic
atcgggggcggtagtttagagtcggta

SEQ ID NO: 6309 - DNA, 27 bp, Artificial Sequences
  Synthetic
tgtaggcgttgatgaaaggttcgggcg

SEQ ID NO: 6310 - DNA, 27 bp, Artificial Sequences
  Synthetic
gtaggcgttgatgaaaggttcgggcga

SEQ ID NO: 6311 - DNA, 27 bp, Artificial Sequences
  Synthetic
taggcgttgatgaaaggttcgggcgag

SEQ ID NO: 6312 - DNA, 28 bp, Artificial Sequences
  Synthetic
gtgtaggcgttgatgaaaggttcgggcg

SEQ ID NO: 6313 - DNA, 26 bp, Artificial Sequences
  Synthetic
cgttgatgaaaggttcgggcgagcgt

SEQ ID NO: 6314 - DNA, 27 bp, Artificial Sequences
  Synthetic
cgggggcggtagtttagagtcggtagg

SEQ ID NO: 6315 - DNA, 27 bp, Artificial Sequences
  Synthetic
gggggcggtagtttagagtcggtaggt

SEQ ID NO: 6316 - DNA, 27 bp, Artificial Sequences
  Synthetic
tcgggggcggtagtttagagtcggtag

SEQ ID NO: 6317 - DNA, 28 bp, Artificial Sequences
  Synthetic
tcgggggcggtagtttagagtcggtagg

SEQ ID NO: 6318 - DNA, 27 bp, Artificial Sequences
  Synthetic
tggcgttgttgtttcggggttttggtt

SEQ ID NO: 6319 - DNA, 27 bp, Artificial Sequences
  Synthetic
gcgttaggtttggggttggaggtcgga

SEQ ID NO: 6320 - DNA, 27 bp, Artificial Sequences
  Synthetic
agcgttaggtttggggttggaggtcgg

SEQ ID NO: 6321 - DNA, 27 bp, Artificial Sequences
  Synthetic
acgtggggggtataaaaagggcgtcgc

SEQ ID NO: 6322 - DNA, 26 bp, Artificial Sequences
  Synthetic
gtggggggtataaaaagggcgtcgcg

SEQ ID NO: 6323 - DNA, 26 bp, Artificial Sequences
  Synthetic
cgtggggggtataaaaagggcgtcgc

SEQ ID NO: 6324 - DNA, 31 bp, Artificial Sequences
  Synthetic
gggtttgttgggttttcggtttttattgggt

SEQ ID NO: 6325 - DNA, 31 bp, Artificial Sequences
  Synthetic
tgggtttgttgggttttcggtttttattggg

SEQ ID NO: 6326 - DNA, 32 bp, Artificial Sequences
  Synthetic
tgggtttgttgggttttcggtttttattgggt

SEQ ID NO: 6327 - DNA, 32 bp, Artificial Sequences
  Synthetic
ttgggtttgttgggttttcggtttttattggg

SEQ ID NO: 6328 - DNA, 33 bp, Artificial Sequences
  Synthetic
ttgggtttgttgggttttcggtttttattgggt

SEQ ID NO: 6329 - DNA, 27 bp, Artificial Sequences
  Synthetic
ttttagacggtggaaatagggcggtga

SEQ ID NO: 6330 - DNA, 27 bp, Artificial Sequences
  Synthetic
agacggtggaaatagggcggtgattaa

SEQ ID NO: 6331 - DNA, 27 bp, Artificial Sequences
  Synthetic
ttagacggtggaaatagggcggtgatt

SEQ ID NO: 6332 - DNA, 27 bp, Artificial Sequences
  Synthetic
tttagacggtggaaatagggcggtgat

SEQ ID NO: 6333 - DNA, 28 bp, Artificial Sequences
  Synthetic
tttttagacggtggaaatagggcggtga

SEQ ID NO: 6334 - DNA, 28 bp, Artificial Sequences
  Synthetic
cgaagcggtggtaggttgaaatcgtcgt

SEQ ID NO: 6335 - DNA, 27 bp, Artificial Sequences
  Synthetic
cgaagcggtggtaggttgaaatcgtcg

SEQ ID NO: 6336 - DNA, 27 bp, Artificial Sequences
  Synthetic
gaagcggtggtaggttgaaatcgtcgt

SEQ ID NO: 6337 - DNA, 29 bp, Artificial Sequences
  Synthetic
cgaagcggtggtaggttgaaatcgtcgtt

SEQ ID NO: 6338 - DNA, 27 bp, Artificial Sequences
  Synthetic
agcggtggtaggttgaaatcgtcgttt

SEQ ID NO: 6339 - DNA, 27 bp, Artificial Sequences
  Synthetic
atttcgggtttagtcggacgggtcggg

SEQ ID NO: 6340 - DNA, 27 bp, Artificial Sequences
  Synthetic
gacgtgttttagggttagggtggggcg

SEQ ID NO: 6341 - DNA, 28 bp, Artificial Sequences
  Synthetic
agacgtgttttagggttagggtggggcg

SEQ ID NO: 6342 - DNA, 27 bp, Artificial Sequences
  Synthetic
gatttcgggtttagtcggacgggtcgg

SEQ ID NO: 6343 - DNA, 26 bp, Artificial Sequences
  Synthetic
tttcgggtttagtcggacgggtcggg

SEQ ID NO: 6344 - DNA, 27 bp, Artificial Sequences
  Synthetic
gttcggttcggttcgttcggttgggtt

SEQ ID NO: 6345 - DNA, 27 bp, Artificial Sequences
  Synthetic
ttcggttcggttcgttcggttgggttc

SEQ ID NO: 6346 - DNA, 27 bp, Artificial Sequences
  Synthetic
aggttcggttcggttcgttcggttggg

SEQ ID NO: 6347 - DNA, 27 bp, Artificial Sequences
  Synthetic
cggttcggttcgttcggttgggttcga

SEQ ID NO: 6348 - DNA, 27 bp, Artificial Sequences
  Synthetic
tcggttcggttcgttcggttgggttcg

SEQ ID NO: 6349 - DNA, 27 bp, Artificial Sequences
  Synthetic
tttttggggtgggggatttgagcgtgc

SEQ ID NO: 6350 - DNA, 27 bp, Artificial Sequences
  Synthetic
acgtgttttagggttagggtggggcgt

SEQ ID NO: 6351 - DNA, 27 bp, Artificial Sequences
  Synthetic
atttcgggtttagtcggacgggtcggg

SEQ ID NO: 6352 - DNA, 27 bp, Artificial Sequences
  Synthetic
gggagagaggcggagggaggtgaaatg

SEQ ID NO: 6353 - DNA, 27 bp, Artificial Sequences
  Synthetic
gcggagggaggtgaaatgcgggagtta

SEQ ID NO: 6354 - DNA, 27 bp, Artificial Sequences
  Synthetic
gaggaggtcggggtggggaaaggtttt

SEQ ID NO: 6355 - DNA, 27 bp, Artificial Sequences
  Synthetic
ggaggtcggggtggggaaaggttttga

SEQ ID NO: 6356 - DNA, 27 bp, Artificial Sequences
  Synthetic
gggcgtagtttcgttggtgcggagttg

SEQ ID NO: 6357 - DNA, 27 bp, Artificial Sequences
  Synthetic
aggaggtcggggtggggaaaggttttg

SEQ ID NO: 6358 - DNA, 27 bp, Artificial Sequences
  Synthetic
ggcgtagtttcgttggtgcggagttgc

SEQ ID NO: 6359 - DNA, 31 bp, Artificial Sequences
  Synthetic
tggtagtgagttttttcggggtttaggttgt

SEQ ID NO: 6360 - DNA, 32 bp, Artificial Sequences
  Synthetic
tggtagtgagttttttcggggtttaggttgtt

SEQ ID NO: 6361 - DNA, 32 bp, Artificial Sequences
  Synthetic
ttggtagtgagttttttcggggtttaggttgt

SEQ ID NO: 6362 - DNA, 33 bp, Artificial Sequences
  Synthetic
tggtagtgagttttttcggggtttaggttgttt

SEQ ID NO: 6363 - DNA, 33 bp, Artificial Sequences
  Synthetic
ttggtagtgagttttttcggggtttaggttgtt

SEQ ID NO: 6364 - DNA, 27 bp, Artificial Sequences
  Synthetic
gttgttgggttgtggggaggaggtgga

SEQ ID NO: 6365 - DNA, 27 bp, Artificial Sequences
  Synthetic
agttgttgggttgtggggaggaggtgg

SEQ ID NO: 6366 - DNA, 27 bp, Artificial Sequences
  Synthetic
ttgttgggttgtggggaggaggtggaa

SEQ ID NO: 6367 - DNA, 27 bp, Artificial Sequences
  Synthetic
tgttgggttgtggggaggaggtggaat

SEQ ID NO: 6368 - DNA, 28 bp, Artificial Sequences
  Synthetic
gttgttgggttgtggggaggaggtggaa

SEQ ID NO: 6369 - DNA, 35 bp, Artificial Sequences
  Synthetic
acggttggattgagagagtaaagagaaaatgagtt

SEQ ID NO: 6370 - DNA, 35 bp, Artificial Sequences
  Synthetic
aacggttggattgagagagtaaagagaaaatgagt

SEQ ID NO: 6371 - DNA, 36 bp, Artificial Sequences
  Synthetic
aacggttggattgagagagtaaagagaaaatgagtt

SEQ ID NO: 6372 - DNA, 29 bp, Artificial Sequences
  Synthetic
gtcggggttttggagttttcggattttgt

SEQ ID NO: 6373 - DNA, 30 bp, Artificial Sequences
  Synthetic
agtcggggttttggagttttcggattttgt

SEQ ID NO: 6374 - DNA, 30 bp, Artificial Sequences
  Synthetic
cggggttttggagttttcggattttgttcg

SEQ ID NO: 6375 - DNA, 29 bp, Artificial Sequences
  Synthetic
agtcggggttttggagttttcggattttg

SEQ ID NO: 6376 - DNA, 31 bp, Artificial Sequences
  Synthetic
cggggttttggagttttcggattttgttcgt

SEQ ID NO: 6377 - DNA, 31 bp, Artificial Sequences
  Synthetic
gcgtttgtttatatgatgaaaggcgggtagg

SEQ ID NO: 6378 - DNA, 32 bp, Artificial Sequences
  Synthetic
gcgtttgtttatatgatgaaaggcgggtagga

SEQ ID NO: 6379 - DNA, 33 bp, Artificial Sequences
  Synthetic
gcgtttgtttatatgatgaaaggcgggtaggat

SEQ ID NO: 6380 - DNA, 34 bp, Artificial Sequences
  Synthetic
gcgtttgtttatatgatgaaaggcgggtaggatt

SEQ ID NO: 6381 - DNA, 35 bp, Artificial Sequences
  Synthetic
gcgtttgtttatatgatgaaaggcgggtaggattt

SEQ ID NO: 6382 - DNA, 27 bp, Artificial Sequences
  Synthetic
tttcgttatttgggtcgcgggttgggc

SEQ ID NO: 6383 - DNA, 27 bp, Artificial Sequences
  Synthetic
gcgttaggagcgaggcgtttttggtga

SEQ ID NO: 6384 - DNA, 27 bp, Artificial Sequences
  Synthetic
ttttggtagaggcgtcggaggaagggg

SEQ ID NO: 6385 - DNA, 27 bp, Artificial Sequences
  Synthetic
tatatttagggcgggggaggtcggggg

SEQ ID NO: 6386 - DNA, 27 bp, Artificial Sequences
  Synthetic
aggagcgaggcgtttttggtgatagcg

SEQ ID NO: 6387 - DNA, 27 bp, Artificial Sequences
  Synthetic
gatggcggagtagtttcgagcggggat

SEQ ID NO: 6388 - DNA, 27 bp, Artificial Sequences
  Synthetic
tagatggcggagtagtttcgagcgggg

SEQ ID NO: 6389 - DNA, 27 bp, Artificial Sequences
  Synthetic
tggcggagtagtttcgagcggggatat

SEQ ID NO: 6390 - DNA, 27 bp, Artificial Sequences
  Synthetic
atggcggagtagtttcgagcggggata

SEQ ID NO: 6391 - DNA, 27 bp, Artificial Sequences
  Synthetic
agatggcggagtagtttcgagcgggga

SEQ ID NO: 6392 - DNA, 29 bp, Artificial Sequences
  Synthetic
cggttaatgttattgtcggacgttcgggt

SEQ ID NO: 6393 - DNA, 28 bp, Artificial Sequences
  Synthetic
cggttaatgttattgtcggacgttcggg

SEQ ID NO: 6394 - DNA, 29 bp, Artificial Sequences
  Synthetic
tcggttaatgttattgtcggacgttcggg

SEQ ID NO: 6395 - DNA, 30 bp, Artificial Sequences
  Synthetic
tcggttaatgttattgtcggacgttcgggt

SEQ ID NO: 6396 - DNA, 30 bp, Artificial Sequences
  Synthetic
ttcggttaatgttattgtcggacgttcggg

SEQ ID NO: 6397 - DNA, 32 bp, Artificial Sequences
  Synthetic
tttggaagagtgtaagagaaaggaatcgggtt

SEQ ID NO: 6398 - DNA, 32 bp, Artificial Sequences
  Synthetic
ttttggaagagtgtaagagaaaggaatcgggt

SEQ ID NO: 6399 - DNA, 32 bp, Artificial Sequences
  Synthetic
aggggtttttggaagagtgtaagagaaaggaa

SEQ ID NO: 6400 - DNA, 32 bp, Artificial Sequences
  Synthetic
aaggggtttttggaagagtgtaagagaaagga

SEQ ID NO: 6401 - DNA, 36 bp, Artificial Sequences
  Synthetic
ggggtttttggaagagtgtaagagaaaggaatcggg

SEQ ID NO: 6402 - DNA, 29 bp, Artificial Sequences
  Synthetic
cgtggttgcgagagttttttagggagagt

SEQ ID NO: 6403 - DNA, 28 bp, Artificial Sequences
  Synthetic
cgtggttgcgagagttttttagggagag

SEQ ID NO: 6404 - DNA, 29 bp, Artificial Sequences
  Synthetic
cgtagaagtgatagggagagggggaaagt

SEQ ID NO: 6405 - DNA, 30 bp, Artificial Sequences
  Synthetic
tcgtagaagtgatagggagagggggaaagt

SEQ ID NO: 6406 - DNA, 29 bp, Artificial Sequences
  Synthetic
tcgtagaagtgatagggagagggggaaag

SEQ ID NO: 6407 - DNA, 27 bp, Artificial Sequences
  Synthetic
ggagtggacgggttggggaaggtatcg

SEQ ID NO: 6408 - DNA, 27 bp, Artificial Sequences
  Synthetic
cggagtggacgggttggggaaggtatc

SEQ ID NO: 6409 - DNA, 27 bp, Artificial Sequences
  Synthetic
gagatcggagtggacgggttggggaag

SEQ ID NO: 6410 - DNA, 27 bp, Artificial Sequences
  Synthetic
gtgggttgaggagatcggagtggacgg

SEQ ID NO: 6411 - DNA, 27 bp, Artificial Sequences
  Synthetic
ttcgcgtgggttgaggagatcggagtg

SEQ ID NO: 6412 - DNA, 27 bp, Artificial Sequences
  Synthetic
cgcggggaggtagagtcggtagaaggt

SEQ ID NO: 6413 - DNA, 27 bp, Artificial Sequences
  Synthetic
tgggtttttatttgggagagcgcgggg

SEQ ID NO: 6414 - DNA, 27 bp, Artificial Sequences
  Synthetic
gagcgcggggaggtagagtcggtagaa

SEQ ID NO: 6415 - DNA, 27 bp, Artificial Sequences
  Synthetic
agcgcggggaggtagagtcggtagaag

SEQ ID NO: 6416 - DNA, 27 bp, Artificial Sequences
  Synthetic
gcggggaggtagagtcggtagaaggtg

SEQ ID NO: 6417 - DNA, 27 bp, Artificial Sequences
  Synthetic
ggagtggacgggttggggaaggtatcg

SEQ ID NO: 6418 - DNA, 27 bp, Artificial Sequences
  Synthetic
cggagtggacgggttggggaaggtatc

SEQ ID NO: 6419 - DNA, 27 bp, Artificial Sequences
  Synthetic
gagatcggagtggacgggttggggaag

SEQ ID NO: 6420 - DNA, 27 bp, Artificial Sequences
  Synthetic
gtgggttgaggagatcggagtggacgg

SEQ ID NO: 6421 - DNA, 27 bp, Artificial Sequences
  Synthetic
cgtgggttgaggagatcggagtggacg

SEQ ID NO: 6422 - DNA, 27 bp, Artificial Sequences
  Synthetic
cgcggggaggtagagtcggtagaaggt

SEQ ID NO: 6423 - DNA, 27 bp, Artificial Sequences
  Synthetic
gagcgcggggaggtagagtcggtagaa

SEQ ID NO: 6424 - DNA, 27 bp, Artificial Sequences
  Synthetic
agcgcggggaggtagagtcggtagaag

SEQ ID NO: 6425 - DNA, 27 bp, Artificial Sequences
  Synthetic
gcggggaggtagagtcggtagaaggtg

SEQ ID NO: 6426 - DNA, 27 bp, Artificial Sequences
  Synthetic
atttgggagagcgcggggaggtagagt

SEQ ID NO: 6427 - DNA, 27 bp, Artificial Sequences
  Synthetic
cggggtcgttggaggatgcggtgatta

SEQ ID NO: 6428 - DNA, 28 bp, Artificial Sequences
  Synthetic
cggggtcgttggaggatgcggtgattat

SEQ ID NO: 6429 - DNA, 27 bp, Artificial Sequences
  Synthetic
ggggtcgttggaggatgcggtgattat

SEQ ID NO: 6430 - DNA, 26 bp, Artificial Sequences
  Synthetic
cggggtcgttggaggatgcggtgatt

SEQ ID NO: 6431 - DNA, 29 bp, Artificial Sequences
  Synthetic
cggggtcgttggaggatgcggtgattatt

SEQ ID NO: 6432 - DNA, 27 bp, Artificial Sequences
  Synthetic
aggaattttacggtgtgcgtttggtgc

SEQ ID NO: 6433 - DNA, 28 bp, Artificial Sequences
  Synthetic
gcgggtttaggggtataggggttatggg

SEQ ID NO: 6434 - DNA, 29 bp, Artificial Sequences
  Synthetic
agcgggtttaggggtataggggttatggg

SEQ ID NO: 6435 - DNA, 29 bp, Artificial Sequences
  Synthetic
gcgggtttaggggtataggggttatggga

SEQ ID NO: 6436 - DNA, 30 bp, Artificial Sequences
  Synthetic
agcgggtttaggggtataggggttatggga

SEQ ID NO: 6437 - DNA, 27 bp, Artificial Sequences
  Synthetic
cggggtttgttgggtttgtgtggggtt

SEQ ID NO: 6438 - DNA, 27 bp, Artificial Sequences
  Synthetic
aacggggtttgttgggtttgtgtgggg

SEQ ID NO: 6439 - DNA, 27 bp, Artificial Sequences
  Synthetic
tttgtgtggggtttcggagtgggggta

SEQ ID NO: 6440 - DNA, 27 bp, Artificial Sequences
  Synthetic
tgtgtggggtttcggagtgggggtatt

SEQ ID NO: 6441 - DNA, 27 bp, Artificial Sequences
  Synthetic
ttgtgtggggtttcggagtgggggtat

SEQ ID NO: 6442 - DNA, 27 bp, Artificial Sequences
  Synthetic
ggattggtgagtggggagtttgggggt

SEQ ID NO: 6443 - DNA, 27 bp, Artificial Sequences
  Synthetic
ggggtttgggattggtgagtggggagt

SEQ ID NO: 6444 - DNA, 27 bp, Artificial Sequences
  Synthetic
tgggattggtgagtggggagtttgggg

SEQ ID NO: 6445 - DNA, 27 bp, Artificial Sequences
  Synthetic
gtgagtggggagtttgggggttttggc

SEQ ID NO: 6446 - DNA, 27 bp, Artificial Sequences
  Synthetic
ggggagtttgggggttttggcgagttt

SEQ ID NO: 6447 - DNA, 29 bp, Artificial Sequences
  Synthetic
gtttcgtttaggttttggtcggtgatggt

SEQ ID NO: 6448 - DNA, 29 bp, Artificial Sequences
  Synthetic
atcgggaggttcgttagggtttttaggtt

SEQ ID NO: 6449 - DNA, 31 bp, Artificial Sequences
  Synthetic
cgttatcgggaggttcgttagggtttttagg

SEQ ID NO: 6450 - DNA, 32 bp, Artificial Sequences
  Synthetic
cgttatcgggaggttcgttagggtttttaggt

SEQ ID NO: 6451 - DNA, 31 bp, Artificial Sequences
  Synthetic
gttatcgggaggttcgttagggtttttaggt

SEQ ID NO: 6452 - DNA, 27 bp, Artificial Sequences
  Synthetic
ggattggtgagtggggagtttgggggt

SEQ ID NO: 6453 - DNA, 27 bp, Artificial Sequences
  Synthetic
ggggtttgggattggtgagtggggagt

SEQ ID NO: 6454 - DNA, 27 bp, Artificial Sequences
  Synthetic
tgggattggtgagtggggagtttgggg

SEQ ID NO: 6455 - DNA, 27 bp, Artificial Sequences
  Synthetic
gagaagtaattaggcggggggaggggc

SEQ ID NO: 6456 - DNA, 27 bp, Artificial Sequences
  Synthetic
gttggggcggagggagtagcggtttta

SEQ ID NO: 6457 - DNA, 35 bp, Artificial Sequences
  Synthetic
ggtgatttatgtagggattttgagtattcgtcggc

SEQ ID NO: 6458 - DNA, 36 bp, Artificial Sequences
  Synthetic
aggtgatttatgtagggattttgagtattcgtcggc

SEQ ID NO: 6459 - DNA, 35 bp, Artificial Sequences
  Synthetic
aggtgatttatgtagggattttgagtattcgtcgg

SEQ ID NO: 6460 - DNA, 36 bp, Artificial Sequences
  Synthetic
taggtgatttatgtagggattttgagtattcgtcgg

SEQ ID NO: 6461 - DNA, 27 bp, Artificial Sequences
  Synthetic
agggggcgtagtagtttttggggaggc

SEQ ID NO: 6462 - DNA, 27 bp, Artificial Sequences
  Synthetic
ggggcgtagtagtttttggggaggcgt

SEQ ID NO: 6463 - DNA, 27 bp, Artificial Sequences
  Synthetic
tttttagagtagcgtgcgtggtgggcg

SEQ ID NO: 6464 - DNA, 27 bp, Artificial Sequences
  Synthetic
ggcgtagtagtttttggggaggcgtcg

SEQ ID NO: 6465 - DNA, 27 bp, Artificial Sequences
  Synthetic
gggcgtagtagtttttggggaggcgtc

SEQ ID NO: 6466 - DNA, 35 bp, Artificial Sequences; identical to SEQ ID NO: 6457
  Synthetic

SEQ ID NO: 6467 - DNA, 36 bp, Artificial Sequences; identical to SEQ ID NO: 6458
  Synthetic

SEQ ID NO: 6468 - DNA, 35 bp, Artificial Sequences; identical to SEQ ID NO: 6459
  Synthetic

SEQ ID NO: 6469 - DNA, 36 bp, Artificial Sequences; identical to SEQ ID NO: 6460
  Synthetic

SEQ ID NO: 6470 - DNA, 27 bp, Artificial Sequences
  Synthetic
tttttagagtagcgtgcgtggtgggcg

SEQ ID NO: 6471 - DNA, 28 bp, Artificial Sequences
  Synthetic
gtttttagagtagcgtgcgtggtgggcg

SEQ ID NO: 6472 - DNA, 28 bp, Artificial Sequences
  Synthetic
gggattgcggggttttaggtttagggcg

SEQ ID NO: 6473 - DNA, 28 bp, Artificial Sequences
  Synthetic
tgtttttagagtagcgtgcgtggtgggc

SEQ ID NO: 6474 - DNA, 27 bp, Artificial Sequences
  Synthetic
gtttttagagtagcgtgcgtggtgggc

SEQ ID NO: 6475 - DNA, 27 bp, Artificial Sequences
  Synthetic
acgttgttttgggagtagggtcggcgg

SEQ ID NO: 6476 - DNA, 26 bp, Artificial Sequences
  Synthetic
gttgttttgggagtagggtcggcggc

SEQ ID NO: 6477 - DNA, 28 bp, Artificial Sequences
  Synthetic
tacgttgttttgggagtagggtcggcgg

SEQ ID NO: 6478 - DNA, 27 bp, Artificial Sequences
  Synthetic
tacgttgttttgggagtagggtcggcg

SEQ ID NO: 6479 - DNA, 26 bp, Artificial Sequences
  Synthetic
cgttgttttgggagtagggtcggcgg

SEQ ID NO: 6480 - DNA, 28 bp, Artificial Sequences
  Synthetic
gggattgcggggttttaggtttagggcg

SEQ ID NO: 6481 - DNA, 28 bp, Artificial Sequences
  Synthetic
ggattgcggggttttaggtttagggcgt

SEQ ID NO: 6482 - DNA, 27 bp, Artificial Sequences
  Synthetic
ggattgcggggttttaggtttagggcg

SEQ ID NO: 6483 - DNA, 28 bp, Artificial Sequences
  Synthetic
tgggattgcggggttttaggtttagggc

SEQ ID NO: 6484 - DNA, 27 bp, Artificial Sequences
  Synthetic
gggattgcggggttttaggtttagggc

SEQ ID NO: 6485 - DNA, 27 bp, Artificial Sequences
  Synthetic
ggttgagtggtcggggtatcggggttt

SEQ ID NO: 6486 - DNA, 27 bp, Artificial Sequences
  Synthetic
ggttggtgagtatttggtcggagcgcg

SEQ ID NO: 6487 - DNA, 27 bp, Artificial Sequences
  Synthetic
cggttggtgagtatttggtcggagcgc

SEQ ID NO: 6488 - DNA, 27 bp, Artificial Sequences
  Synthetic
gcggttggtgagtatttggtcggagcg

SEQ ID NO: 6489 - DNA, 27 bp, Artificial Sequences
  Synthetic
gtcggggtatcggggtttagagagcgg

SEQ ID NO: 6490 - DNA, 27 bp, Artificial Sequences
  Synthetic
agaaggaaagtgggcggggaattcggt

SEQ ID NO: 6491 - DNA, 27 bp, Artificial Sequences
  Synthetic
gcgttgtttcgggggagttgtttcggt

SEQ ID NO: 6492 - DNA, 27 bp, Artificial Sequences
  Synthetic
tgcgttgtttcgggggagttgtttcgg

SEQ ID NO: 6493 - DNA, 27 bp, Artificial Sequences
  Synthetic
cggttgcgttgtttcgggggagttgtt

SEQ ID NO: 6494 - DNA, 27 bp, Artificial Sequences
  Synthetic
tagggtttttcggataggggtcgggcg

SEQ ID NO: 6495 - DNA, 27 bp, Artificial Sequences
  Synthetic
gcggtagagaagtttgcgttcgggatt

SEQ ID NO: 6496 - DNA, 27 bp, Artificial Sequences
  Synthetic
tcgtgggtttatagagggtgaaggggt

SEQ ID NO: 6497 - DNA, 26 bp, Artificial Sequences
  Synthetic
gcggtagagaagtttgcgttcgggat

SEQ ID NO: 6498 - DNA, 27 bp, Artificial Sequences
  Synthetic
ggggtagtttatgttgagtgggggtgt

SEQ ID NO: 6499 - DNA, 27 bp, Artificial Sequences
  Synthetic
cgggattagtagagtgagtcgatcggc

SEQ ID NO: 6500 - DNA, 27 bp, Artificial Sequences
  Synthetic
cgaagtgaagtttggacgcgaatgggg

SEQ ID NO: 6501 - DNA, 28 bp, Artificial Sequences
  Synthetic
tcgaagtgaagtttggacgcgaatgggg

SEQ ID NO: 6502 - DNA, 27 bp, Artificial Sequences
  Synthetic
tcgaagtgaagtttggacgcgaatggg

SEQ ID NO: 6503 - DNA, 26 bp, Artificial Sequences
  Synthetic
cgaagtgaagtttggacgcgaatggg

SEQ ID NO: 6504 - DNA, 26 bp, Artificial Sequences
  Synthetic
gaagtgaagtttggacgcgaatgggg

SEQ ID NO: 6505 - DNA, 27 bp, Artificial Sequences
  Synthetic
gcggtagagaagtttgcgttcgggatt

SEQ ID NO: 6506 - DNA, 26 bp, Artificial Sequences
  Synthetic
gcggtagagaagtttgcgttcgggat

SEQ ID NO: 6507 - DNA, 27 bp, Artificial Sequences
  Synthetic
cgggattagtagagtgagtcgatcggc

SEQ ID NO: 6508 - DNA, 28 bp, Artificial Sequences
  Synthetic
gcggtagagaagtttgcgttcgggatta

SEQ ID NO: 6509 - DNA, 28 bp, Artificial Sequences
  Synthetic
tcgggattagtagagtgagtcgatcggc

SEQ ID NO: 6510 - DNA, 27 bp, Artificial Sequences
  Synthetic
gcggtagagaagtttgcgttcgggatt

SEQ ID NO: 6511 - DNA, 26 bp, Artificial Sequences
  Synthetic
gcggtagagaagtttgcgttcgggat

SEQ ID NO: 6512 - DNA, 27 bp, Artificial Sequences
  Synthetic
ggggtagtttatgttgagtgggggtgt

SEQ ID NO: 6513 - DNA, 27 bp, Artificial Sequences
  Synthetic
cgggattagtagagtgagtcgatcggc

SEQ ID NO: 6514 - DNA, 28 bp, Artificial Sequences
  Synthetic
aggggtagtttatgttgagtgggggtgt

SEQ ID NO: 6515 - DNA, 28 bp, Artificial Sequences
  Synthetic
ggggtgaggttatggaaagtttcgaggt

SEQ ID NO: 6516 - DNA, 29 bp, Artificial Sequences
  Synthetic
aggggtgaggttatggaaagtttcgaggt

SEQ ID NO: 6517 - DNA, 28 bp, Artificial Sequences
  Synthetic
aggggtgaggttatggaaagtttcgagg

SEQ ID NO: 6518 - DNA, 30 bp, Artificial Sequences
  Synthetic
gaggggtgaggttatggaaagtttcgaggt

SEQ ID NO: 6519 - DNA, 29 bp, Artificial Sequences
  Synthetic
gaggggtgaggttatggaaagtttcgagg

SEQ ID NO: 6520 - DNA, 27 bp, Artificial Sequences
  Synthetic
gcggtagagaagtttgcgttcgggatt

SEQ ID NO: 6521 - DNA, 26 bp, Artificial Sequences
  Synthetic
gcggtagagaagtttgcgttcgggat

SEQ ID NO: 6522 - DNA, 27 bp, Artificial Sequences
  Synthetic
cgggattagtagagtgagtcgatcggc

SEQ ID NO: 6523 - DNA, 28 bp, Artificial Sequences
  Synthetic
gcggtagagaagtttgcgttcgggatta

SEQ ID NO: 6524 - DNA, 28 bp, Artificial Sequences
  Synthetic
tcgggattagtagagtgagtcgatcggc

SEQ ID NO: 6525 - DNA, 27 bp, Artificial Sequences
  Synthetic
agtggtggtttggaggacgttggttac

SEQ ID NO: 6526 - DNA, 27 bp, Artificial Sequences
  Synthetic
ttagtggtggtttggaggacgttggtt

SEQ ID NO: 6527 - DNA, 27 bp, Artificial Sequences
  Synthetic
tttagtggtggtttggaggacgttggt

SEQ ID NO: 6528 - DNA, 28 bp, Artificial Sequences
  Synthetic
tttagtggtggtttggaggacgttggtt

SEQ ID NO: 6529 - DNA, 28 bp, Artificial Sequences
  Synthetic
ttttagtggtggtttggaggacgttggt

SEQ ID NO: 6530 - DNA, 24 bp, Artificial Sequences
  Synthetic
gagagagtcgcggtggttgtacgt

SEQ ID NO: 6531 - DNA, 23 bp, Artificial Sequences
  Synthetic
agagagtcgcggtggttgtacgt

SEQ ID NO: 6532 - DNA, 21 bp, Artificial Sequences
  Synthetic
gcggtggttgtacgtgcgtgc

SEQ ID NO: 6533 - DNA, 27 bp, Artificial Sequences
  Synthetic
attttcggttagggaggggatggggcg

SEQ ID NO: 6534 - DNA, 27 bp, Artificial Sequences
  Synthetic
aattgatgagttggtagggcgggcggt

SEQ ID NO: 6535 - DNA, 27 bp, Artificial Sequences
  Synthetic
gcggcgaggcgtagggtgttatggtaa

SEQ ID NO: 6536 - DNA, 27 bp, Artificial Sequences
  Synthetic
ggttagggaggggatggggcggttttc

SEQ ID NO: 6537 - DNA, 27 bp, Artificial Sequences
  Synthetic
ttttcggtaggacgcgcgtttaggagc

SEQ ID NO: 6538 - DNA, 27 bp, Artificial Sequences
  Synthetic
gttcggagtttattcgcgggggaggga

SEQ ID NO: 6539 - DNA, 27 bp, Artificial Sequences
  Synthetic
tgttcggagtttattcgcgggggaggg

SEQ ID NO: 6540 - DNA, 27 bp, Artificial Sequences
  Synthetic
aggggggatttacgggttggggtgttt

SEQ ID NO: 6541 - DNA, 27 bp, Artificial Sequences
  Synthetic
aaggggggatttacgggttggggtgtt

SEQ ID NO: 6542 - DNA, 27 bp, Artificial Sequences
  Synthetic
aaaggggggatttacgggttggggtgt

SEQ ID NO: 6543 - DNA, 27 bp, Artificial Sequences
  Synthetic
aggttaggagggaggttaggaaggcgt

SEQ ID NO: 6544 - DNA, 28 bp, Artificial Sequences
  Synthetic
ggagttggtggggaaagagaagggaggt

SEQ ID NO: 6545 - DNA, 27 bp, Artificial Sequences
  Synthetic
ggagttggtggggaaagagaagggagg

SEQ ID NO: 6546 - DNA, 28 bp, Artificial Sequences
  Synthetic
ggaggttaggagggaggttaggaaggcg

SEQ ID NO: 6547 - DNA, 28 bp, Artificial Sequences
  Synthetic
aggagttggtggggaaagagaagggagg

SEQ ID NO: 6548 - DNA, 27 bp, Artificial Sequences
  Synthetic
ggaggggtggaaagttaggcgagggtt

SEQ ID NO: 6549 - DNA, 27 bp, Artificial Sequences
  Synthetic
aggaggggtggaaagttaggcgagggt

SEQ ID NO: 6550 - DNA, 26 bp, Artificial Sequences
  Synthetic
ggaggggtggaaagttaggcgagggt

SEQ ID NO: 6551 - DNA, 26 bp, Artificial Sequences
  Synthetic
aggaggggtggaaagttaggcgaggg

SEQ ID NO: 6552 - DNA, 28 bp, Artificial Sequences
  Synthetic
aggaggggtggaaagttaggcgagggtt

SEQ ID NO: 6553 - DNA, 27 bp, Artificial Sequences
  Synthetic
gtggggtagttttgggtttcggtgcgg

SEQ ID NO: 6554 - DNA, 27 bp, Artificial Sequences
  Synthetic
gttgtttcggggaggggagttttggcg

SEQ ID NO: 6555 - DNA, 27 bp, Artificial Sequences
  Synthetic
taggttgcggtcggtgttatcgtgggg

SEQ ID NO: 6556 - DNA, 27 bp, Artificial Sequences
  Synthetic
gcgttttgtgtttggttttcgcggcgt

SEQ ID NO: 6557 - DNA, 27 bp, Artificial Sequences
  Synthetic
ttgggtttcggtgcggtttttcgacgt

SEQ ID NO: 6558 - DNA, 27 bp, Artificial Sequences
  Synthetic
tcggaggtttgtacgcgtcgaggttgt

SEQ ID NO: 6559 - DNA, 27 bp, Artificial Sequences
  Synthetic
ggtgcgggaagttaggaggggtggaaa

SEQ ID NO: 6560 - DNA, 27 bp, Artificial Sequences
  Synthetic
ttcggttggtgcgggaagttaggaggg

SEQ ID NO: 6561 - DNA, 27 bp, Artificial Sequences
  Synthetic
ggaggggtggaaagttaggcgagggtt

SEQ ID NO: 6562 - DNA, 27 bp, Artificial Sequences
  Synthetic
gggttcggttggtgcgggaagttagga

SEQ ID NO: 6563 - DNA, 30 bp, Artificial Sequences
  Synthetic
tcgggtttattttttcggtttgggtttcgt

SEQ ID NO: 6564 - DNA, 31 bp, Artificial Sequences
  Synthetic
tcgggtttattttttcggtttgggtttcgtt

SEQ ID NO: 6565 - DNA, 31 bp, Artificial Sequences
  Synthetic
ttcgggtttattttttcggtttgggtttcgt

SEQ ID NO: 6566 - DNA, 32 bp, Artificial Sequences
  Synthetic
ttcgggtttattttttcggtttgggtttcgtt

SEQ ID NO: 6567 - DNA, 32 bp, Artificial Sequences
  Synthetic
tttcgggtttattttttcggtttgggtttcgt

SEQ ID NO: 6568 - DNA, 27 bp, Artificial Sequences
  Synthetic
gcggtttttgtgttcggagcgtgtgtt

SEQ ID NO: 6569 - DNA, 27 bp, Artificial Sequences
  Synthetic
cggttcgttggttcgcggtttttgtgt

SEQ ID NO: 6570 - DNA, 27 bp, Artificial Sequences
  Synthetic
ttggttcgcggtttttgtgttcggagc

SEQ ID NO: 6571 - DNA, 27 bp, Artificial Sequences
  Synthetic
cgttggttcgcggtttttgtgttcgga

SEQ ID NO: 6572 - DNA, 27 bp, Artificial Sequences
  Synthetic
tcgttggttcgcggtttttgtgttcgg

SEQ ID NO: 6573 - DNA, 34 bp, Artificial Sequences
  Synthetic
gttgggagattgggtaataatatacgtttcgggt

SEQ ID NO: 6574 - DNA, 34 bp, Artificial Sequences
  Synthetic
agttgggagattgggtaataatatacgtttcggg

SEQ ID NO: 6575 - DNA, 35 bp, Artificial Sequences
  Synthetic
agttgggagattgggtaataatatacgtttcgggt

SEQ ID NO: 6576 - DNA, 35 bp, Artificial Sequences
  Synthetic
gttgggagattgggtaataatatacgtttcgggta

SEQ ID NO: 6577 - DNA, 36 bp, Artificial Sequences
  Synthetic
agttgggagattgggtaataatatacgtttcgggta

SEQ ID NO: 6578 - DNA, 23 bp, Artificial Sequences
  Synthetic
cggttcgacgtaggttggcgcgg

SEQ ID NO: 6579 - DNA, 23 bp, Artificial Sequences
  Synthetic
ggttcgacgtaggttggcgcggc

SEQ ID NO: 6580 - DNA, 24 bp, Artificial Sequences
  Synthetic
cggttcgacgtaggttggcgcggc

SEQ ID NO: 6581 - DNA, 22 bp, Artificial Sequences
  Synthetic
gttcgacgtaggttggcgcggc

SEQ ID NO: 6582 - DNA, 22 bp, Artificial Sequences
  Synthetic
cggttcgacgtaggttggcgcg

SEQ ID NO: 6583 - DNA, 34 bp, Artificial Sequences; identical to SEQ ID NO: 6573
  Synthetic

SEQ ID NO: 6584 - DNA, 34 bp, Artificial Sequences; identical to SEQ ID NO: 6574
  Synthetic

SEQ ID NO: 6585 - DNA, 35 bp, Artificial Sequences; identical to SEQ ID NO: 6575
  Synthetic

SEQ ID NO: 6586 - DNA, 35 bp, Artificial Sequences; identical to SEQ ID NO: 6576
  Synthetic

SEQ ID NO: 6587 - DNA, 36 bp, Artificial Sequences; identical to SEQ ID NO: 6577
  Synthetic

SEQ ID NO: 6588 - DNA, 27 bp, Artificial Sequences
  Synthetic
tagtagttggggttacgttcgggggcg

SEQ ID NO: 6589 - DNA, 26 bp, Artificial Sequences
  Synthetic
agtagttggggttacgttcgggggcg

SEQ ID NO: 6590 - DNA, 28 bp, Artificial Sequences
  Synthetic
atagtagttggggttacgttcgggggcg

SEQ ID NO: 6591 - DNA, 27 bp, Artificial Sequences
  Synthetic
atagtagttggggttacgttcgggggc

SEQ ID NO: 6592 - DNA, 25 bp, Artificial Sequences
  Synthetic
gtagttggggttacgttcgggggcg

SEQ ID NO: 6593 - DNA, 29 bp, Artificial Sequences
  Synthetic
cgggcgtaattttagttgttgtgacgggt

SEQ ID NO: 6594 - DNA, 28 bp, Artificial Sequences
  Synthetic
cgggcgtaattttagttgttgtgacggg

SEQ ID NO: 6595 - DNA, 29 bp, Artificial Sequences
  Synthetic
tcgggcgtaattttagttgttgtgacggg

SEQ ID NO: 6596 - DNA, 30 bp, Artificial Sequences
  Synthetic
tcgggcgtaattttagttgttgtgacgggt

SEQ ID NO: 6597 - DNA, 28 bp, Artificial Sequences
  Synthetic
tcgggcgtaattttagttgttgtgacgg

SEQ ID NO: 6598 - DNA, 27 bp, Artificial Sequences
  Synthetic
tagtagttggggttacgttcgggggcg

SEQ ID NO: 6599 - DNA, 26 bp, Artificial Sequences
  Synthetic
agtagttggggttacgttcgggggcg

SEQ ID NO: 6600 - DNA, 28 bp, Artificial Sequences
  Synthetic
atagtagttggggttacgttcgggggcg

SEQ ID NO: 6601 - DNA, 27 bp, Artificial Sequences
  Synthetic
atagtagttggggttacgttcgggggc

SEQ ID NO: 6602 - DNA, 25 bp, Artificial Sequences
  Synthetic
gtagttggggttacgttcgggggcg

SEQ ID NO: 6603 - DNA, 27 bp, Artificial Sequences
  Synthetic
ggggtttgaaggggttgtagcgtggga

SEQ ID NO: 6604 - DNA, 27 bp, Artificial Sequences
  Synthetic
tggggtttgaaggggttgtagcgtggg

SEQ ID NO: 6605 - DNA, 27 bp, Artificial Sequences
  Synthetic
ttggggtttgaaggggttgtagcgtgg

SEQ ID NO: 6606 - DNA, 27 bp, Artificial Sequences
  Synthetic
gggtttgaaggggttgtagcgtgggaa

SEQ ID NO: 6607 - DNA, 28 bp, Artificial Sequences
  Synthetic
ggggtttgaaggggttgtagcgtgggaa

SEQ ID NO: 6608 - DNA, 27 bp, Artificial Sequences
  Synthetic
ggaggaaaagcgaagagtagggtgggt

SEQ ID NO: 6609 - DNA, 28 bp, Artificial Sequences
  Synthetic
aggaggaaaagcgaagagtagggtgggt

SEQ ID NO: 6610 - DNA, 27 bp, Artificial Sequences
  Synthetic
aggaggaaaagcgaagagtagggtggg

SEQ ID NO: 6611 - DNA, 29 bp, Artificial Sequences
  Synthetic
gaggaggaaaagcgaagagtagggtgggt

SEQ ID NO: 6612 - DNA, 28 bp, Artificial Sequences
  Synthetic
gaggaggaaaagcgaagagtagggtggg

SEQ ID NO: 6613 - DNA, 31 bp, Artificial Sequences
  Synthetic
cgttatggttttttaggaggtagatgggcga

SEQ ID NO: 6614 - DNA, 31 bp, Artificial Sequences
  Synthetic
tcgttatggttttttaggaggtagatgggcg

SEQ ID NO: 6615 - DNA, 32 bp, Artificial Sequences
  Synthetic
tcgttatggttttttaggaggtagatgggcga

SEQ ID NO: 6616 - DNA, 32 bp, Artificial Sequences
  Synthetic
cgttatggttttttaggaggtagatgggcgaa

SEQ ID NO: 6617 - DNA, 32 bp, Artificial Sequences
  Synthetic
ttcgttatggttttttaggaggtagatgggcg

SEQ ID NO: 6618 - DNA, 27 bp, Artificial Sequences
  Synthetic
ggggatggagtgggggaagagagttgc

SEQ ID NO: 6619 - DNA, 27 bp, Artificial Sequences
  Synthetic
ggatggagtgggggaagagagttgcgg

SEQ ID NO: 6620 - DNA, 27 bp, Artificial Sequences
  Synthetic
gggatggagtgggggaagagagttgcg

SEQ ID NO: 6621 - DNA, 27 bp, Artificial Sequences
  Synthetic
gggaaggggatggagtgggggaagaga

SEQ ID NO: 6622 - DNA, 27 bp, Artificial Sequences
  Synthetic
gatggagtgggggaagagagttgcgga

SEQ ID NO: 6623 - DNA, 27 bp, Artificial Sequences
  Synthetic
aggtgtttttcggagttggggatgcgg

SEQ ID NO: 6624 - DNA, 27 bp, Artificial Sequences
  Synthetic
ggtgtttttcggagttggggatgcgga

SEQ ID NO: 6625 - DNA, 28 bp, Artificial Sequences
  Synthetic
aggtgtttttcggagttggggatgcgga

SEQ ID NO: 6626 - DNA, 28 bp, Artificial Sequences
  Synthetic
ggtgtttttcggagttggggatgcggag

SEQ ID NO: 6627 - DNA, 27 bp, Artificial Sequences
  Synthetic
tgtttttcggagttggggatgcggagt

SEQ ID NO: 6628 - DNA, 27 bp, Artificial Sequences
  Synthetic
atttagtttgggggtagggagggcggc

SEQ ID NO: 6629 - DNA, 27 bp, Artificial Sequences
  Synthetic
ggcggtggttggtgggggagatgttta

SEQ ID NO: 6630 - DNA, 27 bp, Artificial Sequences
  Synthetic
gcggtggttggtgggggagatgtttaa

SEQ ID NO: 6631 - DNA, 26 bp, Artificial Sequences
  Synthetic
tttagtttgggggtagggagggcggc

SEQ ID NO: 6632 - DNA, 28 bp, Artificial Sequences
  Synthetic
gatttagtttgggggtagggagggcggc

SEQ ID NO: 6633 - DNA, 36 bp, Artificial Sequences
  Synthetic
tcggagttgagtagttatttttcggggatttaaaga

SEQ ID NO: 6634 - DNA, 29 bp, Artificial Sequences
  Synthetic
tggagagggtaatgtgtacgtttttgggg

SEQ ID NO: 6635 - DNA, 30 bp, Artificial Sequences
  Synthetic
tggagagggtaatgtgtacgtttttgggga

SEQ ID NO: 6636 - DNA, 29 bp, Artificial Sequences
  Synthetic
ggagagggtaatgtgtacgtttttgggga

SEQ ID NO: 6637 - DNA, 29 bp, Artificial Sequences
  Synthetic
tgcggtttttagtcgtaggaaagggaagt

SEQ ID NO: 6638 - DNA, 29 bp, Artificial Sequences
  Synthetic
agtcgtaggaaagggaagttcgtgattgt

SEQ ID NO: 6639 - DNA, 27 bp, Artificial Sequences
  Synthetic
aggtttggttgggcggtttgttcgtgt

SEQ ID NO: 6640 - DNA, 27 bp, Artificial Sequences
  Synthetic
ggtttggttgggcggtttgttcgtgtt

SEQ ID NO: 6641 - DNA, 28 bp, Artificial Sequences
  Synthetic
aggtttggttgggcggtttgttcgtgtt

SEQ ID NO: 6642 - DNA, 28 bp, Artificial Sequences
  Synthetic
taggtttggttgggcggtttgttcgtgt

SEQ ID NO: 6643 - DNA, 27 bp, Artificial Sequences
  Synthetic
taggtttggttgggcggtttgttcgtg

SEQ ID NO: 6644 - DNA, 27 bp, Artificial Sequences
  Synthetic
acgcgcggtttttggaggtcggatatt

SEQ ID NO: 6645 - DNA, 26 bp, Artificial Sequences
  Synthetic
acgcgcggtttttggaggtcggatat

SEQ ID NO: 6646 - DNA, 28 bp, Artificial Sequences
  Synthetic
acgcgcggtttttggaggtcggatatta

SEQ ID NO: 6647 - DNA, 27 bp, Artificial Sequences
  Synthetic
cgcgcggtttttggaggtcggatatta

SEQ ID NO: 6648 - DNA, 27 bp, Artificial Sequences
  Synthetic
agcgggagtaggaatttggtaggcgat

SEQ ID NO: 6649 - DNA, 27 bp, Artificial Sequences
  Synthetic
aggtttggttgggcggtttgttcgtgt

SEQ ID NO: 6650 - DNA, 27 bp, Artificial Sequences
  Synthetic
ggtttggttgggcggtttgttcgtgtt

SEQ ID NO: 6651 - DNA, 28 bp, Artificial Sequences
  Synthetic
aggtttggttgggcggtttgttcgtgtt

SEQ ID NO: 6652 - DNA, 28 bp, Artificial Sequences
  Synthetic
taggtttggttgggcggtttgttcgtgt

SEQ ID NO: 6653 - DNA, 27 bp, Artificial Sequences
  Synthetic
taggtttggttgggcggtttgttcgtg

SEQ ID NO: 6654 - DNA, 29 bp, Artificial Sequences
  Synthetic
ggttttgcgatcggtttagagttgtgtgg

SEQ ID NO: 6655 - DNA, 30 bp, Artificial Sequences
  Synthetic
ggttttgcgatcggtttagagttgtgtggt

SEQ ID NO: 6656 - DNA, 30 bp, Artificial Sequences
  Synthetic
aggttttgcgatcggtttagagttgtgtgg

SEQ ID NO: 6657 - DNA, 31 bp, Artificial Sequences
  Synthetic
aggttttgcgatcggtttagagttgtgtggt

SEQ ID NO: 6658 - DNA, 29 bp, Artificial Sequences
  Synthetic
gttttgcgatcggtttagagttgtgtggt

SEQ ID NO: 6659 - DNA, 27 bp, Artificial Sequences
  Synthetic
tggggcggggtattttagttgaacgga

SEQ ID NO: 6660 - DNA, 27 bp, Artificial Sequences
  Synthetic
ttggggcggggtattttagttgaacgg

SEQ ID NO: 6661 - DNA, 28 bp, Artificial Sequences
  Synthetic
tggggcggggtattttagttgaacggaa

SEQ ID NO: 6662 - DNA, 28 bp, Artificial Sequences
  Synthetic
ttggggcggggtattttagttgaacgga

SEQ ID NO: 6663 - DNA, 27 bp, Artificial Sequences
  Synthetic
ggggcggggtattttagttgaacggaa

SEQ ID NO: 6664 - DNA, 27 bp, Artificial Sequences
  Synthetic
gagtgggagtgggataaggcgggagtt

SEQ ID NO: 6665 - DNA, 27 bp, Artificial Sequences
  Synthetic
ggagtgggagtgggataaggcgggagt

SEQ ID NO: 6666 - DNA, 26 bp, Artificial Sequences
  Synthetic
ggagtgggagtgggataaggcgggag

SEQ ID NO: 6667 - DNA, 27 bp, Artificial Sequences
  Synthetic
gggagtgggagtgggataaggcgggag

SEQ ID NO: 6668 - DNA, 27 bp, Artificial Sequences
  Synthetic
agtgggagtgggataaggcgggagtta

SEQ ID NO: 6669 - DNA, 27 bp, Artificial Sequences
  Synthetic
agggcgtcgaggataggataaggcgtt

SEQ ID NO: 6670 - DNA, 27 bp, Artificial Sequences
  Synthetic
tagggcgtcgaggataggataaggcgt

SEQ ID NO: 6671 - DNA, 27 bp, Artificial Sequences
  Synthetic
gggcgtcgaggataggataaggcgttt

SEQ ID NO: 6672 - DNA, 28 bp, Artificial Sequences
  Synthetic
agggcgtcgaggataggataaggcgttt

SEQ ID NO: 6673 - DNA, 27 bp, Artificial Sequences
  Synthetic
agtgtgagtagggcgtcgaggatagga

SEQ ID NO: 6674 - DNA, 27 bp, Artificial Sequences
  Synthetic
ggagtcgaggttggagtgggttgtagt

SEQ ID NO: 6675 - DNA, 28 bp, Artificial Sequences
  Synthetic
aggagtcgaggttggagtgggttgtagt

SEQ ID NO: 6676 - DNA, 27 bp, Artificial Sequences
  Synthetic
aggagtcgaggttggagtgggttgtag

SEQ ID NO: 6677 - DNA, 27 bp, Artificial Sequences
  Synthetic
ttaggagtcgaggttggagtgggttgt

SEQ ID NO: 6678 - DNA, 28 bp, Artificial Sequences
  Synthetic
ggagtcgaggttggagtgggttgtagtt

SEQ ID NO: 6679 - DNA, 27 bp, Artificial Sequences
  Synthetic
tcgagttggttgggcggagtggtagtt

SEQ ID NO: 6680 - DNA, 27 bp, Artificial Sequences
  Synthetic
ttcgagttggttgggcggagtggtagt

SEQ ID NO: 6681 - DNA, 27 bp, Artificial Sequences
  Synthetic
cgagttggttgggcggagtggtagttt

SEQ ID NO: 6682 - DNA, 28 bp, Artificial Sequences
  Synthetic
tcgagttggttgggcggagtggtagttt

SEQ ID NO: 6683 - DNA, 28 bp, Artificial Sequences
  Synthetic
ttcgagttggttgggcggagtggtagtt

SEQ ID NO: 6684 - DNA, 28 bp, Artificial Sequences
  Synthetic
tgatttgtaaagtgcgagggtttggcgt

SEQ ID NO: 6685 - DNA, 27 bp, Artificial Sequences
  Synthetic
gatttgtaaagtgcgagggtttggcgt

SEQ ID NO: 6686 - DNA, 27 bp, Artificial Sequences
  Synthetic
tgatttgtaaagtgcgagggtttggcg

SEQ ID NO: 6687 - DNA, 27 bp, Artificial Sequences
  Synthetic
tgtaaagtgcgagggtttggcgttttt

SEQ ID NO: 6688 - DNA, 27 bp, Artificial Sequences
  Synthetic
ttgtaaagtgcgagggtttggcgtttt

SEQ ID NO: 6689 - DNA, 27 bp, Artificial Sequences
  Synthetic
agtaaagaaagcggggatagggcgcgt

SEQ ID NO: 6690 - DNA, 27 bp, Artificial Sequences
  Synthetic
gagtaaagaaagcggggatagggcgcg

SEQ ID NO: 6691 - DNA, 27 bp, Artificial Sequences
  Synthetic
aagaaagcggggatagggcgcgtaatc

SEQ ID NO: 6692 - DNA, 28 bp, Artificial Sequences
  Synthetic
agagtaaagaaagcggggatagggcgcg

SEQ ID NO: 6693 - DNA, 28 bp, Artificial Sequences
  Synthetic
gagtaaagaaagcggggatagggcgcgt

SEQ ID NO: 6694 - DNA, 27 bp, Artificial Sequences
  Synthetic
gtggcgttgcggtgaaagtcggtgttt

SEQ ID NO: 6695 - DNA, 27 bp, Artificial Sequences
  Synthetic
tggcgttgcggtgaaagtcggtgttta

SEQ ID NO: 6696 - DNA, 27 bp, Artificial Sequences
  Synthetic
attttggagtcgtcgggagtggcgttg

SEQ ID NO: 6697 - DNA, 26 bp, Artificial Sequences
  Synthetic
tggcgttgcggtgaaagtcggtgttt

SEQ ID NO: 6698 - DNA, 28 bp, Artificial Sequences
  Synthetic
gtggcgttgcggtgaaagtcggtgttta

SEQ ID NO: 6699 - DNA, 28 bp, Artificial Sequences
  Synthetic
gcgtcggtagaatggtttttggggaggt

SEQ ID NO: 6700 - DNA, 28 bp, Artificial Sequences
  Synthetic
tgcgtcggtagaatggtttttggggagg

SEQ ID NO: 6701 - DNA, 29 bp, Artificial Sequences
  Synthetic
tgcgtcggtagaatggtttttggggaggt

SEQ ID NO: 6702 - DNA, 27 bp, Artificial Sequences
  Synthetic
gcgtcggtagaatggtttttggggagg

SEQ ID NO: 6703 - DNA, 27 bp, Artificial Sequences
  Synthetic
tggttgggcgttttaggggtttttcgt

SEQ ID NO: 6704 - DNA, 27 bp, Artificial Sequences
  Synthetic
gtttggcgtttggggagtcggggtttt

SEQ ID NO: 6705 - DNA, 27 bp, Artificial Sequences
  Synthetic
ttggcgtttggggagtcggggtttttg

SEQ ID NO: 6706 - DNA, 27 bp, Artificial Sequences
  Synthetic
gcgtttggggagtcggggtttttgtgt

SEQ ID NO: 6707 - DNA, 27 bp, Artificial Sequences
  Synthetic
ttgggtgagagcggagggtttttggga

SEQ ID NO: 6708 - DNA, 27 bp, Artificial Sequences
  Synthetic
ggagtcggggtttttgtgtgtgtcggg

SEQ ID NO: 6709 - DNA, 27 bp, Artificial Sequences
  Synthetic
tatgcggtaagagggaggtcgggaggg

SEQ ID NO: 6710 - DNA, 27 bp, Artificial Sequences
  Synthetic
ttatgcggtaagagggaggtcgggagg

SEQ ID NO: 6711 - DNA, 27 bp, Artificial Sequences
  Synthetic
gtaagagggaggtcgggagggcggaag

SEQ ID NO: 6712 - DNA, 28 bp, Artificial Sequences
  Synthetic
ttatgcggtaagagggaggtcgggaggg

SEQ ID NO: 6713 - DNA, 26 bp, Artificial Sequences
  Synthetic
taagagggaggtcgggagggcggaag

SEQ ID NO: 6714 - DNA, 27 bp, Artificial Sequences
  Synthetic
cggtttcgttgcgggaggttagagggt

SEQ ID NO: 6715 - DNA, 27 bp, Artificial Sequences
  Synthetic
gttgcgggaggttagagggttgcgttt

SEQ ID NO: 6716 - DNA, 27 bp, Artificial Sequences
  Synthetic
ttcgttgcgggaggttagagggttgcg

SEQ ID NO: 6717 - DNA, 27 bp, Artificial Sequences
  Synthetic
tgcgggaggttagagggttgcgttttc

SEQ ID NO: 6718 - DNA, 27 bp, Artificial Sequences
  Synthetic
tttcgttgcgggaggttagagggttgc

SEQ ID NO: 6719 - DNA, 27 bp, Artificial Sequences
  Synthetic
tttgggttttgaaaggtggcggggtgg

SEQ ID NO: 6720 - DNA, 27 bp, Artificial Sequences
  Synthetic
tggtttgggttttgaaaggtggcgggg

SEQ ID NO: 6721 - DNA, 27 bp, Artificial Sequences
  Synthetic
ggtttgggttttgaaaggtggcggggt

SEQ ID NO: 6722 - DNA, 27 bp, Artificial Sequences
  Synthetic
gtttgggttttgaaaggtggcggggtg

SEQ ID NO: 6723 - DNA, 28 bp, Artificial Sequences
  Synthetic
ttggtttgggttttgaaaggtggcgggg

SEQ ID NO: 6724 - DNA, 27 bp, Artificial Sequences
  Synthetic
gagtagtggggtttcggggagtagcgg

SEQ ID NO: 6725 - DNA, 27 bp, Artificial Sequences
  Synthetic
ggagtagtggggtttcggggagtagcg

SEQ ID NO: 6726 - DNA, 27 bp, Artificial Sequences
  Synthetic
agaggggagtagtggggtttcggggag

SEQ ID NO: 6727 - DNA, 27 bp, Artificial Sequences
  Synthetic
aggggagtagtggggtttcggggagta

SEQ ID NO: 6728 - DNA, 27 bp, Artificial Sequences
  Synthetic
gggagtagtggggtttcggggagtagc

SEQ ID NO: 6729 - DNA, 27 bp, Artificial Sequences
  Synthetic
tttgggttttgaaaggtggcggggtgg

SEQ ID NO: 6730 - DNA, 27 bp, Artificial Sequences
  Synthetic
tggtttgggttttgaaaggtggcgggg

SEQ ID NO: 6731 - DNA, 27 bp, Artificial Sequences
  Synthetic
ggtttgggttttgaaaggtggcggggt

SEQ ID NO: 6732 - DNA, 27 bp, Artificial Sequences
  Synthetic
ggttggggtcgtttggggaggggatta

SEQ ID NO: 6733 - DNA, 27 bp, Artificial Sequences
  Synthetic
gtttgggttttgaaaggtggcggggtg

SEQ ID NO: 6734 - DNA, 27 bp, Artificial Sequences
  Synthetic
gagtagtggggtttcggggagtagcgg

SEQ ID NO: 6735 - DNA, 27 bp, Artificial Sequences
  Synthetic
ggagtagtggggtttcggggagtagcg

SEQ ID NO: 6736 - DNA, 27 bp, Artificial Sequences
  Synthetic
agaggggagtagtggggtttcggggag

SEQ ID NO: 6737 - DNA, 27 bp, Artificial Sequences
  Synthetic
aggggagtagtggggtttcggggagta

SEQ ID NO: 6738 - DNA, 27 bp, Artificial Sequences
  Synthetic
gggagtagtggggtttcggggagtagc

SEQ ID NO: 6739 - DNA, 27 bp, Artificial Sequences
  Synthetic
tttgggttttgaaaggtggcggggtgg

SEQ ID NO: 6740 - DNA, 27 bp, Artificial Sequences
  Synthetic
tggtttgggttttgaaaggtggcgggg

SEQ ID NO: 6741 - DNA, 27 bp, Artificial Sequences
  Synthetic
ggtttgggttttgaaaggtggcggggt

SEQ ID NO: 6742 - DNA, 27 bp, Artificial Sequences
  Synthetic
ggttggggtcgtttggggaggggatta

SEQ ID NO: 6743 - DNA, 27 bp, Artificial Sequences
  Synthetic
ttgggttttgaaaggtggcggggtggt

SEQ ID NO: 6744 - DNA, 27 bp, Artificial Sequences
  Synthetic
tgcgggtttattcggtagcggtcggta

SEQ ID NO: 6745 - DNA, 27 bp, Artificial Sequences
  Synthetic
agtgcgggtttattcggtagcggtcgg

SEQ ID NO: 6746 - DNA, 27 bp, Artificial Sequences
  Synthetic
gagtgcgggtttattcggtagcggtcg

SEQ ID NO: 6747 - DNA, 27 bp, Artificial Sequences
  Synthetic
gtgcgggtttattcggtagcggtcggt

SEQ ID NO: 6748 - DNA, 27 bp, Artificial Sequences
  Synthetic
gcgggtttattcggtagcggtcggtag

SEQ ID NO: 6749 - DNA, 32 bp, Artificial Sequences
  Synthetic
gcgagcgtgttgttgaattgtaatgtttcggg

SEQ ID NO: 6750 - DNA, 30 bp, Artificial Sequences
  Synthetic
gcgtgttgttgaattgtaatgtttcggggt

SEQ ID NO: 6751 - DNA, 29 bp, Artificial Sequences
  Synthetic
gcgtgttgttgaattgtaatgtttcgggg

SEQ ID NO: 6752 - DNA, 30 bp, Artificial Sequences
  Synthetic
agcgtgttgttgaattgtaatgtttcgggg

SEQ ID NO: 6753 - DNA, 31 bp, Artificial Sequences
  Synthetic
agcgtgttgttgaattgtaatgtttcggggt

SEQ ID NO: 6754 - DNA, 35 bp, Artificial Sequences
  Synthetic
tggagaatttcggttaaaaggtaatttgagaggga

SEQ ID NO: 6755 - DNA, 36 bp, Artificial Sequences
  Synthetic
ttggagaatttcggttaaaaggtaatttgagaggga

SEQ ID NO: 6756 - DNA, 36 bp, Artificial Sequences
  Synthetic
tggagaatttcggttaaaaggtaatttgagagggat

SEQ ID NO: 6757 - DNA, 36 bp, Artificial Sequences
  Synthetic
gttggagaatttcggttaaaaggtaatttgagaggg

SEQ ID NO: 6758 - DNA, 27 bp, Artificial Sequences
  Synthetic
ggcggcgatgggttttgggaacgttat

SEQ ID NO: 6759 - DNA, 27 bp, Artificial Sequences
  Synthetic
taattgtatggtcggtggatgcgcggc

SEQ ID NO: 6760 - DNA, 28 bp, Artificial Sequences
  Synthetic
ggcggcgatgggttttgggaacgttatt

SEQ ID NO: 6761 - DNA, 26 bp, Artificial Sequences
  Synthetic
aattgtatggtcggtggatgcgcggc

SEQ ID NO: 6762 - DNA, 26 bp, Artificial Sequences
  Synthetic
ggcggcgatgggttttgggaacgtta

SEQ ID NO: 6763 - DNA, 27 bp, Artificial Sequences
  Synthetic
ggcgttcgggttgcgttttggttgtta

SEQ ID NO: 6764 - DNA, 26 bp, Artificial Sequences
  Synthetic
ggcgttcgggttgcgttttggttgtt

SEQ ID NO: 6765 - DNA, 28 bp, Artificial Sequences
  Synthetic
ggcgttcgggttgcgttttggttgttat

SEQ ID NO: 6766 - DNA, 27 bp, Artificial Sequences
  Synthetic
gcgttcgggttgcgttttggttgttat

SEQ ID NO: 6767 - DNA, 25 bp, Artificial Sequences
  Synthetic
ggcgttcgggttgcgttttggttgt

SEQ ID NO: 6768 - DNA, 27 bp, Artificial Sequences
  Synthetic
ggcggcgatgggttttgggaacgttat

SEQ ID NO: 6769 - DNA, 27 bp, Artificial Sequences
  Synthetic
taaggtcgggtttgaatagggcggcgg

SEQ ID NO: 6770 - DNA, 27 bp, Artificial Sequences
  Synthetic
tcgggcgggcgggttagtttggattag

SEQ ID NO: 6771 - DNA, 27 bp, Artificial Sequences
  Synthetic
gcgcgggtgggatattaaggtcgggtt

SEQ ID NO: 6772 - DNA, 27 bp, Artificial Sequences
  Synthetic
gaggcgcgggtgggatattaaggtcgg

SEQ ID NO: 6773 - DNA, 29 bp, Artificial Sequences
  Synthetic
ggcgtgttatttggtggcgtttttagagt

SEQ ID NO: 6774 - DNA, 29 bp, Artificial Sequences
  Synthetic
tcgggttgcgttttggttgttattttgga

SEQ ID NO: 6775 - DNA, 30 bp, Artificial Sequences
  Synthetic
cgggttgcgttttggttgttattttggagt

SEQ ID NO: 6776 - DNA, 29 bp, Artificial Sequences
  Synthetic
cgggttgcgttttggttgttattttggag

SEQ ID NO: 6777 - DNA, 30 bp, Artificial Sequences
  Synthetic
tcgggttgcgttttggttgttattttggag

SEQ ID NO: 6778 - DNA, 27 bp, Artificial Sequences
  Synthetic
taaggtcgggtttgaatagggcggcgg

SEQ ID NO: 6779 - DNA, 27 bp, Artificial Sequences
  Synthetic
tcgggcgggcgggttagtttggattag

SEQ ID NO: 6780 - DNA, 27 bp, Artificial Sequences
  Synthetic
gcgcgggtgggatattaaggtcgggtt

SEQ ID NO: 6781 - DNA, 27 bp, Artificial Sequences
  Synthetic
gaggcgcgggtgggatattaaggtcgg

SEQ ID NO: 6782 - DNA, 27 bp, Artificial Sequences
  Synthetic
gtcgggcgggcgggttagtttggatta

SEQ ID NO: 6783 - DNA, 29 bp, Artificial Sequences
  Synthetic
ggcgtgttatttggtggcgtttttagagt

SEQ ID NO: 6784 - DNA, 30 bp, Artificial Sequences
  Synthetic
ggcgtgttatttggtggcgtttttagagtt

SEQ ID NO: 6785 - DNA, 30 bp, Artificial Sequences
  Synthetic
ttggtggcgtttttagagtttatcgtcgtc

SEQ ID NO: 6786 - DNA, 31 bp, Artificial Sequences
  Synthetic
tttggtggcgtttttagagtttatcgtcgtc

SEQ ID NO: 6787 - DNA, 32 bp, Artificial Sequences
  Synthetic
ggcgtgttatttggtggcgtttttagagttta

SEQ ID NO: 6788 - DNA, 27 bp, Artificial Sequences
  Synthetic
tcgggcgggcgggttagtttggattag

SEQ ID NO: 6789 - DNA, 27 bp, Artificial Sequences
  Synthetic
gtcgggcgggcgggttagtttggatta

SEQ ID NO: 6790 - DNA, 27 bp, Artificial Sequences
  Synthetic
cgggcgggcgggttagtttggattagt

SEQ ID NO: 6791 - DNA, 27 bp, Artificial Sequences
  Synthetic
gggcgggcgggttagtttggattagtt

SEQ ID NO: 6792 - DNA, 28 bp, Artificial Sequences
  Synthetic
ggcgggcgggttagtttggattagttgc

SEQ ID NO: 6793 - DNA, 27 bp, Artificial Sequences
  Synthetic
tcgttggggaaattcgtaggggtgcgg

SEQ ID NO: 6794 - DNA, 27 bp, Artificial Sequences
  Synthetic
cgttggggaaattcgtaggggtgcggt

SEQ ID NO: 6795 - DNA, 27 bp, Artificial Sequences
  Synthetic
gttggggaaattcgtaggggtgcggtt

SEQ ID NO: 6796 - DNA, 27 bp, Artificial Sequences
  Synthetic
tggggaaattcgtaggggtgcggtttg

SEQ ID NO: 6797 - DNA, 27 bp, Artificial Sequences
  Synthetic
ttcgttggggaaattcgtaggggtgcg

SEQ ID NO: 6798 - DNA, 27 bp, Artificial Sequences
  Synthetic
ggttttcggaaaggcgaggaggagcga

SEQ ID NO: 6799 - DNA, 27 bp, Artificial Sequences
  Synthetic
gttttcggaaaggcgaggaggagcgag

SEQ ID NO: 6800 - DNA, 27 bp, Artificial Sequences
  Synthetic
ttttcggaaaggcgaggaggagcgagc

SEQ ID NO: 6801 - DNA, 27 bp, Artificial Sequences
  Synthetic
cgtaggcgtgtcgtgtgagtttttgcg

SEQ ID NO: 6802 - DNA, 28 bp, Artificial Sequences
  Synthetic
cgtaggcgtgtcgtgtgagtttttgcgt

SEQ ID NO: 6803 - DNA, 27 bp, Artificial Sequences
  Synthetic
ggtttgcggggtttttgggggcgtatt

SEQ ID NO: 6804 - DNA, 27 bp, Artificial Sequences
  Synthetic
tggggaaattcgtaggggtgcggtttg

SEQ ID NO: 6805 - DNA, 27 bp, Artificial Sequences
  Synthetic
gtttgcggggtttttgggggcgtattt

SEQ ID NO: 6806 - DNA, 26 bp, Artificial Sequences
  Synthetic
ggtttgcggggtttttgggggcgtat

SEQ ID NO: 6807 - DNA, 28 bp, Artificial Sequences
  Synthetic
ggtttgcggggtttttgggggcgtattt

SEQ ID NO: 6808 - DNA, 27 bp, Artificial Sequences
  Synthetic
tcgtgtggttttcgtcgtagtggagtt

SEQ ID NO: 6809 - DNA, 27 bp, Artificial Sequences
  Synthetic
ttcgtgtggttttcgtcgtagtggagt

SEQ ID NO: 6810 - DNA, 28 bp, Artificial Sequences
  Synthetic
cgtgtggttttcgtcgtagtggagttgt

SEQ ID NO: 6811 - DNA, 27 bp, Artificial Sequences
  Synthetic
cgtgtggttttcgtcgtagtggagttg

SEQ ID NO: 6812 - DNA, 29 bp, Artificial Sequences
  Synthetic
tcgtgtggttttcgtcgtagtggagttgt

SEQ ID NO: 6813 - DNA, 27 bp, Artificial Sequences
  Synthetic
tggacgcggggtttttagttcggaggt

SEQ ID NO: 6814 - DNA, 27 bp, Artificial Sequences
  Synthetic
tgggtagggcgtcgggttttcggattt

SEQ ID NO: 6815 - DNA, 27 bp, Artificial Sequences
  Synthetic
ttgggtagggcgtcgggttttcggatt

SEQ ID NO: 6816 - DNA, 27 bp, Artificial Sequences
  Synthetic
tttgggtagggcgtcgggttttcggat

SEQ ID NO: 6817 - DNA, 27 bp, Artificial Sequences
  Synthetic
ttgttttggggtttgggtagggcgtcg

SEQ ID NO: 6818 - DNA, 27 bp, Artificial Sequences
  Synthetic
gtttcggcgggagaggaagcgttttgg

SEQ ID NO: 6819 - DNA, 27 bp, Artificial Sequences
  Synthetic
tgggtagaagtcgcgcgtgtgttcgag

SEQ ID NO: 6820 - DNA, 27 bp, Artificial Sequences
  Synthetic
tttcggcgggagaggaagcgttttggt

SEQ ID NO: 6821 - DNA, 27 bp, Artificial Sequences
  Synthetic
gtgggtagaagtcgcgcgtgtgttcga

SEQ ID NO: 6822 - DNA, 27 bp, Artificial Sequences
  Synthetic
ttcggcgggagaggaagcgttttggtc

SEQ ID NO: 6823 - DNA, 27 bp, Artificial Sequences
  Synthetic
cggggcgagtaaaagtaggatttcggt

SEQ ID NO: 6824 - DNA, 28 bp, Artificial Sequences
  Synthetic
tcggggcgagtaaaagtaggatttcggt

SEQ ID NO: 6825 - DNA, 27 bp, Artificial Sequences
  Synthetic
tcggggcgagtaaaagtaggatttcgg

SEQ ID NO: 6826 - DNA, 30 bp, Artificial Sequences
  Synthetic
cggggcgagtaaaagtaggatttcggttcg

SEQ ID NO: 6827 - DNA, 28 bp, Artificial Sequences
  Synthetic
cggggcgagtaaaagtaggatttcggtt

SEQ ID NO: 6828 - DNA, 36 bp, Artificial Sequences
  Synthetic
cgggttcgttcgttgtttatttgagtaagtttttgg

SEQ ID NO: 6829 - DNA, 35 bp, Artificial Sequences
  Synthetic
cgggttcgttcgttgtttatttgagtaagtttttg

SEQ ID NO: 6830 - DNA, 36 bp, Artificial Sequences
  Synthetic
gggttcgttcgttgtttatttgagtaagtttttgga

SEQ ID NO: 6831 - DNA, 36 bp, Artificial Sequences
  Synthetic
cgttgtttatttgagtaagtttttggattcggtcga

SEQ ID NO: 6832 - DNA, 36 bp, Artificial Sequences
  Synthetic
tcgttgtttatttgagtaagtttttggattcggtcg

SEQ ID NO: 6833 - DNA, 29 bp, Artificial Sequences
  Synthetic
tgggtagcggtttttagtattgggttggt

SEQ ID NO: 6834 - DNA, 30 bp, Artificial Sequences
  Synthetic
tgggtagcggtttttagtattgggttggtt

SEQ ID NO: 6835 - DNA, 30 bp, Artificial Sequences
  Synthetic
ttgggtagcggtttttagtattgggttggt

SEQ ID NO: 6836 - DNA, 30 bp, Artificial Sequences
  Synthetic
gttgggtagcggtttttagtattgggttgg

SEQ ID NO: 6837 - DNA, 31 bp, Artificial Sequences
  Synthetic
gttgggtagcggtttttagtattgggttggt

SEQ ID NO: 6838 - DNA, 27 bp, Artificial Sequences
  Synthetic
ttggttgtggagagagcggataggtgc

SEQ ID NO: 6839 - DNA, 28 bp, Artificial Sequences
  Synthetic
cgggttatgttggttgtggagagagcgg

SEQ ID NO: 6840 - DNA, 28 bp, Artificial Sequences
  Synthetic
gttggttgtggagagagcggataggtgc

SEQ ID NO: 6841 - DNA, 29 bp, Artificial Sequences
  Synthetic
tgttggttgtggagagagcggataggtgc

SEQ ID NO: 6842 - DNA, 29 bp, Artificial Sequences
  Synthetic
cgggttatgttggttgtggagagagcgga

SEQ ID NO: 6843 - DNA, 29 bp, Artificial Sequences
  Synthetic
tgggtagcggtttttagtattgggttggt

SEQ ID NO: 6844 - DNA, 30 bp, Artificial Sequences; identical to SEQ ID NO: 6834
  Synthetic

SEQ ID NO: 6845 - DNA, 30 bp, Artificial Sequences; identical to SEQ ID NO: 6835
  Synthetic

SEQ ID NO: 6846 - DNA, 30 bp, Artificial Sequences; identical to SEQ ID NO: 6836
  Synthetic

SEQ ID NO: 6847 - DNA, 31 bp, Artificial Sequences; identical to SEQ ID NO: 6837
  Synthetic

SEQ ID NO: 6848 - DNA, 26 bp, Artificial Sequences
  Synthetic
gcggcggcggtatttggtagatggtg

SEQ ID NO: 6849 - DNA, 27 bp, Artificial Sequences
  Synthetic
gcggcggcggtatttggtagatggtgt

SEQ ID NO: 6850 - DNA, 27 bp, Artificial Sequences
  Synthetic
cggcggcggtatttggtagatggtgta

SEQ ID NO: 6851 - DNA, 28 bp, Artificial Sequences
  Synthetic
gcggcggcggtatttggtagatggtgta

SEQ ID NO: 6852 - DNA, 27 bp, Artificial Sequences
  Synthetic
ttggttgtggagagagcggataggtgc

SEQ ID NO: 6853 - DNA, 27 bp, Artificial Sequences
  Synthetic
cggtgtattttattttgggcggcgcgt

SEQ ID NO: 6854 - DNA, 27 bp, Artificial Sequences
  Synthetic
tcggtgtattttattttgggcggcgcg

SEQ ID NO: 6855 - DNA, 28 bp, Artificial Sequences
  Synthetic
tcggtgtattttattttgggcggcgcgt

SEQ ID NO: 6856 - DNA, 28 bp, Artificial Sequences
  Synthetic
cggtgtattttattttgggcggcgcgtt

SEQ ID NO: 6857 - DNA, 28 bp, Artificial Sequences
  Synthetic
ttcggtgtattttattttgggcggcgcg

SEQ ID NO: 6858 - DNA, 27 bp, Artificial Sequences
  Synthetic
gagggcgttttgagtagcgagtgggga

SEQ ID NO: 6859 - DNA, 27 bp, Artificial Sequences
  Synthetic
agggcgttttgagtagcgagtggggag

SEQ ID NO: 6860 - DNA, 27 bp, Artificial Sequences
  Synthetic
tggagggcgttttgagtagcgagtggg

SEQ ID NO: 6861 - DNA, 27 bp, Artificial Sequences
  Synthetic
ggcgttttgagtagcgagtggggaggt

SEQ ID NO: 6862 - DNA, 27 bp, Artificial Sequences
  Synthetic
cgtggagggcgttttgagtagcgagtg

SEQ ID NO: 6863 - DNA, 27 bp, Artificial Sequences
  Synthetic
cggtgtattttattttgggcggcgcgt

SEQ ID NO: 6864 - DNA, 27 bp, Artificial Sequences
  Synthetic
tcggtgtattttattttgggcggcgcg

SEQ ID NO: 6865 - DNA, 28 bp, Artificial Sequences
  Synthetic
tcggtgtattttattttgggcggcgcgt

SEQ ID NO: 6866 - DNA, 28 bp, Artificial Sequences
  Synthetic
cggtgtattttattttgggcggcgcgtt

SEQ ID NO: 6867 - DNA, 28 bp, Artificial Sequences
  Synthetic
ttcggtgtattttattttgggcggcgcg

SEQ ID NO: 6868 - DNA, 27 bp, Artificial Sequences
  Synthetic
gagggcgttttgagtagcgagtgggga

SEQ ID NO: 6869 - DNA, 27 bp, Artificial Sequences
  Synthetic
agggcgttttgagtagcgagtggggag

SEQ ID NO: 6870 - DNA, 27 bp, Artificial Sequences
  Synthetic
tggagggcgttttgagtagcgagtggg

SEQ ID NO: 6871 - DNA, 27 bp, Artificial Sequences
  Synthetic
ggcgttttgagtagcgagtggggaggt

SEQ ID NO: 6872 - DNA, 27 bp, Artificial Sequences
  Synthetic
cgtggagggcgttttgagtagcgagtg

SEQ ID NO: 6873 - DNA, 27 bp, Artificial Sequences
  Synthetic
cggtgtattttattttgggcggcgcgt

SEQ ID NO: 6874 - DNA, 27 bp, Artificial Sequences
  Synthetic
tcggtgtattttattttgggcggcgcg

SEQ ID NO: 6875 - DNA, 28 bp, Artificial Sequences
  Synthetic
tcggtgtattttattttgggcggcgcgt

SEQ ID NO: 6876 - DNA, 27 bp, Artificial Sequences
  Synthetic
aggttggttggcgagatttatgggggt

SEQ ID NO: 6877 - DNA, 28 bp, Artificial Sequences
  Synthetic
cggtgtattttattttgggcggcgcgtt

SEQ ID NO: 6878 - DNA, 27 bp, Artificial Sequences
  Synthetic
gagggcgttttgagtagcgagtgggga

SEQ ID NO: 6879 - DNA, 27 bp, Artificial Sequences
  Synthetic
agggcgttttgagtagcgagtggggag

SEQ ID NO: 6880 - DNA, 27 bp, Artificial Sequences
  Synthetic
tggagggcgttttgagtagcgagtggg

SEQ ID NO: 6881 - DNA, 27 bp, Artificial Sequences
  Synthetic
ggcgttttgagtagcgagtggggaggt

SEQ ID NO: 6882 - DNA, 27 bp, Artificial Sequences
  Synthetic
cgtggagggcgttttgagtagcgagtg

SEQ ID NO: 6883 - DNA, 27 bp, Artificial Sequences
  Synthetic
tggaggagatgaagaggttggttggcg

SEQ ID NO: 6884 - DNA, 27 bp, Artificial Sequences
  Synthetic
aggttggttggcgagatttatgggggt

SEQ ID NO: 6885 - DNA, 28 bp, Artificial Sequences
  Synthetic
tggaggagatgaagaggttggttggcga

SEQ ID NO: 6886 - DNA, 27 bp, Artificial Sequences
  Synthetic
ggaggagatgaagaggttggttggcga

SEQ ID NO: 6887 - DNA, 28 bp, Artificial Sequences
  Synthetic
gaggttggttggcgagatttatgggggt

SEQ ID NO: 6888 - DNA, 27 bp, Artificial Sequences
  Synthetic
tcgattgtagggggtgttgaatgtggt

SEQ ID NO: 6889 - DNA, 28 bp, Artificial Sequences
  Synthetic
gtcgattgtagggggtgttgaatgtggt

SEQ ID NO: 6890 - DNA, 29 bp, Artificial Sequences
  Synthetic
agtcgattgtagggggtgttgaatgtggt

SEQ ID NO: 6891 - DNA, 28 bp, Artificial Sequences
  Synthetic
agtcgattgtagggggtgttgaatgtgg

SEQ ID NO: 6892 - DNA, 28 bp, Artificial Sequences
  Synthetic
tcgattgtagggggtgttgaatgtggtt

SEQ ID NO: 6893 - DNA, 27 bp, Artificial Sequences
  Synthetic
ggcgtggaggtgaggatggggtaagag

SEQ ID NO: 6894 - DNA, 27 bp, Artificial Sequences
  Synthetic
agatggcgtggaggtgaggatggggta

SEQ ID NO: 6895 - DNA, 27 bp, Artificial Sequences
  Synthetic
atggcgtggaggtgaggatggggtaag

SEQ ID NO: 6896 - DNA, 27 bp, Artificial Sequences
  Synthetic
gatggcgtggaggtgaggatggggtaa

SEQ ID NO: 6897 - DNA, 27 bp, Artificial Sequences
  Synthetic
tggcgtggaggtgaggatggggtaaga

SEQ ID NO: 6898 - DNA, 29 bp, Artificial Sequences
  Synthetic
tgcggtatattgtggtgggagagatacgt

SEQ ID NO: 6899 - DNA, 28 bp, Artificial Sequences
  Synthetic
gcggtatattgtggtgggagagatacgt

SEQ ID NO: 6900 - DNA, 28 bp, Artificial Sequences
  Synthetic
tgcggtatattgtggtgggagagatacg

SEQ ID NO: 6901 - DNA, 29 bp, Artificial Sequences
  Synthetic
gcggtatattgtggtgggagagatacgtg

SEQ ID NO: 6902 - DNA, 30 bp, Artificial Sequences
  Synthetic
gcggtatattgtggtgggagagatacgtgt

SEQ ID NO: 6903 - DNA, 27 bp, Artificial Sequences
  Synthetic
gtgtgtgtgtgtggaagggtggcgttg

SEQ ID NO: 6904 - DNA, 27 bp, Artificial Sequences
  Synthetic
gtacgtgtgtgtgtgtggaagggtggc

SEQ ID NO: 6905 - DNA, 27 bp, Artificial Sequences
  Synthetic
gtgtgtgtgtggaagggtggcgttgat

SEQ ID NO: 6906 - DNA, 27 bp, Artificial Sequences
  Synthetic
tgtgtgtgtgtggaagggtggcgttga

SEQ ID NO: 6907 - DNA, 27 bp, Artificial Sequences
  Synthetic
tacgtgtgtgtgtgtggaagggtggcg

SEQ ID NO: 6908 - DNA, 29 bp, Artificial Sequences
  Synthetic
gggtaatgttttgtttgggaggttagcgt

SEQ ID NO: 6909 - DNA, 30 bp, Artificial Sequences
  Synthetic
agggtaatgttttgtttgggaggttagcgt

SEQ ID NO: 6910 - DNA, 30 bp, Artificial Sequences
  Synthetic
gggtaatgttttgtttgggaggttagcgtt

SEQ ID NO: 6911 - DNA, 30 bp, Artificial Sequences
  Synthetic
aagggtaatgttttgtttgggaggttagcg

SEQ ID NO: 6912 - DNA, 31 bp, Artificial Sequences
  Synthetic
agggtaatgttttgtttgggaggttagcgtt

SEQ ID NO: 6913 - DNA, 26 bp, Artificial Sequences
  Synthetic
tgcgtgtttggtttttgtgtcggtgt

SEQ ID NO: 6914 - DNA, 28 bp, Artificial Sequences
  Synthetic
tgggaattgtttggtgagtgtcgaagga

SEQ ID NO: 6915 - DNA, 29 bp, Artificial Sequences
  Synthetic
gggaattgtttggtgagtgtcgaaggagg

SEQ ID NO: 6916 - DNA, 30 bp, Artificial Sequences
  Synthetic
tgggaattgtttggtgagtgtcgaaggagg

SEQ ID NO: 6917 - DNA, 26 bp, Artificial Sequences
  Synthetic
gcgtgtttggtttttgtgtcggtgtg

SEQ ID NO: 6918 - DNA, 29 bp, Artificial Sequences
  Synthetic
cgggtttttgatgcgtttttgttggatgt

SEQ ID NO: 6919 - DNA, 30 bp, Artificial Sequences
  Synthetic
tcgggtttttgatgcgtttttgttggatgt

SEQ ID NO: 6920 - DNA, 30 bp, Artificial Sequences
  Synthetic
cgggtttttgatgcgtttttgttggatgtt

SEQ ID NO: 6921 - DNA, 30 bp, Artificial Sequences
  Synthetic
ttcgggtttttgatgcgtttttgttggatg

SEQ ID NO: 6922 - DNA, 31 bp, Artificial Sequences
  Synthetic
tcgggtttttgatgcgtttttgttggatgtt

SEQ ID NO: 6923 - DNA, 27 bp, Artificial Sequences
  Synthetic
gggtgcgtgtgttttgttttgtcgggt

SEQ ID NO: 6924 - DNA, 28 bp, Artificial Sequences
  Synthetic
agggtgcgtgtgttttgttttgtcgggt

SEQ ID NO: 6925 - DNA, 27 bp, Artificial Sequences
  Synthetic
agggtgcgtgtgttttgttttgtcggg

SEQ ID NO: 6926 - DNA, 28 bp, Artificial Sequences
  Synthetic
aagggtgcgtgtgttttgttttgtcggg

SEQ ID NO: 6927 - DNA, 29 bp, Artificial Sequences
  Synthetic
aagggtgcgtgtgttttgttttgtcgggt

SEQ ID NO: 6928 - DNA, 27 bp, Artificial Sequences
  Synthetic
gcgtagaaggaagttaggtcgcgagga

SEQ ID NO: 6929 - DNA, 28 bp, Artificial Sequences
  Synthetic
gcgtagaaggaagttaggtcgcgaggat

SEQ ID NO: 6930 - DNA, 29 bp, Artificial Sequences
  Synthetic
gcgtagaaggaagttaggtcgcgaggatg

SEQ ID NO: 6931 - DNA, 30 bp, Artificial Sequences
  Synthetic
gcgtagaaggaagttaggtcgcgaggatgt

SEQ ID NO: 6932 - DNA, 27 bp, Artificial Sequences
  Synthetic
agaaggaagttaggtcgcgaggatgtc

SEQ ID NO: 6933 - DNA, 27 bp, Artificial Sequences
  Synthetic
agtttgcggggtggggtaaaggtgatt

SEQ ID NO: 6934 - DNA, 27 bp, Artificial Sequences
  Synthetic
aagtttgcggggtggggtaaaggtgat

SEQ ID NO: 6935 - DNA, 27 bp, Artificial Sequences
  Synthetic
taagtttgcggggtggggtaaaggtga

SEQ ID NO: 6936 - DNA, 28 bp, Artificial Sequences
  Synthetic
aagtttgcggggtggggtaaaggtgatt

SEQ ID NO: 6937 - DNA, 26 bp, Artificial Sequences
  Synthetic
aagtttgcggggtggggtaaaggtga

SEQ ID NO: 6938 - DNA, 27 bp, Artificial Sequences
  Synthetic
tgtgggaagcgtgcgttgtttgatttt

SEQ ID NO: 6939 - DNA, 27 bp, Artificial Sequences
  Synthetic
atgtgggaagcgtgcgttgtttgattt

SEQ ID NO: 6940 - DNA, 27 bp, Artificial Sequences
  Synthetic
agcgtgcgttgtttgattttagggtgt

SEQ ID NO: 6941 - DNA, 29 bp, Artificial Sequences
  Synthetic
gggaagcgtgcgttgtttgattttagggt

SEQ ID NO: 6942 - DNA, 29 bp, Artificial Sequences
  Synthetic
tgggaagcgtgcgttgtttgattttaggg

SEQ ID NO: 6943 - DNA, 32 bp, Artificial Sequences
  Synthetic
ggcggcgtttgaatagtattttgggattaggt

SEQ ID NO: 6944 - DNA, 31 bp, Artificial Sequences
  Synthetic
gcggcgtttgaatagtattttgggattaggt

SEQ ID NO: 6945 - DNA, 35 bp, Artificial Sequences
  Synthetic
gcggcgtttgaatagtattttgggattaggtagcg

SEQ ID NO: 6946 - DNA, 33 bp, Artificial Sequences
  Synthetic
ggcggcgtttgaatagtattttgggattaggta

SEQ ID NO: 6947 - DNA, 32 bp, Artificial Sequences
  Synthetic
acggtgttaggtatggaattgatacgtgatgt

SEQ ID NO: 6948 - DNA, 27 bp, Artificial Sequences
  Synthetic
tgtgggaagcgtgcgttgtttgatttt

SEQ ID NO: 6949 - DNA, 27 bp, Artificial Sequences
  Synthetic
atgtgggaagcgtgcgttgtttgattt

SEQ ID NO: 6950 - DNA, 27 bp, Artificial Sequences
  Synthetic
agcgtgcgttgtttgattttagggtgt

SEQ ID NO: 6951 - DNA, 29 bp, Artificial Sequences
  Synthetic
gggaagcgtgcgttgtttgattttagggt

SEQ ID NO: 6952 - DNA, 29 bp, Artificial Sequences
  Synthetic
tgggaagcgtgcgttgtttgattttaggg

SEQ ID NO: 6953 - DNA, 27 bp, Artificial Sequences
  Synthetic
agaggaagtcggcggggttaaagcgtt

SEQ ID NO: 6954 - DNA, 27 bp, Artificial Sequences
  Synthetic
ttggtgggggttgtagaggaagtcggc

SEQ ID NO: 6955 - DNA, 27 bp, Artificial Sequences
  Synthetic
cgggttggtgggggttgtagaggaagt

SEQ ID NO: 6956 - DNA, 27 bp, Artificial Sequences
  Synthetic
gggttgtagaggaagtcggcggggtta

SEQ ID NO: 6957 - DNA, 27 bp, Artificial Sequences
  Synthetic
tcgggttggtgggggttgtagaggaag

SEQ ID NO: 6958 - DNA, 27 bp, Artificial Sequences
  Synthetic
ttcggttgtttttaacgcgcgtgtgag

SEQ ID NO: 6959 - DNA, 27 bp, Artificial Sequences
  Synthetic
tgtttcggttgtttttaacgcgcgtgt

SEQ ID NO: 6960 - DNA, 27 bp, Artificial Sequences
  Synthetic
tttcggttgtttttaacgcgcgtgtga

SEQ ID NO: 6961 - DNA, 28 bp, Artificial Sequences
  Synthetic
tgtttcggttgtttttaacgcgcgtgtg

SEQ ID NO: 6962 - DNA, 27 bp, Artificial Sequences
  Synthetic
gtttcggttgtttttaacgcgcgtgtg

SEQ ID NO: 6963 - DNA, 27 bp, Artificial Sequences
  Synthetic
gttgatggaggtgtttggtgttcgtgt

SEQ ID NO: 6964 - DNA, 28 bp, Artificial Sequences
  Synthetic
agttgatggaggtgtttggtgttcgtgt

SEQ ID NO: 6965 - DNA, 29 bp, Artificial Sequences
  Synthetic
aagttgatggaggtgtttggtgttcgtgt

SEQ ID NO: 6966 - DNA, 28 bp, Artificial Sequences
  Synthetic
aagttgatggaggtgtttggtgttcgtg

SEQ ID NO: 6967 - DNA, 29 bp, Artificial Sequences
  Synthetic
tgaagttgatggaggtgtttggtgttcgt

SEQ ID NO: 6968 - DNA, 27 bp, Artificial Sequences
  Synthetic
ggtaggggtgggcgttagggagtgttc

SEQ ID NO: 6969 - DNA, 27 bp, Artificial Sequences
  Synthetic
cggggtcgggcgtaggagttgtttgta

SEQ ID NO: 6970 - DNA, 27 bp, Artificial Sequences
  Synthetic
ttagggtaggggtgggcgttagggagt

SEQ ID NO: 6971 - DNA, 27 bp, Artificial Sequences
  Synthetic
agttagggtaggggtgggcgttaggga

SEQ ID NO: 6972 - DNA, 27 bp, Artificial Sequences
  Synthetic
gtaggggtgggcgttagggagtgttcg

SEQ ID NO: 6973 - DNA, 27 bp, Artificial Sequences
  Synthetic
gttgatggaggtgtttggtgttcgtgt

SEQ ID NO: 6974 - DNA, 28 bp, Artificial Sequences
  Synthetic
agttgatggaggtgtttggtgttcgtgt

SEQ ID NO: 6975 - DNA, 29 bp, Artificial Sequences
  Synthetic
aagttgatggaggtgtttggtgttcgtgt

SEQ ID NO: 6976 - DNA, 28 bp, Artificial Sequences
  Synthetic
aagttgatggaggtgtttggtgttcgtg

SEQ ID NO: 6977 - DNA, 29 bp, Artificial Sequences
  Synthetic
tgaagttgatggaggtgtttggtgttcgt

SEQ ID NO: 6978 - DNA, 27 bp, Artificial Sequences
  Synthetic
gtgggatggtcgggttttttgcgggaa

SEQ ID NO: 6979 - DNA, 27 bp, Artificial Sequences
  Synthetic
tacgtgggatggtcgggttttttgcgg

SEQ ID NO: 6980 - DNA, 27 bp, Artificial Sequences
  Synthetic
tgggatggtcgggttttttgcgggaat

SEQ ID NO: 6981 - DNA, 26 bp, Artificial Sequences
  Synthetic
acgtgggatggtcgggttttttgcgg

SEQ ID NO: 6982 - DNA, 28 bp, Artificial Sequences
  Synthetic
gtgggatggtcgggttttttgcgggaat

SEQ ID NO: 6983 - DNA, 27 bp, Artificial Sequences
  Synthetic
aagtgttcgcggtggtggttcgagttc

SEQ ID NO: 6984 - DNA, 27 bp, Artificial Sequences
  Synthetic
gaaagtgttcgcggtggtggttcgagt

SEQ ID NO: 6985 - DNA, 27 bp, Artificial Sequences
  Synthetic
aaagtgttcgcggtggtggttcgagtt

SEQ ID NO: 6986 - DNA, 28 bp, Artificial Sequences
  Synthetic
aaagtgttcgcggtggtggttcgagttc

SEQ ID NO: 6987 - DNA, 28 bp, Artificial Sequences
  Synthetic
gaaagtgttcgcggtggtggttcgagtt

SEQ ID NO: 6988 - DNA, 27 bp, Artificial Sequences
  Synthetic
agataggtgtggagggcggttgtggtt

SEQ ID NO: 6989 - DNA, 27 bp, Artificial Sequences
  Synthetic
aagataggtgtggagggcggttgtggt

SEQ ID NO: 6990 - DNA, 27 bp, Artificial Sequences
  Synthetic
tcgaagataggtgtggagggcggttgt

SEQ ID NO: 6991 - DNA, 27 bp, Artificial Sequences
  Synthetic
aggtgtggagggcggttgtggtttagc

SEQ ID NO: 6992 - DNA, 27 bp, Artificial Sequences
  Synthetic
cgaagataggtgtggagggcggttgtg

SEQ ID NO: 6993 - DNA, 27 bp, Artificial Sequences
  Synthetic
gacggagagcgtcgggtttttggttcg

SEQ ID NO: 6994 - DNA, 27 bp, Artificial Sequences
  Synthetic
agagcgtcgggtttttggttcggaggt

SEQ ID NO: 6995 - DNA, 27 bp, Artificial Sequences
  Synthetic
gagagcgtcgggtttttggttcggagg

SEQ ID NO: 6996 - DNA, 27 bp, Artificial Sequences
  Synthetic
ggagagcgtcgggtttttggttcggag

SEQ ID NO: 6997 - DNA, 27 bp, Artificial Sequences
  Synthetic
gagcgtcgggtttttggttcggaggtt

SEQ ID NO: 6998 - DNA, 27 bp, Artificial Sequences
  Synthetic
aggggcggtttttaggttttcgaggtg

SEQ ID NO: 6999 - DNA, 27 bp, Artificial Sequences
  Synthetic
ggggcggtttttaggttttcgaggtga

SEQ ID NO: 7000 - DNA, 28 bp, Artificial Sequences
  Synthetic
aggggcggtttttaggttttcgaggtga

SEQ ID NO: 7001 - DNA, 27 bp, Artificial Sequences
  Synthetic
aaggggcggtttttaggttttcgaggt

SEQ ID NO: 7002 - DNA, 28 bp, Artificial Sequences
  Synthetic
ggggcggtttttaggttttcgaggtgag

SEQ ID NO: 7003 - DNA, 27 bp, Artificial Sequences
  Synthetic
cgttcggtcggggtaggagtgaagtcg

SEQ ID NO: 7004 - DNA, 27 bp, Artificial Sequences
  Synthetic
gttcggtcggggtaggagtgaagtcgc

SEQ ID NO: 7005 - DNA, 27 bp, Artificial Sequences
  Synthetic
cggtcgagcgggttttgagttgggttt

SEQ ID NO: 7006 - DNA, 27 bp, Artificial Sequences
  Synthetic
tcgttcggtcggggtaggagtgaagtc

SEQ ID NO: 7007 - DNA, 27 bp, Artificial Sequences
  Synthetic
ttcgttcggtcggggtaggagtgaagt

SEQ ID NO: 7008 - DNA, 27 bp, Artificial Sequences
  Synthetic
gtttatggattcggaggagatcgcgcg

SEQ ID NO: 7009 - DNA, 28 bp, Artificial Sequences
  Synthetic
agtttatggattcggaggagatcgcgcg

SEQ ID NO: 7010 - DNA, 29 bp, Artificial Sequences
  Synthetic
gagtttatggattcggaggagatcgcgcg

SEQ ID NO: 7011 - DNA, 29 bp, Artificial Sequences
  Synthetic
cgagtttatggattcggaggagatcgcgc

SEQ ID NO: 7012 - DNA, 27 bp, Artificial Sequences
  Synthetic
tcgtcgggttaagtggaggaagaagga

SEQ ID NO: 7013 - DNA, 27 bp, Artificial Sequences
  Synthetic
gttgtcggagttgggcgcgttgtgtag

SEQ ID NO: 7014 - DNA, 27 bp, Artificial Sequences
  Synthetic
agttgggcgcgttgtgtagggataggt

SEQ ID NO: 7015 - DNA, 27 bp, Artificial Sequences
  Synthetic
cgcgttgtgtagggataggtcgtcggg

SEQ ID NO: 7016 - DNA, 27 bp, Artificial Sequences
  Synthetic
ttgggcgcgttgtgtagggataggtcg

SEQ ID NO: 7017 - DNA, 27 bp, Artificial Sequences
  Synthetic
cggagttgggcgcgttgtgtagggata

SEQ ID NO: 7018 - DNA, 30 bp, Artificial Sequences
  Synthetic
ggagttggagaagatggagaagaagaagcg

SEQ ID NO: 7019 - DNA, 31 bp, Artificial Sequences
  Synthetic
ggagttggagaagatggagaagaagaagcgt

SEQ ID NO: 7020 - DNA, 31 bp, Artificial Sequences
  Synthetic
aggagttggagaagatggagaagaagaagcg

SEQ ID NO: 7021 - DNA, 32 bp, Artificial Sequences
  Synthetic
aggagttggagaagatggagaagaagaagcgt

SEQ ID NO: 7022 - DNA, 30 bp, Artificial Sequences
  Synthetic
gagttggagaagatggagaagaagaagcgt

SEQ ID NO: 7023 - DNA, 26 bp, Artificial Sequences
  Synthetic
cgaggcgtgcgtttcggggtttttgg

SEQ ID NO: 7024 - DNA, 25 bp, Artificial Sequences
  Synthetic
cgaggcgtgcgtttcggggtttttg

SEQ ID NO: 7025 - DNA, 26 bp, Artificial Sequences
  Synthetic
gaggcgtgcgtttcggggtttttggc

SEQ ID NO: 7026 - DNA, 25 bp, Artificial Sequences
  Synthetic
gaggcgtgcgtttcggggtttttgg

SEQ ID NO: 7027 - DNA, 27 bp, Artificial Sequences
  Synthetic
gaggcgtgcgtttcggggtttttggcg

SEQ ID NO: 7028 - DNA, 31 bp, Artificial Sequences
  Synthetic
cgagaagaagttgttgaagagttagggtcgt

SEQ ID NO: 7029 - DNA, 31 bp, Artificial Sequences
  Synthetic
acgagaagaagttgttgaagagttagggtcg

SEQ ID NO: 7030 - DNA, 32 bp, Artificial Sequences
  Synthetic
acgagaagaagttgttgaagagttagggtcgt

SEQ ID NO: 7031 - DNA, 31 bp, Artificial Sequences
  Synthetic
gagttagggtcgttatttgtattcgttcggc

SEQ ID NO: 7032 - DNA, 32 bp, Artificial Sequences
  Synthetic
agagttagggtcgttatttgtattcgttcggc

SEQ ID NO: 7033 - DNA, 27 bp, Artificial Sequences
  Synthetic
gtaggtgtcgggtgtaggcggttcgtc

SEQ ID NO: 7034 - DNA, 27 bp, Artificial Sequences
  Synthetic
gtcgtaggtgtcgggtgtaggcggttc

SEQ ID NO: 7035 - DNA, 26 bp, Artificial Sequences
  Synthetic
gtaggtgtcgggtgtaggcggttcgt

SEQ ID NO: 7036 - DNA, 26 bp, Artificial Sequences
  Synthetic
gtcgtaggtgtcgggtgtaggcggtt

SEQ ID NO: 7037 - DNA, 26 bp, Artificial Sequences
  Synthetic
taggtgtcgggtgtaggcggttcgtc

SEQ ID NO: 7038 - DNA, 27 bp, Artificial Sequences
  Synthetic
cgtttcgggttagtgcggaggtgagga

SEQ ID NO: 7039 - DNA, 27 bp, Artificial Sequences
  Synthetic
gtgcggaggtgaggaagagttaggggg

SEQ ID NO: 7040 - DNA, 27 bp, Artificial Sequences
  Synthetic
tgcggaggtgaggaagagttagggggt

SEQ ID NO: 7041 - DNA, 27 bp, Artificial Sequences
  Synthetic
ggaggttcgggggcggaagggtttatt

SEQ ID NO: 7042 - DNA, 27 bp, Artificial Sequences
  Synthetic
acgtttcgggttagtgcggaggtgagg

SEQ ID NO: 7043 - DNA, 30 bp, Artificial Sequences
  Synthetic
tgttttagggattttggagatagtcggcgt

SEQ ID NO: 7044 - DNA, 31 bp, Artificial Sequences
  Synthetic
tgttttagggattttggagatagtcggcgtt

SEQ ID NO: 7045 - DNA, 31 bp, Artificial Sequences
  Synthetic
atgttttagggattttggagatagtcggcgt

SEQ ID NO: 7046 - DNA, 32 bp, Artificial Sequences
  Synthetic
tgttttagggattttggagatagtcggcgttt

SEQ ID NO: 7047 - DNA, 32 bp, Artificial Sequences
  Synthetic
atgttttagggattttggagatagtcggcgtt

SEQ ID NO: 7048 - DNA, 27 bp, Artificial Sequences
  Synthetic
gtcgggaggttgacggggttttgtttt

SEQ ID NO: 7049 - DNA, 27 bp, Artificial Sequences
  Synthetic
tcgggaggttgacggggttttgttttt

SEQ ID NO: 7050 - DNA, 28 bp, Artificial Sequences
  Synthetic
gtcgggaggttgacggggttttgttttt

SEQ ID NO: 7051 - DNA, 29 bp, Artificial Sequences
  Synthetic
cgggaggttgacggggttttgttttttcg

SEQ ID NO: 7052 - DNA, 30 bp, Artificial Sequences
  Synthetic
cgggaggttgacggggttttgttttttcgg

SEQ ID NO: 7053 - DNA, 28 bp, Artificial Sequences
  Synthetic
tgtttggttcggcgatgggagttagggt

SEQ ID NO: 7054 - DNA, 27 bp, Artificial Sequences
  Synthetic
gtttggttcggcgatgggagttagggt

SEQ ID NO: 7055 - DNA, 27 bp, Artificial Sequences
  Synthetic
tgtttggttcggcgatgggagttaggg

SEQ ID NO: 7056 - DNA, 27 bp, Artificial Sequences
  Synthetic
tcggcgatgggagttagggtttaggga

SEQ ID NO: 7057 - DNA, 28 bp, Artificial Sequences
  Synthetic
gtgtttggttcggcgatgggagttaggg

SEQ ID NO: 7058 - DNA, 31 bp, Artificial Sequences
  Synthetic
cggggattatatgggatttagttgtttgcgg

SEQ ID NO: 7059 - DNA, 32 bp, Artificial Sequences
  Synthetic
cggggattatatgggatttagttgtttgcggt

SEQ ID NO: 7060 - DNA, 32 bp, Artificial Sequences
  Synthetic
acggggattatatgggatttagttgtttgcgg

SEQ ID NO: 7061 - DNA, 33 bp, Artificial Sequences
  Synthetic
acggggattatatgggatttagttgtttgcggt

SEQ ID NO: 7062 - DNA, 33 bp, Artificial Sequences
  Synthetic
cggggattatatgggatttagttgtttgcggtt

SEQ ID NO: 7063 - DNA, 27 bp, Artificial Sequences
  Synthetic
tcgtgtgatagggggacggggttagtt

SEQ ID NO: 7064 - DNA, 27 bp, Artificial Sequences
  Synthetic
ttcgtgtgatagggggacggggttagt

SEQ ID NO: 7065 - DNA, 28 bp, Artificial Sequences
  Synthetic
ggttttttcgtgtgatagggggacgggg

SEQ ID NO: 7066 - DNA, 27 bp, Artificial Sequences
  Synthetic
tttttcgtgtgatagggggacggggtt

SEQ ID NO: 7067 - DNA, 27 bp, Artificial Sequences
  Synthetic
ttttttcgtgtgatagggggacggggt

SEQ ID NO: 7068 - DNA, 27 bp, Artificial Sequences
  Synthetic
tgtgggggtcggaataaaaggggtttt

SEQ ID NO: 7069 - DNA, 27 bp, Artificial Sequences
  Synthetic
ttgtgggggtcggaataaaaggggttt

SEQ ID NO: 7070 - DNA, 27 bp, Artificial Sequences
  Synthetic
tttgtgggggtcggaataaaaggggtt

SEQ ID NO: 7071 - DNA, 27 bp, Artificial Sequences
  Synthetic
ttttgtgggggtcggaataaaaggggt

SEQ ID NO: 7072 - DNA, 28 bp, Artificial Sequences
  Synthetic
ttgtgggggtcggaataaaaggggtttt

SEQ ID NO: 7073 - DNA, 27 bp, Artificial Sequences
  Synthetic
gtcggtaggtggttttgggatggaggt

SEQ ID NO: 7074 - DNA, 28 bp, Artificial Sequences
  Synthetic
agtcggtaggtggttttgggatggaggt

SEQ ID NO: 7075 - DNA, 27 bp, Artificial Sequences
  Synthetic
agtcggtaggtggttttgggatggagg

SEQ ID NO: 7076 - DNA, 28 bp, Artificial Sequences
  Synthetic
gggatggaggtaatttcggagttgcggt

SEQ ID NO: 7077 - DNA, 28 bp, Artificial Sequences
  Synthetic
tgggatggaggtaatttcggagttgcgg

SEQ ID NO: 7078 - DNA, 27 bp, Artificial Sequences
  Synthetic
gttaggtttgtagggagaggcgacggg

SEQ ID NO: 7079 - DNA, 28 bp, Artificial Sequences
  Synthetic
agttaggtttgtagggagaggcgacggg

SEQ ID NO: 7080 - DNA, 27 bp, Artificial Sequences
  Synthetic
agttaggtttgtagggagaggcgacgg

SEQ ID NO: 7081 - DNA, 29 bp, Artificial Sequences
  Synthetic
gagttaggtttgtagggagaggcgacggg

SEQ ID NO: 7082 - DNA, 28 bp, Artificial Sequences
  Synthetic
gagttaggtttgtagggagaggcgacgg

SEQ ID NO: 7083 - DNA, 30 bp, Artificial Sequences
  Synthetic
ggggtttttgggttttcgggattatagcgt

SEQ ID NO: 7084 - DNA, 30 bp, Artificial Sequences
  Synthetic
tggggtttttgggttttcgggattatagcg

SEQ ID NO: 7085 - DNA, 29 bp, Artificial Sequences
  Synthetic
ggggtttttgggttttcgggattatagcg

SEQ ID NO: 7086 - DNA, 31 bp, Artificial Sequences
  Synthetic
tggggtttttgggttttcgggattatagcgt

SEQ ID NO: 7087 - DNA, 29 bp, Artificial Sequences
  Synthetic
gggtttttgggttttcgggattatagcgt

SEQ ID NO: 7088 - DNA, 27 bp, Artificial Sequences
  Synthetic
cgtaggaggcgtagggtaggttgtcgt

SEQ ID NO: 7089 - DNA, 28 bp, Artificial Sequences
  Synthetic
tggtcgtaggaggcgtagggtaggttgt

SEQ ID NO: 7090 - DNA, 27 bp, Artificial Sequences
  Synthetic
ggtcgtaggaggcgtagggtaggttgt

SEQ ID NO: 7091 - DNA, 27 bp, Artificial Sequences
  Synthetic
tggtcgtaggaggcgtagggtaggttg

SEQ ID NO: 7092 - DNA, 28 bp, Artificial Sequences
  Synthetic
tcgtaggaggcgtagggtaggttgtcgt

SEQ ID NO: 7093 - DNA, 25 bp, Artificial Sequences
  Synthetic
cggaggcggttatgtgggcggttac

SEQ ID NO: 7094 - DNA, 26 bp, Artificial Sequences
  Synthetic
gcggaggcggttatgtgggcggttac

SEQ ID NO: 7095 - DNA, 27 bp, Artificial Sequences
  Synthetic
tggggtttggtgtaaatttgggggtgt

SEQ ID NO: 7096 - DNA, 27 bp, Artificial Sequences
  Synthetic
tgtgaggattgttgagattggcggagg

SEQ ID NO: 7097 - DNA, 25 bp, Artificial Sequences
  Synthetic
gcggaggcggttatgtgggcggtta

SEQ ID NO: 7098 - DNA, 28 bp, Artificial Sequences
  Synthetic
gcggaaaaagatttggaggtttcgcggg

SEQ ID NO: 7099 - DNA, 29 bp, Artificial Sequences
  Synthetic
gcggaaaaagatttggaggtttcgcggga

SEQ ID NO: 7100 - DNA, 27 bp, Artificial Sequences
  Synthetic
gcggaaaaagatttggaggtttcgcgg

SEQ ID NO: 7101 - DNA, 27 bp, Artificial Sequences
  Synthetic
cggaaaaagatttggaggtttcgcggg

SEQ ID NO: 7102 - DNA, 28 bp, Artificial Sequences
  Synthetic
cggaaaaagatttggaggtttcgcggga

SEQ ID NO: 7103 - DNA, 27 bp, Artificial Sequences
  Synthetic
tgggtaggcggataggagagggatggg

SEQ ID NO: 7104 - DNA, 27 bp, Artificial Sequences
  Synthetic
ggcggataggagagggatggggaggat

SEQ ID NO: 7105 - DNA, 27 bp, Artificial Sequences
  Synthetic
ggtaggcggataggagagggatgggga

SEQ ID NO: 7106 - DNA, 27 bp, Artificial Sequences
  Synthetic
taggcggataggagagggatggggagg

SEQ ID NO: 7107 - DNA, 27 bp, Artificial Sequences
  Synthetic
gggtttgggtaggcggataggagaggg

SEQ ID NO: 7108 - DNA, 27 bp, Artificial Sequences
  Synthetic
tcgtattggggtttgcggacgttaggc

SEQ ID NO: 7109 - DNA, 28 bp, Artificial Sequences
  Synthetic
ttcgtattggggtttgcggacgttaggc

SEQ ID NO: 7110 - DNA, 28 bp, Artificial Sequences
  Synthetic
gcggaaaaagatttggaggtttcgcggg

SEQ ID NO: 7111 - DNA, 29 bp, Artificial Sequences
  Synthetic
gcggaaaaagatttggaggtttcgcggga

SEQ ID NO: 7112 - DNA, 27 bp, Artificial Sequences
  Synthetic
gcggaaaaagatttggaggtttcgcgg

SEQ ID NO: 7113 - DNA, 27 bp, Artificial Sequences
  Synthetic
cggggtaggttgttgcgggggatagag

SEQ ID NO: 7114 - DNA, 27 bp, Artificial Sequences
  Synthetic
tgggtaggcggataggagagggatggg

SEQ ID NO: 7115 - DNA, 27 bp, Artificial Sequences
  Synthetic
ggcggataggagagggatggggaggat

SEQ ID NO: 7116 - DNA, 27 bp, Artificial Sequences
  Synthetic
ggtaggcggataggagagggatgggga

SEQ ID NO: 7117 - DNA, 27 bp, Artificial Sequences
  Synthetic
taggcggataggagagggatggggagg

SEQ ID NO: 7118 - DNA, 27 bp, Artificial Sequences
  Synthetic
tgtttcgcggtggttttgtgggtagga

SEQ ID NO: 7119 - DNA, 27 bp, Artificial Sequences
  Synthetic
agtttgtttcgcggtggttttgtgggt

SEQ ID NO: 7120 - DNA, 27 bp, Artificial Sequences
  Synthetic
ttgtttcgcggtggttttgtgggtagg

SEQ ID NO: 7121 - DNA, 28 bp, Artificial Sequences
  Synthetic
ttgtttcgcggtggttttgtgggtagga

SEQ ID NO: 7122 - DNA, 28 bp, Artificial Sequences
  Synthetic
tgtttcgcggtggttttgtgggtaggat

SEQ ID NO: 7123 - DNA, 30 bp, Artificial Sequences
  Synthetic
tcgattaaggaaaggaagttgggagacgtt

SEQ ID NO: 7124 - DNA, 30 bp, Artificial Sequences
  Synthetic
ttcgattaaggaaaggaagttgggagacgt

SEQ ID NO: 7125 - DNA, 31 bp, Artificial Sequences
  Synthetic
cgattaaggaaaggaagttgggagacgttga

SEQ ID NO: 7126 - DNA, 31 bp, Artificial Sequences
  Synthetic
tcgattaaggaaaggaagttgggagacgttg

SEQ ID NO: 7127 - DNA, 32 bp, Artificial Sequences
  Synthetic
tcgattaaggaaaggaagttgggagacgttga

SEQ ID NO: 7128 - DNA, 27 bp, Artificial Sequences
  Synthetic
gggtgtacgtaggggtggtggtgatgg

SEQ ID NO: 7129 - DNA, 27 bp, Artificial Sequences
  Synthetic
ggggtgtacgtaggggtggtggtgatg

SEQ ID NO: 7130 - DNA, 27 bp, Artificial Sequences
  Synthetic
tcgggcgtgggttttagttaggagcgt

SEQ ID NO: 7131 - DNA, 27 bp, Artificial Sequences
  Synthetic
gtttgggggtgtacgtaggggtggtgg

SEQ ID NO: 7132 - DNA, 27 bp, Artificial Sequences
  Synthetic
aggtcggttggagggtaagttcgcgaa

SEQ ID NO: 7133 - DNA, 27 bp, Artificial Sequences
  Synthetic
gcgacggtgtttggcgtttcgtggaat

SEQ ID NO: 7134 - DNA, 27 bp, Artificial Sequences
  Synthetic
cgacggtgtttggcgtttcgtggaatt

SEQ ID NO: 7135 - DNA, 28 bp, Artificial Sequences
  Synthetic
gcgacggtgtttggcgtttcgtggaatt

SEQ ID NO: 7136 - DNA, 26 bp, Artificial Sequences
  Synthetic
gcgacggtgtttggcgtttcgtggaa

SEQ ID NO: 7137 - DNA, 26 bp, Artificial Sequences
  Synthetic
aaggcgacggtgtttggcgtttcgtg

SEQ ID NO: 7138 - DNA, 27 bp, Artificial Sequences
  Synthetic
gggtgtacgtaggggtggtggtgatgg

SEQ ID NO: 7139 - DNA, 27 bp, Artificial Sequences
  Synthetic
ggggtgtacgtaggggtggtggtgatg

SEQ ID NO: 7140 - DNA, 27 bp, Artificial Sequences
  Synthetic
tcgggcgtgggttttagttaggagcgt

SEQ ID NO: 7141 - DNA, 27 bp, Artificial Sequences
  Synthetic
gtttgggggtgtacgtaggggtggtgg

SEQ ID NO: 7142 - DNA, 27 bp, Artificial Sequences
  Synthetic
gtacgtaggggtggtggtgatggtggt

SEQ ID NO: 7143 - DNA, 27 bp, Artificial Sequences
  Synthetic
gcgacggtgtttggcgtttcgtggaat

SEQ ID NO: 7144 - DNA, 27 bp, Artificial Sequences
  Synthetic
cgacggtgtttggcgtttcgtggaatt

SEQ ID NO: 7145 - DNA, 27 bp, Artificial Sequences
  Synthetic
tgggttagttttttcggtaggcggcga

SEQ ID NO: 7146 - DNA, 28 bp, Artificial Sequences
  Synthetic
gcgacggtgtttggcgtttcgtggaatt

SEQ ID NO: 7147 - DNA, 26 bp, Artificial Sequences
  Synthetic
gcgacggtgtttggcgtttcgtggaa

SEQ ID NO: 7148 - DNA, 27 bp, Artificial Sequences
  Synthetic
gggtgtacgtaggggtggtggtgatgg

SEQ ID NO: 7149 - DNA, 27 bp, Artificial Sequences
  Synthetic
ggggtgtacgtaggggtggtggtgatg

SEQ ID NO: 7150 - DNA, 27 bp, Artificial Sequences
  Synthetic
acgggttgaagtcggggtgttcggtta

SEQ ID NO: 7151 - DNA, 27 bp, Artificial Sequences
  Synthetic
tacgggttgaagtcggggtgttcggtt

SEQ ID NO: 7152 - DNA, 27 bp, Artificial Sequences
  Synthetic
tgtacgggttgaagtcggggtgttcgg

SEQ ID NO: 7153 - DNA, 27 bp, Artificial Sequences
  Synthetic
tgggttagttttttcggtaggcggcga

SEQ ID NO: 7154 - DNA, 27 bp, Artificial Sequences
  Synthetic
cgtggattcgtttttgttgggcgtcga

SEQ ID NO: 7155 - DNA, 28 bp, Artificial Sequences
  Synthetic
tgggttagttttttcggtaggcggcgac

SEQ ID NO: 7156 - DNA, 27 bp, Artificial Sequences
  Synthetic
gggttagttttttcggtaggcggcgac

SEQ ID NO: 7157 - DNA, 28 bp, Artificial Sequences
  Synthetic
cgtggattcgtttttgttgggcgtcgac

SEQ ID NO: 7158 - DNA, 27 bp, Artificial Sequences
  Synthetic
atcgtgtttagcgtttggttcgttcgg

SEQ ID NO: 7159 - DNA, 26 bp, Artificial Sequences
  Synthetic
tcgtgtttagcgtttggttcgttcgg

SEQ ID NO: 7160 - DNA, 28 bp, Artificial Sequences
  Synthetic
tatcgtgtttagcgtttggttcgttcgg

SEQ ID NO: 7161 - DNA, 29 bp, Artificial Sequences
  Synthetic
ttatcgtgtttagcgtttggttcgttcgg

SEQ ID NO: 7162 - DNA, 30 bp, Artificial Sequences
  Synthetic
attatcgtgtttagcgtttggttcgttcgg

SEQ ID NO: 7163 - DNA, 23 bp, Artificial Sequences
  Synthetic
cgtacggttaatgggggcgcggg

SEQ ID NO: 7164 - DNA, 22 bp, Artificial Sequences
  Synthetic
cgtacggttaatgggggcgcgg

SEQ ID NO: 7165 - DNA, 22 bp, Artificial Sequences
  Synthetic
gtacggttaatgggggcgcggg

SEQ ID NO: 7166 - DNA, 31 bp, Artificial Sequences
  Synthetic
gtgatttacgcgttattgttttgttggacgg

SEQ ID NO: 7167 - DNA, 32 bp, Artificial Sequences
  Synthetic
agtgatttacgcgttattgttttgttggacgg

SEQ ID NO: 7168 - DNA, 30 bp, Artificial Sequences
  Synthetic
ggggggagacgggagagtatagagataagg

SEQ ID NO: 7169 - DNA, 31 bp, Artificial Sequences
  Synthetic
ggggggagacgggagagtatagagataaggt

SEQ ID NO: 7170 - DNA, 30 bp, Artificial Sequences
  Synthetic
gggggagacgggagagtatagagataaggt

SEQ ID NO: 7171 - DNA, 29 bp, Artificial Sequences
  Synthetic
gggggagacgggagagtatagagataagg

SEQ ID NO: 7172 - DNA, 29 bp, Artificial Sequences
  Synthetic
ggggggagacgggagagtatagagataag

SEQ ID NO: 7173 - DNA, 29 bp, Artificial Sequences
  Synthetic
ggttagattgttgtgtttggttggcgagt

SEQ ID NO: 7174 - DNA, 30 bp, Artificial Sequences
  Synthetic
aggttagattgttgtgtttggttggcgagt

SEQ ID NO: 7175 - DNA, 29 bp, Artificial Sequences
  Synthetic
aggttagattgttgtgtttggttggcgag

SEQ ID NO: 7176 - DNA, 30 bp, Artificial Sequences
  Synthetic
ggttagattgttgtgtttggttggcgagtt

SEQ ID NO: 7177 - DNA, 30 bp, Artificial Sequences
  Synthetic
aaggttagattgttgtgtttggttggcgag

SEQ ID NO: 7178 - DNA, 27 bp, Artificial Sequences
  Synthetic
tttggagtgttttggtagggtcggcgg

SEQ ID NO: 7179 - DNA, 27 bp, Artificial Sequences
  Synthetic
ttggagtgttttggtagggtcggcggc

SEQ ID NO: 7180 - DNA, 27 bp, Artificial Sequences
  Synthetic
tgttttggtagggtcggcggcggtttc

SEQ ID NO: 7181 - DNA, 28 bp, Artificial Sequences
  Synthetic
gtttggagtgttttggtagggtcggcgg

SEQ ID NO: 7182 - DNA, 26 bp, Artificial Sequences
  Synthetic
gttttggtagggtcggcggcggtttc

SEQ ID NO: 7183 - DNA, 29 bp, Artificial Sequences
  Synthetic
ggttagattgttgtgtttggttggcgagt

SEQ ID NO: 7184 - DNA, 30 bp, Artificial Sequences; identical to SEQ ID NO: 7174
  Synthetic

SEQ ID NO: 7185 - DNA, 29 bp, Artificial Sequences
  Synthetic
aggttagattgttgtgtttggttggcgag

SEQ ID NO: 7186 - DNA, 30 bp, Artificial Sequences; identical to SEQ ID NO: 7176
  Synthetic

SEQ ID NO: 7187 - DNA, 30 bp, Artificial Sequences; identical to SEQ ID NO: 7177
  Synthetic

SEQ ID NO: 7188 - DNA, 27 bp, Artificial Sequences
  Synthetic
tttggagtgttttggtagggtcggcgg

SEQ ID NO: 7189 - DNA, 27 bp, Artificial Sequences
  Synthetic
ttggagtgttttggtagggtcggcggc

SEQ ID NO: 7190 - DNA, 27 bp, Artificial Sequences
  Synthetic
tgttttggtagggtcggcggcggtttc

SEQ ID NO: 7191 - DNA, 28 bp, Artificial Sequences
  Synthetic
gtttggagtgttttggtagggtcggcgg

SEQ ID NO: 7192 - DNA, 26 bp, Artificial Sequences
  Synthetic
gttttggtagggtcggcggcggtttc

SEQ ID NO: 7193 - DNA, 26 bp, Artificial Sequences
  Synthetic
aggtagggatcggtcgtttagggagt

SEQ ID NO: 7194 - DNA, 28 bp, Artificial Sequences
  Synthetic
ttaggtagggatcggtcgtttagggagt

SEQ ID NO: 7195 - DNA, 28 bp, Artificial Sequences
  Synthetic
aggtagggatcggtcgtttagggagtat

SEQ ID NO: 7196 - DNA, 29 bp, Artificial Sequences
  Synthetic
aggtagggatcggtcgtttagggagtatc

SEQ ID NO: 7197 - DNA, 29 bp, Artificial Sequences
  Synthetic
tttaggtagggatcggtcgtttagggagt

SEQ ID NO: 7198 - DNA, 27 bp, Artificial Sequences
  Synthetic
tcgttttggtggcggttggtcgttttt

SEQ ID NO: 7199 - DNA, 27 bp, Artificial Sequences
  Synthetic
ttcgttttggtggcggttggtcgtttt

SEQ ID NO: 7200 - DNA, 27 bp, Artificial Sequences
  Synthetic
tttcgttttggtggcggttggtcgttt

SEQ ID NO: 7201 - DNA, 27 bp, Artificial Sequences
  Synthetic
ttttcgttttggtggcggttggtcgtt

SEQ ID NO: 7202 - DNA, 27 bp, Artificial Sequences
  Synthetic
attttcgttttggtggcggttggtcgt

SEQ ID NO: 7203 - DNA, 27 bp, Artificial Sequences
  Synthetic
ggaggagttggttaggagggagcggtt

SEQ ID NO: 7204 - DNA, 27 bp, Artificial Sequences
  Synthetic
cggaggagttggttaggagggagcggt

SEQ ID NO: 7205 - DNA, 27 bp, Artificial Sequences
  Synthetic
acggaggagttggttaggagggagcgg

SEQ ID NO: 7206 - DNA, 26 bp, Artificial Sequences
  Synthetic
cggaggagttggttaggagggagcgg

SEQ ID NO: 7207 - DNA, 27 bp, Artificial Sequences
  Synthetic
tacggaggagttggttaggagggagcg

SEQ ID NO: 7208 - DNA, 27 bp, Artificial Sequences
  Synthetic
ttagttgatgagaaaggcgggttgggc

SEQ ID NO: 7209 - DNA, 28 bp, Artificial Sequences
  Synthetic
gttagttgatgagaaaggcgggttgggc

SEQ ID NO: 7210 - DNA, 29 bp, Artificial Sequences
  Synthetic
tgttagttgatgagaaaggcgggttgggc

SEQ ID NO: 7211 - DNA, 26 bp, Artificial Sequences
  Synthetic
tagttgatgagaaaggcgggttgggc

SEQ ID NO: 7212 - DNA, 30 bp, Artificial Sequences
  Synthetic
ttgttagttgatgagaaaggcgggttgggc

SEQ ID NO: 7213 - DNA, 27 bp, Artificial Sequences
  Synthetic
tttgagggtttggttggttgtgcggcg

SEQ ID NO: 7214 - DNA, 27 bp, Artificial Sequences
  Synthetic
ggaggagttggttaggagggagcggtt

SEQ ID NO: 7215 - DNA, 27 bp, Artificial Sequences
  Synthetic
cggaggagttggttaggagggagcggt

SEQ ID NO: 7216 - DNA, 27 bp, Artificial Sequences
  Synthetic
acggaggagttggttaggagggagcgg

SEQ ID NO: 7217 - DNA, 27 bp, Artificial Sequences
  Synthetic
ttttgagggtttggttggttgtgcggc

SEQ ID NO: 7218 - DNA, 27 bp, Artificial Sequences
  Synthetic
ttagttgatgagaaaggcgggttgggc

SEQ ID NO: 7219 - DNA, 28 bp, Artificial Sequences
  Synthetic
gttagttgatgagaaaggcgggttgggc

SEQ ID NO: 7220 - DNA, 29 bp, Artificial Sequences
  Synthetic
tgttagttgatgagaaaggcgggttgggc

SEQ ID NO: 7221 - DNA, 27 bp, Artificial Sequences
  Synthetic
tgaggttggagtatagggttgggtcgt

SEQ ID NO: 7222 - DNA, 26 bp, Artificial Sequences
  Synthetic
tagttgatgagaaaggcgggttgggc

SEQ ID NO: 7223 - DNA, 27 bp, Artificial Sequences
  Synthetic
tttgagggtttggttggttgtgcggcg

SEQ ID NO: 7224 - DNA, 27 bp, Artificial Sequences
  Synthetic
ggaggagttggttaggagggagcggtt

SEQ ID NO: 7225 - DNA, 27 bp, Artificial Sequences
  Synthetic
cggaggagttggttaggagggagcggt

SEQ ID NO: 7226 - DNA, 27 bp, Artificial Sequences
  Synthetic
acggaggagttggttaggagggagcgg

SEQ ID NO: 7227 - DNA, 27 bp, Artificial Sequences
  Synthetic
ttttgagggtttggttggttgtgcggc

SEQ ID NO: 7228 - DNA, 27 bp, Artificial Sequences
  Synthetic
ttagttgatgagaaaggcgggttgggc

SEQ ID NO: 7229 - DNA, 28 bp, Artificial Sequences
  Synthetic
gttagttgatgagaaaggcgggttgggc

SEQ ID NO: 7230 - DNA, 29 bp, Artificial Sequences
  Synthetic
tgttagttgatgagaaaggcgggttgggc

SEQ ID NO: 7231 - DNA, 27 bp, Artificial Sequences
  Synthetic
tgaggttggagtatagggttgggtcgt

SEQ ID NO: 7232 - DNA, 26 bp, Artificial Sequences
  Synthetic
tagttgatgagaaaggcgggttgggc

SEQ ID NO: 7233 - DNA, 27 bp, Artificial Sequences
  Synthetic
agcgttgtaagtttggttgcgtttcgt

SEQ ID NO: 7234 - DNA, 27 bp, Artificial Sequences
  Synthetic
tcgtatcgatgtggtttgtttcggggt

SEQ ID NO: 7235 - DNA, 27 bp, Artificial Sequences
  Synthetic
gcgttgtaagtttggttgcgtttcgtg

SEQ ID NO: 7236 - DNA, 28 bp, Artificial Sequences
  Synthetic
agcgttgtaagtttggttgcgtttcgtg

SEQ ID NO: 7237 - DNA, 28 bp, Artificial Sequences
  Synthetic
gcgttgtaagtttggttgcgtttcgtga

SEQ ID NO: 7238 - DNA, 29 bp, Artificial Sequences
  Synthetic
cgggttttttaggtttcggagttgcgggg

SEQ ID NO: 7239 - DNA, 28 bp, Artificial Sequences
  Synthetic
gcgggttttttaggtttcggagttgcgg

SEQ ID NO: 7240 - DNA, 27 bp, Artificial Sequences
  Synthetic
cggtgcgggttttttaggtttcggagt

SEQ ID NO: 7241 - DNA, 29 bp, Artificial Sequences
  Synthetic
tgcgggttttttaggtttcggagttgcgg

SEQ ID NO: 7242 - DNA, 28 bp, Artificial Sequences
  Synthetic
tcggtgcgggttttttaggtttcggagt

SEQ ID NO: 7243 - DNA, 27 bp, Artificial Sequences
  Synthetic
tatgttggttggggggtttttcggcgc

SEQ ID NO: 7244 - DNA, 28 bp, Artificial Sequences
  Synthetic
ttatgttggttggggggtttttcggcgc

SEQ ID NO: 7245 - DNA, 26 bp, Artificial Sequences
  Synthetic
atgttggttggggggtttttcggcgc

SEQ ID NO: 7246 - DNA, 27 bp, Artificial Sequences
  Synthetic
ttatgttggttggggggtttttcggcg

SEQ ID NO: 7247 - DNA, 29 bp, Artificial Sequences
  Synthetic
tttatgttggttggggggtttttcggcgc

SEQ ID NO: 7248 - DNA, 26 bp, Artificial Sequences
  Synthetic
attcggggagttgcgggtgggaggtg

SEQ ID NO: 7249 - DNA, 24 bp, Artificial Sequences
  Synthetic
attcggggagttgcgggtgggagg

SEQ ID NO: 7250 - DNA, 27 bp, Artificial Sequences
  Synthetic
attcggggagttgcgggtgggaggtgg

SEQ ID NO: 7251 - DNA, 27 bp, Artificial Sequences
  Synthetic
gttgcgggtgggaggtggggacgagag

SEQ ID NO: 7252 - DNA, 27 bp, Artificial Sequences
  Synthetic
gagttgcgggtgggaggtggggacgag

SEQ ID NO: 7253 - DNA, 27 bp, Artificial Sequences
  Synthetic
cgtcgttgtgtggtttgtggtttcgga

SEQ ID NO: 7254 - DNA, 27 bp, Artificial Sequences
  Synthetic
tcgtcgttgtgtggtttgtggtttcgg

SEQ ID NO: 7255 - DNA, 28 bp, Artificial Sequences
  Synthetic
tcgtcgttgtgtggtttgtggtttcgga

SEQ ID NO: 7256 - DNA, 28 bp, Artificial Sequences
  Synthetic
cgtcgttgtgtggtttgtggtttcggag

SEQ ID NO: 7257 - DNA, 29 bp, Artificial Sequences
  Synthetic
cgtcgttgtgtggtttgtggtttcggagt

SEQ ID NO: 7258 - DNA, 27 bp, Artificial Sequences
  Synthetic
ggttgttggcggtttagggacggaagg

SEQ ID NO: 7259 - DNA, 27 bp, Artificial Sequences
  Synthetic
gttgttggcggtttagggacggaaggt

SEQ ID NO: 7260 - DNA, 27 bp, Artificial Sequences
  Synthetic
tggttgttggcggtttagggacggaag

SEQ ID NO: 7261 - DNA, 27 bp, Artificial Sequences
  Synthetic
tcgcggggagaagtcgttttggttgtt

SEQ ID NO: 7262 - DNA, 28 bp, Artificial Sequences
  Synthetic
ggggagaagtcgttttggttgttggcgg

SEQ ID NO: 7263 - DNA, 27 bp, Artificial Sequences
  Synthetic
tgcgttagttttgaggagttcgggcgt

SEQ ID NO: 7264 - DNA, 28 bp, Artificial Sequences
  Synthetic
ttgcgttagttttgaggagttcgggcgt

SEQ ID NO: 7265 - DNA, 27 bp, Artificial Sequences
  Synthetic
ttgcgttagttttgaggagttcgggcg

SEQ ID NO: 7266 - DNA, 28 bp, Artificial Sequences
  Synthetic
tttgcgttagttttgaggagttcgggcg

SEQ ID NO: 7267 - DNA, 29 bp, Artificial Sequences
  Synthetic
tttgcgttagttttgaggagttcgggcgt

SEQ ID NO: 7268 - DNA, 27 bp, Artificial Sequences
  Synthetic
cgcgttcggattttttagagttggcgt

SEQ ID NO: 7269 - DNA, 28 bp, Artificial Sequences
  Synthetic
cgcgttcggattttttagagttggcgta

SEQ ID NO: 7270 - DNA, 29 bp, Artificial Sequences
  Synthetic
cgcgttcggattttttagagttggcgtaa

SEQ ID NO: 7271 - DNA, 30 bp, Artificial Sequences
  Synthetic
cgcgttcggattttttagagttggcgtaaa

SEQ ID NO: 7272 - DNA, 31 bp, Artificial Sequences
  Synthetic
cgcgttcggattttttagagttggcgtaaat

SEQ ID NO: 7273 - DNA, 28 bp, Artificial Sequences
  Synthetic
tgaagagcgattagtggtattgtcgggg

SEQ ID NO: 7274 - DNA, 29 bp, Artificial Sequences
  Synthetic
tgaagagcgattagtggtattgtcgggga

SEQ ID NO: 7275 - DNA, 28 bp, Artificial Sequences
  Synthetic
gaagagcgattagtggtattgtcgggga

SEQ ID NO: 7276 - DNA, 29 bp, Artificial Sequences
  Synthetic
gtgaagagcgattagtggtattgtcgggg

SEQ ID NO: 7277 - DNA, 30 bp, Artificial Sequences
  Synthetic
agtgaagagcgattagtggtattgtcgggg

SEQ ID NO: 7278 - DNA, 27 bp, Artificial Sequences
  Synthetic
agggagtttggtgaagggttcggttgg

SEQ ID NO: 7279 - DNA, 27 bp, Artificial Sequences
  Synthetic
gggagtttggtgaagggttcggttgga

SEQ ID NO: 7280 - DNA, 28 bp, Artificial Sequences
  Synthetic
agggagtttggtgaagggttcggttgga

SEQ ID NO: 7281 - DNA, 28 bp, Artificial Sequences
  Synthetic
gagggagtttggtgaagggttcggttgg

SEQ ID NO: 7282 - DNA, 29 bp, Artificial Sequences
  Synthetic
agagggagtttggtgaagggttcggttgg

SEQ ID NO: 7283 - DNA, 27 bp, Artificial Sequences
  Synthetic
aagtcggtgtttttcgcgggttggtcg

SEQ ID NO: 7284 - DNA, 26 bp, Artificial Sequences
  Synthetic
agtcggtgtttttcgcgggttggtcg

SEQ ID NO: 7285 - DNA, 28 bp, Artificial Sequences
  Synthetic
taagtcggtgtttttcgcgggttggtcg

SEQ ID NO: 7286 - DNA, 27 bp, Artificial Sequences
  Synthetic
gtaagtcggtgtttttcgcgggttggt

SEQ ID NO: 7287 - DNA, 28 bp, Artificial Sequences
  Synthetic
agtaagtcggtgtttttcgcgggttggt

SEQ ID NO: 7288 - DNA, 27 bp, Artificial Sequences
  Synthetic
agttcgcgggggatatcggtttgttgg

SEQ ID NO: 7289 - DNA, 27 bp, Artificial Sequences
  Synthetic
gttcgcgggggatatcggtttgttgga

SEQ ID NO: 7290 - DNA, 28 bp, Artificial Sequences
  Synthetic
agttcgcgggggatatcggtttgttgga

SEQ ID NO: 7291 - DNA, 27 bp, Artificial Sequences
  Synthetic
agggagtttggtgaagggttcggttgg

SEQ ID NO: 7292 - DNA, 27 bp, Artificial Sequences
  Synthetic
gggagtttggtgaagggttcggttgga

SEQ ID NO: 7293 - DNA, 27 bp, Artificial Sequences
  Synthetic
ttttttgggttagtggtagcgtcgggt

SEQ ID NO: 7294 - DNA, 27 bp, Artificial Sequences
  Synthetic
tgggttagtggtagcgtcgggtataga

SEQ ID NO: 7295 - DNA, 27 bp, Artificial Sequences
  Synthetic
tttttgggttagtggtagcgtcgggta

SEQ ID NO: 7296 - DNA, 27 bp, Artificial Sequences
  Synthetic
ttttgggttagtggtagcgtcgggtat

SEQ ID NO: 7297 - DNA, 28 bp, Artificial Sequences
  Synthetic
tgggttagtggtagcgtcgggtatagag

SEQ ID NO: 7298 - DNA, 27 bp, Artificial Sequences
  Synthetic
ttgcgggttatttagtcggggcgttgg

SEQ ID NO: 7299 - DNA, 27 bp, Artificial Sequences
  Synthetic
tgcgggttatttagtcggggcgttggg

SEQ ID NO: 7300 - DNA, 27 bp, Artificial Sequences
  Synthetic
agttcgcgggggatatcggtttgttgg

SEQ ID NO: 7301 - DNA, 27 bp, Artificial Sequences
  Synthetic
gttcgcgggggatatcggtttgttgga

SEQ ID NO: 7302 - DNA, 28 bp, Artificial Sequences
  Synthetic
agttcgcgggggatatcggtttgttgga

SEQ ID NO: 7303 - DNA, 27 bp, Artificial Sequences
  Synthetic
ttaagttagggtggggtgggcgttcgc

SEQ ID NO: 7304 - DNA, 27 bp, Artificial Sequences
  Synthetic
attaagttagggtggggtgggcgttcg

SEQ ID NO: 7305 - DNA, 26 bp, Artificial Sequences
  Synthetic
taagttagggtggggtgggcgttcgc

SEQ ID NO: 7306 - DNA, 28 bp, Artificial Sequences
  Synthetic
attaagttagggtggggtgggcgttcgc

SEQ ID NO: 7307 - DNA, 29 bp, Artificial Sequences
  Synthetic
tattaagttagggtggggtgggcgttcgc

SEQ ID NO: 7308 - DNA, 27 bp, Artificial Sequences
  Synthetic
ttgcgggttatttagtcggggcgttgg

SEQ ID NO: 7309 - DNA, 27 bp, Artificial Sequences
  Synthetic
tgcgggttatttagtcggggcgttggg

SEQ ID NO: 7310 - DNA, 27 bp, Artificial Sequences
  Synthetic
agttcgcgggggatatcggtttgttgg

SEQ ID NO: 7311 - DNA, 27 bp, Artificial Sequences
  Synthetic
gttcgcgggggatatcggtttgttgga

SEQ ID NO: 7312 - DNA, 28 bp, Artificial Sequences
  Synthetic
agttcgcgggggatatcggtttgttgga

SEQ ID NO: 7313 - DNA, 27 bp, Artificial Sequences
  Synthetic
ttaagttagggtggggtgggcgttcgc

SEQ ID NO: 7314 - DNA, 27 bp, Artificial Sequences
  Synthetic
attaagttagggtggggtgggcgttcg

SEQ ID NO: 7315 - DNA, 26 bp, Artificial Sequences
  Synthetic
taagttagggtggggtgggcgttcgc

SEQ ID NO: 7316 - DNA, 28 bp, Artificial Sequences
  Synthetic
attaagttagggtggggtgggcgttcgc

SEQ ID NO: 7317 - DNA, 29 bp, Artificial Sequences
  Synthetic
tattaagttagggtggggtgggcgttcgc

SEQ ID NO: 7318 - DNA, 27 bp, Artificial Sequences
  Synthetic
tagttttacggaggaggtcgggtcgcg

SEQ ID NO: 7319 - DNA, 27 bp, Artificial Sequences
  Synthetic
gttggcggggattttgtaggtcgggtc

SEQ ID NO: 7320 - DNA, 27 bp, Artificial Sequences
  Synthetic
ttggcggggattttgtaggtcgggtcg

SEQ ID NO: 7321 - DNA, 27 bp, Artificial Sequences
  Synthetic
ggttggcggggattttgtaggtcgggt

SEQ ID NO: 7322 - DNA, 27 bp, Artificial Sequences
  Synthetic
gggttggcggggattttgtaggtcggg

SEQ ID NO: 7323 - DNA, 27 bp, Artificial Sequences
  Synthetic
ttcgtggggttgtggtttttcgcggtc

SEQ ID NO: 7324 - DNA, 27 bp, Artificial Sequences
  Synthetic
tttcgtggggttgtggtttttcgcggt

SEQ ID NO: 7325 - DNA, 27 bp, Artificial Sequences
  Synthetic
ttttcgggtaagtcgggtaggcgggag

SEQ ID NO: 7326 - DNA, 27 bp, Artificial Sequences
  Synthetic
ggtaagtcgggtaggcgggaggttgtt

SEQ ID NO: 7327 - DNA, 27 bp, Artificial Sequences
  Synthetic
attttcgggtaagtcgggtaggcggga

SEQ ID NO: 7328 - DNA, 27 bp, Artificial Sequences
  Synthetic
tagttttacggaggaggtcgggtcgcg

SEQ ID NO: 7329 - DNA, 27 bp, Artificial Sequences
  Synthetic
gttggcggggattttgtaggtcgggtc

SEQ ID NO: 7330 - DNA, 27 bp, Artificial Sequences
  Synthetic
ttggcggggattttgtaggtcgggtcg

SEQ ID NO: 7331 - DNA, 27 bp, Artificial Sequences
  Synthetic
ggttggcggggattttgtaggtcgggt

SEQ ID NO: 7332 - DNA, 27 bp, Artificial Sequences
  Synthetic
gggttggcggggattttgtaggtcggg

SEQ ID NO: 7333 - DNA, 27 bp, Artificial Sequences
  Synthetic
agtcgggtaggcgggaggttgttttgt

SEQ ID NO: 7334 - DNA, 27 bp, Artificial Sequences
  Synthetic
ttttcgggtaagtcgggtaggcgggag

SEQ ID NO: 7335 - DNA, 27 bp, Artificial Sequences
  Synthetic
ggtaagtcgggtaggcgggaggttgtt

SEQ ID NO: 7336 - DNA, 27 bp, Artificial Sequences
  Synthetic
attttcgggtaagtcgggtaggcggga

SEQ ID NO: 7337 - DNA, 28 bp, Artificial Sequences
  Synthetic
aagtcgggtaggcgggaggttgttttgt

SEQ ID NO: 7338 - DNA, 27 bp, Artificial Sequences
  Synthetic
tcggtttgttcggggatgtgggtggat

SEQ ID NO: 7339 - DNA, 27 bp, Artificial Sequences
  Synthetic
ttcggtttgttcggggatgtgggtgga

SEQ ID NO: 7340 - DNA, 27 bp, Artificial Sequences
  Synthetic
gttcggtttgttcggggatgtgggtgg

SEQ ID NO: 7341 - DNA, 27 bp, Artificial Sequences
  Synthetic
tgttcggtttgttcggggatgtgggtg

SEQ ID NO: 7342 - DNA, 27 bp, Artificial Sequences
  Synthetic
cggtttgttcggggatgtgggtggatt

SEQ ID NO: 7343 - DNA, 27 bp, Artificial Sequences
  Synthetic
gcgagggttacgttgttggttaggggc

SEQ ID NO: 7344 - DNA, 27 bp, Artificial Sequences
  Synthetic
cgagggttacgttgttggttaggggcg

SEQ ID NO: 7345 - DNA, 27 bp, Artificial Sequences
  Synthetic
tgcgagggttacgttgttggttagggg

SEQ ID NO: 7346 - DNA, 28 bp, Artificial Sequences
  Synthetic
tgcgagggttacgttgttggttaggggc

SEQ ID NO: 7347 - DNA, 28 bp, Artificial Sequences
  Synthetic
ttgcgagggttacgttgttggttagggg

SEQ ID NO: 7348 - DNA, 27 bp, Artificial Sequences
  Synthetic
tcggtttgttcggggatgtgggtggat

SEQ ID NO: 7349 - DNA, 27 bp, Artificial Sequences
  Synthetic
ttcggtttgttcggggatgtgggtgga

SEQ ID NO: 7350 - DNA, 27 bp, Artificial Sequences
  Synthetic
tcgttcggtgggaggaattcggggttt

SEQ ID NO: 7351 - DNA, 27 bp, Artificial Sequences
  Synthetic
ttcgttcggtgggaggaattcggggtt

SEQ ID NO: 7352 - DNA, 27 bp, Artificial Sequences
  Synthetic
tttcgttcggtgggaggaattcggggt

SEQ ID NO: 7353 - DNA, 27 bp, Artificial Sequences
  Synthetic
gcgagggttacgttgttggttaggggc

SEQ ID NO: 7354 - DNA, 27 bp, Artificial Sequences
  Synthetic
cgagggttacgttgttggttaggggcg

SEQ ID NO: 7355 - DNA, 27 bp, Artificial Sequences
  Synthetic
tgcgagggttacgttgttggttagggg

SEQ ID NO: 7356 - DNA, 28 bp, Artificial Sequences
  Synthetic
tgcgagggttacgttgttggttaggggc

SEQ ID NO: 7357 - DNA, 28 bp, Artificial Sequences
  Synthetic
ttgcgagggttacgttgttggttagggg

SEQ ID NO: 7358 - DNA, 27 bp, Artificial Sequences
  Synthetic
gtgttttgagtgcggggtgttgagggg

SEQ ID NO: 7359 - DNA, 27 bp, Artificial Sequences
  Synthetic
ggggtgttgagggggcggatgtaagtt

SEQ ID NO: 7360 - DNA, 27 bp, Artificial Sequences
  Synthetic
agtgttttgagtgcggggtgttgaggg

SEQ ID NO: 7361 - DNA, 27 bp, Artificial Sequences
  Synthetic
tgttttgagtgcggggtgttgaggggg

SEQ ID NO: 7362 - DNA, 26 bp, Artificial Sequences
  Synthetic
gttttgagtgcggggtgttgaggggg

SEQ ID NO: 7363 - DNA, 28 bp, Artificial Sequences
  Synthetic
cggcgtttgattttgttttcgtttgggg

SEQ ID NO: 7364 - DNA, 28 bp, Artificial Sequences
  Synthetic
tcggatcggcgtttgattttgttttcgt

SEQ ID NO: 7365 - DNA, 29 bp, Artificial Sequences
  Synthetic
cggcgtttgattttgttttcgtttgggga

SEQ ID NO: 7366 - DNA, 29 bp, Artificial Sequences
  Synthetic
tcggcgtttgattttgttttcgtttgggg

SEQ ID NO: 7367 - DNA, 30 bp, Artificial Sequences
  Synthetic
tcggcgtttgattttgttttcgtttgggga

SEQ ID NO: 7368 - DNA, 27 bp, Artificial Sequences
  Synthetic
ggcggatgtaagttttggatttggggg

SEQ ID NO: 7369 - DNA, 28 bp, Artificial Sequences
  Synthetic
ggcggatgtaagttttggatttggggga

SEQ ID NO: 7370 - DNA, 29 bp, Artificial Sequences
  Synthetic
ggcggatgtaagttttggatttgggggat

SEQ ID NO: 7371 - DNA, 30 bp, Artificial Sequences
  Synthetic
ggcggatgtaagttttggatttgggggatt

SEQ ID NO: 7372 - DNA, 32 bp, Artificial Sequences
  Synthetic
ggcggatgtaagttttggatttgggggattcg

SEQ ID NO: 7373 - DNA, 27 bp, Artificial Sequences
  Synthetic
tggtcggagggttgtagtattcgggtt

SEQ ID NO: 7374 - DNA, 27 bp, Artificial Sequences
  Synthetic
ttggtcggagggttgtagtattcgggt

SEQ ID NO: 7375 - DNA, 29 bp, Artificial Sequences
  Synthetic
tggtcggagggttgtagtattcgggttgt

SEQ ID NO: 7376 - DNA, 28 bp, Artificial Sequences
  Synthetic
ggtcggagggttgtagtattcgggttgt

SEQ ID NO: 7377 - DNA, 28 bp, Artificial Sequences
  Synthetic
tggtcggagggttgtagtattcgggttg

SEQ ID NO: 7378 - DNA, 27 bp, Artificial Sequences
  Synthetic
gggtgtaagaggtatggaggcgcggaa

SEQ ID NO: 7379 - DNA, 27 bp, Artificial Sequences
  Synthetic
agggtgtaagaggtatggaggcgcgga

SEQ ID NO: 7380 - DNA, 27 bp, Artificial Sequences
  Synthetic
tagggtgtaagaggtatggaggcgcgg

SEQ ID NO: 7381 - DNA, 28 bp, Artificial Sequences
  Synthetic
tagggtgtaagaggtatggaggcgcgga

SEQ ID NO: 7382 - DNA, 27 bp, Artificial Sequences
  Synthetic
aggtatggaggcgcggaagttaggagt

SEQ ID NO: 7383 - DNA, 28 bp, Artificial Sequences
  Synthetic
acgtgtaaattggtcggagggttgtagt

SEQ ID NO: 7384 - DNA, 29 bp, Artificial Sequences
  Synthetic
gacgtgtaaattggtcggagggttgtagt

SEQ ID NO: 7385 - DNA, 30 bp, Artificial Sequences
  Synthetic
gacgtgtaaattggtcggagggttgtagta

SEQ ID NO: 7386 - DNA, 31 bp, Artificial Sequences
  Synthetic
gacgtgtaaattggtcggagggttgtagtat

SEQ ID NO: 7387 - DNA, 31 bp, Artificial Sequences
  Synthetic
acgtgtaaattggtcggagggttgtagtatt

SEQ ID NO: 7388 - DNA, 27 bp, Artificial Sequences
  Synthetic
tgcggtttatttgggtagttcgggtgt

SEQ ID NO: 7389 - DNA, 28 bp, Artificial Sequences
  Synthetic
tgcggtttatttgggtagttcgggtgtt

SEQ ID NO: 7390 - DNA, 28 bp, Artificial Sequences
  Synthetic
ttgcggtttatttgggtagttcgggtgt

SEQ ID NO: 7391 - DNA, 29 bp, Artificial Sequences
  Synthetic
gcggtttatttgggtagttcgggtgttgt

SEQ ID NO: 7392 - DNA, 29 bp, Artificial Sequences
  Synthetic
tgcggtttatttgggtagttcgggtgttg

SEQ ID NO: 7393 - DNA, 27 bp, Artificial Sequences
  Synthetic
aggaaggaaaggggaaggggggaggat

SEQ ID NO: 7394 - DNA, 27 bp, Artificial Sequences
  Synthetic
aggaaaggggaaggggggaggattcga

SEQ ID NO: 7395 - DNA, 27 bp, Artificial Sequences
  Synthetic
taggaaggaaaggggaaggggggagga

SEQ ID NO: 7396 - DNA, 27 bp, Artificial Sequences
  Synthetic
aaggaaaggggaaggggggaggattcg

SEQ ID NO: 7397 - DNA, 27 bp, Artificial Sequences
  Synthetic
ggaaaggggaaggggggaggattcgat

SEQ ID NO: 7398 - DNA, 29 bp, Artificial Sequences
  Synthetic
cgcgatggggttaagggatagttgttgcg

SEQ ID NO: 7399 - DNA, 29 bp, Artificial Sequences
  Synthetic
gcgatggggttaagggatagttgttgcgg

SEQ ID NO: 7400 - DNA, 28 bp, Artificial Sequences
  Synthetic
gcgatggggttaagggatagttgttgcg

SEQ ID NO: 7401 - DNA, 28 bp, Artificial Sequences
  Synthetic
cgcgatggggttaagggatagttgttgc

SEQ ID NO: 7402 - DNA, 27 bp, Artificial Sequences
  Synthetic
agggggaaaaataaatcgcgatggggt

SEQ ID NO: 7403 - DNA, 27 bp, Artificial Sequences
  Synthetic
acggcggagatttgagattcggaggtt

SEQ ID NO: 7404 - DNA, 27 bp, Artificial Sequences
  Synthetic
aacggcggagatttgagattcggaggt

SEQ ID NO: 7405 - DNA, 27 bp, Artificial Sequences
  Synthetic
tgaggttgtaggtgggtttcgttgggt

SEQ ID NO: 7406 - DNA, 28 bp, Artificial Sequences
  Synthetic
cggaggttgaggttgtaggtgggtttcg

SEQ ID NO: 7407 - DNA, 29 bp, Artificial Sequences
  Synthetic
cggaggttgaggttgtaggtgggtttcgt

SEQ ID NO: 7408 - DNA, 27 bp, Artificial Sequences
  Synthetic
gtggtaagtcggggaaggggtggagtg

SEQ ID NO: 7409 - DNA, 27 bp, Artificial Sequences
  Synthetic
gtgtggtaagtcggggaaggggtggag

SEQ ID NO: 7410 - DNA, 27 bp, Artificial Sequences
  Synthetic
tggtaagtcggggaaggggtggagtga

SEQ ID NO: 7411 - DNA, 27 bp, Artificial Sequences
  Synthetic
tgtggtaagtcggggaaggggtggagt

SEQ ID NO: 7412 - DNA, 27 bp, Artificial Sequences
  Synthetic
taagtcggggaaggggtggagtgaacg

SEQ ID NO: 7413 - DNA, 27 bp, Artificial Sequences
  Synthetic
atacgtgggttgcggggtggatgttga

SEQ ID NO: 7414 - DNA, 27 bp, Artificial Sequences
  Synthetic
tgggttgcggggtggatgttgaggtag

SEQ ID NO: 7415 - DNA, 27 bp, Artificial Sequences
  Synthetic
gtgggttgcggggtggatgttgaggta

SEQ ID NO: 7416 - DNA, 27 bp, Artificial Sequences
  Synthetic
tacgtgggttgcggggtggatgttgag

SEQ ID NO: 7417 - DNA, 27 bp, Artificial Sequences
  Synthetic
tggtcggagggtttaggggttttcggt

SEQ ID NO: 7418 - DNA, 28 bp, Artificial Sequences
  Synthetic
cgatagcggcgatgttggtagtttcggt

SEQ ID NO: 7419 - DNA, 27 bp, Artificial Sequences
  Synthetic
cgatagcggcgatgttggtagtttcgg

SEQ ID NO: 7420 - DNA, 27 bp, Artificial Sequences
  Synthetic
cggagattacgtggagaaaggggtcgt

SEQ ID NO: 7421 - DNA, 27 bp, Artificial Sequences
  Synthetic
aggaagtcgtagtgggggtgtcgtttt

SEQ ID NO: 7422 - DNA, 27 bp, Artificial Sequences
  Synthetic
aaggaagtcgtagtgggggtgtcgttt

SEQ ID NO: 7423 - DNA, 27 bp, Artificial Sequences
  Synthetic
ttgttggtttagttcgggttgggcggc

SEQ ID NO: 7424 - DNA, 27 bp, Artificial Sequences
  Synthetic
tttgtttggtttggggggttcgtcggc

SEQ ID NO: 7425 - DNA, 27 bp, Artificial Sequences
  Synthetic
tcgggtttggaattgggggtttggggt

SEQ ID NO: 7426 - DNA, 27 bp, Artificial Sequences
  Synthetic
gggggtttggggtagtgttgggtaggt

SEQ ID NO: 7427 - DNA, 27 bp, Artificial Sequences
  Synthetic
tgggggtttggggtagtgttgggtagg

SEQ ID NO: 7428 - DNA, 27 bp, Artificial Sequences
  Synthetic
tttcggaggcgggtaggttttcggagg

SEQ ID NO: 7429 - DNA, 27 bp, Artificial Sequences
  Synthetic
ggcgggtaggttttcggaggaggtagg

SEQ ID NO: 7430 - DNA, 27 bp, Artificial Sequences
  Synthetic
gcgttacgttgttttcggaggcgggta

SEQ ID NO: 7431 - DNA, 27 bp, Artificial Sequences
  Synthetic
gcgggtaggttttcggaggaggtaggt

SEQ ID NO: 7432 - DNA, 27 bp, Artificial Sequences
  Synthetic
ttcggaggcgggtaggttttcggagga

SEQ ID NO: 7433 - DNA, 27 bp, Artificial Sequences
  Synthetic
taagggggcgggtttgaagtttcgggt

SEQ ID NO: 7434 - DNA, 27 bp, Artificial Sequences
  Synthetic
cgtaagggggcgggtttgaagtttcgg

SEQ ID NO: 7435 - DNA, 27 bp, Artificial Sequences
  Synthetic
gggcgggtttgaagtttcgggtttgga

SEQ ID NO: 7436 - DNA, 27 bp, Artificial Sequences
  Synthetic
gtaagggggcgggtttgaagtttcggg

SEQ ID NO: 7437 - DNA, 27 bp, Artificial Sequences
  Synthetic
tcgggtttggaattgggggtttggggt

SEQ ID NO: 7438 - DNA, 24 bp, Artificial Sequences
  Synthetic
cgtttcggggcgttcggtaggacg

SEQ ID NO: 7439 - DNA, 27 bp, Artificial Sequences
  Synthetic
agggtttatcgagtattacggcgggtg

SEQ ID NO: 7440 - DNA, 27 bp, Artificial Sequences
  Synthetic
gagggtttatcgagtattacggcgggt

SEQ ID NO: 7441 - DNA, 28 bp, Artificial Sequences
  Synthetic
agagggtttatcgagtattacggcgggt

SEQ ID NO: 7442 - DNA, 27 bp, Artificial Sequences
  Synthetic
agagggtttatcgagtattacggcggg

SEQ ID NO: 7443 - DNA, 27 bp, Artificial Sequences
  Synthetic
gttttagagggaggaaggacgcggagg

SEQ ID NO: 7444 - DNA, 28 bp, Artificial Sequences
  Synthetic
agttttagagggaggaaggacgcggagg

SEQ ID NO: 7445 - DNA, 27 bp, Artificial Sequences
  Synthetic
agttttagagggaggaaggacgcggag

SEQ ID NO: 7446 - DNA, 27 bp, Artificial Sequences
  Synthetic
tagttttagagggaggaaggacgcgga

SEQ ID NO: 7447 - DNA, 26 bp, Artificial Sequences
  Synthetic
ttttagagggaggaaggacgcggagg

SEQ ID NO: 7448 - DNA, 27 bp, Artificial Sequences
  Synthetic
tggggttggggatagtcgggatgtttt

SEQ ID NO: 7449 - DNA, 27 bp, Artificial Sequences
  Synthetic
ttggggttggggatagtcgggatgttt

SEQ ID NO: 7450 - DNA, 27 bp, Artificial Sequences
  Synthetic
tttggggttggggatagtcgggatgtt

SEQ ID NO: 7451 - DNA, 27 bp, Artificial Sequences
  Synthetic
ttttggggttggggatagtcgggatgt

SEQ ID NO: 7452 - DNA, 28 bp, Artificial Sequences
  Synthetic
ttggggttggggatagtcgggatgtttt

SEQ ID NO: 7453 - DNA, 27 bp, Artificial Sequences
  Synthetic
ggcgtagggtagcgagcgttagggttt

SEQ ID NO: 7454 - DNA, 27 bp, Artificial Sequences
  Synthetic
gcgttgattggttgcgggttttcggga

SEQ ID NO: 7455 - DNA, 27 bp, Artificial Sequences
  Synthetic
aggcgtagggtagcgagcgttagggtt

SEQ ID NO: 7456 - DNA, 26 bp, Artificial Sequences
  Synthetic
ggcgtagggtagcgagcgttagggtt

SEQ ID NO: 7457 - DNA, 27 bp, Artificial Sequences
  Synthetic
ggcgttgattggttgcgggttttcggg

SEQ ID NO: 7458 - DNA, 27 bp, Artificial Sequences
  Synthetic
gcggcgcggaattacggatagtgagtt

SEQ ID NO: 7459 - DNA, 28 bp, Artificial Sequences
  Synthetic
gcggcgcggaattacggatagtgagttt

SEQ ID NO: 7460 - DNA, 26 bp, Artificial Sequences
  Synthetic
gcggcgcggaattacggatagtgagt

SEQ ID NO: 7461 - DNA, 27 bp, Artificial Sequences
  Synthetic
tggggttggggatagtcgggatgtttt

SEQ ID NO: 7462 - DNA, 27 bp, Artificial Sequences
  Synthetic
ttggggttggggatagtcgggatgttt

SEQ ID NO: 7463 - DNA, 27 bp, Artificial Sequences
  Synthetic
agacggcgttgattggttgcgggtttt

SEQ ID NO: 7464 - DNA, 27 bp, Artificial Sequences
  Synthetic
ggcgtagggtagcgagcgttagggttt

SEQ ID NO: 7465 - DNA, 27 bp, Artificial Sequences
  Synthetic
gagacggcgttgattggttgcgggttt

SEQ ID NO: 7466 - DNA, 27 bp, Artificial Sequences
  Synthetic
gcgttgattggttgcgggttttcggga

SEQ ID NO: 7467 - DNA, 27 bp, Artificial Sequences
  Synthetic
gttttcggcggcggaattaggaagcgg

SEQ ID NO: 7468 - DNA, 27 bp, Artificial Sequences
  Synthetic
cgcgtggtttgtcgtttcggttgttcg

SEQ ID NO: 7469 - DNA, 27 bp, Artificial Sequences
  Synthetic
gcgtggtttgtcgtttcggttgttcgg

SEQ ID NO: 7470 - DNA, 27 bp, Artificial Sequences
  Synthetic
gttcgcgtggtttgtcgtttcggttgt

SEQ ID NO: 7471 - DNA, 28 bp, Artificial Sequences
  Synthetic
tcgcgtggtttgtcgtttcggttgttcg

SEQ ID NO: 7472 - DNA, 28 bp, Artificial Sequences
  Synthetic
gcgtggtttgtcgtttcggttgttcggt

SEQ ID NO: 7473 - DNA, 27 bp, Artificial Sequences
  Synthetic
agggaagcgtttagtagaattcggcgt

SEQ ID NO: 7474 - DNA, 28 bp, Artificial Sequences
  Synthetic
agggaagcgtttagtagaattcggcgtt

SEQ ID NO: 7475 - DNA, 28 bp, Artificial Sequences
  Synthetic
tagggaagcgtttagtagaattcggcgt

SEQ ID NO: 7476 - DNA, 28 bp, Artificial Sequences
  Synthetic
gggaagcgtttagtagaattcggcgttt

SEQ ID NO: 7477 - DNA, 29 bp, Artificial Sequences
  Synthetic
agggaagcgtttagtagaattcggcgttt

SEQ ID NO: 7478 - DNA, 29 bp, Artificial Sequences
  Synthetic
cgagtatggatttggttagttggcgtcgg

SEQ ID NO: 7479 - DNA, 30 bp, Artificial Sequences
  Synthetic
cgagtatggatttggttagttggcgtcggt

SEQ ID NO: 7480 - DNA, 28 bp, Artificial Sequences
  Synthetic
agtatggatttggttagttggcgtcggt

SEQ ID NO: 7481 - DNA, 30 bp, Artificial Sequences
  Synthetic
tcgagtatggatttggttagttggcgtcgg

SEQ ID NO: 7482 - DNA, 31 bp, Artificial Sequences
  Synthetic
tcgagtatggatttggttagttggcgtcggt

SEQ ID NO: 7483 - DNA, 27 bp, Artificial Sequences
  Synthetic
agtcgggagggcgggtttgagttttgt

SEQ ID NO: 7484 - DNA, 27 bp, Artificial Sequences
  Synthetic
gagtcgggagggcgggtttgagttttg

SEQ ID NO: 7485 - DNA, 27 bp, Artificial Sequences
  Synthetic
gtcgggagggcgggtttgagttttgtt

SEQ ID NO: 7486 - DNA, 27 bp, Artificial Sequences
  Synthetic
cgagtcgggagggcgggtttgagtttt

SEQ ID NO: 7487 - DNA, 27 bp, Artificial Sequences
  Synthetic
tcgggagggcgggtttgagttttgttt

SEQ ID NO: 7488 - DNA, 27 bp, Artificial Sequences
  Synthetic
tggtgcggaggttttttgggtcggttc

SEQ ID NO: 7489 - DNA, 27 bp, Artificial Sequences
  Synthetic
gtgcggaggttttttgggtcggttcga

SEQ ID NO: 7490 - DNA, 27 bp, Artificial Sequences
  Synthetic
ggtgcggaggttttttgggtcggttcg

SEQ ID NO: 7491 - DNA, 26 bp, Artificial Sequences
  Synthetic
tggtgcggaggttttttgggtcggtt

SEQ ID NO: 7492 - DNA, 26 bp, Artificial Sequences
  Synthetic
tgcggaggttttttgggtcggttcga

SEQ ID NO: 7493 - DNA, 27 bp, Artificial Sequences
  Synthetic
agtcgggagggcgggtttgagttttgt

SEQ ID NO: 7494 - DNA, 27 bp, Artificial Sequences
  Synthetic
gagtcgggagggcgggtttgagttttg

SEQ ID NO: 7495 - DNA, 27 bp, Artificial Sequences
  Synthetic
gtcgggagggcgggtttgagttttgtt

SEQ ID NO: 7496 - DNA, 27 bp, Artificial Sequences
  Synthetic
cgagtcgggagggcgggtttgagtttt

SEQ ID NO: 7497 - DNA, 27 bp, Artificial Sequences
  Synthetic
tcgggagggcgggtttgagttttgttt

SEQ ID NO: 7498 - DNA, 27 bp, Artificial Sequences
  Synthetic
tggtgcggaggttttttgggtcggttc

SEQ ID NO: 7499 - DNA, 27 bp, Artificial Sequences
  Synthetic
gtgcggaggttttttgggtcggttcga

SEQ ID NO: 7500 - DNA, 27 bp, Artificial Sequences
  Synthetic
ggtgcggaggttttttgggtcggttcg

SEQ ID NO: 7501 - DNA, 27 bp, Artificial Sequences
  Synthetic
ttggtgcggaggttttttgggtcggtt

SEQ ID NO: 7502 - DNA, 27 bp, Artificial Sequences
  Synthetic
tttggtgcggaggttttttgggtcggt

SEQ ID NO: 7503 - DNA, 27 bp, Artificial Sequences
  Synthetic
agtcgggagggcgggtttgagttttgt

SEQ ID NO: 7504 - DNA, 27 bp, Artificial Sequences
  Synthetic
gagtcgggagggcgggtttgagttttg

SEQ ID NO: 7505 - DNA, 27 bp, Artificial Sequences
  Synthetic
gtcgggagggcgggtttgagttttgtt

SEQ ID NO: 7506 - DNA, 27 bp, Artificial Sequences
  Synthetic
cgagtcgggagggcgggtttgagtttt

SEQ ID NO: 7507 - DNA, 27 bp, Artificial Sequences
  Synthetic
tcgggagggcgggtttgagttttgttt

SEQ ID NO: 7508 - DNA, 27 bp, Artificial Sequences
  Synthetic
tggtgcggaggttttttgggtcggttc

SEQ ID NO: 7509 - DNA, 27 bp, Artificial Sequences
  Synthetic
gtgcggaggttttttgggtcggttcga

SEQ ID NO: 7510 - DNA, 27 bp, Artificial Sequences
  Synthetic
ggtgcggaggttttttgggtcggttcg

SEQ ID NO: 7511 - DNA, 27 bp, Artificial Sequences
  Synthetic
ttggtgcggaggttttttgggtcggtt

SEQ ID NO: 7512 - DNA, 27 bp, Artificial Sequences
  Synthetic
tttggtgcggaggttttttgggtcggt

SEQ ID NO: 7513 - DNA, 27 bp, Artificial Sequences
  Synthetic
cgggagggcgggtttgagttttgtttt

SEQ ID NO: 7514 - DNA, 28 bp, Artificial Sequences
  Synthetic
cgggagggcgggtttgagttttgttttt

SEQ ID NO: 7515 - DNA, 26 bp, Artificial Sequences
  Synthetic
cgggagggcgggtttgagttttgttt

SEQ ID NO: 7516 - DNA, 27 bp, Artificial Sequences
  Synthetic
gggagggcgggtttgagttttgttttt

SEQ ID NO: 7517 - DNA, 29 bp, Artificial Sequences
  Synthetic
cgggagggcgggtttgagttttgtttttt

SEQ ID NO: 7518 - DNA, 27 bp, Artificial Sequences
  Synthetic
tggtgcggaggttttttgggtcggttc

SEQ ID NO: 7519 - DNA, 27 bp, Artificial Sequences
  Synthetic
gtgcggaggttttttgggtcggttcga

SEQ ID NO: 7520 - DNA, 27 bp, Artificial Sequences
  Synthetic
ggtgcggaggttttttgggtcggttcg

SEQ ID NO: 7521 - DNA, 27 bp, Artificial Sequences
  Synthetic
ttggtgcggaggttttttgggtcggtt

SEQ ID NO: 7522 - DNA, 27 bp, Artificial Sequences
  Synthetic
tttggtgcggaggttttttgggtcggt

SEQ ID NO: 7523 - DNA, 27 bp, Artificial Sequences
  Synthetic
agtttttggatggggtgtgagtgcgcg

SEQ ID NO: 7524 - DNA, 27 bp, Artificial Sequences
  Synthetic
gtttttggatggggtgtgagtgcgcgc

SEQ ID NO: 7525 - DNA, 28 bp, Artificial Sequences
  Synthetic
aagtttttggatggggtgtgagtgcgcg

SEQ ID NO: 7526 - DNA, 26 bp, Artificial Sequences
  Synthetic
tttttggatggggtgtgagtgcgcgc

SEQ ID NO: 7527 - DNA, 27 bp, Artificial Sequences
  Synthetic
aagtttttggatggggtgtgagtgcgc

SEQ ID NO: 7528 - DNA, 24 bp, Artificial Sequences
  Synthetic
tcggttttggagatgggcgcgaag

SEQ ID NO: 7529 - DNA, 29 bp, Artificial Sequences
  Synthetic
tcggttttatagttgggcgagattgaggt

SEQ ID NO: 7530 - DNA, 23 bp, Artificial Sequences
  Synthetic
cggttttggagatgggcgcgaag

SEQ ID NO: 7531 - DNA, 31 bp, Artificial Sequences
  Synthetic
cggttttatagttgggcgagattgaggtttc

SEQ ID NO: 7532 - DNA, 22 bp, Artificial Sequences
  Synthetic
cggttttggagatgggcgcgaa

SEQ ID NO: 7533 - DNA, 27 bp, Artificial Sequences
  Synthetic
gttgtagggttgcgggggcgttatagt

SEQ ID NO: 7534 - DNA, 28 bp, Artificial Sequences
  Synthetic
agttgtagggttgcgggggcgttatagt

SEQ ID NO: 7535 - DNA, 27 bp, Artificial Sequences
  Synthetic
agttgtagggttgcgggggcgttatag

SEQ ID NO: 7536 - DNA, 27 bp, Artificial Sequences
  Synthetic
tgtagggttgcgggggcgttatagttt

SEQ ID NO: 7537 - DNA, 27 bp, Artificial Sequences
  Synthetic
ttgtagggttgcgggggcgttatagtt

SEQ ID NO: 7538 - DNA, 32 bp, Artificial Sequences
  Synthetic
gggagaggttagtgttgtttttaaggggaggg

SEQ ID NO: 7539 - DNA, 33 bp, Artificial Sequences
  Synthetic
tgggagaggttagtgttgtttttaaggggaggg

SEQ ID NO: 7540 - DNA, 33 bp, Artificial Sequences
  Synthetic
gggagaggttagtgttgtttttaaggggaggga

SEQ ID NO: 7541 - DNA, 31 bp, Artificial Sequences
  Synthetic
ggagaggttagtgttgtttttaaggggaggg

SEQ ID NO: 7542 - DNA, 31 bp, Artificial Sequences
  Synthetic
gggagaggttagtgttgtttttaaggggagg

SEQ ID NO: 7543 - DNA, 28 bp, Artificial Sequences
  Synthetic
ggaggtagtcgaagggtatgagttgcgt

SEQ ID NO: 7544 - DNA, 27 bp, Artificial Sequences
  Synthetic
ggaggtagtcgaagggtatgagttgcg

SEQ ID NO: 7545 - DNA, 29 bp, Artificial Sequences
  Synthetic
aggaggtagtcgaagggtatgagttgcgt

SEQ ID NO: 7546 - DNA, 28 bp, Artificial Sequences
  Synthetic
aggaggtagtcgaagggtatgagttgcg

SEQ ID NO: 7547 - DNA, 27 bp, Artificial Sequences
  Synthetic
aggtagtcgaagggtatgagttgcgtg

SEQ ID NO: 7548 - DNA, 27 bp, Artificial Sequences
  Synthetic
tgggttggttaaattgttgggtgcgga

SEQ ID NO: 7549 - DNA, 27 bp, Artificial Sequences
  Synthetic
ttgggttggttaaattgttgggtgcgg

SEQ ID NO: 7550 - DNA, 28 bp, Artificial Sequences
  Synthetic
tgggttggttaaattgttgggtgcggaa

SEQ ID NO: 7551 - DNA, 28 bp, Artificial Sequences
  Synthetic
ttgggttggttaaattgttgggtgcgga

SEQ ID NO: 7552 - DNA, 27 bp, Artificial Sequences
  Synthetic
gggttggttaaattgttgggtgcggaa

SEQ ID NO: 7553 - DNA, 27 bp, Artificial Sequences
  Synthetic
acgtttttggttgttaggtcgcggtgt

SEQ ID NO: 7554 - DNA, 28 bp, Artificial Sequences
  Synthetic
acgtttttggttgttaggtcgcggtgta

SEQ ID NO: 7555 - DNA, 28 bp, Artificial Sequences
  Synthetic
tacgtttttggttgttaggtcgcggtgt

SEQ ID NO: 7556 - DNA, 27 bp, Artificial Sequences
  Synthetic
gtacgtttttggttgttaggtcgcggt

SEQ ID NO: 7557 - DNA, 27 bp, Artificial Sequences
  Synthetic
cgtttttggttgttaggtcgcggtgta

SEQ ID NO: 7558 - DNA, 30 bp, Artificial Sequences
  Synthetic
tgggggtacggttggttttgttatagtcgt

SEQ ID NO: 7559 - DNA, 29 bp, Artificial Sequences
  Synthetic
gggggtacggttggttttgttatagtcgt

SEQ ID NO: 7560 - DNA, 29 bp, Artificial Sequences
  Synthetic
tgggggtacggttggttttgttatagtcg

SEQ ID NO: 7561 - DNA, 29 bp, Artificial Sequences
  Synthetic
ggtttatttgggggtacggttggttttgt

SEQ ID NO: 7562 - DNA, 30 bp, Artificial Sequences
  Synthetic
aggtttatttgggggtacggttggttttgt

SEQ ID NO: 7563 - DNA, 27 bp, Artificial Sequences
  Synthetic
agatggaaagttgttcgggtagcgtcg

SEQ ID NO: 7564 - DNA, 27 bp, Artificial Sequences
  Synthetic
gatggaaagttgttcgggtagcgtcga

SEQ ID NO: 7565 - DNA, 27 bp, Artificial Sequences
  Synthetic
acgggaagttacggttgcggttgtaat

SEQ ID NO: 7566 - DNA, 28 bp, Artificial Sequences
  Synthetic
agatggaaagttgttcgggtagcgtcga

SEQ ID NO: 7567 - DNA, 28 bp, Artificial Sequences
  Synthetic
gagatggaaagttgttcgggtagcgtcg

SEQ ID NO: 7568 - DNA, 27 bp, Artificial Sequences
  Synthetic
tggggatgagttagttcgttggagggg

SEQ ID NO: 7569 - DNA, 28 bp, Artificial Sequences
  Synthetic
tggggatgagttagttcgttggagggga

SEQ ID NO: 7570 - DNA, 27 bp, Artificial Sequences
  Synthetic
ggggatgagttagttcgttggagggga

SEQ ID NO: 7571 - DNA, 29 bp, Artificial Sequences
  Synthetic
ggggatgagttagttcgttggaggggagt

SEQ ID NO: 7572 - DNA, 29 bp, Artificial Sequences
  Synthetic
tggggatgagttagttcgttggaggggag

SEQ ID NO: 7573 - DNA, 29 bp, Artificial Sequences
  Synthetic
gcgggttttgagtagtcgttttgtatggt

SEQ ID NO: 7574 - DNA, 30 bp, Artificial Sequences
  Synthetic
agcgggttttgagtagtcgttttgtatggt

SEQ ID NO: 7575 - DNA, 30 bp, Artificial Sequences
  Synthetic
agggttttcgtattagagcgggttttgagt

SEQ ID NO: 7576 - DNA, 30 bp, Artificial Sequences
  Synthetic
gagcgggttttgagtagtcgttttgtatgg

SEQ ID NO: 7577 - DNA, 31 bp, Artificial Sequences
  Synthetic
gagcgggttttgagtagtcgttttgtatggt

SEQ ID NO: 7578 - DNA, 27 bp, Artificial Sequences
  Synthetic
agtgcgagggttttggtttagggtagt

SEQ ID NO: 7579 - DNA, 29 bp, Artificial Sequences
  Synthetic
gcgagggttttggtttagggtagtagggt

SEQ ID NO: 7580 - DNA, 29 bp, Artificial Sequences
  Synthetic
tgcgagggttttggtttagggtagtaggg

SEQ ID NO: 7581 - DNA, 30 bp, Artificial Sequences
  Synthetic
tgcgagggttttggtttagggtagtagggt

SEQ ID NO: 7582 - DNA, 28 bp, Artificial Sequences
  Synthetic
gcgagggttttggtttagggtagtaggg

SEQ ID NO: 7583 - DNA, 30 bp, Artificial Sequences; identical to SEQ ID NO: 7575
  Synthetic

SEQ ID NO: 7584 - DNA, 31 bp, Artificial Sequences
  Synthetic
agggttttcgtattagagcgggttttgagta

SEQ ID NO: 7585 - DNA, 31 bp, Artificial Sequences
  Synthetic
tagggttttcgtattagagcgggttttgagt

SEQ ID NO: 7586 - DNA, 31 bp, Artificial Sequences
  Synthetic
tgagttagggttttcgtattagagcgggttt

SEQ ID NO: 7587 - DNA, 31 bp, Artificial Sequences
  Synthetic
ttgagttagggttttcgtattagagcgggtt

SEQ ID NO: 7588 - DNA, 32 bp, Artificial Sequences
  Synthetic
ggaggtattgttttgggagttgtttttggtgt

SEQ ID NO: 7589 - DNA, 32 bp, Artificial Sequences
  Synthetic
aggaggtattgttttgggagttgtttttggtg

SEQ ID NO: 7590 - DNA, 33 bp, Artificial Sequences
  Synthetic
aggaggtattgttttgggagttgtttttggtgt

SEQ ID NO: 7591 - DNA, 33 bp, Artificial Sequences
  Synthetic
ggaggtattgttttgggagttgtttttggtgtt

SEQ ID NO: 7592 - DNA, 33 bp, Artificial Sequences
  Synthetic
aaggaggtattgttttgggagttgtttttggtg

SEQ ID NO: 7593 - DNA, 36 bp, Artificial Sequences
  Synthetic
tgaggtttttaggtatgttgtttaagggggtttagg

SEQ ID NO: 7594 - DNA, 36 bp, Artificial Sequences
  Synthetic
aggtttttaggtatgttgtttaagggggtttaggat

SEQ ID NO: 7595 - DNA, 36 bp, Artificial Sequences
  Synthetic
agtattgaggtttttaggtatgttgtttaagggggt

SEQ ID NO: 7596 - DNA, 27 bp, Artificial Sequences
  Synthetic
gttcgcggggtgggtgttttagtgtcg

SEQ ID NO: 7597 - DNA, 27 bp, Artificial Sequences
  Synthetic
aaggtggtcggcgcggtttttagttcg

SEQ ID NO: 7598 - DNA, 27 bp, Artificial Sequences
  Synthetic
cgagggaagaagaaaagagagcgcgcg

SEQ ID NO: 7599 - DNA, 27 bp, Artificial Sequences
  Synthetic
cggtttttagttcgcggggtgggtgtt

SEQ ID NO: 7600 - DNA, 27 bp, Artificial Sequences
  Synthetic
ggtaagttagggagtcggcggcggtat

SEQ ID NO: 7601 - DNA, 27 bp, Artificial Sequences
  Synthetic
ttgggggattcgttggggaggagttgg

SEQ ID NO: 7602 - DNA, 27 bp, Artificial Sequences
  Synthetic
gtgttgtcggcggtaaggttttggggg

SEQ ID NO: 7603 - DNA, 27 bp, Artificial Sequences
  Synthetic
ggtgttgtcggcggtaaggttttgggg

SEQ ID NO: 7604 - DNA, 27 bp, Artificial Sequences
  Synthetic
tagagcgaggagtgtggtgttgtcggc

SEQ ID NO: 7605 - DNA, 27 bp, Artificial Sequences
  Synthetic
ggattcgttggggaggagttggggagg

SEQ ID NO: 7606 - DNA, 27 bp, Artificial Sequences
  Synthetic
tcgggtttttgggttcgttttggtcgt

SEQ ID NO: 7607 - DNA, 28 bp, Artificial Sequences
  Synthetic
gtcgggtttttgggttcgttttggtcgt

SEQ ID NO: 7608 - DNA, 27 bp, Artificial Sequences
  Synthetic
gtcgggtttttgggttcgttttggtcg

SEQ ID NO: 7609 - DNA, 28 bp, Artificial Sequences
  Synthetic
gcgtttaggagtcgggtttttgggttcg

SEQ ID NO: 7610 - DNA, 29 bp, Artificial Sequences
  Synthetic
gcgtttaggagtcgggtttttgggttcgt

SEQ ID NO: 7611 - DNA, 27 bp, Artificial Sequences
  Synthetic
cgtgtatgtgtatgcgtgtgtgtgtgt

SEQ ID NO: 7612 - DNA, 28 bp, Artificial Sequences
  Synthetic
tcgtgtatgtgtatgcgtgtgtgtgtgt

SEQ ID NO: 7613 - DNA, 28 bp, Artificial Sequences
  Synthetic
tgtcgtgtatgtgtatgcgtgtgtgtgt

SEQ ID NO: 7614 - DNA, 28 bp, Artificial Sequences
  Synthetic
tgtgtcgtgtatgtgtatgcgtgtgtgt

SEQ ID NO: 7615 - DNA, 28 bp, Artificial Sequences
  Synthetic
tgtgtgtcgtgtatgtgtatgcgtgtgt

SEQ ID NO: 7616 - DNA, 27 bp, Artificial Sequences
  Synthetic
cgtggggagaatgttacgtgggtttgg

SEQ ID NO: 7617 - DNA, 28 bp, Artificial Sequences
  Synthetic
cgtggggagaatgttacgtgggtttgga

SEQ ID NO: 7618 - DNA, 29 bp, Artificial Sequences
  Synthetic
tggggagaatgttacgtgggtttggaggt

SEQ ID NO: 7619 - DNA, 28 bp, Artificial Sequences
  Synthetic
ggggagaatgttacgtgggtttggaggt

SEQ ID NO: 7620 - DNA, 28 bp, Artificial Sequences
  Synthetic
tggggagaatgttacgtgggtttggagg

SEQ ID NO: 7621 - DNA, 27 bp, Artificial Sequences
  Synthetic
cgacggatagtttcgcggggtgttgag

SEQ ID NO: 7622 - DNA, 26 bp, Artificial Sequences
  Synthetic
gatagatgcggggcggggtgattcgg

SEQ ID NO: 7623 - DNA, 26 bp, Artificial Sequences
  Synthetic
ggatagatgcggggcggggtgattcg

SEQ ID NO: 7624 - DNA, 27 bp, Artificial Sequences
  Synthetic
gatagatgcggggcggggtgattcggg

SEQ ID NO: 7625 - DNA, 27 bp, Artificial Sequences
  Synthetic
ggatagatgcggggcggggtgattcgg

SEQ ID NO: 7626 - DNA, 27 bp, Artificial Sequences
  Synthetic
tcgtcgtagtaagtgttcgcgcggtgt

SEQ ID NO: 7627 - DNA, 27 bp, Artificial Sequences
  Synthetic
cgtagtaagtgttcgcgcggtgttggt

SEQ ID NO: 7628 - DNA, 27 bp, Artificial Sequences
  Synthetic
cgtcgtagtaagtgttcgcgcggtgtt

SEQ ID NO: 7629 - DNA, 27 bp, Artificial Sequences
  Synthetic
tagtaagtgttcgcgcggtgttggtcg

SEQ ID NO: 7630 - DNA, 27 bp, Artificial Sequences
  Synthetic
tcgtagtaagtgttcgcgcggtgttgg

SEQ ID NO: 7631 - DNA, 26 bp, Artificial Sequences
  Synthetic
gatagatgcggggcggggtgattcgg

SEQ ID NO: 7632 - DNA, 26 bp, Artificial Sequences
  Synthetic
ggatagatgcggggcggggtgattcg

SEQ ID NO: 7633 - DNA, 27 bp, Artificial Sequences
  Synthetic
gatagatgcggggcggggtgattcggg

SEQ ID NO: 7634 - DNA, 27 bp, Artificial Sequences
  Synthetic
ggatagatgcggggcggggtgattcgg

SEQ ID NO: 7635 - DNA, 25 bp, Artificial Sequences
  Synthetic
gatagatgcggggcggggtgattcg

SEQ ID NO: 7636 - DNA, 27 bp, Artificial Sequences
  Synthetic
tcgtcgtagtaagtgttcgcgcggtgt

SEQ ID NO: 7637 - DNA, 27 bp, Artificial Sequences
  Synthetic
cgtagtaagtgttcgcgcggtgttggt

SEQ ID NO: 7638 - DNA, 27 bp, Artificial Sequences
  Synthetic
cgtcgtagtaagtgttcgcgcggtgtt

SEQ ID NO: 7639 - DNA, 27 bp, Artificial Sequences
  Synthetic
tagtaagtgttcgcgcggtgttggtcg

SEQ ID NO: 7640 - DNA, 27 bp, Artificial Sequences
  Synthetic
tcgtagtaagtgttcgcgcggtgttgg

SEQ ID NO: 7641 - DNA, 27 bp, Artificial Sequences
  Synthetic
taggtggaagataaagaggggcgttgg

SEQ ID NO: 7642 - DNA, 29 bp, Artificial Sequences
  Synthetic
tgtaggtggaagataaagaggggcgttgg

SEQ ID NO: 7643 - DNA, 28 bp, Artificial Sequences
  Synthetic
gtaggtggaagataaagaggggcgttgg

SEQ ID NO: 7644 - DNA, 26 bp, Artificial Sequences
  Synthetic
aggtggaagataaagaggggcgttgg

SEQ ID NO: 7645 - DNA, 28 bp, Artificial Sequences
  Synthetic
tgtaggtggaagataaagaggggcgttg

SEQ ID NO: 7646 - DNA, 31 bp, Artificial Sequences
  Synthetic
gcgttattaagtcgtaggttcgcggtagagc

SEQ ID NO: 7647 - DNA, 29 bp, Artificial Sequences
  Synthetic
tgagagtgagaaagggaagacgaggatgt

SEQ ID NO: 7648 - DNA, 29 bp, Artificial Sequences
  Synthetic
gcgttattaagtcgtaggttcgcggtaga

SEQ ID NO: 7649 - DNA, 30 bp, Artificial Sequences
  Synthetic
gcggtagagcgttgcgtttatttttgaagg

SEQ ID NO: 7650 - DNA, 29 bp, Artificial Sequences
  Synthetic
tggtttagaatttttggagttcgggggga

SEQ ID NO: 7651 - DNA, 27 bp, Artificial Sequences
  Synthetic
cgatttggtggcgcggatgtgatgtta

SEQ ID NO: 7652 - DNA, 26 bp, Artificial Sequences
  Synthetic
cgatttggtggcgcggatgtgatgtt

SEQ ID NO: 7653 - DNA, 28 bp, Artificial Sequences
  Synthetic
cgatttggtggcgcggatgtgatgttaa

SEQ ID NO: 7654 - DNA, 28 bp, Artificial Sequences
  Synthetic
tggtggcgcggatgtgatgttaatttgt

SEQ ID NO: 7655 - DNA, 27 bp, Artificial Sequences
  Synthetic
ggtggcgcggatgtgatgttaatttgt

SEQ ID NO: 7656 - DNA, 27 bp, Artificial Sequences
  Synthetic
tcgcgtcgattcgttggttttggtcgt

SEQ ID NO: 7657 - DNA, 27 bp, Artificial Sequences
  Synthetic
cgcgtcgattcgttggttttggtcgtt

SEQ ID NO: 7658 - DNA, 28 bp, Artificial Sequences
  Synthetic
tcgcgtcgattcgttggttttggtcgtt

SEQ ID NO: 7659 - DNA, 28 bp, Artificial Sequences
  Synthetic
cgcgtcgattcgttggttttggtcgttt

SEQ ID NO: 7660 - DNA, 29 bp, Artificial Sequences
  Synthetic
tcgcgtcgattcgttggttttggtcgttt

SEQ ID NO: 7661 - DNA, 27 bp, Artificial Sequences
  Synthetic
ttttttgggtagtcgggggtagggggc

SEQ ID NO: 7662 - DNA, 27 bp, Artificial Sequences
  Synthetic
tagtcgggggtagggggcgttaaggtc

SEQ ID NO: 7663 - DNA, 27 bp, Artificial Sequences
  Synthetic
gcggggtattttcgggtcggagtggtt

SEQ ID NO: 7664 - DNA, 27 bp, Artificial Sequences
  Synthetic
gtagtcgggggtagggggcgttaaggt

SEQ ID NO: 7665 - DNA, 28 bp, Artificial Sequences
  Synthetic
gcggggtattttcgggtcggagtggtta

SEQ ID NO: 7666 - DNA, 34 bp, Artificial Sequences
  Synthetic
ggagtttcgttttatttaggattcggtggttagc

SEQ ID NO: 7667 - DNA, 35 bp, Artificial Sequences
  Synthetic
aggagtttcgttttatttaggattcggtggttagc

SEQ ID NO: 7668 - DNA, 36 bp, Artificial Sequences
  Synthetic
cggttgggttttttatttttcggtttttgtttacga

SEQ ID NO: 7669 - DNA, 36 bp, Artificial Sequences
  Synthetic
tcggttgggttttttatttttcggtttttgtttacg

SEQ ID NO: 7670 - DNA, 27 bp, Artificial Sequences
  Synthetic
gggagttttagttcggtagcggcgttc

SEQ ID NO: 7671 - DNA, 26 bp, Artificial Sequences
  Synthetic
gggagttttagttcggtagcggcgtt

SEQ ID NO: 7672 - DNA, 26 bp, Artificial Sequences
  Synthetic
ggagttttagttcggtagcggcgttc

SEQ ID NO: 7673 - DNA, 25 bp, Artificial Sequences
  Synthetic
gggagttttagttcggtagcggcgt

SEQ ID NO: 7674 - DNA, 29 bp, Artificial Sequences
  Synthetic
agttcggtggttttcggttttgttaacgt

SEQ ID NO: 7675 - DNA, 27 bp, Artificial Sequences
  Synthetic
ggcggttgggagttggggcgtaatttt

SEQ ID NO: 7676 - DNA, 27 bp, Artificial Sequences
  Synthetic
tcgagaagtttggaggcggttgggagt

SEQ ID NO: 7677 - DNA, 27 bp, Artificial Sequences
  Synthetic
gaagtttggaggcggttgggagttggg

SEQ ID NO: 7678 - DNA, 27 bp, Artificial Sequences
  Synthetic
aggcggttgggagttggggcgtaattt

SEQ ID NO: 7679 - DNA, 27 bp, Artificial Sequences
  Synthetic
aagtttggaggcggttgggagttgggg

SEQ ID NO: 7680 - DNA, 27 bp, Artificial Sequences
  Synthetic
tcggcgggatttgatcgaaggtagcgt

SEQ ID NO: 7681 - DNA, 27 bp, Artificial Sequences
  Synthetic
ggcggtggtggtttagaggttcgaggt

SEQ ID NO: 7682 - DNA, 27 bp, Artificial Sequences
  Synthetic
tgtagaggagaaggggaggagcgcgat

SEQ ID NO: 7683 - DNA, 27 bp, Artificial Sequences
  Synthetic
atgtagaggagaaggggaggagcgcga

SEQ ID NO: 7684 - DNA, 27 bp, Artificial Sequences
  Synthetic
agttggggcggtggtggtttagaggtt

SEQ ID NO: 7685 - DNA, 27 bp, Artificial Sequences
  Synthetic
ggcggttgggagttggggcgtaatttt

SEQ ID NO: 7686 - DNA, 27 bp, Artificial Sequences
  Synthetic
tcgagaagtttggaggcggttgggagt

SEQ ID NO: 7687 - DNA, 27 bp, Artificial Sequences
  Synthetic
gaagtttggaggcggttgggagttggg

SEQ ID NO: 7688 - DNA, 27 bp, Artificial Sequences
  Synthetic
aggcggttgggagttggggcgtaattt

SEQ ID NO: 7689 - DNA, 27 bp, Artificial Sequences
  Synthetic
aagtttggaggcggttgggagttgggg

SEQ ID NO: 7690 - DNA, 27 bp, Artificial Sequences
  Synthetic
ggcggtggtggtttagaggttcgaggt

SEQ ID NO: 7691 - DNA, 27 bp, Artificial Sequences
  Synthetic
tgtagaggagaaggggaggagcgcgat

SEQ ID NO: 7692 - DNA, 27 bp, Artificial Sequences
  Synthetic
atgtagaggagaaggggaggagcgcga

SEQ ID NO: 7693 - DNA, 27 bp, Artificial Sequences
  Synthetic
agttggggcggtggtggtttagaggtt

SEQ ID NO: 7694 - DNA, 27 bp, Artificial Sequences
  Synthetic
ttggggcggtggtggtttagaggttcg

SEQ ID NO: 7695 - DNA, 27 bp, Artificial Sequences
  Synthetic
tcgggttggggtttttaagcgttcggt

SEQ ID NO: 7696 - DNA, 28 bp, Artificial Sequences
  Synthetic
gtcgggttggggtttttaagcgttcggt

SEQ ID NO: 7697 - DNA, 28 bp, Artificial Sequences
  Synthetic
tgtcgggttggggtttttaagcgttcgg

SEQ ID NO: 7698 - DNA, 27 bp, Artificial Sequences
  Synthetic
gtcgggttggggtttttaagcgttcgg

SEQ ID NO: 7699 - DNA, 27 bp, Artificial Sequences
  Synthetic
cgggttggggtttttaagcgttcggtt

SEQ ID NO: 7700 - DNA, 27 bp, Artificial Sequences
  Synthetic
tgtagaggagaaggggaggagcgcgat

SEQ ID NO: 7701 - DNA, 27 bp, Artificial Sequences
  Synthetic
atgtagaggagaaggggaggagcgcga

SEQ ID NO: 7702 - DNA, 27 bp, Artificial Sequences
  Synthetic
aatgtagaggagaaggggaggagcgcg

SEQ ID NO: 7703 - DNA, 27 bp, Artificial Sequences
  Synthetic
gtagaggagaaggggaggagcgcgatt

SEQ ID NO: 7704 - DNA, 27 bp, Artificial Sequences
  Synthetic
tagaggagaaggggaggagcgcgattg

SEQ ID NO: 7705 - DNA, 28 bp, Artificial Sequences
  Synthetic
ggtcggattggtcgtcgtagtttagggc

SEQ ID NO: 7706 - DNA, 29 bp, Artificial Sequences
  Synthetic
aggtcggattggtcgtcgtagtttagggc

SEQ ID NO: 7707 - DNA, 27 bp, Artificial Sequences
  Synthetic
gtcggattggtcgtcgtagtttagggc

SEQ ID NO: 7708 - DNA, 27 bp, Artificial Sequences
  Synthetic
ggtcggattggtcgtcgtagtttaggg

SEQ ID NO: 7709 - DNA, 28 bp, Artificial Sequences
  Synthetic
aggtcggattggtcgtcgtagtttaggg

SEQ ID NO: 7710 - DNA, 27 bp, Artificial Sequences
  Synthetic
ttgggagggtcgggttttaagggcgtt

SEQ ID NO: 7711 - DNA, 27 bp, Artificial Sequences
  Synthetic
tttgggagggtcgggttttaagggcgt

SEQ ID NO: 7712 - DNA, 27 bp, Artificial Sequences
  Synthetic
tgggagggtcgggttttaagggcgtta

SEQ ID NO: 7713 - DNA, 27 bp, Artificial Sequences
  Synthetic
gggcgtttttgggagggtcgggtttta

SEQ ID NO: 7714 - DNA, 27 bp, Artificial Sequences
  Synthetic
ttttgggagggtcgggttttaagggcg

SEQ ID NO: 7715 - DNA, 27 bp, Artificial Sequences
  Synthetic
gcggtaggggtgtggcgtttttgaagt

SEQ ID NO: 7716 - DNA, 27 bp, Artificial Sequences
  Synthetic
tgcggtaggggtgtggcgtttttgaag

SEQ ID NO: 7717 - DNA, 27 bp, Artificial Sequences
  Synthetic
cgtttttgcggtaggggtgtggcgttt

SEQ ID NO: 7718 - DNA, 27 bp, Artificial Sequences
  Synthetic
ttgcggtaggggtgtggcgtttttgaa

SEQ ID NO: 7719 - DNA, 27 bp, Artificial Sequences
  Synthetic
tttgcggtaggggtgtggcgtttttga

SEQ ID NO: 7720 - DNA, 26 bp, Artificial Sequences
  Synthetic
cgtttcgcgcgggttgtacgtttttt

SEQ ID NO: 7721 - DNA, 25 bp, Artificial Sequences
  Synthetic
cgtttcgcgcgggttgtacgttttt

SEQ ID NO: 7722 - DNA, 25 bp, Artificial Sequences
  Synthetic
gcgtatcgttcgttgcggtttttgc

SEQ ID NO: 7723 - DNA, 24 bp, Artificial Sequences
  Synthetic
cgtttcgcgcgggttgtacgtttt

SEQ ID NO: 7724 - DNA, 25 bp, Artificial Sequences
  Synthetic
gtttcgcgcgggttgtacgtttttt

SEQ ID NO: 7725 - DNA, 27 bp, Artificial Sequences
  Synthetic
ttcggaaaggaaagcggcgagaaaggc

SEQ ID NO: 7726 - DNA, 27 bp, Artificial Sequences
  Synthetic
gcggtaggggtgtggcgtttttgaagt

SEQ ID NO: 7727 - DNA, 27 bp, Artificial Sequences
  Synthetic
tgcggtaggggtgtggcgtttttgaag

SEQ ID NO: 7728 - DNA, 27 bp, Artificial Sequences
  Synthetic
cgtttttgcggtaggggtgtggcgttt

SEQ ID NO: 7729 - DNA, 27 bp, Artificial Sequences
  Synthetic
ttgcggtaggggtgtggcgtttttgaa

SEQ ID NO: 7730 - DNA, 27 bp, Artificial Sequences
  Synthetic
tgtttgttgttggttcggtcgcgttcg

SEQ ID NO: 7731 - DNA, 28 bp, Artificial Sequences
  Synthetic
ggtttgtttgttgttggttcggtcgcgt

SEQ ID NO: 7732 - DNA, 28 bp, Artificial Sequences
  Synthetic
tggtttgtttgttgttggttcggtcgcg

SEQ ID NO: 7733 - DNA, 27 bp, Artificial Sequences
  Synthetic
ggtttgtttgttgttggttcggtcgcg

SEQ ID NO: 7734 - DNA, 28 bp, Artificial Sequences
  Synthetic
ttgtttgttgttggttcggtcgcgttcg

SEQ ID NO: 7735 - DNA, 24 bp, Artificial Sequences
  Synthetic
gagtcgtaggggtcgtagcgggcg

SEQ ID NO: 7736 - DNA, 24 bp, Artificial Sequences
  Synthetic
cgagtcgtaggggtcgtagcgggc

SEQ ID NO: 7737 - DNA, 23 bp, Artificial Sequences
  Synthetic
agtcgtaggggtcgtagcgggcg

SEQ ID NO: 7738 - DNA, 25 bp, Artificial Sequences
  Synthetic
cgagtcgtaggggtcgtagcgggcg

SEQ ID NO: 7739 - DNA, 23 bp, Artificial Sequences
  Synthetic
gagtcgtaggggtcgtagcgggc

SEQ ID NO: 7740 - DNA, 27 bp, Artificial Sequences
  Synthetic
tgtttgttgttggttcggtcgcgttcg

SEQ ID NO: 7741 - DNA, 28 bp, Artificial Sequences
  Synthetic
ggtttgtttgttgttggttcggtcgcgt

SEQ ID NO: 7742 - DNA, 28 bp, Artificial Sequences
  Synthetic
tggtttgtttgttgttggttcggtcgcg

SEQ ID NO: 7743 - DNA, 27 bp, Artificial Sequences
  Synthetic
ggtttgtttgttgttggttcggtcgcg

SEQ ID NO: 7744 - DNA, 28 bp, Artificial Sequences
  Synthetic
ttgtttgttgttggttcggtcgcgttcg

SEQ ID NO: 7745 - DNA, 27 bp, Artificial Sequences
  Synthetic
cgcggtcgggttagtagtaggtaggtt

SEQ ID NO: 7746 - DNA, 26 bp, Artificial Sequences
  Synthetic
cgcggtcgggttagtagtaggtaggt

SEQ ID NO: 7747 - DNA, 25 bp, Artificial Sequences
  Synthetic
gcgtagttaggtcggtggggtatcg

SEQ ID NO: 7748 - DNA, 31 bp, Artificial Sequences
  Synthetic
cgcggtcgggttagtagtaggtaggttagtt

SEQ ID NO: 7749 - DNA, 33 bp, Artificial Sequences
  Synthetic
gcggaaggttttgtagtagtagttaggcgagcg

SEQ ID NO: 7750 - DNA, 27 bp, Artificial Sequences
  Synthetic
tgttgttgttgtcggtcgggattacgc

SEQ ID NO: 7751 - DNA, 27 bp, Artificial Sequences
  Synthetic
tggatttgttgttgttgtcggtcggga

SEQ ID NO: 7752 - DNA, 28 bp, Artificial Sequences
  Synthetic
ttgttgttgttgtcggtcgggattacgc

SEQ ID NO: 7753 - DNA, 27 bp, Artificial Sequences
  Synthetic
ttggatttgttgttgttgtcggtcggg

SEQ ID NO: 7754 - DNA, 28 bp, Artificial Sequences
  Synthetic
ttggatttgttgttgttgtcggtcggga

SEQ ID NO: 7755 - DNA, 27 bp, Artificial Sequences
  Synthetic
cgcggtcgggttagtagtaggtaggtt

SEQ ID NO: 7756 - DNA, 27 bp, Artificial Sequences
  Synthetic
gagcgcgggtagtcgatttttgtgttt

SEQ ID NO: 7757 - DNA, 26 bp, Artificial Sequences
  Synthetic
cgcggtcgggttagtagtaggtaggt

SEQ ID NO: 7758 - DNA, 26 bp, Artificial Sequences
  Synthetic
gagcgcgggtagtcgatttttgtgtt

SEQ ID NO: 7759 - DNA, 28 bp, Artificial Sequences
  Synthetic
gagcgcgggtagtcgatttttgtgttta

SEQ ID NO: 7760 - DNA, 27 bp, Artificial Sequences
  Synthetic
tgttgttgttgtcggtcgggattacgc

SEQ ID NO: 7761 - DNA, 27 bp, Artificial Sequences
  Synthetic
tggatttgttgttgttgtcggtcggga

SEQ ID NO: 7762 - DNA, 28 bp, Artificial Sequences
  Synthetic
ttgttgttgttgtcggtcgggattacgc

SEQ ID NO: 7763 - DNA, 27 bp, Artificial Sequences
  Synthetic
ttggatttgttgttgttgtcggtcggg

SEQ ID NO: 7764 - DNA, 28 bp, Artificial Sequences
  Synthetic
ttggatttgttgttgttgtcggtcggga

SEQ ID NO: 7765 - DNA, 33 bp, Artificial Sequences
  Synthetic
tgtttgtgagttggtgtagaggtaagtttgagt

SEQ ID NO: 7766 - DNA, 34 bp, Artificial Sequences
  Synthetic
ttgtttgtgagttggtgtagaggtaagtttgagt

SEQ ID NO: 7767 - DNA, 35 bp, Artificial Sequences
  Synthetic
tttgtttgtgagttggtgtagaggtaagtttgagt

SEQ ID NO: 7768 - DNA, 35 bp, Artificial Sequences
  Synthetic
ttgtttgtgagttggtgtagaggtaagtttgagta

SEQ ID NO: 7769 - DNA, 36 bp, Artificial Sequences
  Synthetic
ttttgtttgtgagttggtgtagaggtaagtttgagt

SEQ ID NO: 7770 - DNA, 29 bp, Artificial Sequences
  Synthetic
cgttggagatggaggaataggaagtgggt

SEQ ID NO: 7771 - DNA, 28 bp, Artificial Sequences
  Synthetic
cgttggagatggaggaataggaagtggg

SEQ ID NO: 7772 - DNA, 30 bp, Artificial Sequences
  Synthetic
tcgttggagatggaggaataggaagtgggt

SEQ ID NO: 7773 - DNA, 29 bp, Artificial Sequences
  Synthetic
tcgttggagatggaggaataggaagtggg

SEQ ID NO: 7774 - DNA, 29 bp, Artificial Sequences
  Synthetic
tggagatggaggaataggaagtgggtagg

SEQ ID NO: 7775 - DNA, 27 bp, Artificial Sequences
  Synthetic
tagtagaagaagcgtgggttggggcgg

SEQ ID NO: 7776 - DNA, 27 bp, Artificial Sequences
  Synthetic
tagaagaagcgtgggttggggcggaac

SEQ ID NO: 7777 - DNA, 27 bp, Artificial Sequences
  Synthetic
gtagaagaagcgtgggttggggcggaa

SEQ ID NO: 7778 - DNA, 27 bp, Artificial Sequences
  Synthetic
tttcgcggcgtttttatcggtgttggc

SEQ ID NO: 7779 - DNA, 26 bp, Artificial Sequences
  Synthetic
tagaagaagcgtgggttggggcggaa

SEQ ID NO: 7780 - DNA, 27 bp, Artificial Sequences
  Synthetic
gaggttatgcgcgtcggggtgttgttt

SEQ ID NO: 7781 - DNA, 27 bp, Artificial Sequences
  Synthetic
aggttatgcgcgtcggggtgttgtttt

SEQ ID NO: 7782 - DNA, 28 bp, Artificial Sequences
  Synthetic
gaggttatgcgcgtcggggtgttgtttt

SEQ ID NO: 7783 - DNA, 27 bp, Artificial Sequences
  Synthetic
ggttatgcgcgtcggggtgttgttttt

SEQ ID NO: 7784 - DNA, 26 bp, Artificial Sequences
  Synthetic
gaggttatgcgcgtcggggtgttgtt

SEQ ID NO: 7785 - DNA, 27 bp, Artificial Sequences
  Synthetic
tagtagaagaagcgtgggttggggcgg

SEQ ID NO: 7786 - DNA, 27 bp, Artificial Sequences
  Synthetic
cgggggtagtatttcggcgcgtatggt

SEQ ID NO: 7787 - DNA, 27 bp, Artificial Sequences
  Synthetic
tagaagaagcgtgggttggggcggaac

SEQ ID NO: 7788 - DNA, 27 bp, Artificial Sequences
  Synthetic
gtagaagaagcgtgggttggggcggaa

SEQ ID NO: 7789 - DNA, 27 bp, Artificial Sequences
  Synthetic
tttcgcggcgtttttatcggtgttggc

SEQ ID NO: 7790 - DNA, 27 bp, Artificial Sequences
  Synthetic
agttgtagtttggttcggacgcgtttt

SEQ ID NO: 7791 - DNA, 30 bp, Artificial Sequences
  Synthetic
gcgttcggttagtttttatcgtttcgggcg

SEQ ID NO: 7792 - DNA, 30 bp, Artificial Sequences
  Synthetic
cgcgttcggttagtttttatcgtttcgggc

SEQ ID NO: 7793 - DNA, 31 bp, Artificial Sequences
  Synthetic
gcgttcggttagtttttatcgtttcgggcgt

SEQ ID NO: 7794 - DNA, 31 bp, Artificial Sequences
  Synthetic
cgcgttcggttagtttttatcgtttcgggcg

SEQ ID NO: 7795 - DNA, 27 bp, Artificial Sequences
  Synthetic
tagtagaagaagcgtgggttggggcgg

SEQ ID NO: 7796 - DNA, 27 bp, Artificial Sequences
  Synthetic
cgggggtagtatttcggcgcgtatggt

SEQ ID NO: 7797 - DNA, 27 bp, Artificial Sequences
  Synthetic
tagaagaagcgtgggttggggcggaac

SEQ ID NO: 7798 - DNA, 27 bp, Artificial Sequences
  Synthetic
gtagaagaagcgtgggttggggcggaa

SEQ ID NO: 7799 - DNA, 27 bp, Artificial Sequences
  Synthetic
tttcgcggcgtttttatcggtgttggc

SEQ ID NO: 7800 - DNA, 27 bp, Artificial Sequences
  Synthetic
agttgtagtttggttcggacgcgtttt

SEQ ID NO: 7801 - DNA, 30 bp, Artificial Sequences; identical to SEQ ID NO: 7791
  Synthetic

SEQ ID NO: 7802 - DNA, 30 bp, Artificial Sequences; identical to SEQ ID NO: 7792
  Synthetic

SEQ ID NO: 7803 - DNA, 31 bp, Artificial Sequences; identical to SEQ ID NO: 7793
  Synthetic

SEQ ID NO: 7804 - DNA, 31 bp, Artificial Sequences; identical to SEQ ID NO: 7794
  Synthetic

SEQ ID NO: 7805 - DNA, 27 bp, Artificial Sequences
  Synthetic
cgggggtagtatttcggcgcgtatggt

SEQ ID NO: 7806 - DNA, 27 bp, Artificial Sequences
  Synthetic
tttcgcggcgtttttatcggtgttggc

SEQ ID NO: 7807 - DNA, 27 bp, Artificial Sequences
  Synthetic
gcgggggtagtatttcggcgcgtatgg

SEQ ID NO: 7808 - DNA, 27 bp, Artificial Sequences
  Synthetic
gggtttcgcggcgtttttatcggtgtt

SEQ ID NO: 7809 - DNA, 26 bp, Artificial Sequences
  Synthetic
gcgtttttatcggtgttggcgtggcg

SEQ ID NO: 7810 - DNA, 27 bp, Artificial Sequences
  Synthetic
gcgtgcgttggtgggtttcggtttttc

SEQ ID NO: 7811 - DNA, 27 bp, Artificial Sequences
  Synthetic
cgtgcgttggtgggtttcggtttttcg

SEQ ID NO: 7812 - DNA, 27 bp, Artificial Sequences
  Synthetic
ggcgtgcgttggtgggtttcggttttt

SEQ ID NO: 7813 - DNA, 27 bp, Artificial Sequences
  Synthetic
gtgcgttggtgggtttcggtttttcgt

SEQ ID NO: 7814 - DNA, 27 bp, Artificial Sequences
  Synthetic
tgcgttggtgggtttcggtttttcgtt

SEQ ID NO: 7815 - DNA, 27 bp, Artificial Sequences
  Synthetic
cgggggtagtatttcggcgcgtatggt

SEQ ID NO: 7816 - DNA, 27 bp, Artificial Sequences
  Synthetic
gcgggggtagtatttcggcgcgtatgg

SEQ ID NO: 7817 - DNA, 28 bp, Artificial Sequences
  Synthetic
cgggggtagtatttcggcgcgtatggtt

SEQ ID NO: 7818 - DNA, 27 bp, Artificial Sequences
  Synthetic
gggggtagtatttcggcgcgtatggtt

SEQ ID NO: 7819 - DNA, 26 bp, Artificial Sequences
  Synthetic
gcgggggtagtatttcggcgcgtatg

SEQ ID NO: 7820 - DNA, 27 bp, Artificial Sequences
  Synthetic
gcgtgcgttggtgggtttcggtttttc

SEQ ID NO: 7821 - DNA, 27 bp, Artificial Sequences
  Synthetic
cgtgcgttggtgggtttcggtttttcg

SEQ ID NO: 7822 - DNA, 27 bp, Artificial Sequences
  Synthetic
ggcgtgcgttggtgggtttcggttttt

SEQ ID NO: 7823 - DNA, 27 bp, Artificial Sequences
  Synthetic
gtgcgttggtgggtttcggtttttcgt

SEQ ID NO: 7824 - DNA, 27 bp, Artificial Sequences
  Synthetic
tgcgttggtgggtttcggtttttcgtt

SEQ ID NO: 7825 - DNA, 27 bp, Artificial Sequences
  Synthetic
ttgcggggcggagagtcgggatttatt

SEQ ID NO: 7826 - DNA, 27 bp, Artificial Sequences
  Synthetic
gttgcggggcggagagtcgggatttat

SEQ ID NO: 7827 - DNA, 27 bp, Artificial Sequences
  Synthetic
tgcggggcggagagtcgggatttatta

SEQ ID NO: 7828 - DNA, 26 bp, Artificial Sequences
  Synthetic
tgcggggcggagagtcgggatttatt

SEQ ID NO: 7829 - DNA, 26 bp, Artificial Sequences
  Synthetic
ttgcggggcggagagtcgggatttat

SEQ ID NO: 7830 - DNA, 22 bp, Artificial Sequences
  Synthetic
gcggcgtgcgttggtgggtttt

SEQ ID NO: 7831 - DNA, 29 bp, Artificial Sequences
  Synthetic
tggataattacgtggtagggttcgggttc

SEQ ID NO: 7832 - DNA, 21 bp, Artificial Sequences
  Synthetic
gcggcgtgcgttggtgggttt

SEQ ID NO: 7833 - DNA, 24 bp, Artificial Sequences
  Synthetic
cgtggtggtggacgtggatttgac

SEQ ID NO: 7834 - DNA, 30 bp, Artificial Sequences
  Synthetic
atggataattacgtggtagggttcgggttc

SEQ ID NO: 7835 - DNA, 27 bp, Artificial Sequences
  Synthetic
ttgcggggcggagagtcgggatttatt

SEQ ID NO: 7836 - DNA, 27 bp, Artificial Sequences
  Synthetic
gttgcggggcggagagtcgggatttat

SEQ ID NO: 7837 - DNA, 27 bp, Artificial Sequences
  Synthetic
tgcggggcggagagtcgggatttatta

SEQ ID NO: 7838 - DNA, 26 bp, Artificial Sequences
  Synthetic
tgcggggcggagagtcgggatttatt

SEQ ID NO: 7839 - DNA, 26 bp, Artificial Sequences
  Synthetic
ttgcggggcggagagtcgggatttat

SEQ ID NO: 7840 - DNA, 21 bp, Artificial Sequences
  Synthetic
cgggagtcgtcggtgcggtcg

SEQ ID NO: 7841 - DNA, 21 bp, Artificial Sequences
  Synthetic
ggagtcgtcggtgcggtcggg

SEQ ID NO: 7842 - DNA, 21 bp, Artificial Sequences
  Synthetic
gggagtcgtcggtgcggtcgg

SEQ ID NO: 7843 - DNA, 21 bp, Artificial Sequences
  Synthetic
gagtcgtcggtgcggtcgggc

SEQ ID NO: 7844 - DNA, 22 bp, Artificial Sequences
  Synthetic
gggagtcgtcggtgcggtcggg

SEQ ID NO: 7845 - DNA, 27 bp, Artificial Sequences
  Synthetic
gggttagcgattcgttgttgggtgtcg

SEQ ID NO: 7846 - DNA, 28 bp, Artificial Sequences
  Synthetic
agggttagcgattcgttgttgggtgtcg

SEQ ID NO: 7847 - DNA, 27 bp, Artificial Sequences
  Synthetic
agggttagcgattcgttgttgggtgtc

SEQ ID NO: 7848 - DNA, 25 bp, Artificial Sequences
  Synthetic
cgattcgttgttgggtgtcgcgggc

SEQ ID NO: 7849 - DNA, 29 bp, Artificial Sequences
  Synthetic
tagggttagcgattcgttgttgggtgtcg

SEQ ID NO: 7850 - DNA, 21 bp, Artificial Sequences
  Synthetic
cgggagtcgtcggtgcggtcg

SEQ ID NO: 7851 - DNA, 21 bp, Artificial Sequences
  Synthetic
ggagtcgtcggtgcggtcggg

SEQ ID NO: 7852 - DNA, 21 bp, Artificial Sequences
  Synthetic
gggagtcgtcggtgcggtcgg

SEQ ID NO: 7853 - DNA, 21 bp, Artificial Sequences
  Synthetic
gagtcgtcggtgcggtcgggc

SEQ ID NO: 7854 - DNA, 22 bp, Artificial Sequences
  Synthetic
gggagtcgtcggtgcggtcggg

SEQ ID NO: 7855 - DNA, 27 bp, Artificial Sequences
  Synthetic
gggttagcgattcgttgttgggtgtcg

SEQ ID NO: 7856 - DNA, 28 bp, Artificial Sequences
  Synthetic
agggttagcgattcgttgttgggtgtcg

SEQ ID NO: 7857 - DNA, 27 bp, Artificial Sequences
  Synthetic
agggttagcgattcgttgttgggtgtc

SEQ ID NO: 7858 - DNA, 25 bp, Artificial Sequences
  Synthetic
cgattcgttgttgggtgtcgcgggc

SEQ ID NO: 7859 - DNA, 29 bp, Artificial Sequences
  Synthetic
tagggttagcgattcgttgttgggtgtcg

SEQ ID NO: 7860 - DNA, 31 bp, Artificial Sequences
  Synthetic
agcggttgggggtttattttttaggttttgt

SEQ ID NO: 7861 - DNA, 33 bp, Artificial Sequences
  Synthetic
gcggttgggggtttattttttaggttttgttcg

SEQ ID NO: 7862 - DNA, 34 bp, Artificial Sequences
  Synthetic
gcggttgggggtttattttttaggttttgttcgt

SEQ ID NO: 7863 - DNA, 32 bp, Artificial Sequences
  Synthetic
agcggttgggggtttattttttaggttttgtt

SEQ ID NO: 7864 - DNA, 34 bp, Artificial Sequences
  Synthetic
agcggttgggggtttattttttaggttttgttcg

SEQ ID NO: 7865 - DNA, 27 bp, Artificial Sequences
  Synthetic
tttaggcggaaggttttggcgcggttt

SEQ ID NO: 7866 - DNA, 27 bp, Artificial Sequences
  Synthetic
ttttaggcggaaggttttggcgcggtt

SEQ ID NO: 7867 - DNA, 27 bp, Artificial Sequences
  Synthetic
agttttaggcggaaggttttggcgcgg

SEQ ID NO: 7868 - DNA, 27 bp, Artificial Sequences
  Synthetic
ttaggcggaaggttttggcgcggtttg

SEQ ID NO: 7869 - DNA, 27 bp, Artificial Sequences
  Synthetic
gttttaggcggaaggttttggcgcggt

SEQ ID NO: 7870 - DNA, 27 bp, Artificial Sequences
  Synthetic
ggaagtggggatggggggttgttcgtt

SEQ ID NO: 7871 - DNA, 27 bp, Artificial Sequences
  Synthetic
gaagtggggatggggggttgttcgttt

SEQ ID NO: 7872 - DNA, 27 bp, Artificial Sequences
  Synthetic
agtggggatggggggttgttcgttttt

SEQ ID NO: 7873 - DNA, 27 bp, Artificial Sequences
  Synthetic
aagtggggatggggggttgttcgtttt

SEQ ID NO: 7874 - DNA, 26 bp, Artificial Sequences
  Synthetic
ggaagtggggatggggggttgttcgt

SEQ ID NO: 7875 - DNA, 27 bp, Artificial Sequences
  Synthetic
aggttatcgggaggcgtcgtgtttttt

SEQ ID NO: 7876 - DNA, 27 bp, Artificial Sequences
  Synthetic
taggttatcgggaggcgtcgtgttttt

SEQ ID NO: 7877 - DNA, 27 bp, Artificial Sequences
  Synthetic
ttaggttatcgggaggcgtcgtgtttt

SEQ ID NO: 7878 - DNA, 27 bp, Artificial Sequences
  Synthetic
tttaggttatcgggaggcgtcgtgttt

SEQ ID NO: 7879 - DNA, 27 bp, Artificial Sequences
  Synthetic
ttttaggttatcgggaggcgtcgtgtt

SEQ ID NO: 7880 - DNA, 35 bp, Artificial Sequences
  Synthetic
gggggaaagtttgtgtgagtagatagtattgtggg

SEQ ID NO: 7881 - DNA, 34 bp, Artificial Sequences
  Synthetic
ggggaaagtttgtgtgagtagatagtattgtggg

SEQ ID NO: 7882 - DNA, 34 bp, Artificial Sequences
  Synthetic
gggggaaagtttgtgtgagtagatagtattgtgg

SEQ ID NO: 7883 - DNA, 36 bp, Artificial Sequences
  Synthetic
agggggaaagtttgtgtgagtagatagtattgtggg

SEQ ID NO: 7884 - DNA, 36 bp, Artificial Sequences
  Synthetic
gggggaaagtttgtgtgagtagatagtattgtggga

SEQ ID NO: 7885 - DNA, 29 bp, Artificial Sequences
  Synthetic
cgcgtagttaagggtagtttcggggaggg

SEQ ID NO: 7886 - DNA, 28 bp, Artificial Sequences
  Synthetic
cgcgtagttaagggtagtttcggggagg

SEQ ID NO: 7887 - DNA, 29 bp, Artificial Sequences
  Synthetic
gcgtagttaagggtagtttcggggagggt

SEQ ID NO: 7888 - DNA, 28 bp, Artificial Sequences
  Synthetic
gcgtagttaagggtagtttcggggaggg

SEQ ID NO: 7889 - DNA, 27 bp, Artificial Sequences
  Synthetic
aggggatttgaagttagttgagcgcgt

SEQ ID NO: 7890 - DNA, 27 bp, Artificial Sequences
  Synthetic
cgagagagagagcgcgcgtttagttgg

SEQ ID NO: 7891 - DNA, 27 bp, Artificial Sequences
  Synthetic
tcggggttgtttttggttgcgcgtttt

SEQ ID NO: 7892 - DNA, 27 bp, Artificial Sequences
  Synthetic
ttcggggttgtttttggttgcgcgttt

SEQ ID NO: 7893 - DNA, 27 bp, Artificial Sequences
  Synthetic
tttcggggttgtttttggttgcgcgtt

SEQ ID NO: 7894 - DNA, 27 bp, Artificial Sequences
  Synthetic
ttttcggggttgtttttggttgcgcgt

SEQ ID NO: 7895 - DNA, 27 bp, Artificial Sequences
  Synthetic
gtttgggagatggggcgttcgttcgtg

SEQ ID NO: 7896 - DNA, 27 bp, Artificial Sequences
  Synthetic
aggagttcgtttgggagatggggcgtt

SEQ ID NO: 7897 - DNA, 27 bp, Artificial Sequences
  Synthetic
gaggagttcgtttgggagatggggcgt

SEQ ID NO: 7898 - DNA, 27 bp, Artificial Sequences
  Synthetic
tttgggagatggggcgttcgttcgtga

SEQ ID NO: 7899 - DNA, 27 bp, Artificial Sequences
  Synthetic
agttcgtttgggagatggggcgttcgt

SEQ ID NO: 7900 - DNA, 27 bp, Artificial Sequences
  Synthetic
gttacggaggagaagttgggggtgggg

SEQ ID NO: 7901 - DNA, 27 bp, Artificial Sequences
  Synthetic
gagttaggtagaggaggcggcggttcg

SEQ ID NO: 7902 - DNA, 27 bp, Artificial Sequences
  Synthetic
ggagttaggtagaggaggcggcggttc

SEQ ID NO: 7903 - DNA, 27 bp, Artificial Sequences
  Synthetic
ttttcgaacgaggcgggtagggagagg

SEQ ID NO: 7904 - DNA, 27 bp, Artificial Sequences
  Synthetic
tgggggtgggggatttaggaattgcgg

SEQ ID NO: 7905 - DNA, 27 bp, Artificial Sequences
  Synthetic
agcggcgtttgagttcggatgtttcgg

SEQ ID NO: 7906 - DNA, 27 bp, Artificial Sequences
  Synthetic
cggagcggcgtttgagttcggatgttt

SEQ ID NO: 7907 - DNA, 27 bp, Artificial Sequences
  Synthetic
ttttcgtttgtagttcggtgcgcgggg

SEQ ID NO: 7908 - DNA, 27 bp, Artificial Sequences
  Synthetic
cgcggggtgtttttgttgttggagggt

SEQ ID NO: 7909 - DNA, 27 bp, Artificial Sequences
  Synthetic
cgtagtgggaggaacggtttggagggg

SEQ ID NO: 7910 - DNA, 27 bp, Artificial Sequences
  Synthetic
ttttgtagttcggtgggtttcgcggcg

SEQ ID NO: 7911 - DNA, 27 bp, Artificial Sequences
  Synthetic
gtagttcggtgggtttcgcggcgtttt

SEQ ID NO: 7912 - DNA, 27 bp, Artificial Sequences
  Synthetic
agttcggtgggtttcgcggcgttttta

SEQ ID NO: 7913 - DNA, 27 bp, Artificial Sequences
  Synthetic
tagttcggtgggtttcgcggcgttttt

SEQ ID NO: 7914 - DNA, 27 bp, Artificial Sequences
  Synthetic
cggtgggtttcgcggcgtttttattcg

SEQ ID NO: 7915 - DNA, 27 bp, Artificial Sequences
  Synthetic
gaggggcggatgggttttaggtagggg

SEQ ID NO: 7916 - DNA, 27 bp, Artificial Sequences
  Synthetic
ggggcggatgggttttaggtaggggtt

SEQ ID NO: 7917 - DNA, 27 bp, Artificial Sequences
  Synthetic
cgtagtgggaggaacggtttggagggg

SEQ ID NO: 7918 - DNA, 27 bp, Artificial Sequences
  Synthetic
agtgggaggaacggtttggaggggaag

SEQ ID NO: 7919 - DNA, 27 bp, Artificial Sequences
  Synthetic
ggaaggagtttggttggacgttgcggt

SEQ ID NO: 7920 - DNA, 28 bp, Artificial Sequences
  Synthetic
cgcgttttgaggtagaggagtggttgcg

SEQ ID NO: 7921 - DNA, 28 bp, Artificial Sequences
  Synthetic
gcgttttgaggtagaggagtggttgcgt

SEQ ID NO: 7922 - DNA, 27 bp, Artificial Sequences
  Synthetic
gcgttttgaggtagaggagtggttgcg

SEQ ID NO: 7923 - DNA, 27 bp, Artificial Sequences
  Synthetic
cgcgttttgaggtagaggagtggttgc

SEQ ID NO: 7924 - DNA, 28 bp, Artificial Sequences
  Synthetic
tcgcgttttgaggtagaggagtggttgc

SEQ ID NO: 7925 - DNA, 29 bp, Artificial Sequences
  Synthetic
gcgttttatttgggtgattatcgcggggc

SEQ ID NO: 7926 - DNA, 28 bp, Artificial Sequences
  Synthetic
cgttttatttgggtgattatcgcggggc

SEQ ID NO: 7927 - DNA, 28 bp, Artificial Sequences
  Synthetic
gcgttttatttgggtgattatcgcgggg

SEQ ID NO: 7928 - DNA, 30 bp, Artificial Sequences
  Synthetic
agaagggtttggcgttttatttgggtgatt

SEQ ID NO: 7929 - DNA, 31 bp, Artificial Sequences
  Synthetic
agggtttggcgttttatttgggtgattatcg

SEQ ID NO: 7930 - DNA, 27 bp, Artificial Sequences
  Synthetic
atggcgttgggtttggttgcggtgatt

SEQ ID NO: 7931 - DNA, 27 bp, Artificial Sequences
  Synthetic
ggtgattgatggcgcgcgttgtagagg

SEQ ID NO: 7932 - DNA, 27 bp, Artificial Sequences
  Synthetic
cgggagaagggataggagcggcgtttt

SEQ ID NO: 7933 - DNA, 27 bp, Artificial Sequences
  Synthetic
cggtgattgatggcgcgcgttgtagag

SEQ ID NO: 7934 - DNA, 27 bp, Artificial Sequences
  Synthetic
tgggtttggttgcggtgattgatggcg

SEQ ID NO: 7935 - DNA, 27 bp, Artificial Sequences
  Synthetic
gcgaggatagcggcggattgtagtagc

SEQ ID NO: 7936 - DNA, 27 bp, Artificial Sequences
  Synthetic
cgaggatagcggcggattgtagtagcg

SEQ ID NO: 7937 - DNA, 28 bp, Artificial Sequences
  Synthetic
cgaggatagcggcggattgtagtagcgt

SEQ ID NO: 7938 - DNA, 28 bp, Artificial Sequences
  Synthetic
gcgaggatagcggcggattgtagtagcg

SEQ ID NO: 7939 - DNA, 27 bp, Artificial Sequences
  Synthetic
gaggatagcggcggattgtagtagcgt

SEQ ID NO: 7940 - DNA, 28 bp, Artificial Sequences
  Synthetic
ggggtcgaggagagagagaagtatcgcg

SEQ ID NO: 7941 - DNA, 29 bp, Artificial Sequences
  Synthetic
ggggtcgaggagagagagaagtatcgcgt

SEQ ID NO: 7942 - DNA, 28 bp, Artificial Sequences
  Synthetic
gggtcgaggagagagagaagtatcgcgt

SEQ ID NO: 7943 - DNA, 27 bp, Artificial Sequences
  Synthetic
gggtcgaggagagagagaagtatcgcg

SEQ ID NO: 7944 - DNA, 27 bp, Artificial Sequences
  Synthetic
ggggtcgaggagagagagaagtatcgc

SEQ ID NO: 7945 - DNA, 27 bp, Artificial Sequences
  Synthetic
acgtgtttttcggaagcggagttgtgg

SEQ ID NO: 7946 - DNA, 28 bp, Artificial Sequences
  Synthetic
acgtgtttttcggaagcggagttgtgga

SEQ ID NO: 7947 - DNA, 27 bp, Artificial Sequences
  Synthetic
cgtgtttttcggaagcggagttgtgga

SEQ ID NO: 7948 - DNA, 28 bp, Artificial Sequences
  Synthetic
cgtgtttttcggaagcggagttgtggat

SEQ ID NO: 7949 - DNA, 29 bp, Artificial Sequences
  Synthetic
acgtgtttttcggaagcggagttgtggat

SEQ ID NO: 7950 - DNA, 27 bp, Artificial Sequences
  Synthetic
tttttattggggcgcgggttggtggtt

SEQ ID NO: 7951 - DNA, 27 bp, Artificial Sequences
  Synthetic
ttttattggggcgcgggttggtggttg

SEQ ID NO: 7952 - DNA, 27 bp, Artificial Sequences
  Synthetic
gtttttattggggcgcgggttggtggt

SEQ ID NO: 7953 - DNA, 27 bp, Artificial Sequences
  Synthetic
gcgggtataagcgggcgtgagaaatcg

SEQ ID NO: 7954 - DNA, 27 bp, Artificial Sequences
  Synthetic
tgttgggtcgcggggtttttattgggg

SEQ ID NO: 7955 - DNA, 27 bp, Artificial Sequences
  Synthetic
cggagggcgcgggtagaaaagttttcg

SEQ ID NO: 7956 - DNA, 27 bp, Artificial Sequences
  Synthetic
agacggagggcgcgggtagaaaagttt

SEQ ID NO: 7957 - DNA, 27 bp, Artificial Sequences
  Synthetic
gtagacggagggcgcgggtagaaaagt

SEQ ID NO: 7958 - DNA, 27 bp, Artificial Sequences
  Synthetic
gggagtcgaggagttgttggggtcgtt

SEQ ID NO: 7959 - DNA, 27 bp, Artificial Sequences
  Synthetic
gggttgcggggaggaggaagttacgag

SEQ ID NO: 7960 - DNA, 27 bp, Artificial Sequences
  Synthetic
gtgttaggagcgtgcgttttgggtgcg

SEQ ID NO: 7961 - DNA, 27 bp, Artificial Sequences
  Synthetic
cgtgttaggagcgtgcgttttgggtgc

SEQ ID NO: 7962 - DNA, 26 bp, Artificial Sequences
  Synthetic
tgttaggagcgtgcgttttgggtgcg

SEQ ID NO: 7963 - DNA, 26 bp, Artificial Sequences
  Synthetic
gtgttaggagcgtgcgttttgggtgc

SEQ ID NO: 7964 - DNA, 25 bp, Artificial Sequences
  Synthetic
gttaggagcgtgcgttttgggtgcg

SEQ ID NO: 7965 - DNA, 27 bp, Artificial Sequences
  Synthetic
ggtttggtttcgcgtttgggttggtcg

SEQ ID NO: 7966 - DNA, 27 bp, Artificial Sequences
  Synthetic
gtttggtttcgcgtttgggttggtcgt

SEQ ID NO: 7967 - DNA, 28 bp, Artificial Sequences
  Synthetic
aggtttggtttcgcgtttgggttggtcg

SEQ ID NO: 7968 - DNA, 28 bp, Artificial Sequences
  Synthetic
ggtttggtttcgcgtttgggttggtcgt

SEQ ID NO: 7969 - DNA, 27 bp, Artificial Sequences
  Synthetic
aggtttggtttcgcgtttgggttggtc

SEQ ID NO: 7970 - DNA, 27 bp, Artificial Sequences
  Synthetic
ttattttggttttgagggggcggcggg

SEQ ID NO: 7971 - DNA, 28 bp, Artificial Sequences
  Synthetic
attattttggttttgagggggcggcggg

SEQ ID NO: 7972 - DNA, 26 bp, Artificial Sequences
  Synthetic
tattttggttttgagggggcggcggg

SEQ ID NO: 7973 - DNA, 27 bp, Artificial Sequences
  Synthetic
tattttggttttgagggggcggcgggg

SEQ ID NO: 7974 - DNA, 27 bp, Artificial Sequences
  Synthetic
attattttggttttgagggggcggcgg

SEQ ID NO: 7975 - DNA, 27 bp, Artificial Sequences
  Synthetic
cgcggggtaggaaggttcgggaagttt

SEQ ID NO: 7976 - DNA, 27 bp, Artificial Sequences
  Synthetic
gttttacggcgcggggtaggaaggttc

SEQ ID NO: 7977 - DNA, 27 bp, Artificial Sequences
  Synthetic
ttttacggcgcggggtaggaaggttcg

SEQ ID NO: 7978 - DNA, 27 bp, Artificial Sequences
  Synthetic
ggttttacggcgcggggtaggaaggtt

SEQ ID NO: 7979 - DNA, 27 bp, Artificial Sequences
  Synthetic
gtgggttttacggcgcggggtaggaag

SEQ ID NO: 7980 - DNA, 27 bp, Artificial Sequences
  Synthetic
gtatttaggttgtgcgcgcgggtgtgt

SEQ ID NO: 7981 - DNA, 27 bp, Artificial Sequences
  Synthetic
ttattttggttttgagggggcggcggg

SEQ ID NO: 7982 - DNA, 27 bp, Artificial Sequences
  Synthetic
gggggtcggaggaggaggtttggtttg

SEQ ID NO: 7983 - DNA, 27 bp, Artificial Sequences
  Synthetic
ggtatttaggttgtgcgcgcgggtgtg

SEQ ID NO: 7984 - DNA, 27 bp, Artificial Sequences
  Synthetic
gtggtatttaggttgtgcgcgcgggtg

SEQ ID NO: 7985 - DNA, 30 bp, Artificial Sequences
  Synthetic
tcgcgcgttttttgtttttatttggttcga

SEQ ID NO: 7986 - DNA, 31 bp, Artificial Sequences
  Synthetic
cgcgcgttttttgtttttatttggttcgagt

SEQ ID NO: 7987 - DNA, 31 bp, Artificial Sequences
  Synthetic
tcgcgcgttttttgtttttatttggttcgag

SEQ ID NO: 7988 - DNA, 32 bp, Artificial Sequences
  Synthetic
tcgcgcgttttttgtttttatttggttcgagt

SEQ ID NO: 7989 - DNA, 31 bp, Artificial Sequences
  Synthetic
cggttttcgcgcgttttttgtttttatttgg

SEQ ID NO: 7990 - DNA, 27 bp, Artificial Sequences
  Synthetic
gcggtaggagggattcggggttagtcg

SEQ ID NO: 7991 - DNA, 27 bp, Artificial Sequences
  Synthetic
ggcggtaggagggattcggggttagtc

SEQ ID NO: 7992 - DNA, 27 bp, Artificial Sequences
  Synthetic
gggggtcggaggaggaggtttggtttg

SEQ ID NO: 7993 - DNA, 27 bp, Artificial Sequences
  Synthetic
tttggtttgcgggcggtaggagggatt

SEQ ID NO: 7994 - DNA, 27 bp, Artificial Sequences
  Synthetic
ttggtttgcgggcggtaggagggattc

SEQ ID NO: 7995 - DNA, 27 bp, Artificial Sequences
  Synthetic
agcggggattcgggaggagagttagga

SEQ ID NO: 7996 - DNA, 27 bp, Artificial Sequences
  Synthetic
gcggggattcgggaggagagttaggag

SEQ ID NO: 7997 - DNA, 28 bp, Artificial Sequences
  Synthetic
agcggggattcgggaggagagttaggag

SEQ ID NO: 7998 - DNA, 28 bp, Artificial Sequences
  Synthetic
gcggggattcgggaggagagttaggagt

SEQ ID NO: 7999 - DNA, 27 bp, Artificial Sequences
  Synthetic
tagcggggattcgggaggagagttagg

SEQ ID NO: 8000 - DNA, 28 bp, Artificial Sequences
  Synthetic
cggggttagtcgaggttgtttttaggga

SEQ ID NO: 8001 - DNA, 28 bp, Artificial Sequences
  Synthetic
tcggggttagtcgaggttgtttttaggg

SEQ ID NO: 8002 - DNA, 30 bp, Artificial Sequences
  Synthetic
cggggttagtcgaggttgtttttagggagg

SEQ ID NO: 8003 - DNA, 29 bp, Artificial Sequences
  Synthetic
tcggggttagtcgaggttgtttttaggga

SEQ ID NO: 8004 - DNA, 31 bp, Artificial Sequences
  Synthetic
cggggttagtcgaggttgtttttagggaggt

SEQ ID NO: 8005 - DNA, 27 bp, Artificial Sequences
  Synthetic
agcggggattcgggaggagagttagga

SEQ ID NO: 8006 - DNA, 27 bp, Artificial Sequences
  Synthetic
gagtcgggcgaggttggtggagatagg

SEQ ID NO: 8007 - DNA, 27 bp, Artificial Sequences
  Synthetic
ggagtcgggcgaggttggtggagatag

SEQ ID NO: 8008 - DNA, 27 bp, Artificial Sequences
  Synthetic
agtcgggcgaggttggtggagatagga

SEQ ID NO: 8009 - DNA, 27 bp, Artificial Sequences
  Synthetic
tgggatttagcggggattcgggaggag

SEQ ID NO: 8010 - DNA, 27 bp, Artificial Sequences
  Synthetic
agaggaggggtgggagtcgttttaggt

SEQ ID NO: 8011 - DNA, 28 bp, Artificial Sequences
  Synthetic
cgcgttgttttagtagaggaggggtggg

SEQ ID NO: 8012 - DNA, 27 bp, Artificial Sequences
  Synthetic
gaggaggggtgggagtcgttttaggtt

SEQ ID NO: 8013 - DNA, 28 bp, Artificial Sequences
  Synthetic
agaggaggggtgggagtcgttttaggtt

SEQ ID NO: 8014 - DNA, 29 bp, Artificial Sequences
  Synthetic
cgcgttgttttagtagaggaggggtggga

SEQ ID NO: 8015 - DNA, 27 bp, Artificial Sequences
  Synthetic
gcgcgggtttaggtagtagggagtcgg

SEQ ID NO: 8016 - DNA, 27 bp, Artificial Sequences
  Synthetic
cgcgggtttaggtagtagggagtcggg

SEQ ID NO: 8017 - DNA, 27 bp, Artificial Sequences
  Synthetic
agcgcgggtttaggtagtagggagtcg

SEQ ID NO: 8018 - DNA, 27 bp, Artificial Sequences
  Synthetic
gggaggtgggtttggggcggtttttat

SEQ ID NO: 8019 - DNA, 27 bp, Artificial Sequences
  Synthetic
ggggaggtgggtttggggcggttttta

SEQ ID NO: 8020 - DNA, 27 bp, Artificial Sequences
  Synthetic
cggggttgagggcgaggagggttttat

SEQ ID NO: 8021 - DNA, 27 bp, Artificial Sequences
  Synthetic
gcgggatttggatagtcggggagtcgt

SEQ ID NO: 8022 - DNA, 27 bp, Artificial Sequences
  Synthetic
gtcgcgggatttggatagtcggggagt

SEQ ID NO: 8023 - DNA, 27 bp, Artificial Sequences
  Synthetic
aatttgggagaggtcgggggaggttcg

SEQ ID NO: 8024 - DNA, 27 bp, Artificial Sequences
  Synthetic
ggtcgcgggatttggatagtcggggag

SEQ ID NO: 8025 - DNA, 27 bp, Artificial Sequences
  Synthetic
cgggcgggtaggaagcgggttttttag

SEQ ID NO: 8026 - DNA, 27 bp, Artificial Sequences
  Synthetic
gcgggcgggtaggaagcgggtttttta

SEQ ID NO: 8027 - DNA, 28 bp, Artificial Sequences
  Synthetic
gggcgggtaggaagcgggttttttagtc

SEQ ID NO: 8028 - DNA, 26 bp, Artificial Sequences
  Synthetic
cgggcgggtaggaagcgggtttttta

SEQ ID NO: 8029 - DNA, 28 bp, Artificial Sequences
  Synthetic
cgggtaggaagcgggttttttagtcggg

SEQ ID NO: 8030 - DNA, 29 bp, Artificial Sequences
  Synthetic
tggggttgagagatttgtttagggtcggt

SEQ ID NO: 8031 - DNA, 28 bp, Artificial Sequences
  Synthetic
ggggttgagagatttgtttagggtcggt

SEQ ID NO: 8032 - DNA, 28 bp, Artificial Sequences
  Synthetic
tggggttgagagatttgtttagggtcgg

SEQ ID NO: 8033 - DNA, 29 bp, Artificial Sequences
  Synthetic
ggggttgagagatttgtttagggtcggtg

SEQ ID NO: 8034 - DNA, 30 bp, Artificial Sequences
  Synthetic
tggggttgagagatttgtttagggtcggtg

SEQ ID NO: 8035 - DNA, 33 bp, Artificial Sequences
  Synthetic
tcgggaagattagttattttggttacgtgtgga

SEQ ID NO: 8036 - DNA, 33 bp, Artificial Sequences
  Synthetic
cgggaagattagttattttggttacgtgtggac

SEQ ID NO: 8037 - DNA, 33 bp, Artificial Sequences
  Synthetic
gtcgggaagattagttattttggttacgtgtgg

SEQ ID NO: 8038 - DNA, 34 bp, Artificial Sequences
  Synthetic
agtcgggaagattagttattttggttacgtgtgg

SEQ ID NO: 8039 - DNA, 34 bp, Artificial Sequences
  Synthetic
tcgggaagattagttattttggttacgtgtggac

SEQ ID NO: 8040 - DNA, 29 bp, Artificial Sequences
  Synthetic
tggggttgagagatttgtttagggtcggt

SEQ ID NO: 8041 - DNA, 28 bp, Artificial Sequences
  Synthetic
ggggttgagagatttgtttagggtcggt

SEQ ID NO: 8042 - DNA, 28 bp, Artificial Sequences
  Synthetic
tggggttgagagatttgtttagggtcgg

SEQ ID NO: 8043 - DNA, 29 bp, Artificial Sequences
  Synthetic
acgtggttagggtggttgattttttcggt

SEQ ID NO: 8044 - DNA, 28 bp, Artificial Sequences
  Synthetic
cgtggttagggtggttgattttttcggt

SEQ ID NO: 8045 - DNA, 27 bp, Artificial Sequences
  Synthetic
cggggggcgtttcgagaatttgggttc

SEQ ID NO: 8046 - DNA, 27 bp, Artificial Sequences
  Synthetic
ttcggagggggttcgtcgtttgggttt

SEQ ID NO: 8047 - DNA, 27 bp, Artificial Sequences
  Synthetic
tttcggagggggttcgtcgtttgggtt

SEQ ID NO: 8048 - DNA, 27 bp, Artificial Sequences
  Synthetic
ttttcggagggggttcgtcgtttgggt

SEQ ID NO: 8049 - DNA, 27 bp, Artificial Sequences
  Synthetic
gttttcggagggggttcgtcgtttggg

SEQ ID NO: 8050 - DNA, 29 bp, Artificial Sequences
  Synthetic
acgtggttagggtggttgattttttcggt

SEQ ID NO: 8051 - DNA, 28 bp, Artificial Sequences
  Synthetic
cgtggttagggtggttgattttttcggt

SEQ ID NO: 8052 - DNA, 28 bp, Artificial Sequences
  Synthetic
acgtggttagggtggttgattttttcgg

SEQ ID NO: 8053 - DNA, 30 bp, Artificial Sequences
  Synthetic
acgtggttagggtggttgattttttcggtt

SEQ ID NO: 8054 - DNA, 29 bp, Artificial Sequences
  Synthetic
cgtggttagggtggttgattttttcggtt

SEQ ID NO: 8055 - DNA, 27 bp, Artificial Sequences
  Synthetic
cggggggcgtttcgagaatttgggttc

SEQ ID NO: 8056 - DNA, 27 bp, Artificial Sequences
  Synthetic
ttcggagggggttcgtcgtttgggttt

SEQ ID NO: 8057 - DNA, 27 bp, Artificial Sequences
  Synthetic
tttcggagggggttcgtcgtttgggtt

SEQ ID NO: 8058 - DNA, 27 bp, Artificial Sequences
  Synthetic
ttttcggagggggttcgtcgtttgggt

SEQ ID NO: 8059 - DNA, 27 bp, Artificial Sequences
  Synthetic
gttttcggagggggttcgtcgtttggg

SEQ ID NO: 8060 - DNA, 36 bp, Artificial Sequences
  Synthetic
acgttatttatagtaaatttaggcggcgggtttttt

SEQ ID NO: 8061 - DNA, 27 bp, Artificial Sequences
  Synthetic
cggggggcgtttcgagaatttgggttc

SEQ ID NO: 8062 - DNA, 27 bp, Artificial Sequences
  Synthetic
tcggggggcgtttcgagaatttgggtt

SEQ ID NO: 8063 - DNA, 27 bp, Artificial Sequences
  Synthetic
cggtcgtcgtttgggtgttggaggtag

SEQ ID NO: 8064 - DNA, 28 bp, Artificial Sequences
  Synthetic
cggtcgtcgtttgggtgttggaggtaga

SEQ ID NO: 8065 - DNA, 26 bp, Artificial Sequences
  Synthetic
cggggggcgtttcgagaatttgggtt

SEQ ID NO: 8066 - DNA, 27 bp, Artificial Sequences
  Synthetic
gcgttcggatttaggttttcggggcgt

SEQ ID NO: 8067 - DNA, 27 bp, Artificial Sequences
  Synthetic
tgcgttcggatttaggttttcggggcg

SEQ ID NO: 8068 - DNA, 27 bp, Artificial Sequences
  Synthetic
aaggttgattttgttcgggggcgacgg

SEQ ID NO: 8069 - DNA, 27 bp, Artificial Sequences
  Synthetic
gttgattttgttcgggggcgacgggtg

SEQ ID NO: 8070 - DNA, 27 bp, Artificial Sequences
  Synthetic
gcgtcgcggtggaggtcgttgtttttt

SEQ ID NO: 8071 - DNA, 27 bp, Artificial Sequences
  Synthetic
tcgcgggttggggttagtacgttcgtt

SEQ ID NO: 8072 - DNA, 27 bp, Artificial Sequences
  Synthetic
ttcgcgggttggggttagtacgttcgt

SEQ ID NO: 8073 - DNA, 27 bp, Artificial Sequences
  Synthetic
tttcgggtttagtaggtgcggggcgat

SEQ ID NO: 8074 - DNA, 27 bp, Artificial Sequences
  Synthetic
cgcggttgtatttggggaagggttcgg

SEQ ID NO: 8075 - DNA, 27 bp, Artificial Sequences
  Synthetic
gcgcggttgtatttggggaagggttcg

SEQ ID NO: 8076 - DNA, 27 bp, Artificial Sequences
  Synthetic
gtcggtttgaggaggggtcgtttcgtt

SEQ ID NO: 8077 - DNA, 27 bp, Artificial Sequences
  Synthetic
tcggtttgaggaggggtcgtttcgtta

SEQ ID NO: 8078 - DNA, 26 bp, Artificial Sequences
  Synthetic
gtcggtttgaggaggggtcgtttcgt

SEQ ID NO: 8079 - DNA, 27 bp, Artificial Sequences
  Synthetic
tgaggaggggtcgtttcgttatgtcgt

SEQ ID NO: 8080 - DNA, 28 bp, Artificial Sequences
  Synthetic
gtcggtttgaggaggggtcgtttcgtta

SEQ ID NO: 8081 - DNA, 27 bp, Artificial Sequences
  Synthetic
tttcgggtttagtaggtgcggggcgat

SEQ ID NO: 8082 - DNA, 27 bp, Artificial Sequences
  Synthetic
gtttcgggtttagtaggtgcggggcga

SEQ ID NO: 8083 - DNA, 27 bp, Artificial Sequences
  Synthetic
ttcgggtttagtaggtgcggggcgata

SEQ ID NO: 8084 - DNA, 27 bp, Artificial Sequences
  Synthetic
acgtttcgggtttagtaggtgcggggc

SEQ ID NO: 8085 - DNA, 27 bp, Artificial Sequences
  Synthetic
tcgggtttagtaggtgcggggcgatat

SEQ ID NO: 8086 - DNA, 27 bp, Artificial Sequences
  Synthetic
gtcggtttgaggaggggtcgtttcgtt

SEQ ID NO: 8087 - DNA, 27 bp, Artificial Sequences
  Synthetic
tcggtttgaggaggggtcgtttcgtta

SEQ ID NO: 8088 - DNA, 26 bp, Artificial Sequences
  Synthetic
gtcggtttgaggaggggtcgtttcgt

SEQ ID NO: 8089 - DNA, 25 bp, Artificial Sequences
  Synthetic
gagtcgtcgggggttgtcgggagtc

SEQ ID NO: 8090 - DNA, 27 bp, Artificial Sequences
  Synthetic
tgaggaggggtcgtttcgttatgtcgt

SEQ ID NO: 8091 - DNA, 29 bp, Artificial Sequences
  Synthetic
ggttgtttttggggtttttagcgtttcgg

SEQ ID NO: 8092 - DNA, 30 bp, Artificial Sequences
  Synthetic
aggttgtttttggggtttttagcgtttcgg

SEQ ID NO: 8093 - DNA, 31 bp, Artificial Sequences
  Synthetic
taggttgtttttggggtttttagcgtttcgg

SEQ ID NO: 8094 - DNA, 32 bp, Artificial Sequences
  Synthetic
ataggttgtttttggggtttttagcgtttcgg

SEQ ID NO: 8095 - DNA, 32 bp, Artificial Sequences
  Synthetic
cgagtataggttgtttttggggtttttagcgt

SEQ ID NO: 8096 - DNA, 31 bp, Artificial Sequences
  Synthetic
ggagaggtttggggaagttattgtattcggg

SEQ ID NO: 8097 - DNA, 32 bp, Artificial Sequences
  Synthetic
ggagaggtttggggaagttattgtattcgggt

SEQ ID NO: 8098 - DNA, 32 bp, Artificial Sequences
  Synthetic
tggagaggtttggggaagttattgtattcggg

SEQ ID NO: 8099 - DNA, 33 bp, Artificial Sequences
  Synthetic
tggagaggtttggggaagttattgtattcgggt

SEQ ID NO: 8100 - DNA, 31 bp, Artificial Sequences
  Synthetic
gagaggtttggggaagttattgtattcgggt

SEQ ID NO: 8101 - DNA, 27 bp, Artificial Sequences
  Synthetic
agcggttgggataggagattcggatgt

SEQ ID NO: 8102 - DNA, 27 bp, Artificial Sequences
  Synthetic
gcggttgggataggagattcggatgta

SEQ ID NO: 8103 - DNA, 28 bp, Artificial Sequences
  Synthetic
agcggttgggataggagattcggatgta

SEQ ID NO: 8104 - DNA, 28 bp, Artificial Sequences
  Synthetic
tagcggttgggataggagattcggatgt

SEQ ID NO: 8105 - DNA, 29 bp, Artificial Sequences
  Synthetic
gcggttgggataggagattcggatgtagt

SEQ ID NO: 8106 - DNA, 28 bp, Artificial Sequences
  Synthetic
cggggaaaatgatagggagcgattcggg

SEQ ID NO: 8107 - DNA, 29 bp, Artificial Sequences
  Synthetic
acggggaaaatgatagggagcgattcggg

SEQ ID NO: 8108 - DNA, 28 bp, Artificial Sequences
  Synthetic
ggggaaaatgatagggagcgattcgggg

SEQ ID NO: 8109 - DNA, 29 bp, Artificial Sequences
  Synthetic
ggggaaaatgatagggagcgattcggggt

SEQ ID NO: 8110 - DNA, 29 bp, Artificial Sequences
  Synthetic
cggggaaaatgatagggagcgattcgggg

SEQ ID NO: 8111 - DNA, 27 bp, Artificial Sequences
  Synthetic
cgtcgtttttggtttttaggagggcga

SEQ ID NO: 8112 - DNA, 27 bp, Artificial Sequences
  Synthetic
tcgtcgtttttggtttttaggagggcg

SEQ ID NO: 8113 - DNA, 29 bp, Artificial Sequences
  Synthetic
cgtcgtttttggtttttaggagggcgagg

SEQ ID NO: 8114 - DNA, 30 bp, Artificial Sequences
  Synthetic
cgtcgtttttggtttttaggagggcgaggt

SEQ ID NO: 8115 - DNA, 27 bp, Artificial Sequences
  Synthetic
cgtttttggtttttaggagggcgaggt

SEQ ID NO: 8116 - DNA, 27 bp, Artificial Sequences
  Synthetic
tgagggagttggaggtttggattcgga

SEQ ID NO: 8117 - DNA, 27 bp, Artificial Sequences
  Synthetic
tgagggaaattgggggagttcgtaggt

SEQ ID NO: 8118 - DNA, 27 bp, Artificial Sequences
  Synthetic
agggagttggaggtttggattcggaga

SEQ ID NO: 8119 - DNA, 27 bp, Artificial Sequences
  Synthetic
gtgagggagttggaggtttggattcgg

SEQ ID NO: 8120 - DNA, 28 bp, Artificial Sequences
  Synthetic
agtgagggagttggaggtttggattcgg

SEQ ID NO: 8121 - DNA, 28 bp, Artificial Sequences
  Synthetic
tggggattgtaggttgggagtttacggt

SEQ ID NO: 8122 - DNA, 27 bp, Artificial Sequences
  Synthetic
ggggattgtaggttgggagtttacggt

SEQ ID NO: 8123 - DNA, 27 bp, Artificial Sequences
  Synthetic
tggggattgtaggttgggagtttacgg

SEQ ID NO: 8124 - DNA, 28 bp, Artificial Sequences
  Synthetic
acgtgtagtttggggattgtaggttggg

SEQ ID NO: 8125 - DNA, 29 bp, Artificial Sequences
  Synthetic
tggggattgtaggttgggagtttacggtt

SEQ ID NO: 8126 - DNA, 27 bp, Artificial Sequences
  Synthetic
gtcgggtgataggggagttgcggtgag

SEQ ID NO: 8127 - DNA, 27 bp, Artificial Sequences
  Synthetic
tagggggtcgggtgataggggagttgc

SEQ ID NO: 8128 - DNA, 26 bp, Artificial Sequences
  Synthetic
gtcgggtgataggggagttgcggtga

SEQ ID NO: 8129 - DNA, 27 bp, Artificial Sequences
  Synthetic
ggtcgggtgataggggagttgcggtga

SEQ ID NO: 8130 - DNA, 26 bp, Artificial Sequences
  Synthetic
tcgggtgataggggagttgcggtgag

SEQ ID NO: 8131 - DNA, 27 bp, Artificial Sequences
  Synthetic
ttggaaggaggtagcgttgtgggggtg

SEQ ID NO: 8132 - DNA, 27 bp, Artificial Sequences
  Synthetic
tttggaaggaggtagcgttgtgggggt

SEQ ID NO: 8133 - DNA, 26 bp, Artificial Sequences
  Synthetic
tggaaggaggtagcgttgtgggggtg

SEQ ID NO: 8134 - DNA, 28 bp, Artificial Sequences
  Synthetic
tttggaaggaggtagcgttgtgggggtg

SEQ ID NO: 8135 - DNA, 28 bp, Artificial Sequences
  Synthetic
ttttggaaggaggtagcgttgtgggggt

SEQ ID NO: 8136 - DNA, 28 bp, Artificial Sequences
  Synthetic
gagatgtgatttgtttagagtcgcgcgt

SEQ ID NO: 8137 - DNA, 29 bp, Artificial Sequences
  Synthetic
agagatgtgatttgtttagagtcgcgcgt

SEQ ID NO: 8138 - DNA, 29 bp, Artificial Sequences
  Synthetic
gagagatgtgatttgtttagagtcgcgcg

SEQ ID NO: 8139 - DNA, 30 bp, Artificial Sequences
  Synthetic
gagagatgtgatttgtttagagtcgcgcgt

SEQ ID NO: 8140 - DNA, 29 bp, Artificial Sequences
  Synthetic
gagatgtgatttgtttagagtcgcgcgtt

SEQ ID NO: 8141 - DNA, 27 bp, Artificial Sequences
  Synthetic
gtggagcggagaaaaggagggagatga

SEQ ID NO: 8142 - DNA, 27 bp, Artificial Sequences
  Synthetic
tggagcggagaaaaggagggagatgaa

SEQ ID NO: 8143 - DNA, 28 bp, Artificial Sequences
  Synthetic
gtggagcggagaaaaggagggagatgaa

SEQ ID NO: 8144 - DNA, 28 bp, Artificial Sequences
  Synthetic
tggagcggagaaaaggagggagatgaaa

SEQ ID NO: 8145 - DNA, 27 bp, Artificial Sequences
  Synthetic
ggagcggagaaaaggagggagatgaaa

SEQ ID NO: 8146 - DNA, 27 bp, Artificial Sequences
  Synthetic
tagattatcgggggtggcggagggttg

SEQ ID NO: 8147 - DNA, 27 bp, Artificial Sequences
  Synthetic
gggggtggcggagggttggtaaagttt

SEQ ID NO: 8148 - DNA, 27 bp, Artificial Sequences
  Synthetic
attatcgggggtggcggagggttggta

SEQ ID NO: 8149 - DNA, 27 bp, Artificial Sequences
  Synthetic
aaagggtgtggtaagaggaggagcggt

SEQ ID NO: 8150 - DNA, 27 bp, Artificial Sequences
  Synthetic
tatcgggggtggcggagggttggtaaa

SEQ ID NO: 8151 - DNA, 31 bp, Artificial Sequences
  Synthetic
agttattttcggcggagtgtttcgagttttt

SEQ ID NO: 8152 - DNA, 31 bp, Artificial Sequences
  Synthetic
aagttattttcggcggagtgtttcgagtttt

SEQ ID NO: 8153 - DNA, 31 bp, Artificial Sequences
  Synthetic
aaagttattttcggcggagtgtttcgagttt

SEQ ID NO: 8154 - DNA, 32 bp, Artificial Sequences
  Synthetic
agttattttcggcggagtgtttcgagtttttc

SEQ ID NO: 8155 - DNA, 32 bp, Artificial Sequences
  Synthetic
aagttattttcggcggagtgtttcgagttttt

SEQ ID NO: 8156 - DNA, 33 bp, Artificial Sequences
  Synthetic
gatttttcggaatagaagcgatgttgaaatgcg

SEQ ID NO: 8157 - DNA, 34 bp, Artificial Sequences
  Synthetic
agatttttcggaatagaagcgatgttgaaatgcg

SEQ ID NO: 8158 - DNA, 35 bp, Artificial Sequences
  Synthetic
aagatttttcggaatagaagcgatgttgaaatgcg

SEQ ID NO: 8159 - DNA, 36 bp, Artificial Sequences
  Synthetic
aaagatttttcggaatagaagcgatgttgaaatgcg

SEQ ID NO: 8160 - DNA, 36 bp, Artificial Sequences
  Synthetic
tggggatttagattatgaatagacggaagaggaaga

SEQ ID NO: 8161 - DNA, 27 bp, Artificial Sequences
  Synthetic
tggggggaagtgaaatcgggttgaggg

SEQ ID NO: 8162 - DNA, 27 bp, Artificial Sequences
  Synthetic
gggtggggggaagtgaaatcgggttga

SEQ ID NO: 8163 - DNA, 27 bp, Artificial Sequences
  Synthetic
agggtggggggaagtgaaatcgggttg

SEQ ID NO: 8164 - DNA, 27 bp, Artificial Sequences
  Synthetic
ggggggaagtgaaatcgggttgaggga

SEQ ID NO: 8165 - DNA, 27 bp, Artificial Sequences
  Synthetic
ggatgtggtcgggttagcgttttgggg

SEQ ID NO: 8166 - DNA, 27 bp, Artificial Sequences
  Synthetic
cggaagttttagggcgttggttcggtt

SEQ ID NO: 8167 - DNA, 26 bp, Artificial Sequences
  Synthetic
cggaagttttagggcgttggttcggt

SEQ ID NO: 8168 - DNA, 27 bp, Artificial Sequences
  Synthetic
tgtgtagagtggggtgaatagggtcga

SEQ ID NO: 8169 - DNA, 28 bp, Artificial Sequences
  Synthetic
cggaagttttagggcgttggttcggtta

SEQ ID NO: 8170 - DNA, 28 bp, Artificial Sequences
  Synthetic
ttgtgtagagtggggtgaatagggtcga

SEQ ID NO: 8171 - DNA, 28 bp, Artificial Sequences
  Synthetic
agaaggaagtaggaatgagtgtacggcg

SEQ ID NO: 8172 - DNA, 28 bp, Artificial Sequences
  Synthetic
gaaggaagtaggaatgagtgtacggcga

SEQ ID NO: 8173 - DNA, 30 bp, Artificial Sequences
  Synthetic
ggagaaggaagtaggaatgagtgtacggcg

SEQ ID NO: 8174 - DNA, 29 bp, Artificial Sequences
  Synthetic
agaaggaagtaggaatgagtgtacggcga

SEQ ID NO: 8175 - DNA, 31 bp, Artificial Sequences
  Synthetic
tggagaaggaagtaggaatgagtgtacggcg

SEQ ID NO: 8176 - DNA, 27 bp, Artificial Sequences
  Synthetic
ggggagggttttgaggagtacggggtc

SEQ ID NO: 8177 - DNA, 27 bp, Artificial Sequences
  Synthetic
aggggagggttttgaggagtacggggt

SEQ ID NO: 8178 - DNA, 28 bp, Artificial Sequences
  Synthetic
taggggagggttttgaggagtacggggt

SEQ ID NO: 8179 - DNA, 27 bp, Artificial Sequences
  Synthetic
taggggagggttttgaggagtacgggg

SEQ ID NO: 8180 - DNA, 28 bp, Artificial Sequences
  Synthetic
aggggagggttttgaggagtacggggtc

SEQ ID NO: 8181 - DNA, 27 bp, Artificial Sequences
  Synthetic
gagggttggtgattgaggggttcgggt

SEQ ID NO: 8182 - DNA, 27 bp, Artificial Sequences
  Synthetic
tgattgaggggttcgggttggcggtaa

SEQ ID NO: 8183 - DNA, 27 bp, Artificial Sequences
  Synthetic
tgaggggttcgggttggcggtaaagag

SEQ ID NO: 8184 - DNA, 27 bp, Artificial Sequences
  Synthetic
ttgaggggttcgggttggcggtaaaga

SEQ ID NO: 8185 - DNA, 27 bp, Artificial Sequences
  Synthetic
gttggtgattgaggggttcgggttggc

SEQ ID NO: 8186 - DNA, 30 bp, Artificial Sequences
  Synthetic
cggagttagttggtagggttagggttttcg

SEQ ID NO: 8187 - DNA, 31 bp, Artificial Sequences
  Synthetic
tcggagttagttggtagggttagggttttcg

SEQ ID NO: 8188 - DNA, 30 bp, Artificial Sequences
  Synthetic
tgtgttgttttcggagttagttggtagggt

SEQ ID NO: 8189 - DNA, 31 bp, Artificial Sequences
  Synthetic
tgttttcggagttagttggtagggttagggt

SEQ ID NO: 8190 - DNA, 30 bp, Artificial Sequences
  Synthetic
gttttcggagttagttggtagggttagggt

SEQ ID NO: 8191 - DNA, 27 bp, Artificial Sequences
  Synthetic
gcggcggcggtgatagaaagttggatg

SEQ ID NO: 8192 - DNA, 27 bp, Artificial Sequences
  Synthetic
cggcggcggtgatagaaagttggatgg

SEQ ID NO: 8193 - DNA, 27 bp, Artificial Sequences
  Synthetic
agaggtttataacgttggtggcggcgg

SEQ ID NO: 8194 - DNA, 27 bp, Artificial Sequences
  Synthetic
ggcggcggtgatagaaagttggatggt

SEQ ID NO: 8195 - DNA, 26 bp, Artificial Sequences
  Synthetic
gcggcggcggtgatagaaagttggat

SEQ ID NO: 8196 - DNA, 27 bp, Artificial Sequences
  Synthetic
gaagggggtggaggtgacggggtttag

SEQ ID NO: 8197 - DNA, 27 bp, Artificial Sequences
  Synthetic
agggggtggaggtgacggggtttagta

SEQ ID NO: 8198 - DNA, 27 bp, Artificial Sequences
  Synthetic
gggggtggaggtgacggggtttagtag

SEQ ID NO: 8199 - DNA, 27 bp, Artificial Sequences
  Synthetic
agaagggggtggaggtgacggggttta

SEQ ID NO: 8200 - DNA, 27 bp, Artificial Sequences
  Synthetic
ttgatcgagaagggggtggaggtgacg

SEQ ID NO: 8201 - DNA, 27 bp, Artificial Sequences
  Synthetic
tgcggggtttgtagcgataagacggga

SEQ ID NO: 8202 - DNA, 27 bp, Artificial Sequences
  Synthetic
tgggtttgtttgcggggtttgtagcga

SEQ ID NO: 8203 - DNA, 27 bp, Artificial Sequences
  Synthetic
ttgcggggtttgtagcgataagacggg

SEQ ID NO: 8204 - DNA, 28 bp, Artificial Sequences
  Synthetic
tgcggggtttgtagcgataagacgggaa

SEQ ID NO: 8205 - DNA, 28 bp, Artificial Sequences
  Synthetic
ttgcggggtttgtagcgataagacggga

SEQ ID NO: 8206 - DNA, 27 bp, Artificial Sequences
  Synthetic
gaagggggtggaggtgacggggtttag

SEQ ID NO: 8207 - DNA, 27 bp, Artificial Sequences
  Synthetic
agggggtggaggtgacggggtttagta

SEQ ID NO: 8208 - DNA, 27 bp, Artificial Sequences
  Synthetic
gggggtggaggtgacggggtttagtag

SEQ ID NO: 8209 - DNA, 27 bp, Artificial Sequences
  Synthetic
agaagggggtggaggtgacggggttta

SEQ ID NO: 8210 - DNA, 27 bp, Artificial Sequences
  Synthetic
ttgatcgagaagggggtggaggtgacg

SEQ ID NO: 8211 - DNA, 27 bp, Artificial Sequences
  Synthetic
gggaagaaagcgttgggggaggaaggt

SEQ ID NO: 8212 - DNA, 27 bp, Artificial Sequences
  Synthetic
tgcggggtttgtagcgataagacggga

SEQ ID NO: 8213 - DNA, 27 bp, Artificial Sequences
  Synthetic
tgggtttgtttgcggggtttgtagcga

SEQ ID NO: 8214 - DNA, 27 bp, Artificial Sequences
  Synthetic
ggaagaaagcgttgggggaggaaggtg

SEQ ID NO: 8215 - DNA, 27 bp, Artificial Sequences
  Synthetic
cgggaagaaagcgttgggggaggaagg

SEQ ID NO: 8216 - DNA, 27 bp, Artificial Sequences
  Synthetic
tggtaggttcgggtttagggtcgggtg

SEQ ID NO: 8217 - DNA, 27 bp, Artificial Sequences
  Synthetic
ggtaggttcgggtttagggtcgggtga

SEQ ID NO: 8218 - DNA, 27 bp, Artificial Sequences
  Synthetic
ttggtaggttcgggtttagggtcgggt

SEQ ID NO: 8219 - DNA, 28 bp, Artificial Sequences
  Synthetic
tggtaggttcgggtttagggtcgggtga

SEQ ID NO: 8220 - DNA, 28 bp, Artificial Sequences
  Synthetic
gttggtaggttcgggtttagggtcgggt

SEQ ID NO: 8221 - DNA, 27 bp, Artificial Sequences
  Synthetic
ttggggattggagaggattcgacgggc

SEQ ID NO: 8222 - DNA, 28 bp, Artificial Sequences
  Synthetic
attggggattggagaggattcgacgggc

SEQ ID NO: 8223 - DNA, 27 bp, Artificial Sequences
  Synthetic
aggaaggcgattggggattggagagga

SEQ ID NO: 8224 - DNA, 26 bp, Artificial Sequences
  Synthetic
tggggattggagaggattcgacgggc

SEQ ID NO: 8225 - DNA, 27 bp, Artificial Sequences
  Synthetic
aggcgattggggattggagaggattcg

SEQ ID NO: 8226 - DNA, 24 bp, Artificial Sequences
  Synthetic
cgtggagagatagtgttgcgcgcg

SEQ ID NO: 8227 - DNA, 28 bp, Artificial Sequences
  Synthetic
aagaaaacgtggagagatagtgttgcgc

SEQ ID NO: 8228 - DNA, 29 bp, Artificial Sequences
  Synthetic
aaagaaaacgtggagagatagtgttgcgc

SEQ ID NO: 8229 - DNA, 23 bp, Artificial Sequences
  Synthetic
gtggagagatagtgttgcgcgcg

SEQ ID NO: 8230 - DNA, 23 bp, Artificial Sequences
  Synthetic
cgtggagagatagtgttgcgcgc

SEQ ID NO: 8231 - DNA, 29 bp, Artificial Sequences
  Synthetic
acggagatttaagtcgcgcgtagtattgt

SEQ ID NO: 8232 - DNA, 30 bp, Artificial Sequences
  Synthetic
acggagatttaagtcgcgcgtagtattgtt

SEQ ID NO: 8233 - DNA, 31 bp, Artificial Sequences
  Synthetic
acggagatttaagtcgcgcgtagtattgttt

SEQ ID NO: 8234 - DNA, 31 bp, Artificial Sequences
  Synthetic
cggagatttaagtcgcgcgtagtattgtttt

SEQ ID NO: 8235 - DNA, 32 bp, Artificial Sequences
  Synthetic
acggagatttaagtcgcgcgtagtattgtttt

SEQ ID NO: 8236 - DNA, 27 bp, Artificial Sequences
  Synthetic
agtcggtaggggaaagttcgagggatt

SEQ ID NO: 8237 - DNA, 27 bp, Artificial Sequences
  Synthetic
ttagtcggtaggggaaagttcgaggga

SEQ ID NO: 8238 - DNA, 27 bp, Artificial Sequences
  Synthetic
tagtcggtaggggaaagttcgagggat

SEQ ID NO: 8239 - DNA, 27 bp, Artificial Sequences
  Synthetic
gttagtcggtaggggaaagttcgaggg

SEQ ID NO: 8240 - DNA, 27 bp, Artificial Sequences
  Synthetic
gtcggtaggggaaagttcgagggattt

SEQ ID NO: 8241 - DNA, 27 bp, Artificial Sequences
  Synthetic
agtgtacgtgtgaaatgtggcggcgtc

SEQ ID NO: 8242 - DNA, 27 bp, Artificial Sequences
  Synthetic
tagtgtacgtgtgaaatgtggcggcgt

SEQ ID NO: 8243 - DNA, 26 bp, Artificial Sequences
  Synthetic
agtgtacgtgtgaaatgtggcggcgt

SEQ ID NO: 8244 - DNA, 28 bp, Artificial Sequences
  Synthetic
tagtgtacgtgtgaaatgtggcggcgtc

SEQ ID NO: 8245 - DNA, 28 bp, Artificial Sequences
  Synthetic
ttagtgtacgtgtgaaatgtggcggcgt

SEQ ID NO: 8246 - DNA, 27 bp, Artificial Sequences
  Synthetic
ggcggaggtgtgagcgatgtgttgatt

SEQ ID NO: 8247 - DNA, 27 bp, Artificial Sequences
  Synthetic
ttttttcggatcgcggcggaggtgtga

SEQ ID NO: 8248 - DNA, 27 bp, Artificial Sequences
  Synthetic
cggcggaggtgtgagcgatgtgttgat

SEQ ID NO: 8249 - DNA, 26 bp, Artificial Sequences
  Synthetic
ttttttcggatcgcggcggaggtgtg

SEQ ID NO: 8250 - DNA, 27 bp, Artificial Sequences
  Synthetic
tttttcggatcgcggcggaggtgtgag

SEQ ID NO: 8251 - DNA, 27 bp, Artificial Sequences
  Synthetic
gaaaaggtagtcgggttgggggtgggt

SEQ ID NO: 8252 - DNA, 27 bp, Artificial Sequences
  Synthetic
ggggtgggtaggtagtagtgagcggga

SEQ ID NO: 8253 - DNA, 27 bp, Artificial Sequences
  Synthetic
aggaaaaggtagtcgggttgggggtgg

SEQ ID NO: 8254 - DNA, 27 bp, Artificial Sequences
  Synthetic
agtgtacgtgtgaaatgtggcggcgtc

SEQ ID NO: 8255 - DNA, 27 bp, Artificial Sequences
  Synthetic
tgggggtgggtaggtagtagtgagcgg

SEQ ID NO: 8256 - DNA, 27 bp, Artificial Sequences
  Synthetic
gcggaggtgtgagcgatgtgttgatta

SEQ ID NO: 8257 - DNA, 26 bp, Artificial Sequences
  Synthetic
gcggaggtgtgagcgatgtgttgatt

SEQ ID NO: 8258 - DNA, 28 bp, Artificial Sequences
  Synthetic
gcggaggtgtgagcgatgtgttgattat

SEQ ID NO: 8259 - DNA, 25 bp, Artificial Sequences
  Synthetic
gcggaggtgtgagcgatgtgttgat

SEQ ID NO: 8260 - DNA, 29 bp, Artificial Sequences
  Synthetic
gcggaggtgtgagcgatgtgttgattatt

SEQ ID NO: 8261 - DNA, 27 bp, Artificial Sequences
  Synthetic
gaaaaggtagtcgggttgggggtgggt

SEQ ID NO: 8262 - DNA, 27 bp, Artificial Sequences
  Synthetic
ggggtgggtaggtagtagtgagcggga

SEQ ID NO: 8263 - DNA, 27 bp, Artificial Sequences
  Synthetic
aggaaaaggtagtcgggttgggggtgg

SEQ ID NO: 8264 - DNA, 27 bp, Artificial Sequences
  Synthetic
tgggggtgggtaggtagtagtgagcgg

SEQ ID NO: 8265 - DNA, 27 bp, Artificial Sequences
  Synthetic
ggtagtcgggttgggggtgggtaggta

SEQ ID NO: 8266 - DNA, 27 bp, Artificial Sequences
  Synthetic
gaaaaggtagtcgggttgggggtgggt

SEQ ID NO: 8267 - DNA, 27 bp, Artificial Sequences
  Synthetic
ggggtgggtaggtagtagtgagcggga

SEQ ID NO: 8268 - DNA, 27 bp, Artificial Sequences
  Synthetic
aggaaaaggtagtcgggttgggggtgg

SEQ ID NO: 8269 - DNA, 27 bp, Artificial Sequences
  Synthetic
tgggggtgggtaggtagtagtgagcgg

SEQ ID NO: 8270 - DNA, 27 bp, Artificial Sequences
  Synthetic
ggtagtcgggttgggggtgggtaggta

SEQ ID NO: 8271 - DNA, 27 bp, Artificial Sequences
  Synthetic
tttgaggatgggggagattttggcggc

SEQ ID NO: 8272 - DNA, 27 bp, Artificial Sequences
  Synthetic
ttgaggatgggggagattttggcggcg

SEQ ID NO: 8273 - DNA, 28 bp, Artificial Sequences
  Synthetic
atttgaggatgggggagattttggcggc

SEQ ID NO: 8274 - DNA, 26 bp, Artificial Sequences
  Synthetic
ttgaggatgggggagattttggcggc

SEQ ID NO: 8275 - DNA, 26 bp, Artificial Sequences
  Synthetic
tgaggatgggggagattttggcggcg

SEQ ID NO: 8276 - DNA, 27 bp, Artificial Sequences
  Synthetic
tgcgtgtgtgtgttggaggaggaggtt

SEQ ID NO: 8277 - DNA, 27 bp, Artificial Sequences
  Synthetic
agtgcgtgtgtgtgttggaggaggagg

SEQ ID NO: 8278 - DNA, 27 bp, Artificial Sequences
  Synthetic
aggtggaggtgatcgtgatggtgtgcg

SEQ ID NO: 8279 - DNA, 27 bp, Artificial Sequences
  Synthetic
cgagtgcgtgtgtgtgttggaggagga

SEQ ID NO: 8280 - DNA, 27 bp, Artificial Sequences
  Synthetic
gtgcgtgtgtgtgttggaggaggaggt

SEQ ID NO: 8281 - DNA, 27 bp, Artificial Sequences
  Synthetic
tgcggcgtggattaaatgagatagcgt

SEQ ID NO: 8282 - DNA, 29 bp, Artificial Sequences
  Synthetic
ggttgcggcgtggattaaatgagatagcg

SEQ ID NO: 8283 - DNA, 28 bp, Artificial Sequences
  Synthetic
ttgcggcgtggattaaatgagatagcgt

SEQ ID NO: 8284 - DNA, 30 bp, Artificial Sequences
  Synthetic
ggttgcggcgtggattaaatgagatagcgt

SEQ ID NO: 8285 - DNA, 27 bp, Artificial Sequences
  Synthetic
ttgcggcgtggattaaatgagatagcg

SEQ ID NO: 8286 - DNA, 27 bp, Artificial Sequences
  Synthetic
aaatgtagaagattcgcgcgggtttgc

SEQ ID NO: 8287 - DNA, 27 bp, Artificial Sequences
  Synthetic
cgttgggattttttcggtgtgatgcga

SEQ ID NO: 8288 - DNA, 27 bp, Artificial Sequences
  Synthetic
tcgttgggattttttcggtgtgatgcg

SEQ ID NO: 8289 - DNA, 28 bp, Artificial Sequences
  Synthetic
ggaattaagagagttgttgtgcgcgggt

SEQ ID NO: 8290 - DNA, 28 bp, Artificial Sequences
  Synthetic
tcgttgggattttttcggtgtgatgcga

SEQ ID NO: 8291 - DNA, 27 bp, Artificial Sequences
  Synthetic
gggtacggtgtaggcgtttgtggtttt

SEQ ID NO: 8292 - DNA, 27 bp, Artificial Sequences
  Synthetic
attcgggaggttggggtagaaggatcg

SEQ ID NO: 8293 - DNA, 26 bp, Artificial Sequences
  Synthetic
gggtacggtgtaggcgtttgtggttt

SEQ ID NO: 8294 - DNA, 26 bp, Artificial Sequences
  Synthetic
ttcgggaggttggggtagaaggatcg

SEQ ID NO: 8295 - DNA, 28 bp, Artificial Sequences
  Synthetic
gggtacggtgtaggcgtttgtggtttta

SEQ ID NO: 8296 - DNA, 27 bp, Artificial Sequences
  Synthetic
tttgtcgtttaggttggagtgcggtgg

SEQ ID NO: 8297 - DNA, 28 bp, Artificial Sequences
  Synthetic
ggttttgtcgtttaggttggagtgcggt

SEQ ID NO: 8298 - DNA, 29 bp, Artificial Sequences
  Synthetic
tggttttgtcgtttaggttggagtgcggt

SEQ ID NO: 8299 - DNA, 28 bp, Artificial Sequences
  Synthetic
ttttgtcgtttaggttggagtgcggtgg

SEQ ID NO: 8300 - DNA, 28 bp, Artificial Sequences
  Synthetic
tggttttgtcgtttaggttggagtgcgg

SEQ ID NO: 8301 - DNA, 27 bp, Artificial Sequences
  Synthetic
gcggtgatggtcgggttgggtttttgt

SEQ ID NO: 8302 - DNA, 27 bp, Artificial Sequences
  Synthetic
gggagcggggtaggtttggagcgttat

SEQ ID NO: 8303 - DNA, 27 bp, Artificial Sequences
  Synthetic
gggatatgaaggtgaagggcgaggcgt

SEQ ID NO: 8304 - DNA, 27 bp, Artificial Sequences
  Synthetic
gttgaggggagcggggtaggtttggag

SEQ ID NO: 8305 - DNA, 27 bp, Artificial Sequences
  Synthetic
gcgataggttagaatacgggcggcggt

SEQ ID NO: 8306 - DNA, 27 bp, Artificial Sequences
  Synthetic
agcgcgttttgggtttggttttggtcg

SEQ ID NO: 8307 - DNA, 27 bp, Artificial Sequences
  Synthetic
aaagttgttttggagggtcggagggcg

SEQ ID NO: 8308 - DNA, 27 bp, Artificial Sequences
  Synthetic
aggcggaaagttgttttggagggtcgg

SEQ ID NO: 8309 - DNA, 27 bp, Artificial Sequences
  Synthetic
ggcggaaagttgttttggagggtcgga

SEQ ID NO: 8310 - DNA, 27 bp, Artificial Sequences
  Synthetic
aagttgttttggagggtcggagggcgg

SEQ ID NO: 8311 - DNA, 30 bp, Artificial Sequences
  Synthetic
tgacgtttaaaattaggggtgtgtagcggt

SEQ ID NO: 8312 - DNA, 31 bp, Artificial Sequences
  Synthetic
tgacgtttaaaattaggggtgtgtagcggtt

SEQ ID NO: 8313 - DNA, 31 bp, Artificial Sequences
  Synthetic
ttgacgtttaaaattaggggtgtgtagcggt

SEQ ID NO: 8314 - DNA, 31 bp, Artificial Sequences
  Synthetic
gcgagtttgacgtttaaaattaggggtgtgt

SEQ ID NO: 8315 - DNA, 31 bp, Artificial Sequences
  Synthetic
tgcgagtttgacgtttaaaattaggggtgtg

SEQ ID NO: 8316 - DNA, 27 bp, Artificial Sequences
  Synthetic
gtcgttcggaggtgtcgggaagtcgtt

SEQ ID NO: 8317 - DNA, 27 bp, Artificial Sequences
  Synthetic
tcgttcggaggtgtcgggaagtcgttt

SEQ ID NO: 8318 - DNA, 27 bp, Artificial Sequences
  Synthetic
aaagttgttttggagggtcggagggcg

SEQ ID NO: 8319 - DNA, 27 bp, Artificial Sequences
  Synthetic
aggcggaaagttgttttggagggtcgg

SEQ ID NO: 8320 - DNA, 27 bp, Artificial Sequences
  Synthetic
ggcggaaagttgttttggagggtcgga

SEQ ID NO: 8321 - DNA, 30 bp, Artificial Sequences; identical to SEQ ID NO: 8311
  Synthetic

SEQ ID NO: 8322 - DNA, 31 bp, Artificial Sequences; identical to SEQ ID NO: 8312
  Synthetic

SEQ ID NO: 8323 - DNA, 31 bp, Artificial Sequences; identical to SEQ ID NO: 8313
  Synthetic

SEQ ID NO: 8324 - DNA, 31 bp, Artificial Sequences; identical to SEQ ID NO: 8314
  Synthetic

SEQ ID NO: 8325 - DNA, 31 bp, Artificial Sequences; identical to SEQ ID NO: 8315
  Synthetic

SEQ ID NO: 8326 - DNA, 27 bp, Artificial Sequences
  Synthetic
gtcgttcggaggtgtcgggaagtcgtt

SEQ ID NO: 8327 - DNA, 27 bp, Artificial Sequences
  Synthetic
tcgttcggaggtgtcgggaagtcgttt

SEQ ID NO: 8328 - DNA, 27 bp, Artificial Sequences
  Synthetic
cgttcggaggtgtcgggaagtcgtttt

SEQ ID NO: 8329 - DNA, 26 bp, Artificial Sequences
  Synthetic
gtcgttcggaggtgtcgggaagtcgt

SEQ ID NO: 8330 - DNA, 28 bp, Artificial Sequences
  Synthetic
tcgttcggaggtgtcgggaagtcgtttt

SEQ ID NO: 8331 - DNA, 24 bp, Artificial Sequences
  Synthetic
cgttgtcgggtagggatcgggcga

SEQ ID NO: 8332 - DNA, 23 bp, Artificial Sequences
  Synthetic
cgttgtcgggtagggatcgggcg

SEQ ID NO: 8333 - DNA, 29 bp, Artificial Sequences
  Synthetic
gcgttaaggtttcggaagtttttagcggg

SEQ ID NO: 8334 - DNA, 30 bp, Artificial Sequences
  Synthetic
gcgttaaggtttcggaagtttttagcggga

SEQ ID NO: 8335 - DNA, 29 bp, Artificial Sequences
  Synthetic
agggaagaggaggggatttgtgtttttgt

SEQ ID NO: 8336 - DNA, 27 bp, Artificial Sequences
  Synthetic
tttttcgtcgttgaggtggagttcggc

SEQ ID NO: 8337 - DNA, 28 bp, Artificial Sequences
  Synthetic
gtttttcgtcgttgaggtggagttcggc

SEQ ID NO: 8338 - DNA, 29 bp, Artificial Sequences
  Synthetic
agtttttcgtcgttgaggtggagttcggc

SEQ ID NO: 8339 - DNA, 26 bp, Artificial Sequences
  Synthetic
ttttcgtcgttgaggtggagttcggc

SEQ ID NO: 8340 - DNA, 24 bp, Artificial Sequences
  Synthetic
cgttgtcgggtagggatcgggcga

SEQ ID NO: 8341 - DNA, 28 bp, Artificial Sequences
  Synthetic
tcgggttagttttagtttacggcgtggt

SEQ ID NO: 8342 - DNA, 29 bp, Artificial Sequences
  Synthetic
tcgggttagttttagtttacggcgtggtt

SEQ ID NO: 8343 - DNA, 29 bp, Artificial Sequences
  Synthetic
ttcgggttagttttagtttacggcgtggt

SEQ ID NO: 8344 - DNA, 30 bp, Artificial Sequences
  Synthetic
ttcgggttagttttagtttacggcgtggtt

SEQ ID NO: 8345 - DNA, 30 bp, Artificial Sequences
  Synthetic
tttcgggttagttttagtttacggcgtggt

SEQ ID NO: 8346 - DNA, 27 bp, Artificial Sequences
  Synthetic
tggagttcggcggcgggagtttagatt

SEQ ID NO: 8347 - DNA, 27 bp, Artificial Sequences
  Synthetic
gtggagttcggcggcgggagtttagat

SEQ ID NO: 8348 - DNA, 27 bp, Artificial Sequences
  Synthetic
ggagttcggcggcgggagtttagattt

SEQ ID NO: 8349 - DNA, 28 bp, Artificial Sequences
  Synthetic
tggagttcggcggcgggagtttagattt

SEQ ID NO: 8350 - DNA, 26 bp, Artificial Sequences
  Synthetic
tggagttcggcggcgggagtttagat

SEQ ID NO: 8351 - DNA, 27 bp, Artificial Sequences
  Synthetic
agatgtttcgacggttgcgcgggtttt

SEQ ID NO: 8352 - DNA, 27 bp, Artificial Sequences
  Synthetic
gagatgtttcgacggttgcgcgggttt

SEQ ID NO: 8353 - DNA, 27 bp, Artificial Sequences
  Synthetic
gatgtttcgacggttgcgcgggttttc

SEQ ID NO: 8354 - DNA, 27 bp, Artificial Sequences
  Synthetic
atgtttcgacggttgcgcgggttttcg

SEQ ID NO: 8355 - DNA, 26 bp, Artificial Sequences
  Synthetic
gagatgtttcgacggttgcgcgggtt

SEQ ID NO: 8356 - DNA, 27 bp, Artificial Sequences
  Synthetic
tggagttcggcggcgggagtttagatt

SEQ ID NO: 8357 - DNA, 27 bp, Artificial Sequences
  Synthetic
cgtcgtgggttgggattggttcggaac

SEQ ID NO: 8358 - DNA, 27 bp, Artificial Sequences
  Synthetic
acgtcgtgggttgggattggttcggaa

SEQ ID NO: 8359 - DNA, 27 bp, Artificial Sequences
  Synthetic
cggggtaggtttggagcgtcgtgagta

SEQ ID NO: 8360 - DNA, 27 bp, Artificial Sequences
  Synthetic
tacgtcgtgggttgggattggttcgga

SEQ ID NO: 8361 - DNA, 27 bp, Artificial Sequences
  Synthetic
agatgtttcgacggttgcgcgggtttt

SEQ ID NO: 8362 - DNA, 27 bp, Artificial Sequences
  Synthetic
gagatgtttcgacggttgcgcgggttt

SEQ ID NO: 8363 - DNA, 27 bp, Artificial Sequences
  Synthetic
gacgcggaggaaaagaaggtggtgagc

SEQ ID NO: 8364 - DNA, 27 bp, Artificial Sequences
  Synthetic
cggacgcggaggaaaagaaggtggtga

SEQ ID NO: 8365 - DNA, 27 bp, Artificial Sequences
  Synthetic
tcggacgcggaggaaaagaaggtggtg

SEQ ID NO: 8366 - DNA, 27 bp, Artificial Sequences
  Synthetic
gaggtgggcgtaggaggaggagttgtt

SEQ ID NO: 8367 - DNA, 27 bp, Artificial Sequences
  Synthetic
cgaggtgggcgtaggaggaggagttgt

SEQ ID NO: 8368 - DNA, 27 bp, Artificial Sequences
  Synthetic
aggtgggcgtaggaggaggagttgttt

SEQ ID NO: 8369 - DNA, 26 bp, Artificial Sequences
  Synthetic
cgaggtgggcgtaggaggaggagttg

SEQ ID NO: 8370 - DNA, 28 bp, Artificial Sequences
  Synthetic
gaggtgggcgtaggaggaggagttgttt

SEQ ID NO: 8371 - DNA, 27 bp, Artificial Sequences
  Synthetic
tttgcgcggggaagggtaggtttaggt

SEQ ID NO: 8372 - DNA, 27 bp, Artificial Sequences
  Synthetic
cgcggggaagggtaggtttaggtcgtt

SEQ ID NO: 8373 - DNA, 27 bp, Artificial Sequences
  Synthetic
ggaaagttttgcgcggggaagggtagg

SEQ ID NO: 8374 - DNA, 27 bp, Artificial Sequences
  Synthetic
gggaaagttttgcgcggggaagggtag

SEQ ID NO: 8375 - DNA, 27 bp, Artificial Sequences
  Synthetic
ttgcgcggggaagggtaggtttaggtc

SEQ ID NO: 8376 - DNA, 27 bp, Artificial Sequences
  Synthetic
gaggtgggcgtaggaggaggagttgtt

SEQ ID NO: 8377 - DNA, 27 bp, Artificial Sequences
  Synthetic
cgaggtgggcgtaggaggaggagttgt

SEQ ID NO: 8378 - DNA, 27 bp, Artificial Sequences
  Synthetic
aggtgggcgtaggaggaggagttgttt

SEQ ID NO: 8379 - DNA, 26 bp, Artificial Sequences
  Synthetic
cgaggtgggcgtaggaggaggagttg

SEQ ID NO: 8380 - DNA, 28 bp, Artificial Sequences
  Synthetic
gaggtgggcgtaggaggaggagttgttt

SEQ ID NO: 8381 - DNA, 27 bp, Artificial Sequences
  Synthetic
tagggcgtgggtagtggtggtagtgga

SEQ ID NO: 8382 - DNA, 27 bp, Artificial Sequences
  Synthetic
tttgcgcggggaagggtaggtttaggt

SEQ ID NO: 8383 - DNA, 27 bp, Artificial Sequences
  Synthetic
cgcggggaagggtaggtttaggtcgtt

SEQ ID NO: 8384 - DNA, 27 bp, Artificial Sequences
  Synthetic
ggaaagttttgcgcggggaagggtagg

SEQ ID NO: 8385 - DNA, 27 bp, Artificial Sequences
  Synthetic
gggaaagttttgcgcggggaagggtag

SEQ ID NO: 8386 - DNA, 27 bp, Artificial Sequences
  Synthetic
gcgtagttttgggcggtttgggtttgt

SEQ ID NO: 8387 - DNA, 28 bp, Artificial Sequences
  Synthetic
gcgtagttttgggcggtttgggtttgtt

SEQ ID NO: 8388 - DNA, 27 bp, Artificial Sequences
  Synthetic
gcggggattttgcgggattaggttaga

SEQ ID NO: 8389 - DNA, 29 bp, Artificial Sequences
  Synthetic
gcgtagttttgggcggtttgggtttgttt

SEQ ID NO: 8390 - DNA, 27 bp, Artificial Sequences
  Synthetic
cgtagttttgggcggtttgggtttgtt

SEQ ID NO: 8391 - DNA, 27 bp, Artificial Sequences
  Synthetic
tagggcgtgggtagtggtggtagtgga

SEQ ID NO: 8392 - DNA, 27 bp, Artificial Sequences
  Synthetic
gtagggcgtgggtagtggtggtagtgg

SEQ ID NO: 8393 - DNA, 27 bp, Artificial Sequences
  Synthetic
cggggtagcgatcggtaggagggaaag

SEQ ID NO: 8394 - DNA, 27 bp, Artificial Sequences
  Synthetic
tgggtagtggtggtagtggagcgggag

SEQ ID NO: 8395 - DNA, 27 bp, Artificial Sequences
  Synthetic
gggtagtggtggtagtggagcgggagt

SEQ ID NO: 8396 - DNA, 27 bp, Artificial Sequences
  Synthetic
gcgtagttttgggcggtttgggtttgt

SEQ ID NO: 8397 - DNA, 28 bp, Artificial Sequences
  Synthetic
gcgtagttttgggcggtttgggtttgtt

SEQ ID NO: 8398 - DNA, 29 bp, Artificial Sequences
  Synthetic
gcgtagttttgggcggtttgggtttgttt

SEQ ID NO: 8399 - DNA, 27 bp, Artificial Sequences
  Synthetic
cgtagttttgggcggtttgggtttgtt

SEQ ID NO: 8400 - DNA, 26 bp, Artificial Sequences
  Synthetic
gcgtagttttgggcggtttgggtttg

SEQ ID NO: 8401 - DNA, 27 bp, Artificial Sequences
  Synthetic
taggtttagcgatgagggggttgcggg

SEQ ID NO: 8402 - DNA, 27 bp, Artificial Sequences
  Synthetic
ttgttggtgcggggtaggtttggggta

SEQ ID NO: 8403 - DNA, 27 bp, Artificial Sequences
  Synthetic
tgttggtgcggggtaggtttggggtag

SEQ ID NO: 8404 - DNA, 27 bp, Artificial Sequences
  Synthetic
tagcgatgagggggttgcgggtttgta

SEQ ID NO: 8405 - DNA, 27 bp, Artificial Sequences
  Synthetic
ttagcgatgagggggttgcgggtttgt

SEQ ID NO: 8406 - DNA, 27 bp, Artificial Sequences
  Synthetic
gttttcgtttgatcgcgtggagtcgga

SEQ ID NO: 8407 - DNA, 27 bp, Artificial Sequences
  Synthetic
tcgtttgatcgcgtggagtcggatttc

SEQ ID NO: 8408 - DNA, 27 bp, Artificial Sequences
  Synthetic
ttcgtttgatcgcgtggagtcggattt

SEQ ID NO: 8409 - DNA, 27 bp, Artificial Sequences
  Synthetic
tttcgtttgatcgcgtggagtcggatt

SEQ ID NO: 8410 - DNA, 27 bp, Artificial Sequences
  Synthetic
ttttcgtttgatcgcgtggagtcggat

SEQ ID NO: 8411 - DNA, 27 bp, Artificial Sequences
  Synthetic
taggtttagcgatgagggggttgcggg

SEQ ID NO: 8412 - DNA, 27 bp, Artificial Sequences
  Synthetic
ttgttggtgcggggtaggtttggggta

SEQ ID NO: 8413 - DNA, 27 bp, Artificial Sequences
  Synthetic
tgttggtgcggggtaggtttggggtag

SEQ ID NO: 8414 - DNA, 27 bp, Artificial Sequences
  Synthetic
tagcgatgagggggttgcgggtttgta

SEQ ID NO: 8415 - DNA, 27 bp, Artificial Sequences
  Synthetic
ttagcgatgagggggttgcgggtttgt

SEQ ID NO: 8416 - DNA, 27 bp, Artificial Sequences
  Synthetic
gttttcgtttgatcgcgtggagtcgga

SEQ ID NO: 8417 - DNA, 27 bp, Artificial Sequences
  Synthetic
tcgtttgatcgcgtggagtcggatttc

SEQ ID NO: 8418 - DNA, 27 bp, Artificial Sequences
  Synthetic
ttcgtttgatcgcgtggagtcggattt

SEQ ID NO: 8419 - DNA, 27 bp, Artificial Sequences
  Synthetic
tttcgtttgatcgcgtggagtcggatt

SEQ ID NO: 8420 - DNA, 27 bp, Artificial Sequences
  Synthetic
ttttcgtttgatcgcgtggagtcggat

SEQ ID NO: 8421 - DNA, 27 bp, Artificial Sequences
  Synthetic
tttcgttggttgcgtggggttagcgtc

SEQ ID NO: 8422 - DNA, 27 bp, Artificial Sequences
  Synthetic
gttggttgcgtggggttagcgtcgttt

SEQ ID NO: 8423 - DNA, 27 bp, Artificial Sequences
  Synthetic
atttcgttggttgcgtggggttagcgt

SEQ ID NO: 8424 - DNA, 27 bp, Artificial Sequences
  Synthetic
ggttgcgtggggttagcgtcgtttagt

SEQ ID NO: 8425 - DNA, 27 bp, Artificial Sequences
  Synthetic
tggttgcgtggggttagcgtcgtttag

SEQ ID NO: 8426 - DNA, 27 bp, Artificial Sequences
  Synthetic
gagtttgcgtttcgggtgggagagagt

SEQ ID NO: 8427 - DNA, 28 bp, Artificial Sequences
  Synthetic
gcgtttcgggtgggagagagtttgttgg

SEQ ID NO: 8428 - DNA, 27 bp, Artificial Sequences
  Synthetic
tgcgtttcgggtgggagagagtttgtt

SEQ ID NO: 8429 - DNA, 27 bp, Artificial Sequences
  Synthetic
ttgcgtttcgggtgggagagagtttgt

SEQ ID NO: 8430 - DNA, 28 bp, Artificial Sequences
  Synthetic
agagtttgcgtttcgggtgggagagagt

SEQ ID NO: 8431 - DNA, 27 bp, Artificial Sequences
  Synthetic
aggtcgttttttcggtcggtttttcgt

SEQ ID NO: 8432 - DNA, 28 bp, Artificial Sequences
  Synthetic
gaggtcgttttttcggtcggtttttcgt

SEQ ID NO: 8433 - DNA, 28 bp, Artificial Sequences
  Synthetic
aggtcgttttttcggtcggtttttcgtt

SEQ ID NO: 8434 - DNA, 29 bp, Artificial Sequences
  Synthetic
gaggtcgttttttcggtcggtttttcgtt

SEQ ID NO: 8435 - DNA, 29 bp, Artificial Sequences
  Synthetic
aggtcgttttttcggtcggtttttcgttt

SEQ ID NO: 8436 - DNA, 27 bp, Artificial Sequences
  Synthetic
ttttcgggtgaggcgggaagtcgatcg

SEQ ID NO: 8437 - DNA, 27 bp, Artificial Sequences
  Synthetic
cgcggggttggggtcgagattaggata

SEQ ID NO: 8438 - DNA, 27 bp, Artificial Sequences
  Synthetic
tcgcggggttggggtcgagattaggat

SEQ ID NO: 8439 - DNA, 27 bp, Artificial Sequences
  Synthetic
tttttcgggtgaggcgggaagtcgatc

SEQ ID NO: 8440 - DNA, 26 bp, Artificial Sequences
  Synthetic
cgcggggttggggtcgagattaggat

SEQ ID NO: 8441 - DNA, 27 bp, Artificial Sequences
  Synthetic
ttggtttcggttttagtttcgcggtgc

SEQ ID NO: 8442 - DNA, 28 bp, Artificial Sequences
  Synthetic
tttggtttcggttttagtttcgcggtgc

SEQ ID NO: 8443 - DNA, 27 bp, Artificial Sequences
  Synthetic
aggtcgttttttcggtcggtttttcgt

SEQ ID NO: 8444 - DNA, 26 bp, Artificial Sequences
  Synthetic
tggtttcggttttagtttcgcggtgc

SEQ ID NO: 8445 - DNA, 28 bp, Artificial Sequences
  Synthetic
gaggtcgttttttcggtcggtttttcgt

SEQ ID NO: 8446 - DNA, 28 bp, Artificial Sequences
  Synthetic
tgcgcggcgatggttatttgtattcggt

SEQ ID NO: 8447 - DNA, 27 bp, Artificial Sequences
  Synthetic
gcgcggcgatggttatttgtattcggt

SEQ ID NO: 8448 - DNA, 27 bp, Artificial Sequences
  Synthetic
tgcgcggcgatggttatttgtattcgg

SEQ ID NO: 8449 - DNA, 28 bp, Artificial Sequences
  Synthetic
gcgcggcgatggttatttgtattcggtt

SEQ ID NO: 8450 - DNA, 28 bp, Artificial Sequences
  Synthetic
ttgcgcggcgatggttatttgtattcgg

SEQ ID NO: 8451 - DNA, 27 bp, Artificial Sequences
  Synthetic
ggcgtcgttttgtaggttgcgggtgag

SEQ ID NO: 8452 - DNA, 27 bp, Artificial Sequences
  Synthetic
aaaggatcgaaggtgcggtgaggtcgg

SEQ ID NO: 8453 - DNA, 27 bp, Artificial Sequences
  Synthetic
gttggcgttgagggggttgttcgttgg

SEQ ID NO: 8454 - DNA, 27 bp, Artificial Sequences
  Synthetic
ggtgagatgcgcgatgtaggtggtggt

SEQ ID NO: 8455 - DNA, 27 bp, Artificial Sequences
  Synthetic
gcgtcgttttgtaggttgcgggtgaga

SEQ ID NO: 8456 - DNA, 27 bp, Artificial Sequences
  Synthetic
cgtacggggagaattagggggttgcgt

SEQ ID NO: 8457 - DNA, 27 bp, Artificial Sequences
  Synthetic
tttcgttgggttgttggtgggcgtacg

SEQ ID NO: 8458 - DNA, 27 bp, Artificial Sequences
  Synthetic
ttggtgggcgtacggggagaattaggg

SEQ ID NO: 8459 - DNA, 27 bp, Artificial Sequences
  Synthetic
gggcgtacggggagaattagggggttg

SEQ ID NO: 8460 - DNA, 27 bp, Artificial Sequences
  Synthetic
ggttgttggtgggcgtacggggagaat

SEQ ID NO: 8461 - DNA, 27 bp, Artificial Sequences
  Synthetic
aagcggttcggagttgtaggaagggcg

SEQ ID NO: 8462 - DNA, 27 bp, Artificial Sequences
  Synthetic
ggttcggagttgtaggaagggcgtcgg

SEQ ID NO: 8463 - DNA, 27 bp, Artificial Sequences
  Synthetic
cggttcggagttgtaggaagggcgtcg

SEQ ID NO: 8464 - DNA, 27 bp, Artificial Sequences
  Synthetic
gaagcggttcggagttgtaggaagggc

SEQ ID NO: 8465 - DNA, 27 bp, Artificial Sequences
  Synthetic
gcggttcggagttgtaggaagggcgtc

SEQ ID NO: 8466 - DNA, 24 bp, Artificial Sequences
  Synthetic
cgtagtcggtatttttgcggcgcg

SEQ ID NO: 8467 - DNA, 27 bp, Artificial Sequences
  Synthetic
agatttagaggcgggttggggacgtga

SEQ ID NO: 8468 - DNA, 27 bp, Artificial Sequences
  Synthetic
gatttagaggcgggttggggacgtgag

SEQ ID NO: 8469 - DNA, 28 bp, Artificial Sequences
  Synthetic
agatttagaggcgggttggggacgtgag

SEQ ID NO: 8470 - DNA, 27 bp, Artificial Sequences
  Synthetic
ggggcggggtttgcggtttttagattt

SEQ ID NO: 8471 - DNA, 27 bp, Artificial Sequences
  Synthetic
tagatttagaggcgggttggggacgtg

SEQ ID NO: 8472 - DNA, 27 bp, Artificial Sequences
  Synthetic
gaggggacgtttaaggttatcgcggcg

SEQ ID NO: 8473 - DNA, 27 bp, Artificial Sequences
  Synthetic
ggaggggacgtttaaggttatcgcggc

SEQ ID NO: 8474 - DNA, 27 bp, Artificial Sequences
  Synthetic
gggaggggacgtttaaggttatcgcgg

SEQ ID NO: 8475 - DNA, 27 bp, Artificial Sequences
  Synthetic
ggggaggggacgtttaaggttatcgcg

SEQ ID NO: 8476 - DNA, 27 bp, Artificial Sequences
  Synthetic
cggggaggggacgtttaaggttatcgc

SEQ ID NO: 8477 - DNA, 27 bp, Artificial Sequences
  Synthetic
tcgtagggggcggtggaattaaagtgt

SEQ ID NO: 8478 - DNA, 27 bp, Artificial Sequences
  Synthetic
cgtagggggcggtggaattaaagtgtt

SEQ ID NO: 8479 - DNA, 28 bp, Artificial Sequences
  Synthetic
tcgtagggggcggtggaattaaagtgtt

SEQ ID NO: 8480 - DNA, 28 bp, Artificial Sequences
  Synthetic
ttcgtagggggcggtggaattaaagtgt

SEQ ID NO: 8481 - DNA, 27 bp, Artificial Sequences
  Synthetic
gggggcggtggaattaaagtgttaggt

SEQ ID NO: 8482 - DNA, 30 bp, Artificial Sequences
  Synthetic
tgagttcgggtttgggtttatagagggagt

SEQ ID NO: 8483 - DNA, 30 bp, Artificial Sequences
  Synthetic
tgttgagttcgggtttgggtttatagaggg

SEQ ID NO: 8484 - DNA, 30 bp, Artificial Sequences
  Synthetic
gttgagttcgggtttgggtttatagaggga

SEQ ID NO: 8485 - DNA, 31 bp, Artificial Sequences
  Synthetic
tgttgagttcgggtttgggtttatagaggga

SEQ ID NO: 8486 - DNA, 31 bp, Artificial Sequences
  Synthetic
tgagttcgggtttgggtttatagagggagtt

SEQ ID NO: 8487 - DNA, 27 bp, Artificial Sequences
  Synthetic
gaaggggggtatggcgggggtagtaga

SEQ ID NO: 8488 - DNA, 27 bp, Artificial Sequences
  Synthetic
aaggggggtatggcgggggtagtagac

SEQ ID NO: 8489 - DNA, 27 bp, Artificial Sequences
  Synthetic
tattcggaaggggaaggggggtatggc

SEQ ID NO: 8490 - DNA, 27 bp, Artificial Sequences
  Synthetic
ggaaggggggtatggcgggggtagtag

SEQ ID NO: 8491 - DNA, 26 bp, Artificial Sequences
  Synthetic
aaggggggtatggcgggggtagtaga

SEQ ID NO: 8492 - DNA, 28 bp, Artificial Sequences
  Synthetic
tggaggtcgtagcgtttgttgttttcgt

SEQ ID NO: 8493 - DNA, 27 bp, Artificial Sequences
  Synthetic
ggaggtcgtagcgtttgttgttttcgt

SEQ ID NO: 8494 - DNA, 27 bp, Artificial Sequences
  Synthetic
tggaggtcgtagcgtttgttgttttcg

SEQ ID NO: 8495 - DNA, 28 bp, Artificial Sequences
  Synthetic
ggtagttggaggtcgtagcgtttgttgt

SEQ ID NO: 8496 - DNA, 29 bp, Artificial Sequences
  Synthetic
tggaggtcgtagcgtttgttgttttcgtt

SEQ ID NO: 8497 - DNA, 27 bp, Artificial Sequences
  Synthetic
ggggtatggcgggggtagtagacgttg

SEQ ID NO: 8498 - DNA, 27 bp, Artificial Sequences
  Synthetic
gaaggggggtatggcgggggtagtaga

SEQ ID NO: 8499 - DNA, 27 bp, Artificial Sequences
  Synthetic
gggtatggcgggggtagtagacgttgc

SEQ ID NO: 8500 - DNA, 27 bp, Artificial Sequences
  Synthetic
gtatggcgggggtagtagacgttgcgg

SEQ ID NO: 8501 - DNA, 27 bp, Artificial Sequences
  Synthetic
ggtatggcgggggtagtagacgttgcg

SEQ ID NO: 8502 - DNA, 32 bp, Artificial Sequences
  Synthetic
cgggatggttttatttcggttaagtgaggtcg

SEQ ID NO: 8503 - DNA, 33 bp, Artificial Sequences
  Synthetic
cgggatggttttatttcggttaagtgaggtcgt

SEQ ID NO: 8504 - DNA, 31 bp, Artificial Sequences
  Synthetic
tcgggatggttttatttcggttaagtgaggt

SEQ ID NO: 8505 - DNA, 33 bp, Artificial Sequences
  Synthetic
tcgggatggttttatttcggttaagtgaggtcg

SEQ ID NO: 8506 - DNA, 31 bp, Artificial Sequences
  Synthetic
cggtttcgggatggttttatttcggttaagt

SEQ ID NO: 8507 - DNA, 27 bp, Artificial Sequences
  Synthetic
tttgcgggttgtttttcggcgggtagt

SEQ ID NO: 8508 - DNA, 27 bp, Artificial Sequences
  Synthetic
aggttttgcgggttgtttttcggcggg

SEQ ID NO: 8509 - DNA, 27 bp, Artificial Sequences
  Synthetic
ttgcgggttgtttttcggcgggtagta

SEQ ID NO: 8510 - DNA, 27 bp, Artificial Sequences
  Synthetic
ggttttgcgggttgtttttcggcgggt

SEQ ID NO: 8511 - DNA, 27 bp, Artificial Sequences
  Synthetic
gttttgcgggttgtttttcggcgggta

SEQ ID NO: 8512 - DNA, 27 bp, Artificial Sequences
  Synthetic
ggatttggggttggttggggtggagga

SEQ ID NO: 8513 - DNA, 27 bp, Artificial Sequences
  Synthetic
atttggggttggttggggtggaggagg

SEQ ID NO: 8514 - DNA, 27 bp, Artificial Sequences
  Synthetic
tggatttggggttggttggggtggagg

SEQ ID NO: 8515 - DNA, 27 bp, Artificial Sequences
  Synthetic
gttggttggggtggaggaggttggtgg

SEQ ID NO: 8516 - DNA, 27 bp, Artificial Sequences
  Synthetic
ggttggttggggtggaggaggttggtg

SEQ ID NO: 8517 - DNA, 27 bp, Artificial Sequences
  Synthetic
tttgcgggttgtttttcggcgggtagt

SEQ ID NO: 8518 - DNA, 27 bp, Artificial Sequences
  Synthetic
aggttttgcgggttgtttttcggcggg

SEQ ID NO: 8519 - DNA, 27 bp, Artificial Sequences
  Synthetic
ttgcgggttgtttttcggcgggtagta

SEQ ID NO: 8520 - DNA, 27 bp, Artificial Sequences
  Synthetic
ggttttgcgggttgtttttcggcgggt

SEQ ID NO: 8521 - DNA, 27 bp, Artificial Sequences
  Synthetic
gttttgcgggttgtttttcggcgggta

SEQ ID NO: 8522 - DNA, 27 bp, Artificial Sequences
  Synthetic
ggatttggggttggttggggtggagga

SEQ ID NO: 8523 - DNA, 27 bp, Artificial Sequences
  Synthetic
atttggggttggttggggtggaggagg

SEQ ID NO: 8524 - DNA, 27 bp, Artificial Sequences
  Synthetic
tggatttggggttggttggggtggagg

SEQ ID NO: 8525 - DNA, 27 bp, Artificial Sequences
  Synthetic
gttggttggggtggaggaggttggtgg

SEQ ID NO: 8526 - DNA, 27 bp, Artificial Sequences
  Synthetic
ggttggttggggtggaggaggttggtg

SEQ ID NO: 8527 - DNA, 27 bp, Artificial Sequences
  Synthetic
cgggtggtcgttttgttttttcggggg

SEQ ID NO: 8528 - DNA, 28 bp, Artificial Sequences
  Synthetic
cgggtggtcgttttgttttttcgggggt

SEQ ID NO: 8529 - DNA, 28 bp, Artificial Sequences
  Synthetic
tcgggtggtcgttttgttttttcggggg

SEQ ID NO: 8530 - DNA, 27 bp, Artificial Sequences
  Synthetic
gggtggtcgttttgttttttcgggggt

SEQ ID NO: 8531 - DNA, 27 bp, Artificial Sequences
  Synthetic
tcgggtggtcgttttgttttttcgggg

SEQ ID NO: 8532 - DNA, 27 bp, Artificial Sequences
  Synthetic
atgcggtttttgggcgttcggtatggg

SEQ ID NO: 8533 - DNA, 27 bp, Artificial Sequences
  Synthetic
gcggtttttgggcgttcggtatgggtt

SEQ ID NO: 8534 - DNA, 26 bp, Artificial Sequences
  Synthetic
tgcggtttttgggcgttcggtatggg

SEQ ID NO: 8535 - DNA, 26 bp, Artificial Sequences
  Synthetic
gcggtttttgggcgttcggtatgggt

SEQ ID NO: 8536 - DNA, 27 bp, Artificial Sequences
  Synthetic
tgcggtttttgggcgttcggtatgggt

SEQ ID NO: 8537 - DNA, 27 bp, Artificial Sequences
  Synthetic
agaaagaagcgtcgagggtgggggaaa

SEQ ID NO: 8538 - DNA, 27 bp, Artificial Sequences
  Synthetic
gaagcgtcgagggtgggggaaacgtag

SEQ ID NO: 8539 - DNA, 27 bp, Artificial Sequences
  Synthetic
gaaagaagcgtcgagggtgggggaaac

SEQ ID NO: 8540 - DNA, 27 bp, Artificial Sequences
  Synthetic
aaagaagcgtcgagggtgggggaaacg

SEQ ID NO: 8541 - DNA, 27 bp, Artificial Sequences
  Synthetic
tagaaagaagcgtcgagggtgggggaa

SEQ ID NO: 8542 - DNA, 27 bp, Artificial Sequences
  Synthetic
atgcggtttttgggcgttcggtatggg

SEQ ID NO: 8543 - DNA, 27 bp, Artificial Sequences
  Synthetic
ggtcggggggtaggcgaggaatttgtt

SEQ ID NO: 8544 - DNA, 27 bp, Artificial Sequences
  Synthetic
gcggtttttgggcgttcggtatgggtt

SEQ ID NO: 8545 - DNA, 27 bp, Artificial Sequences
  Synthetic
aagaggaagtagcggtcggggggtagg

SEQ ID NO: 8546 - DNA, 27 bp, Artificial Sequences
  Synthetic
tcgttgttaggtcgggggtgaggttgt

SEQ ID NO: 8547 - DNA, 27 bp, Artificial Sequences
  Synthetic
agaaagaagcgtcgagggtgggggaaa

SEQ ID NO: 8548 - DNA, 27 bp, Artificial Sequences
  Synthetic
gaagcgtcgagggtgggggaaacgtag

SEQ ID NO: 8549 - DNA, 27 bp, Artificial Sequences
  Synthetic
gaaagaagcgtcgagggtgggggaaac

SEQ ID NO: 8550 - DNA, 27 bp, Artificial Sequences
  Synthetic
aaagaagcgtcgagggtgggggaaacg

SEQ ID NO: 8551 - DNA, 27 bp, Artificial Sequences
  Synthetic
tagaaagaagcgtcgagggtgggggaa

SEQ ID NO: 8552 - DNA, 27 bp, Artificial Sequences
  Synthetic
aagaggaagtagcggtcggggggtagg

SEQ ID NO: 8553 - DNA, 27 bp, Artificial Sequences
  Synthetic
tcgttgttaggtcgggggtgaggttgt

SEQ ID NO: 8554 - DNA, 27 bp, Artificial Sequences
  Synthetic
gttaagaggaagtagcggtcggggggt

SEQ ID NO: 8555 - DNA, 27 bp, Artificial Sequences
  Synthetic
agtcgttgttaggtcgggggtgaggtt

SEQ ID NO: 8556 - DNA, 27 bp, Artificial Sequences
  Synthetic
aagtcgttgttaggtcgggggtgaggt

SEQ ID NO: 8557 - DNA, 27 bp, Artificial Sequences
  Synthetic
agaaagaagcgtcgagggtgggggaaa

SEQ ID NO: 8558 - DNA, 27 bp, Artificial Sequences
  Synthetic
gaagcgtcgagggtgggggaaacgtag

SEQ ID NO: 8559 - DNA, 27 bp, Artificial Sequences
  Synthetic
gaaagaagcgtcgagggtgggggaaac

SEQ ID NO: 8560 - DNA, 27 bp, Artificial Sequences
  Synthetic
aaagaagcgtcgagggtgggggaaacg

SEQ ID NO: 8561 - DNA, 27 bp, Artificial Sequences
  Synthetic
tagaaagaagcgtcgagggtgggggaa

SEQ ID NO: 8562 - DNA, 27 bp, Artificial Sequences
  Synthetic
tcgttgttaggtcgggggtgaggttgt

SEQ ID NO: 8563 - DNA, 27 bp, Artificial Sequences
  Synthetic
agtcgttgttaggtcgggggtgaggtt

SEQ ID NO: 8564 - DNA, 27 bp, Artificial Sequences
  Synthetic
aagtcgttgttaggtcgggggtgaggt

SEQ ID NO: 8565 - DNA, 28 bp, Artificial Sequences
  Synthetic
gtcgttgttaggtcgggggtgaggttgt

SEQ ID NO: 8566 - DNA, 27 bp, Artificial Sequences
  Synthetic
gtcgttgttaggtcgggggtgaggttg

SEQ ID NO: 8567 - DNA, 28 bp, Artificial Sequences
  Synthetic
gcggtttggaagagagagggaaaggagg

SEQ ID NO: 8568 - DNA, 27 bp, Artificial Sequences
  Synthetic
agcggtttggaagagagagggaaagga

SEQ ID NO: 8569 - DNA, 29 bp, Artificial Sequences
  Synthetic
agcggtttggaagagagagggaaaggagg

SEQ ID NO: 8570 - DNA, 29 bp, Artificial Sequences
  Synthetic
gcggtttggaagagagagggaaaggagga

SEQ ID NO: 8571 - DNA, 27 bp, Artificial Sequences
  Synthetic
tggtagcggtttggaagagagagggaa

SEQ ID NO: 8572 - DNA, 27 bp, Artificial Sequences
  Synthetic
ggttgcgggcgttttgaagattcggga

SEQ ID NO: 8573 - DNA, 27 bp, Artificial Sequences
  Synthetic
tcggttgcgggcgttttgaagattcgg

SEQ ID NO: 8574 - DNA, 27 bp, Artificial Sequences
  Synthetic
ggagtttagaagttcggttgcgggcgt

SEQ ID NO: 8575 - DNA, 27 bp, Artificial Sequences
  Synthetic
cggttgcgggcgttttgaagattcggg

SEQ ID NO: 8576 - DNA, 27 bp, Artificial Sequences
  Synthetic
aggagtttagaagttcggttgcgggcg

SEQ ID NO: 8577 - DNA, 27 bp, Artificial Sequences
  Synthetic
gcggttggatgtgagggcgatttggtt

SEQ ID NO: 8578 - DNA, 27 bp, Artificial Sequences
  Synthetic
ggtaggcggttggatgtgagggcgatt

SEQ ID NO: 8579 - DNA, 27 bp, Artificial Sequences
  Synthetic
attggtaggcggttggatgtgagggcg

SEQ ID NO: 8580 - DNA, 27 bp, Artificial Sequences
  Synthetic
aattggtaggcggttggatgtgagggc

SEQ ID NO: 8581 - DNA, 27 bp, Artificial Sequences
  Synthetic
gtaggcggttggatgtgagggcgattt

SEQ ID NO: 8582 - DNA, 31 bp, Artificial Sequences
  Synthetic
tggagtagtgaggtaggaaggggatattcgt

SEQ ID NO: 8583 - DNA, 30 bp, Artificial Sequences
  Synthetic
ggagtagtgaggtaggaaggggatattcgt

SEQ ID NO: 8584 - DNA, 30 bp, Artificial Sequences
  Synthetic
tggagtagtgaggtaggaaggggatattcg

SEQ ID NO: 8585 - DNA, 30 bp, Artificial Sequences
  Synthetic
tggttggtgaggaagttgaaggttaaggaa

SEQ ID NO: 8586 - DNA, 30 bp, Artificial Sequences
  Synthetic
atggttggtgaggaagttgaaggttaagga

SEQ ID NO: 8587 - DNA, 27 bp, Artificial Sequences
  Synthetic
cgtgttgaggtttcggagtagtcggga

SEQ ID NO: 8588 - DNA, 27 bp, Artificial Sequences
  Synthetic
tcgtgttgaggtttcggagtagtcggg

SEQ ID NO: 8589 - DNA, 28 bp, Artificial Sequences
  Synthetic
tcgtgttgaggtttcggagtagtcggga

SEQ ID NO: 8590 - DNA, 28 bp, Artificial Sequences
  Synthetic
cgtgttgaggtttcggagtagtcgggag

SEQ ID NO: 8591 - DNA, 29 bp, Artificial Sequences
  Synthetic
cgtgttgaggtttcggagtagtcgggagt

SEQ ID NO: 8592 - DNA, 27 bp, Artificial Sequences
  Synthetic
gggtgggatggttagtcgggttggagt

SEQ ID NO: 8593 - DNA, 27 bp, Artificial Sequences
  Synthetic
tgggtgggatggttagtcgggttggag

SEQ ID NO: 8594 - DNA, 27 bp, Artificial Sequences
  Synthetic
ttgcgttgggtgggatggttagtcggg

SEQ ID NO: 8595 - DNA, 27 bp, Artificial Sequences
  Synthetic
gcgttgggtgggatggttagtcgggtt

SEQ ID NO: 8596 - DNA, 27 bp, Artificial Sequences
  Synthetic
ttgggtgggatggttagtcgggttgga

SEQ ID NO: 8597 - DNA, 27 bp, Artificial Sequences
  Synthetic
gcggcgttaggattagggggttgttcg

SEQ ID NO: 8598 - DNA, 27 bp, Artificial Sequences
  Synthetic
cgcggcgttaggattagggggttgttc

SEQ ID NO: 8599 - DNA, 27 bp, Artificial Sequences
  Synthetic
tcggagggcgtagggttttagttcggt

SEQ ID NO: 8600 - DNA, 27 bp, Artificial Sequences
  Synthetic
gcgcggcgttaggattagggggttgtt

SEQ ID NO: 8601 - DNA, 28 bp, Artificial Sequences
  Synthetic
gtcggagggcgtagggttttagttcggt

SEQ ID NO: 8602 - DNA, 27 bp, Artificial Sequences
  Synthetic
tcgcgcgggtttttcgttggtttttgt

SEQ ID NO: 8603 - DNA, 27 bp, Artificial Sequences
  Synthetic
gtcgcgcgggtttttcgttggtttttg

SEQ ID NO: 8604 - DNA, 28 bp, Artificial Sequences
  Synthetic
gtcgcgcgggtttttcgttggtttttgt

SEQ ID NO: 8605 - DNA, 28 bp, Artificial Sequences
  Synthetic
cgggtagttttttggttttggcgtcgcg

SEQ ID NO: 8606 - DNA, 28 bp, Artificial Sequences
  Synthetic
ggcgtcgggtagttttttggttttggcg

SEQ ID NO: 8607 - DNA, 33 bp, Artificial Sequences
  Synthetic
gtgggattttttagtgtcggttttgtttagggt

SEQ ID NO: 8608 - DNA, 33 bp, Artificial Sequences
  Synthetic
tgtgggattttttagtgtcggttttgtttaggg

SEQ ID NO: 8609 - DNA, 34 bp, Artificial Sequences
  Synthetic
tgtgggattttttagtgtcggttttgtttagggt

SEQ ID NO: 8610 - DNA, 34 bp, Artificial Sequences
  Synthetic
gtgggattttttagtgtcggttttgtttagggtt

SEQ ID NO: 8611 - DNA, 34 bp, Artificial Sequences
  Synthetic
ttgtgggattttttagtgtcggttttgtttaggg

SEQ ID NO: 8612 - DNA, 27 bp, Artificial Sequences
  Synthetic
aggcggatgaattcggttggagagggg

SEQ ID NO: 8613 - DNA, 27 bp, Artificial Sequences
  Synthetic
gttggagaggggtcgggatggggattg

SEQ ID NO: 8614 - DNA, 27 bp, Artificial Sequences
  Synthetic
ggaggacgggaggtagtaggcggatga

SEQ ID NO: 8615 - DNA, 27 bp, Artificial Sequences
  Synthetic
aattcggttggagaggggtcgggatgg

SEQ ID NO: 8616 - DNA, 27 bp, Artificial Sequences
  Synthetic
agaggggtcgggatggggattgatgga

SEQ ID NO: 8617 - DNA, 27 bp, Artificial Sequences
  Synthetic
tagtcgggggttgggaggagagttcgt

SEQ ID NO: 8618 - DNA, 27 bp, Artificial Sequences
  Synthetic
aggttagtgcggggcgaggtgagtttt

SEQ ID NO: 8619 - DNA, 27 bp, Artificial Sequences
  Synthetic
attttcgaggttagtgcggggcgaggt

SEQ ID NO: 8620 - DNA, 27 bp, Artificial Sequences
  Synthetic
agttcgtggataggaggagggggcgat

SEQ ID NO: 8621 - DNA, 27 bp, Artificial Sequences
  Synthetic
ggttgggttgggttgggtgttgttcgg

SEQ ID NO: 8622 - DNA, 27 bp, Artificial Sequences
  Synthetic
ttaggtttttagggggtggggtggggg

SEQ ID NO: 8623 - DNA, 27 bp, Artificial Sequences
  Synthetic
cggatggtaagtcggcgtgtaagagcg

SEQ ID NO: 8624 - DNA, 27 bp, Artificial Sequences
  Synthetic
cgttgtcgtcgcgttttgtggtcgttt

SEQ ID NO: 8625 - DNA, 28 bp, Artificial Sequences
  Synthetic
cggatggtaagtcggcgtgtaagagcga

SEQ ID NO: 8626 - DNA, 28 bp, Artificial Sequences
  Synthetic
tcggatggtaagtcggcgtgtaagagcg

SEQ ID NO: 8627 - DNA, 27 bp, Artificial Sequences
  Synthetic
cgggtggggagggagatttaggtgtgg

SEQ ID NO: 8628 - DNA, 27 bp, Artificial Sequences
  Synthetic
gttttcggggggttttggagtcgggtg

SEQ ID NO: 8629 - DNA, 27 bp, Artificial Sequences
  Synthetic
gttttggagtcgggtggggagggagat

SEQ ID NO: 8630 - DNA, 27 bp, Artificial Sequences
  Synthetic
ttttcggggggttttggagtcgggtgg

SEQ ID NO: 8631 - DNA, 27 bp, Artificial Sequences
  Synthetic
ggttttcggggggttttggagtcgggt

SEQ ID NO: 8632 - DNA, 27 bp, Artificial Sequences
  Synthetic
aaaaggtagggtcgggaaggggaagcg

SEQ ID NO: 8633 - DNA, 27 bp, Artificial Sequences
  Synthetic
tcgtgatggtggagcgggtgatttcgt

SEQ ID NO: 8634 - DNA, 27 bp, Artificial Sequences
  Synthetic
cgtgatggtggagcgggtgatttcgtg

SEQ ID NO: 8635 - DNA, 27 bp, Artificial Sequences
  Synthetic
attagaggtcggagggcgtggggtttc

SEQ ID NO: 8636 - DNA, 27 bp, Artificial Sequences
  Synthetic
gaattagaggtcggagggcgtggggtt

SEQ ID NO: 8637 - DNA, 28 bp, Artificial Sequences
  Synthetic
tcgttagtgtttttagggaggttgcgga

SEQ ID NO: 8638 - DNA, 29 bp, Artificial Sequences
  Synthetic
tcgttagtgtttttagggaggttgcggaa

SEQ ID NO: 8639 - DNA, 29 bp, Artificial Sequences
  Synthetic
atcgttagtgtttttagggaggttgcgga

SEQ ID NO: 8640 - DNA, 29 bp, Artificial Sequences
  Synthetic
agggaggttgcggaaaagtagaggtaatg

SEQ ID NO: 8641 - DNA, 29 bp, Artificial Sequences
  Synthetic
gggaggttgcggaaaagtagaggtaatga

SEQ ID NO: 8642 - DNA, 27 bp, Artificial Sequences
  Synthetic
gggtttgtggggagggtcgagttggat

SEQ ID NO: 8643 - DNA, 27 bp, Artificial Sequences
  Synthetic
ttgggtttgtggggagggtcgagttgg

SEQ ID NO: 8644 - DNA, 27 bp, Artificial Sequences
  Synthetic
ggtttgtggggagggtcgagttggatg

SEQ ID NO: 8645 - DNA, 26 bp, Artificial Sequences
  Synthetic
gggtttgtggggagggtcgagttgga

SEQ ID NO: 8646 - DNA, 28 bp, Artificial Sequences
  Synthetic
ggtttgtggggagggtcgagttggatgt

SEQ ID NO: 8647 - DNA, 27 bp, Artificial Sequences
  Synthetic
gcggggttgggttcggtcggtataagt

SEQ ID NO: 8648 - DNA, 27 bp, Artificial Sequences
  Synthetic
tcggtgaggcgttcggtatggattggg

SEQ ID NO: 8649 - DNA, 27 bp, Artificial Sequences
  Synthetic
attcgagacggagcgggggttatacgg

SEQ ID NO: 8650 - DNA, 27 bp, Artificial Sequences
  Synthetic
cggtgaggcgttcggtatggattgggt

SEQ ID NO: 8651 - DNA, 27 bp, Artificial Sequences
  Synthetic
ggagcggttttgggcgatgggtttgac

SEQ ID NO: 8652 - DNA, 27 bp, Artificial Sequences
  Synthetic
cggaaggcgggaaaatgcgagtggttt

SEQ ID NO: 8653 - DNA, 26 bp, Artificial Sequences
  Synthetic
cggaaggcgggaaaatgcgagtggtt

SEQ ID NO: 8654 - DNA, 28 bp, Artificial Sequences
  Synthetic
cggaaggcgggaaaatgcgagtggtttt

SEQ ID NO: 8655 - DNA, 27 bp, Artificial Sequences
  Synthetic
tcgtagggtttttgggttgttcgcgga

SEQ ID NO: 8656 - DNA, 27 bp, Artificial Sequences
  Synthetic
ggaaggcgggaaaatgcgagtggtttt

SEQ ID NO: 8657 - DNA, 27 bp, Artificial Sequences
  Synthetic
attcgagacggagcgggggttatacgg

SEQ ID NO: 8658 - DNA, 27 bp, Artificial Sequences
  Synthetic
ttcgggtgggggataggtcgtcgagtt

SEQ ID NO: 8659 - DNA, 27 bp, Artificial Sequences
  Synthetic
tttcgggtgggggataggtcgtcgagt

SEQ ID NO: 8660 - DNA, 27 bp, Artificial Sequences
  Synthetic
ttttcgggtgggggataggtcgtcgag

SEQ ID NO: 8661 - DNA, 27 bp, Artificial Sequences
  Synthetic
tcgggtgggggataggtcgtcgagttc

SEQ ID NO: 8662 - DNA, 27 bp, Artificial Sequences
  Synthetic
cggaaggcgggaaaatgcgagtggttt

SEQ ID NO: 8663 - DNA, 27 bp, Artificial Sequences
  Synthetic
gcgtagggaagggcggattttcgggat

SEQ ID NO: 8664 - DNA, 26 bp, Artificial Sequences
  Synthetic
cggaaggcgggaaaatgcgagtggtt

SEQ ID NO: 8665 - DNA, 28 bp, Artificial Sequences
  Synthetic
cggaaggcgggaaaatgcgagtggtttt

SEQ ID NO: 8666 - DNA, 27 bp, Artificial Sequences
  Synthetic
tcgtagggtttttgggttgttcgcgga

SEQ ID NO: 8667 - DNA, 27 bp, Artificial Sequences
  Synthetic
ttttgcgggaggaggagagggtttcgg

SEQ ID NO: 8668 - DNA, 27 bp, Artificial Sequences
  Synthetic
gggttttgcgggaggaggagagggttt

SEQ ID NO: 8669 - DNA, 27 bp, Artificial Sequences
  Synthetic
ttcgggtgggggataggtcgtcgagtt

SEQ ID NO: 8670 - DNA, 27 bp, Artificial Sequences
  Synthetic
tttcgggtgggggataggtcgtcgagt

SEQ ID NO: 8671 - DNA, 27 bp, Artificial Sequences
  Synthetic
ttttcgggtgggggataggtcgtcgag

SEQ ID NO: 8672 - DNA, 27 bp, Artificial Sequences
  Synthetic
taataggggagggaggcggtggaggag

SEQ ID NO: 8673 - DNA, 27 bp, Artificial Sequences
  Synthetic
ttaataggggagggaggcggtggagga

SEQ ID NO: 8674 - DNA, 27 bp, Artificial Sequences
  Synthetic
gggagggaggcggtggaggagatttta

SEQ ID NO: 8675 - DNA, 27 bp, Artificial Sequences
  Synthetic
tttaataggggagggaggcggtggagg

SEQ ID NO: 8676 - DNA, 28 bp, Artificial Sequences
  Synthetic
ttaataggggagggaggcggtggaggag

SEQ ID NO: 8677 - DNA, 27 bp, Artificial Sequences
  Synthetic
tcggagaagggttttatttgagcgcgt

SEQ ID NO: 8678 - DNA, 27 bp, Artificial Sequences
  Synthetic
cggagaagggttttatttgagcgcgtt

SEQ ID NO: 8679 - DNA, 28 bp, Artificial Sequences
  Synthetic
tcggagaagggttttatttgagcgcgtt

SEQ ID NO: 8680 - DNA, 26 bp, Artificial Sequences
  Synthetic
cggagaagggttttatttgagcgcgt

SEQ ID NO: 8681 - DNA, 26 bp, Artificial Sequences
  Synthetic
tcggagaagggttttatttgagcgcg

SEQ ID NO: 8682 - DNA, 27 bp, Artificial Sequences
  Synthetic
cgagttgcgcgatgattggttggggag

SEQ ID NO: 8683 - DNA, 27 bp, Artificial Sequences
  Synthetic
agggattgtgggtcgagcggaagagtt

SEQ ID NO: 8684 - DNA, 27 bp, Artificial Sequences
  Synthetic
gagttgcgcgatgattggttggggagt

SEQ ID NO: 8685 - DNA, 27 bp, Artificial Sequences
  Synthetic
agttgcgcgatgattggttggggagtt

SEQ ID NO: 8686 - DNA, 27 bp, Artificial Sequences
  Synthetic
gagtagaaagtggcggatttgggcggt

SEQ ID NO: 8687 - DNA, 27 bp, Artificial Sequences
  Synthetic
ggtgggagggatagggcggtagtgaga

SEQ ID NO: 8688 - DNA, 27 bp, Artificial Sequences
  Synthetic
ttttgggaagggtgggagggatagggc

SEQ ID NO: 8689 - DNA, 27 bp, Artificial Sequences
  Synthetic
gaagggtgggagggatagggcggtagt

SEQ ID NO: 8690 - DNA, 27 bp, Artificial Sequences
  Synthetic
tgggagggatagggcggtagtgagagt

SEQ ID NO: 8691 - DNA, 27 bp, Artificial Sequences
  Synthetic
aagggtgggagggatagggcggtagtg

SEQ ID NO: 8692 - DNA, 27 bp, Artificial Sequences
  Synthetic
agagttggacggatgttttgtgggggt

SEQ ID NO: 8693 - DNA, 27 bp, Artificial Sequences
  Synthetic
gttggacggatgttttgtgggggttgt

SEQ ID NO: 8694 - DNA, 28 bp, Artificial Sequences
  Synthetic
agttggacggatgttttgtgggggttgt

SEQ ID NO: 8695 - DNA, 27 bp, Artificial Sequences
  Synthetic
agttggacggatgttttgtgggggttg

SEQ ID NO: 8696 - DNA, 27 bp, Artificial Sequences
  Synthetic
gagttggacggatgttttgtgggggtt

SEQ ID NO: 8697 - DNA, 27 bp, Artificial Sequences
  Synthetic
ggatttgggtttgggttagggcggtgt

SEQ ID NO: 8698 - DNA, 27 bp, Artificial Sequences
  Synthetic
tggatttgggtttgggttagggcggtg

SEQ ID NO: 8699 - DNA, 28 bp, Artificial Sequences
  Synthetic
tggatttgggtttgggttagggcggtgt

SEQ ID NO: 8700 - DNA, 27 bp, Artificial Sequences
  Synthetic
atggatttgggtttgggttagggcggt

SEQ ID NO: 8701 - DNA, 27 bp, Artificial Sequences
  Synthetic
tggggttggtggttacgtttgtttgcg

SEQ ID NO: 8702 - DNA, 27 bp, Artificial Sequences
  Synthetic
agagttggacggatgttttgtgggggt

SEQ ID NO: 8703 - DNA, 27 bp, Artificial Sequences
  Synthetic
gttggacggatgttttgtgggggttgt

SEQ ID NO: 8704 - DNA, 28 bp, Artificial Sequences
  Synthetic
agttggacggatgttttgtgggggttgt

SEQ ID NO: 8705 - DNA, 27 bp, Artificial Sequences
  Synthetic
agttggacggatgttttgtgggggttg

SEQ ID NO: 8706 - DNA, 27 bp, Artificial Sequences
  Synthetic
gagttggacggatgttttgtgggggtt

SEQ ID NO: 8707 - DNA, 27 bp, Artificial Sequences
  Synthetic
cggaaagggaaatgaaggggttcggcg

SEQ ID NO: 8708 - DNA, 27 bp, Artificial Sequences
  Synthetic
ggaaagggaaatgaaggggttcggcgt

SEQ ID NO: 8709 - DNA, 27 bp, Artificial Sequences
  Synthetic
tcggaaagggaaatgaaggggttcggc

SEQ ID NO: 8710 - DNA, 28 bp, Artificial Sequences
  Synthetic
gtcggaaagggaaatgaaggggttcggc

SEQ ID NO: 8711 - DNA, 28 bp, Artificial Sequences
  Synthetic
tcggaaagggaaatgaaggggttcggcg

SEQ ID NO: 8712 - DNA, 27 bp, Artificial Sequences
  Synthetic
aggtttttagagggttagcgtcgggtt

SEQ ID NO: 8713 - DNA, 28 bp, Artificial Sequences
  Synthetic
aggtttttagagggttagcgtcgggttt

SEQ ID NO: 8714 - DNA, 29 bp, Artificial Sequences
  Synthetic
aggtttttagagggttagcgtcgggtttt

SEQ ID NO: 8715 - DNA, 29 bp, Artificial Sequences
  Synthetic
taggtttttagagggttagcgtcgggttt

SEQ ID NO: 8716 - DNA, 30 bp, Artificial Sequences
  Synthetic
aggtttttagagggttagcgtcgggttttt

SEQ ID NO: 8717 - DNA, 31 bp, Artificial Sequences
  Synthetic
ggaaatgaacggttcgagtgttttttagggg

SEQ ID NO: 8718 - DNA, 32 bp, Artificial Sequences
  Synthetic
ggaaatgaacggttcgagtgttttttaggggt

SEQ ID NO: 8719 - DNA, 32 bp, Artificial Sequences
  Synthetic
tggaaatgaacggttcgagtgttttttagggg

SEQ ID NO: 8720 - DNA, 33 bp, Artificial Sequences
  Synthetic
tggaaatgaacggttcgagtgttttttaggggt

SEQ ID NO: 8721 - DNA, 31 bp, Artificial Sequences
  Synthetic
gaaatgaacggttcgagtgttttttaggggt

SEQ ID NO: 8722 - DNA, 27 bp, Artificial Sequences
  Synthetic
tcgtcgagaaggggcgtttgaaaggga

SEQ ID NO: 8723 - DNA, 27 bp, Artificial Sequences
  Synthetic
gtcgtcgagaaggggcgtttgaaaggg

SEQ ID NO: 8724 - DNA, 27 bp, Artificial Sequences
  Synthetic
ggttgtcgtcgagaaggggcgtttgaa

SEQ ID NO: 8725 - DNA, 27 bp, Artificial Sequences
  Synthetic
cggttgtcgtcgagaaggggcgtttga

SEQ ID NO: 8726 - DNA, 27 bp, Artificial Sequences
  Synthetic
tgtcgtcgagaaggggcgtttgaaagg

SEQ ID NO: 8727 - DNA, 27 bp, Artificial Sequences
  Synthetic
tttcgcggtatttacggaggttcgggt

SEQ ID NO: 8728 - DNA, 27 bp, Artificial Sequences
  Synthetic
cgcggtatttacggaggttcgggtagt

SEQ ID NO: 8729 - DNA, 28 bp, Artificial Sequences
  Synthetic
tcgcggtatttacggaggttcgggtagt

SEQ ID NO: 8730 - DNA, 27 bp, Artificial Sequences
  Synthetic
tcgcggtatttacggaggttcgggtag

SEQ ID NO: 8731 - DNA, 27 bp, Artificial Sequences
  Synthetic
gtttcgcggtatttacggaggttcggg

SEQ ID NO: 8732 - DNA, 27 bp, Artificial Sequences
  Synthetic
gcggggcgggtattttggtgttttggt

SEQ ID NO: 8733 - DNA, 27 bp, Artificial Sequences
  Synthetic
ggcggggcgggtattttggtgttttgg

SEQ ID NO: 8734 - DNA, 27 bp, Artificial Sequences
  Synthetic
cggcggggcgggtattttggtgttttg

SEQ ID NO: 8735 - DNA, 27 bp, Artificial Sequences
  Synthetic
cggggcgggtattttggtgttttggtg

SEQ ID NO: 8736 - DNA, 27 bp, Artificial Sequences
  Synthetic
gcgaggcggttttgttgaggatttcgg

SEQ ID NO: 8737 - DNA, 27 bp, Artificial Sequences
  Synthetic
gaggtggtcgacgtgttggtggaggac

SEQ ID NO: 8738 - DNA, 26 bp, Artificial Sequences
  Synthetic
gaggtggtcgacgtgttggtggagga

SEQ ID NO: 8739 - DNA, 26 bp, Artificial Sequences
  Synthetic
aggtggtcgacgtgttggtggaggac

SEQ ID NO: 8740 - DNA, 27 bp, Artificial Sequences
  Synthetic
ggaggtggtcgacgtgttggtggagga

SEQ ID NO: 8741 - DNA, 27 bp, Artificial Sequences
  Synthetic
tcggaggtggtcgacgtgttggtggag

SEQ ID NO: 8742 - DNA, 28 bp, Artificial Sequences
  Synthetic
tgtatgtgcgtgtgtgtgtcgatgtttt

SEQ ID NO: 8743 - DNA, 29 bp, Artificial Sequences
  Synthetic
tgtatgtgcgtgtgtgtgtcgatgttttc

SEQ ID NO: 8744 - DNA, 27 bp, Artificial Sequences
  Synthetic
agttcgggggttgtcggtggggatttt

SEQ ID NO: 8745 - DNA, 27 bp, Artificial Sequences
  Synthetic
gaggtggtcgacgtgttggtggaggat

SEQ ID NO: 8746 - DNA, 27 bp, Artificial Sequences
  Synthetic
gttcgggggttgtcggtggggattttg

SEQ ID NO: 8747 - DNA, 27 bp, Artificial Sequences
  Synthetic
tcgggggttgtcggtggggattttgta

SEQ ID NO: 8748 - DNA, 27 bp, Artificial Sequences
  Synthetic
ttcgggggttgtcggtggggattttgt

SEQ ID NO: 8749 - DNA, 27 bp, Artificial Sequences
  Synthetic
cggggttttattcggttcgggttgcgc

SEQ ID NO: 8750 - DNA, 27 bp, Artificial Sequences
  Synthetic
gcggggttttattcggttcgggttgcg

SEQ ID NO: 8751 - DNA, 27 bp, Artificial Sequences
  Synthetic
cgcggggttttattcggttcgggttgc

SEQ ID NO: 8752 - DNA, 27 bp, Artificial Sequences
  Synthetic
gcgcggggttttattcggttcgggttg

SEQ ID NO: 8753 - DNA, 26 bp, Artificial Sequences
  Synthetic
gcgcggggttttattcggttcgggtt

SEQ ID NO: 8754 - DNA, 27 bp, Artificial Sequences
  Synthetic
tcggggggaggagtcgtatatgcggtt

SEQ ID NO: 8755 - DNA, 27 bp, Artificial Sequences
  Synthetic
ttcggggggaggagtcgtatatgcggt

SEQ ID NO: 8756 - DNA, 27 bp, Artificial Sequences
  Synthetic
tttcggggggaggagtcgtatatgcgg

SEQ ID NO: 8757 - DNA, 27 bp, Artificial Sequences
  Synthetic
cggggggaggagtcgtatatgcggtta

SEQ ID NO: 8758 - DNA, 28 bp, Artificial Sequences
  Synthetic
tcggggggaggagtcgtatatgcggtta

SEQ ID NO: 8759 - DNA, 27 bp, Artificial Sequences
  Synthetic
ttgaggcgggtgtattaagggatgcga

SEQ ID NO: 8760 - DNA, 27 bp, Artificial Sequences
  Synthetic
tgaggcgggtgtattaagggatgcgat

SEQ ID NO: 8761 - DNA, 27 bp, Artificial Sequences
  Synthetic
tgttttgagtcgttttgaggcgggtgt

SEQ ID NO: 8762 - DNA, 27 bp, Artificial Sequences
  Synthetic
tttgaggcgggtgtattaagggatgcg

SEQ ID NO: 8763 - DNA, 28 bp, Artificial Sequences
  Synthetic
tttgaggcgggtgtattaagggatgcga

SEQ ID NO: 8764 - DNA, 27 bp, Artificial Sequences
  Synthetic
ggggttcgtgataagcggggcgtagat

SEQ ID NO: 8765 - DNA, 27 bp, Artificial Sequences
  Synthetic
cgcgggttaggggatattggtcggtga

SEQ ID NO: 8766 - DNA, 27 bp, Artificial Sequences
  Synthetic
tcgggagggtcgggagggttttagaga

SEQ ID NO: 8767 - DNA, 27 bp, Artificial Sequences
  Synthetic
tgtcgcgcgggttaggggatattggtc

SEQ ID NO: 8768 - DNA, 27 bp, Artificial Sequences
  Synthetic
agggtcgggagggttttagagacgggt

SEQ ID NO: 8769 - DNA, 31 bp, Artificial Sequences
  Synthetic
cgagtttttagaaaatttgtagtggcggcgg

SEQ ID NO: 8770 - DNA, 32 bp, Artificial Sequences
  Synthetic
acgagtttttagaaaatttgtagtggcggcgg

SEQ ID NO: 8771 - DNA, 31 bp, Artificial Sequences
  Synthetic
acgagtttttagaaaatttgtagtggcggcg

SEQ ID NO: 8772 - DNA, 33 bp, Artificial Sequences
  Synthetic
tacgagtttttagaaaatttgtagtggcggcgg

SEQ ID NO: 8773 - DNA, 32 bp, Artificial Sequences
  Synthetic
tacgagtttttagaaaatttgtagtggcggcg

SEQ ID NO: 8774 - DNA, 27 bp, Artificial Sequences
  Synthetic
ggggttcgtgataagcggggcgtagat

SEQ ID NO: 8775 - DNA, 27 bp, Artificial Sequences
  Synthetic
ttggaggtggttggattcgaggggtcg

SEQ ID NO: 8776 - DNA, 27 bp, Artificial Sequences
  Synthetic
ggaggtggttggattcgaggggtcgtc

SEQ ID NO: 8777 - DNA, 27 bp, Artificial Sequences
  Synthetic
cgtagcggaggagttggaggtggttgg

SEQ ID NO: 8778 - DNA, 27 bp, Artificial Sequences
  Synthetic
tttttgggggttcgtgataagcggggc

SEQ ID NO: 8779 - DNA, 27 bp, Artificial Sequences
  Synthetic
acggaggttcgggaaggggttttagga

SEQ ID NO: 8780 - DNA, 27 bp, Artificial Sequences
  Synthetic
aacggaggttcgggaaggggttttagg

SEQ ID NO: 8781 - DNA, 28 bp, Artificial Sequences
  Synthetic
aacggaggttcgggaaggggttttagga

SEQ ID NO: 8782 - DNA, 28 bp, Artificial Sequences
  Synthetic
acggaggttcgggaaggggttttaggat

SEQ ID NO: 8783 - DNA, 27 bp, Artificial Sequences
  Synthetic
cggaggttcgggaaggggttttaggat

SEQ ID NO: 8784 - DNA, 27 bp, Artificial Sequences
  Synthetic
gtaggtcgggggcgggggaaaatgtat

SEQ ID NO: 8785 - DNA, 27 bp, Artificial Sequences
  Synthetic
gtttatagtgtaggtcgggggcggggg

SEQ ID NO: 8786 - DNA, 27 bp, Artificial Sequences
  Synthetic
tatagtgtaggtcgggggcgggggaaa

SEQ ID NO: 8787 - DNA, 27 bp, Artificial Sequences
  Synthetic
ttatagtgtaggtcgggggcgggggaa

SEQ ID NO: 8788 - DNA, 27 bp, Artificial Sequences
  Synthetic
tttatagtgtaggtcgggggcggggga

SEQ ID NO: 8789 - DNA, 28 bp, Artificial Sequences
  Synthetic
ggcgaggttggtaggtatatgcgtgggt

SEQ ID NO: 8790 - DNA, 27 bp, Artificial Sequences
  Synthetic
ggcgaggttggtaggtatatgcgtggg

SEQ ID NO: 8791 - DNA, 28 bp, Artificial Sequences
  Synthetic
aggcgaggttggtaggtatatgcgtggg

SEQ ID NO: 8792 - DNA, 27 bp, Artificial Sequences
  Synthetic
gcgaggttggtaggtatatgcgtgggt

SEQ ID NO: 8793 - DNA, 27 bp, Artificial Sequences
  Synthetic
aggcgaggttggtaggtatatgcgtgg

SEQ ID NO: 8794 - DNA, 27 bp, Artificial Sequences
  Synthetic
gggaggtttgtgtggggaggatagggt

SEQ ID NO: 8795 - DNA, 28 bp, Artificial Sequences
  Synthetic
gggaggtttgtgtggggaggatagggtt

SEQ ID NO: 8796 - DNA, 29 bp, Artificial Sequences
  Synthetic
gggaggtttgtgtggggaggatagggttg

SEQ ID NO: 8797 - DNA, 27 bp, Artificial Sequences
  Synthetic
ggaggtttgtgtggggaggatagggtt

SEQ ID NO: 8798 - DNA, 27 bp, Artificial Sequences
  Synthetic
aggtttgtgtggggaggatagggttgt

SEQ ID NO: 8799 - DNA, 27 bp, Artificial Sequences
  Synthetic
agaagttggtcgggtgtaggttgcggg

SEQ ID NO: 8800 - DNA, 27 bp, Artificial Sequences
  Synthetic
gttggtcgggtgtaggttgcggggtag

SEQ ID NO: 8801 - DNA, 27 bp, Artificial Sequences
  Synthetic
aggttgcggggtaggtatgaggggagg

SEQ ID NO: 8802 - DNA, 27 bp, Artificial Sequences
  Synthetic
gtcgggtgtaggttgcggggtaggtat

SEQ ID NO: 8803 - DNA, 27 bp, Artificial Sequences
  Synthetic
cgggtgtaggttgcggggtaggtatga

SEQ ID NO: 8804 - DNA, 27 bp, Artificial Sequences
  Synthetic
gcgggagggagttcgggttgtgttttg

SEQ ID NO: 8805 - DNA, 27 bp, Artificial Sequences
  Synthetic
gtagcgggagggagttcgggttgtgtt

SEQ ID NO: 8806 - DNA, 27 bp, Artificial Sequences
  Synthetic
gagtagcgggagggagttcgggttgtg

SEQ ID NO: 8807 - DNA, 27 bp, Artificial Sequences
  Synthetic
taggagtagcgggagggagttcgggtt

SEQ ID NO: 8808 - DNA, 27 bp, Artificial Sequences
  Synthetic
ttaggagtagcgggagggagttcgggt

SEQ ID NO: 8809 - DNA, 27 bp, Artificial Sequences
  Synthetic
gggggtttagtttcgggtcggtgtgga

SEQ ID NO: 8810 - DNA, 27 bp, Artificial Sequences
  Synthetic
ggagggggtttagtttcgggtcggtgt

SEQ ID NO: 8811 - DNA, 27 bp, Artificial Sequences
  Synthetic
agggggtttagtttcgggtcggtgtgg

SEQ ID NO: 8812 - DNA, 27 bp, Artificial Sequences
  Synthetic
gcggagaggagggggtttagtttcggg

SEQ ID NO: 8813 - DNA, 27 bp, Artificial Sequences
  Synthetic
gggttgcggagaggagggggtttagtt

SEQ ID NO: 8814 - DNA, 27 bp, Artificial Sequences
  Synthetic
gcggatgagtttttggaggatgggcgg

SEQ ID NO: 8815 - DNA, 27 bp, Artificial Sequences
  Synthetic
cgcggatgagtttttggaggatgggcg

SEQ ID NO: 8816 - DNA, 27 bp, Artificial Sequences
  Synthetic
tcgcggatgagtttttggaggatgggc

SEQ ID NO: 8817 - DNA, 27 bp, Artificial Sequences
  Synthetic
cggatgagtttttggaggatgggcggt

SEQ ID NO: 8818 - DNA, 28 bp, Artificial Sequences
  Synthetic
tgggggagggagaggaagagagtttcgt

SEQ ID NO: 8819 - DNA, 27 bp, Artificial Sequences
  Synthetic
tttataggggttgagcggtggggggtg

SEQ ID NO: 8820 - DNA, 27 bp, Artificial Sequences
  Synthetic
gcgggggtgttaagggggtagaggttg

SEQ ID NO: 8821 - DNA, 27 bp, Artificial Sequences
  Synthetic
gggttgcggagaggagggggtttagtt

SEQ ID NO: 8822 - DNA, 27 bp, Artificial Sequences
  Synthetic
gaagtggggttggatgggttgcggaga

SEQ ID NO: 8823 - DNA, 27 bp, Artificial Sequences
  Synthetic
atgggttgcggagaggagggggtttag

SEQ ID NO: 8824 - DNA, 27 bp, Artificial Sequences
  Synthetic
gcggatgagtttttggaggatgggcgg

SEQ ID NO: 8825 - DNA, 27 bp, Artificial Sequences
  Synthetic
cgcggatgagtttttggaggatgggcg

SEQ ID NO: 8826 - DNA, 27 bp, Artificial Sequences
  Synthetic
ttttggaggatgggcggttcgtttcgg

SEQ ID NO: 8827 - DNA, 27 bp, Artificial Sequences
  Synthetic
tcgcggatgagtttttggaggatgggc

SEQ ID NO: 8828 - DNA, 27 bp, Artificial Sequences
  Synthetic
cggatgagtttttggaggatgggcggt

SEQ ID NO: 8829 - DNA, 27 bp, Artificial Sequences
  Synthetic
aagggggtagaggttgtggatggggga

SEQ ID NO: 8830 - DNA, 27 bp, Artificial Sequences
  Synthetic
tttataggggttgagcggtggggggtg

SEQ ID NO: 8831 - DNA, 27 bp, Artificial Sequences
  Synthetic
gcgggggtgttaagggggtagaggttg

SEQ ID NO: 8832 - DNA, 27 bp, Artificial Sequences
  Synthetic
tagagggcgggggtgttaagggggtag

SEQ ID NO: 8833 - DNA, 27 bp, Artificial Sequences
  Synthetic
gtagagggcgggggtgttaagggggta

SEQ ID NO: 8834 - DNA, 27 bp, Artificial Sequences
  Synthetic
aggagtcgttagtttgtgggttcggga

SEQ ID NO: 8835 - DNA, 27 bp, Artificial Sequences
  Synthetic
ggagtcgttagtttgtgggttcgggat

SEQ ID NO: 8836 - DNA, 28 bp, Artificial Sequences
  Synthetic
aggagtcgttagtttgtgggttcgggat

SEQ ID NO: 8837 - DNA, 27 bp, Artificial Sequences
  Synthetic
taggagtcgttagtttgtgggttcggg

SEQ ID NO: 8838 - DNA, 28 bp, Artificial Sequences
  Synthetic
taggagtcgttagtttgtgggttcggga

SEQ ID NO: 8839 - DNA, 27 bp, Artificial Sequences
  Synthetic
gttgacggaggggtggaggtatcgtgg

SEQ ID NO: 8840 - DNA, 27 bp, Artificial Sequences
  Synthetic
ggttgacggaggggtggaggtatcgtg

SEQ ID NO: 8841 - DNA, 27 bp, Artificial Sequences
  Synthetic
agatttgttgggggttgacggaggggt

SEQ ID NO: 8842 - DNA, 27 bp, Artificial Sequences
  Synthetic
gatttgttgggggttgacggaggggtg

SEQ ID NO: 8843 - DNA, 27 bp, Artificial Sequences
  Synthetic
atttgttgggggttgacggaggggtgg

SEQ ID NO: 8844 - DNA, 27 bp, Artificial Sequences
  Synthetic
gggcggcgttgttgttgttgttgttgg

SEQ ID NO: 8845 - DNA, 27 bp, Artificial Sequences
  Synthetic
ttcgtggtgttgtaggcgaggttgggt

SEQ ID NO: 8846 - DNA, 27 bp, Artificial Sequences
  Synthetic
agtcgttcgtggtgttgtaggcgaggt

SEQ ID NO: 8847 - DNA, 27 bp, Artificial Sequences
  Synthetic
tggagtcgttcgtggtgttgtaggcga

SEQ ID NO: 8848 - DNA, 27 bp, Artificial Sequences
  Synthetic
taggcgaggttgggtagtttggacggg

SEQ ID NO: 8849 - DNA, 27 bp, Artificial Sequences
  Synthetic
atggtttcggtcggtcgttggttgtgc

SEQ ID NO: 8850 - DNA, 27 bp, Artificial Sequences
  Synthetic
ggcggggtgtaggcgaatgtagggatt

SEQ ID NO: 8851 - DNA, 27 bp, Artificial Sequences
  Synthetic
ggtcgttggttgtgcggtaggttgtcg

SEQ ID NO: 8852 - DNA, 27 bp, Artificial Sequences
  Synthetic
cggtcgttggttgtgcggtaggttgtc

SEQ ID NO: 8853 - DNA, 27 bp, Artificial Sequences
  Synthetic
gtcggtcgttggttgtgcggtaggttg

SEQ ID NO: 8854 - DNA, 27 bp, Artificial Sequences
  Synthetic
ggtggttgggtttgcggtattgggacg

SEQ ID NO: 8855 - DNA, 27 bp, Artificial Sequences
  Synthetic
atcggagcgggaagtggatttggggag

SEQ ID NO: 8856 - DNA, 27 bp, Artificial Sequences
  Synthetic
gagttttcgggtggttgggtttgcggt

SEQ ID NO: 8857 - DNA, 27 bp, Artificial Sequences
  Synthetic
gggtggttgggtttgcggtattgggac

SEQ ID NO: 8858 - DNA, 27 bp, Artificial Sequences
  Synthetic
tttagggggagggtatcggagcgggaa

SEQ ID NO: 8859 - DNA, 27 bp, Artificial Sequences
  Synthetic
tttagcgcggtttttgggggattcggg

SEQ ID NO: 8860 - DNA, 27 bp, Artificial Sequences
  Synthetic
gggaaggtcggttaggtagaggtggcg

SEQ ID NO: 8861 - DNA, 27 bp, Artificial Sequences
  Synthetic
cgggaaggtcggttaggtagaggtggc

SEQ ID NO: 8862 - DNA, 27 bp, Artificial Sequences
  Synthetic
ggaggtgtttagcgcggtttttggggg

SEQ ID NO: 8863 - DNA, 27 bp, Artificial Sequences
  Synthetic
tggtggagtacggaggtgtttagcgcg

SEQ ID NO: 8864 - DNA, 27 bp, Artificial Sequences
  Synthetic
ggtaagtatagatgaggggcgcgcggt

SEQ ID NO: 8865 - DNA, 27 bp, Artificial Sequences
  Synthetic
ggtggggcggggtttttcgggttttta

SEQ ID NO: 8866 - DNA, 27 bp, Artificial Sequences
  Synthetic
aggtaagtatagatgaggggcgcgcgg

SEQ ID NO: 8867 - DNA, 27 bp, Artificial Sequences
  Synthetic
aagtatagatgaggggcgcgcggttgg

SEQ ID NO: 8868 - DNA, 27 bp, Artificial Sequences
  Synthetic
ggaaaggttagtgtttgcgggggcgat

SEQ ID NO: 8869 - DNA, 27 bp, Artificial Sequences
  Synthetic
ggcggtggttatggggattcggaggat

SEQ ID NO: 8870 - DNA, 27 bp, Artificial Sequences
  Synthetic
ggttttcgtggtttatgggggcgggtg

SEQ ID NO: 8871 - DNA, 27 bp, Artificial Sequences
  Synthetic
ttgttcggtggggaggggattgcgtag

SEQ ID NO: 8872 - DNA, 27 bp, Artificial Sequences
  Synthetic
ttatgggggcgggtgatggacgttgtt

SEQ ID NO: 8873 - DNA, 27 bp, Artificial Sequences
  Synthetic
tttatgggggcgggtgatggacgttgt

SEQ ID NO: 8874 - DNA, 34 bp, Artificial Sequences
  Synthetic
ggaagggtttgatacggaatttgattaaggttgg

SEQ ID NO: 8875 - DNA, 35 bp, Artificial Sequences
  Synthetic
tggaagggtttgatacggaatttgattaaggttgg

SEQ ID NO: 8876 - DNA, 35 bp, Artificial Sequences
  Synthetic
ggaagggtttgatacggaatttgattaaggttgga

SEQ ID NO: 8877 - DNA, 36 bp, Artificial Sequences
  Synthetic
tggaagggtttgatacggaatttgattaaggttgga

SEQ ID NO: 8878 - DNA, 35 bp, Artificial Sequences
  Synthetic
agttggaagggtttgatacggaatttgattaaggt

SEQ ID NO: 8879 - DNA, 27 bp, Artificial Sequences
  Synthetic
tcggagggtttttgcgtttttggggtt

SEQ ID NO: 8880 - DNA, 27 bp, Artificial Sequences
  Synthetic
ttcggagggtttttgcgtttttggggt

SEQ ID NO: 8881 - DNA, 28 bp, Artificial Sequences
  Synthetic
gttcggagggtttttgcgtttttggggt

SEQ ID NO: 8882 - DNA, 27 bp, Artificial Sequences
  Synthetic
gttcggagggtttttgcgtttttgggg

SEQ ID NO: 8883 - DNA, 28 bp, Artificial Sequences
  Synthetic
agttcggagggtttttgcgtttttgggg

SEQ ID NO: 8884 - DNA, 27 bp, Artificial Sequences
  Synthetic
cggagtagtcgtttgagggttggaagg

SEQ ID NO: 8885 - DNA, 28 bp, Artificial Sequences
  Synthetic
cggagtagtcgtttgagggttggaagga

SEQ ID NO: 8886 - DNA, 28 bp, Artificial Sequences
  Synthetic
tcggagtagtcgtttgagggttggaagg

SEQ ID NO: 8887 - DNA, 29 bp, Artificial Sequences
  Synthetic
tcggagtagtcgtttgagggttggaagga

SEQ ID NO: 8888 - DNA, 27 bp, Artificial Sequences
  Synthetic
tcggagtagtcgtttgagggttggaag

SEQ ID NO: 8889 - DNA, 24 bp, Artificial Sequences
  Synthetic
ggcggtcgggggaggatagtgatc

SEQ ID NO: 8890 - DNA, 23 bp, Artificial Sequences
  Synthetic
ggcggtcgggggaggatagtgat

SEQ ID NO: 8891 - DNA, 22 bp, Artificial Sequences
  Synthetic
ggcggtcgggggaggatagtga

SEQ ID NO: 8892 - DNA, 23 bp, Artificial Sequences
  Synthetic
gcggtcgggggaggatagtgatc

SEQ ID NO: 8893 - DNA, 21 bp, Artificial Sequences
  Synthetic
ggcggtcgggggaggatagtg

SEQ ID NO: 8894 - DNA, 27 bp, Artificial Sequences
  Synthetic
gggggcgttgggttttaggttcggatg

SEQ ID NO: 8895 - DNA, 27 bp, Artificial Sequences
  Synthetic
ggaagtcgggggcgttgggttttaggt

SEQ ID NO: 8896 - DNA, 27 bp, Artificial Sequences
  Synthetic
agtcgggggcgttgggttttaggttcg

SEQ ID NO: 8897 - DNA, 27 bp, Artificial Sequences
  Synthetic
ggggcgttgggttttaggttcggatgt

SEQ ID NO: 8898 - DNA, 27 bp, Artificial Sequences
  Synthetic
cgggggcgttgggttttaggttcggat

SEQ ID NO: 8899 - DNA, 27 bp, Artificial Sequences
  Synthetic
aaacgttagggttattcgcggcgggtc

SEQ ID NO: 8900 - DNA, 27 bp, Artificial Sequences
  Synthetic
aacgttagggttattcgcggcgggtcg

SEQ ID NO: 8901 - DNA, 27 bp, Artificial Sequences
  Synthetic
cgttagggttattcgcggcgggtcgtc

SEQ ID NO: 8902 - DNA, 27 bp, Artificial Sequences
  Synthetic
taaacgttagggttattcgcggcgggt

SEQ ID NO: 8903 - DNA, 26 bp, Artificial Sequences
  Synthetic
gttagggttattcgcggcgggtcgtc

SEQ ID NO: 8904 - DNA, 27 bp, Artificial Sequences
  Synthetic
gggggcgttgggttttaggttcggatg

SEQ ID NO: 8905 - DNA, 27 bp, Artificial Sequences
  Synthetic
ggaagtcgggggcgttgggttttaggt

SEQ ID NO: 8906 - DNA, 27 bp, Artificial Sequences
  Synthetic
agtcgggggcgttgggttttaggttcg

SEQ ID NO: 8907 - DNA, 27 bp, Artificial Sequences
  Synthetic
ggggcgttgggttttaggttcggatgt

SEQ ID NO: 8908 - DNA, 27 bp, Artificial Sequences
  Synthetic
cgggggcgttgggttttaggttcggat

SEQ ID NO: 8909 - DNA, 27 bp, Artificial Sequences
  Synthetic
aaacgttagggttattcgcggcgggtc

SEQ ID NO: 8910 - DNA, 27 bp, Artificial Sequences
  Synthetic
aacgttagggttattcgcggcgggtcg

SEQ ID NO: 8911 - DNA, 27 bp, Artificial Sequences
  Synthetic
cgttagggttattcgcggcgggtcgtc

SEQ ID NO: 8912 - DNA, 27 bp, Artificial Sequences
  Synthetic
taaacgttagggttattcgcggcgggt

SEQ ID NO: 8913 - DNA, 26 bp, Artificial Sequences
  Synthetic
gttagggttattcgcggcgggtcgtc

SEQ ID NO: 8914 - DNA, 27 bp, Artificial Sequences
  Synthetic
gggggcgttgggttttaggttcggatg

SEQ ID NO: 8915 - DNA, 27 bp, Artificial Sequences
  Synthetic
ggaagtcgggggcgttgggttttaggt

SEQ ID NO: 8916 - DNA, 27 bp, Artificial Sequences
  Synthetic
agtcgggggcgttgggttttaggttcg

SEQ ID NO: 8917 - DNA, 27 bp, Artificial Sequences
  Synthetic
ggggcgttgggttttaggttcggatgt

SEQ ID NO: 8918 - DNA, 27 bp, Artificial Sequences
  Synthetic
cgggggcgttgggttttaggttcggat

SEQ ID NO: 8919 - DNA, 27 bp, Artificial Sequences
  Synthetic
aaacgttagggttattcgcggcgggtc

SEQ ID NO: 8920 - DNA, 27 bp, Artificial Sequences
  Synthetic
aacgttagggttattcgcggcgggtcg

SEQ ID NO: 8921 - DNA, 27 bp, Artificial Sequences
  Synthetic
cgttagggttattcgcggcgggtcgtc

SEQ ID NO: 8922 - DNA, 27 bp, Artificial Sequences
  Synthetic
taaacgttagggttattcgcggcgggt

SEQ ID NO: 8923 - DNA, 26 bp, Artificial Sequences
  Synthetic
gttagggttattcgcggcgggtcgtc

SEQ ID NO: 8924 - DNA, 28 bp, Artificial Sequences
  Synthetic
gggttttaggttcggatgttgagcgcgg

SEQ ID NO: 8925 - DNA, 28 bp, Artificial Sequences
  Synthetic
tgggttttaggttcggatgttgagcgcg

SEQ ID NO: 8926 - DNA, 27 bp, Artificial Sequences
  Synthetic
ggttttaggttcggatgttgagcgcgg

SEQ ID NO: 8927 - DNA, 27 bp, Artificial Sequences
  Synthetic
gggttttaggttcggatgttgagcgcg

SEQ ID NO: 8928 - DNA, 28 bp, Artificial Sequences
  Synthetic
ggttttaggttcggatgttgagcgcgga

SEQ ID NO: 8929 - DNA, 27 bp, Artificial Sequences
  Synthetic
gtcgaaaatttattgacgcggcgaggt

SEQ ID NO: 8930 - DNA, 27 bp, Artificial Sequences
  Synthetic
tcgaaaatttattgacgcggcgaggtt

SEQ ID NO: 8931 - DNA, 28 bp, Artificial Sequences
  Synthetic
gtcgaaaatttattgacgcggcgaggtt

SEQ ID NO: 8932 - DNA, 26 bp, Artificial Sequences
  Synthetic
tcgaaaatttattgacgcggcgaggt

SEQ ID NO: 8933 - DNA, 29 bp, Artificial Sequences
  Synthetic
cgaaaatttattgacgcggcgaggttagg

SEQ ID NO: 8934 - DNA, 27 bp, Artificial Sequences
  Synthetic
agtgttgttagtttggtttcgtcgcgt

SEQ ID NO: 8935 - DNA, 31 bp, Artificial Sequences
  Synthetic
aggatcgttagagttggggggagattaaagt

SEQ ID NO: 8936 - DNA, 31 bp, Artificial Sequences
  Synthetic
agtgttgttagtttggtttcgtcgcgttaat

SEQ ID NO: 8937 - DNA, 31 bp, Artificial Sequences
  Synthetic
gaggatcgttagagttggggggagattaaag

SEQ ID NO: 8938 - DNA, 31 bp, Artificial Sequences
  Synthetic
tttggtttcgtcgcgttaataaattttcggc

SEQ ID NO: 8939 - DNA, 28 bp, Artificial Sequences
  Synthetic
ggtcgtttttgtggtgatttcgtcgtgg

SEQ ID NO: 8940 - DNA, 29 bp, Artificial Sequences
  Synthetic
ggtcgtttttgtggtgatttcgtcgtggt

SEQ ID NO: 8941 - DNA, 29 bp, Artificial Sequences
  Synthetic
tggtcgtttttgtggtgatttcgtcgtgg

SEQ ID NO: 8942 - DNA, 30 bp, Artificial Sequences
  Synthetic
tggtcgtttttgtggtgatttcgtcgtggt

SEQ ID NO: 8943 - DNA, 27 bp, Artificial Sequences
  Synthetic
tcgtttttgtggtgatttcgtcgtggt

SEQ ID NO: 8944 - DNA, 30 bp, Artificial Sequences
  Synthetic
tgcggggaagaatgataattacgtagggag

SEQ ID NO: 8945 - DNA, 31 bp, Artificial Sequences
  Synthetic
tgcggggaagaatgataattacgtagggaga

SEQ ID NO: 8946 - DNA, 31 bp, Artificial Sequences
  Synthetic
atgcggggaagaatgataattacgtagggag

SEQ ID NO: 8947 - DNA, 31 bp, Artificial Sequences
  Synthetic
gcggggaagaatgataattacgtagggagaa

SEQ ID NO: 8948 - DNA, 32 bp, Artificial Sequences
  Synthetic
tgcggggaagaatgataattacgtagggagaa

SEQ ID NO: 8949 - DNA, 28 bp, Artificial Sequences
  Synthetic
ggtcgtttttgtggtgatttcgtcgtgg

SEQ ID NO: 8950 - DNA, 29 bp, Artificial Sequences
  Synthetic
ggtcgtttttgtggtgatttcgtcgtggt

SEQ ID NO: 8951 - DNA, 29 bp, Artificial Sequences
  Synthetic
tggtcgtttttgtggtgatttcgtcgtgg

SEQ ID NO: 8952 - DNA, 30 bp, Artificial Sequences; identical to SEQ ID NO: 8942
  Synthetic

SEQ ID NO: 8953 - DNA, 27 bp, Artificial Sequences
  Synthetic
tcgtttttgtggtgatttcgtcgtggt

SEQ ID NO: 8954 - DNA, 27 bp, Artificial Sequences
  Synthetic
cgacgaaggagttggtggagagtagga

SEQ ID NO: 8955 - DNA, 29 bp, Artificial Sequences
  Synthetic
acgaaggagttggtggagagtaggatcgg

SEQ ID NO: 8956 - DNA, 28 bp, Artificial Sequences
  Synthetic
cgaaggagttggtggagagtaggatcgg

SEQ ID NO: 8957 - DNA, 29 bp, Artificial Sequences
  Synthetic
cgaaggagttggtggagagtaggatcgga

SEQ ID NO: 8958 - DNA, 30 bp, Artificial Sequences
  Synthetic
acgaaggagttggtggagagtaggatcgga

SEQ ID NO: 8959 - DNA, 28 bp, Artificial Sequences
  Synthetic
tggttgttgtttaaggagttcggcgaga

SEQ ID NO: 8960 - DNA, 28 bp, Artificial Sequences
  Synthetic
ttggttgttgtttaaggagttcggcgag

SEQ ID NO: 8961 - DNA, 29 bp, Artificial Sequences
  Synthetic
ttggttgttgtttaaggagttcggcgaga

SEQ ID NO: 8962 - DNA, 29 bp, Artificial Sequences
  Synthetic
tggttgttgtttaaggagttcggcgagat

SEQ ID NO: 8963 - DNA, 29 bp, Artificial Sequences
  Synthetic
tttggttgttgtttaaggagttcggcgag

SEQ ID NO: 8964 - DNA, 27 bp, Artificial Sequences
  Synthetic
tcggagttaggagttgggcgttgagaa

SEQ ID NO: 8965 - DNA, 27 bp, Artificial Sequences
  Synthetic
ttcggagttaggagttgggcgttgaga

SEQ ID NO: 8966 - DNA, 27 bp, Artificial Sequences
  Synthetic
cgacgaaggagttggtggagagtagga

SEQ ID NO: 8967 - DNA, 27 bp, Artificial Sequences
  Synthetic
cggagttaggagttgggcgttgagaag

SEQ ID NO: 8968 - DNA, 28 bp, Artificial Sequences
  Synthetic
cggagttaggagttgggcgttgagaaga

SEQ ID NO: 8969 - DNA, 30 bp, Artificial Sequences
  Synthetic
acgtgtgataggagtcgtttggttaagtgg

SEQ ID NO: 8970 - DNA, 30 bp, Artificial Sequences
  Synthetic
cgtgtgataggagtcgtttggttaagtgga

SEQ ID NO: 8971 - DNA, 31 bp, Artificial Sequences
  Synthetic
acgtgtgataggagtcgtttggttaagtgga

SEQ ID NO: 8972 - DNA, 31 bp, Artificial Sequences
  Synthetic
cgtgtgataggagtcgtttggttaagtggaa

SEQ ID NO: 8973 - DNA, 32 bp, Artificial Sequences
  Synthetic
acgtgtgataggagtcgtttggttaagtggaa

SEQ ID NO: 8974 - DNA, 27 bp, Artificial Sequences
  Synthetic
gcgtggattgttgggtttggggacgtt

SEQ ID NO: 8975 - DNA, 27 bp, Artificial Sequences
  Synthetic
gacggtgtggcgtggattgttgggttt

SEQ ID NO: 8976 - DNA, 27 bp, Artificial Sequences
  Synthetic
acggtgtggcgtggattgttgggtttg

SEQ ID NO: 8977 - DNA, 27 bp, Artificial Sequences
  Synthetic
gtggcgtggattgttgggtttggggac

SEQ ID NO: 8978 - DNA, 27 bp, Artificial Sequences
  Synthetic
ggattgttgggtttggggacgttgggc

SEQ ID NO: 8979 - DNA, 27 bp, Artificial Sequences
  Synthetic
gtttcgggtgagggtggggtaagaggt

SEQ ID NO: 8980 - DNA, 27 bp, Artificial Sequences
  Synthetic
agtttcgggtgagggtggggtaagagg

SEQ ID NO: 8981 - DNA, 28 bp, Artificial Sequences
  Synthetic
agtttcgggtgagggtggggtaagaggt

SEQ ID NO: 8982 - DNA, 27 bp, Artificial Sequences
  Synthetic
tttcgggtgagggtggggtaagaggta

SEQ ID NO: 8983 - DNA, 27 bp, Artificial Sequences
  Synthetic
tcgggtgagggtggggtaagaggtatt

SEQ ID NO: 8984 - DNA, 27 bp, Artificial Sequences
  Synthetic
gtgggggttaggggttttttggtcgcg

SEQ ID NO: 8985 - DNA, 27 bp, Artificial Sequences
  Synthetic
tgggggttaggggttttttggtcgcga

SEQ ID NO: 8986 - DNA, 27 bp, Artificial Sequences
  Synthetic
ggcgggttgtttttcgagtgggggtta

SEQ ID NO: 8987 - DNA, 27 bp, Artificial Sequences
  Synthetic
gggggttaggggttttttggtcgcgat

SEQ ID NO: 8988 - DNA, 27 bp, Artificial Sequences
  Synthetic
agtgggggttaggggttttttggtcgc

SEQ ID NO: 8989 - DNA, 29 bp, Artificial Sequences
  Synthetic
gcgaagggtgcgttttttgagttttacgt

SEQ ID NO: 8990 - DNA, 28 bp, Artificial Sequences
  Synthetic
gcgaagggtgcgttttttgagttttacg

SEQ ID NO: 8991 - DNA, 31 bp, Artificial Sequences
  Synthetic
gcgaagggtgcgttttttgagttttacgtcg

SEQ ID NO: 8992 - DNA, 30 bp, Artificial Sequences
  Synthetic
gcgaagggtgcgttttttgagttttacgtc

SEQ ID NO: 8993 - DNA, 30 bp, Artificial Sequences
  Synthetic
cgaagggtgcgttttttgagttttacgtcg

SEQ ID NO: 8994 - DNA, 27 bp, Artificial Sequences
  Synthetic
cggcggggaattgcgggtttgtagttt

SEQ ID NO: 8995 - DNA, 26 bp, Artificial Sequences
  Synthetic
cggcggggaattgcgggtttgtagtt

SEQ ID NO: 8996 - DNA, 28 bp, Artificial Sequences
  Synthetic
cggcggggaattgcgggtttgtagttta

SEQ ID NO: 8997 - DNA, 25 bp, Artificial Sequences
  Synthetic
cggcggggaattgcgggtttgtagt

SEQ ID NO: 8998 - DNA, 29 bp, Artificial Sequences
  Synthetic
cggcggggaattgcgggtttgtagtttag

SEQ ID NO: 8999 - DNA, 27 bp, Artificial Sequences
  Synthetic
gggagttggaaggtaggtagacgcgcg

SEQ ID NO: 9000 - DNA, 27 bp, Artificial Sequences
  Synthetic
cgggagttggaaggtaggtagacgcgc

SEQ ID NO: 9001 - DNA, 27 bp, Artificial Sequences
  Synthetic
tcgggagttggaaggtaggtagacgcg

SEQ ID NO: 9002 - DNA, 28 bp, Artificial Sequences
  Synthetic
gtcgggagttggaaggtaggtagacgcg

SEQ ID NO: 9003 - DNA, 27 bp, Artificial Sequences
  Synthetic
gtcgggagttggaaggtaggtagacgc

SEQ ID NO: 9004 - DNA, 27 bp, Artificial Sequences
  Synthetic
cggcggggaattgcgggtttgtagttt

SEQ ID NO: 9005 - DNA, 26 bp, Artificial Sequences
  Synthetic
cggcggggaattgcgggtttgtagtt

SEQ ID NO: 9006 - DNA, 28 bp, Artificial Sequences
  Synthetic
cggcggggaattgcgggtttgtagttta

SEQ ID NO: 9007 - DNA, 25 bp, Artificial Sequences
  Synthetic
cggcggggaattgcgggtttgtagt

SEQ ID NO: 9008 - DNA, 29 bp, Artificial Sequences
  Synthetic
cggcggggaattgcgggtttgtagtttag

SEQ ID NO: 9009 - DNA, 27 bp, Artificial Sequences
  Synthetic
ggtaggtagacgcgcgaggtttgggaa

SEQ ID NO: 9010 - DNA, 27 bp, Artificial Sequences
  Synthetic
taggtagacgcgcgaggtttgggaagg

SEQ ID NO: 9011 - DNA, 27 bp, Artificial Sequences
  Synthetic
aaggtaggtagacgcgcgaggtttggg

SEQ ID NO: 9012 - DNA, 27 bp, Artificial Sequences
  Synthetic
gttggaaggtaggtagacgcgcgaggt

SEQ ID NO: 9013 - DNA, 27 bp, Artificial Sequences
  Synthetic
agttggaaggtaggtagacgcgcgagg

SEQ ID NO: 9014 - DNA, 27 bp, Artificial Sequences
  Synthetic
gcgcggtggtggagttttcgaaggtat

SEQ ID NO: 9015 - DNA, 27 bp, Artificial Sequences
  Synthetic
cgcgcggtggtggagttttcgaaggta

SEQ ID NO: 9016 - DNA, 28 bp, Artificial Sequences
  Synthetic
gcgcggtggtggagttttcgaaggtatt

SEQ ID NO: 9017 - DNA, 26 bp, Artificial Sequences
  Synthetic
gcgcggtggtggagttttcgaaggta

SEQ ID NO: 9018 - DNA, 28 bp, Artificial Sequences
  Synthetic
cgcgcggtggtggagttttcgaaggtat

SEQ ID NO: 9019 - DNA, 27 bp, Artificial Sequences
  Synthetic
tgtaggtggttggggaatggaagcgtt

SEQ ID NO: 9020 - DNA, 27 bp, Artificial Sequences
  Synthetic
ttgtaggtggttggggaatggaagcgt

SEQ ID NO: 9021 - DNA, 29 bp, Artificial Sequences
  Synthetic
cgtttgtaggtggttggggaatggaagcg

SEQ ID NO: 9022 - DNA, 27 bp, Artificial Sequences
  Synthetic
aggtggttggggaatggaagcgttttt

SEQ ID NO: 9023 - DNA, 28 bp, Artificial Sequences
  Synthetic
tgtaggtggttggggaatggaagcgttt

SEQ ID NO: 9024 - DNA, 27 bp, Artificial Sequences
  Synthetic
tgtttttggtttgggatggggggcgtg

SEQ ID NO: 9025 - DNA, 27 bp, Artificial Sequences
  Synthetic
ttgtttttggtttgggatggggggcgt

SEQ ID NO: 9026 - DNA, 27 bp, Artificial Sequences
  Synthetic
gtttttggtttgggatggggggcgtgg

SEQ ID NO: 9027 - DNA, 27 bp, Artificial Sequences
  Synthetic
tcggggcgtggatttggagttttcgtt

SEQ ID NO: 9028 - DNA, 27 bp, Artificial Sequences
  Synthetic
tgtgtttcggggcgtggatttggagtt

SEQ ID NO: 9029 - DNA, 27 bp, Artificial Sequences
  Synthetic
aagggtaggagaggcgggggttttaaa

SEQ ID NO: 9030 - DNA, 27 bp, Artificial Sequences
  Synthetic
agggtaggagaggcgggggttttaaat

SEQ ID NO: 9031 - DNA, 29 bp, Artificial Sequences
  Synthetic
tggttaatttttagcggggtttggggcgt

SEQ ID NO: 9032 - DNA, 28 bp, Artificial Sequences
  Synthetic
ggttaatttttagcggggtttggggcgt

SEQ ID NO: 9033 - DNA, 28 bp, Artificial Sequences
  Synthetic
tggttaatttttagcggggtttggggcg

SEQ ID NO: 9034 - DNA, 27 bp, Artificial Sequences
  Synthetic
tgtcgttgtagtcgttgtggcggtcgt

SEQ ID NO: 9035 - DNA, 27 bp, Artificial Sequences
  Synthetic
gtcgttgtagtcgttgtggcggtcgtt

SEQ ID NO: 9036 - DNA, 27 bp, Artificial Sequences
  Synthetic
ttgtcgttgtagtcgttgtggcggtcg

SEQ ID NO: 9037 - DNA, 27 bp, Artificial Sequences
  Synthetic
tcgttgtagtcgttgtggcggtcgttt

SEQ ID NO: 9038 - DNA, 28 bp, Artificial Sequences
  Synthetic
tgtcgttgtagtcgttgtggcggtcgtt

SEQ ID NO: 9039 - DNA, 29 bp, Artificial Sequences
  Synthetic
tggttaatttttagcggggtttggggcgt

SEQ ID NO: 9040 - DNA, 28 bp, Artificial Sequences
  Synthetic
ggttaatttttagcggggtttggggcgt

SEQ ID NO: 9041 - DNA, 28 bp, Artificial Sequences
  Synthetic
tggttaatttttagcggggtttggggcg

SEQ ID NO: 9042 - DNA, 27 bp, Artificial Sequences
  Synthetic
ggttaatttttagcggggtttggggcg

SEQ ID NO: 9043 - DNA, 27 bp, Artificial Sequences
  Synthetic
gttaatttttagcggggtttggggcgt

SEQ ID NO: 9044 - DNA, 27 bp, Artificial Sequences
  Synthetic
agagttcgggttttagagcgggtaggc

SEQ ID NO: 9045 - DNA, 28 bp, Artificial Sequences
  Synthetic
tagagttcgggttttagagcgggtaggc

SEQ ID NO: 9046 - DNA, 26 bp, Artificial Sequences
  Synthetic
gagttcgggttttagagcgggtaggc

SEQ ID NO: 9047 - DNA, 24 bp, Artificial Sequences
  Synthetic
gcgttcgggggtttcgtcgtgtgc

SEQ ID NO: 9048 - DNA, 29 bp, Artificial Sequences
  Synthetic
ttagagttcgggttttagagcgggtaggc

SEQ ID NO: 9049 - DNA, 23 bp, Artificial Sequences
  Synthetic
gtatacggcggggttttcgagcg

SEQ ID NO: 9050 - DNA, 32 bp, Artificial Sequences
  Synthetic
cgtatttattaggataagatgggaggacgcgt

SEQ ID NO: 9051 - DNA, 33 bp, Artificial Sequences
  Synthetic
tcgtatttattaggataagatgggaggacgcgt

SEQ ID NO: 9052 - DNA, 33 bp, Artificial Sequences
  Synthetic
ttcgtatttattaggataagatgggaggacgcg

SEQ ID NO: 9053 - DNA, 35 bp, Artificial Sequences
  Synthetic
cgttcgtatttattaggataagatgggaggacgcg

SEQ ID NO: 9054 - DNA, 27 bp, Artificial Sequences
  Synthetic
gattcggagcgtcgggtttatagcggt

SEQ ID NO: 9055 - DNA, 27 bp, Artificial Sequences
  Synthetic
ttcggagcgtcgggtttatagcggttt

SEQ ID NO: 9056 - DNA, 28 bp, Artificial Sequences
  Synthetic
agattcggagcgtcgggtttatagcggt

SEQ ID NO: 9057 - DNA, 27 bp, Artificial Sequences
  Synthetic
agattcggagcgtcgggtttatagcgg

SEQ ID NO: 9058 - DNA, 27 bp, Artificial Sequences
  Synthetic
attcggagcgtcgggtttatagcggtt

SEQ ID NO: 9059 - DNA, 23 bp, Artificial Sequences
  Synthetic
gtatacggcggggttttcgagcg

SEQ ID NO: 9060 - DNA, 32 bp, Artificial Sequences; identical to SEQ ID NO: 9050
  Synthetic

SEQ ID NO: 9061 - DNA, 33 bp, Artificial Sequences; identical to SEQ ID NO: 9051
  Synthetic

SEQ ID NO: 9062 - DNA, 33 bp, Artificial Sequences; identical to SEQ ID NO: 9052
  Synthetic

SEQ ID NO: 9063 - DNA, 35 bp, Artificial Sequences; identical to SEQ ID NO: 9053
  Synthetic

SEQ ID NO: 9064 - DNA, 27 bp, Artificial Sequences
  Synthetic
ggtagcgttagattcggagcgtcgggt

SEQ ID NO: 9065 - DNA, 27 bp, Artificial Sequences
  Synthetic
ggtcgggtagcgttagattcggagcgt

SEQ ID NO: 9066 - DNA, 27 bp, Artificial Sequences
  Synthetic
tcgggtagcgttagattcggagcgtcg

SEQ ID NO: 9067 - DNA, 27 bp, Artificial Sequences
  Synthetic
gggggtcgggtagcgttagattcggag

SEQ ID NO: 9068 - DNA, 27 bp, Artificial Sequences
  Synthetic
ggggtcgggtagcgttagattcggagc

SEQ ID NO: 9069 - DNA, 27 bp, Artificial Sequences
  Synthetic
cgggttgggttcgggaggagattgagt

SEQ ID NO: 9070 - DNA, 27 bp, Artificial Sequences
  Synthetic
agtcgggttgggttcgggaggagattg

SEQ ID NO: 9071 - DNA, 27 bp, Artificial Sequences
  Synthetic
gtcgggttgggttcgggaggagattga

SEQ ID NO: 9072 - DNA, 27 bp, Artificial Sequences
  Synthetic
tcgggttgggttcgggaggagattgag

SEQ ID NO: 9073 - DNA, 27 bp, Artificial Sequences
  Synthetic
gttagtcgggttgggttcgggaggaga

SEQ ID NO: 9074 - DNA, 27 bp, Artificial Sequences
  Synthetic
ggtagcgttagattcggagcgtcgggt

SEQ ID NO: 9075 - DNA, 27 bp, Artificial Sequences
  Synthetic
ggtcgggtagcgttagattcggagcgt

SEQ ID NO: 9076 - DNA, 27 bp, Artificial Sequences
  Synthetic
tcgggtagcgttagattcggagcgtcg

SEQ ID NO: 9077 - DNA, 27 bp, Artificial Sequences
  Synthetic
gggggtcgggtagcgttagattcggag

SEQ ID NO: 9078 - DNA, 27 bp, Artificial Sequences
  Synthetic
ggggtcgggtagcgttagattcggagc

SEQ ID NO: 9079 - DNA, 27 bp, Artificial Sequences
  Synthetic
cgggttgggttcgggaggagattgagt

SEQ ID NO: 9080 - DNA, 27 bp, Artificial Sequences
  Synthetic
agtcgggttgggttcgggaggagattg

SEQ ID NO: 9081 - DNA, 27 bp, Artificial Sequences
  Synthetic
gtcgggttgggttcgggaggagattga

SEQ ID NO: 9082 - DNA, 27 bp, Artificial Sequences
  Synthetic
tcgggttgggttcgggaggagattgag

SEQ ID NO: 9083 - DNA, 27 bp, Artificial Sequences
  Synthetic
gttagtcgggttgggttcgggaggaga

SEQ ID NO: 9084 - DNA, 27 bp, Artificial Sequences
  Synthetic
ggtcgggtagcgttagattcggagcgt

SEQ ID NO: 9085 - DNA, 27 bp, Artificial Sequences
  Synthetic
gggggtcgggtagcgttagattcggag

SEQ ID NO: 9086 - DNA, 27 bp, Artificial Sequences
  Synthetic
ggggtcgggtagcgttagattcggagc

SEQ ID NO: 9087 - DNA, 27 bp, Artificial Sequences
  Synthetic
gggtcgggtagcgttagattcggagcg

SEQ ID NO: 9088 - DNA, 27 bp, Artificial Sequences
  Synthetic
atagtttagagggaggggtcggcgggg

SEQ ID NO: 9089 - DNA, 27 bp, Artificial Sequences
  Synthetic
cgggttgggttcgggaggagattgagt

SEQ ID NO: 9090 - DNA, 27 bp, Artificial Sequences
  Synthetic
agtcgggttgggttcgggaggagattg

SEQ ID NO: 9091 - DNA, 27 bp, Artificial Sequences
  Synthetic
gtcgggttgggttcgggaggagattga

SEQ ID NO: 9092 - DNA, 27 bp, Artificial Sequences
  Synthetic
tcgggttgggttcgggaggagattgag

SEQ ID NO: 9093 - DNA, 27 bp, Artificial Sequences
  Synthetic
gttagtcgggttgggttcgggaggaga

SEQ ID NO: 9094 - DNA, 27 bp, Artificial Sequences
  Synthetic
aggaggcgtggagtaaaggattcggga

SEQ ID NO: 9095 - DNA, 28 bp, Artificial Sequences
  Synthetic
ggaggcgtggagtaaaggattcgggagt

SEQ ID NO: 9096 - DNA, 27 bp, Artificial Sequences
  Synthetic
ggaggcgtggagtaaaggattcgggag

SEQ ID NO: 9097 - DNA, 28 bp, Artificial Sequences
  Synthetic
aggaggcgtggagtaaaggattcgggag

SEQ ID NO: 9098 - DNA, 27 bp, Artificial Sequences
  Synthetic
gaggcgtggagtaaaggattcgggagt

SEQ ID NO: 9099 - DNA, 24 bp, Artificial Sequences
  Synthetic
ggcgtttcgagtttggcgttgttc

SEQ ID NO: 9100 - DNA, 33 bp, Artificial Sequences
  Synthetic
agcgcgtttagttttcgagttttttgttttacg

SEQ ID NO: 9101 - DNA, 34 bp, Artificial Sequences
  Synthetic
tagcgcgtttagttttcgagttttttgttttacg

SEQ ID NO: 9102 - DNA, 35 bp, Artificial Sequences
  Synthetic
gtagcgcgtttagttttcgagttttttgttttacg

SEQ ID NO: 9103 - DNA, 33 bp, Artificial Sequences
  Synthetic
tgcggagaaattttttaagagacggttgttagc

SEQ ID NO: 9104 - DNA, 34 bp, Artificial Sequences
  Synthetic
ttgcggagaaattttttaagagacggttgttagc

SEQ ID NO: 9105 - DNA, 35 bp, Artificial Sequences
  Synthetic
attgcggagaaattttttaagagacggttgttagc

SEQ ID NO: 9106 - DNA, 36 bp, Artificial Sequences
  Synthetic
tattgcggagaaattttttaagagacggttgttagc

SEQ ID NO: 9107 - DNA, 29 bp, Artificial Sequences
  Synthetic
aggagttatcggggaggagttaagatggt

SEQ ID NO: 9108 - DNA, 30 bp, Artificial Sequences
  Synthetic
aggagttatcggggaggagttaagatggtt

SEQ ID NO: 9109 - DNA, 30 bp, Artificial Sequences
  Synthetic
aaggagttatcggggaggagttaagatggt

SEQ ID NO: 9110 - DNA, 31 bp, Artificial Sequences
  Synthetic
aaggagttatcggggaggagttaagatggtt

SEQ ID NO: 9111 - DNA, 31 bp, Artificial Sequences
  Synthetic
aaaggagttatcggggaggagttaagatggt

SEQ ID NO: 9112 - DNA, 28 bp, Artificial Sequences
  Synthetic
acgttgggagttgtagatcggagttgtt

SEQ ID NO: 9113 - DNA, 29 bp, Artificial Sequences
  Synthetic
acgttgggagttgtagatcggagttgttt

SEQ ID NO: 9114 - DNA, 30 bp, Artificial Sequences
  Synthetic
acgttgggagttgtagatcggagttgtttt

SEQ ID NO: 9115 - DNA, 30 bp, Artificial Sequences
  Synthetic
tacgttgggagttgtagatcggagttgttt

SEQ ID NO: 9116 - DNA, 30 bp, Artificial Sequences
  Synthetic
ttacgttgggagttgtagatcggagttgtt

SEQ ID NO: 9117 - DNA, 36 bp, Artificial Sequences
  Synthetic
ggaagaaagagtggtagtcgtatttaggaggatttg

SEQ ID NO: 9118 - DNA, 36 bp, Artificial Sequences
  Synthetic
agagtggtagtcgtatttaggaggatttgtttgttt

SEQ ID NO: 9119 - DNA, 36 bp, Artificial Sequences
  Synthetic
aagagtggtagtcgtatttaggaggatttgtttgtt

SEQ ID NO: 9120 - DNA, 36 bp, Artificial Sequences
  Synthetic
aaagagtggtagtcgtatttaggaggatttgtttgt

SEQ ID NO: 9121 - DNA, 27 bp, Artificial Sequences
  Synthetic
gttagtttttcggggtttcggggggcg

SEQ ID NO: 9122 - DNA, 27 bp, Artificial Sequences
  Synthetic
tgttagtttttcggggtttcggggggc

SEQ ID NO: 9123 - DNA, 27 bp, Artificial Sequences
  Synthetic
ggtagtcgggagttgggtagcggagta

SEQ ID NO: 9124 - DNA, 27 bp, Artificial Sequences
  Synthetic
ttagtttttcggggtttcggggggcgc

SEQ ID NO: 9125 - DNA, 26 bp, Artificial Sequences
  Synthetic
ttagtttttcggggtttcggggggcg

SEQ ID NO: 9126 - DNA, 30 bp, Artificial Sequences
  Synthetic
ttttcgtttcggcgcgtattatttgtttcg

SEQ ID NO: 9127 - DNA, 31 bp, Artificial Sequences
  Synthetic
gttttcgtttcggcgcgtattatttgtttcg

SEQ ID NO: 9128 - DNA, 27 bp, Artificial Sequences
  Synthetic
gttagtttttcggggtttcggggggcg

SEQ ID NO: 9129 - DNA, 27 bp, Artificial Sequences
  Synthetic
tgttagtttttcggggtttcggggggc

SEQ ID NO: 9130 - DNA, 27 bp, Artificial Sequences
  Synthetic
ggtagtcgggagttgggtagcggagta

SEQ ID NO: 9131 - DNA, 27 bp, Artificial Sequences
  Synthetic
ttagtttttcggggtttcggggggcgc

SEQ ID NO: 9132 - DNA, 26 bp, Artificial Sequences
  Synthetic
ttagtttttcggggtttcggggggcg

SEQ ID NO: 9133 - DNA, 28 bp, Artificial Sequences
  Synthetic
tcgtttcggcgcgtattatttgtttcgt

SEQ ID NO: 9134 - DNA, 29 bp, Artificial Sequences
  Synthetic
tcgtttcggcgcgtattatttgtttcgtt

SEQ ID NO: 9135 - DNA, 29 bp, Artificial Sequences
  Synthetic
ttcgtttcggcgcgtattatttgtttcgt

SEQ ID NO: 9136 - DNA, 29 bp, Artificial Sequences
  Synthetic
cgtttcggcgcgtattatttgtttcgttg

SEQ ID NO: 9137 - DNA, 30 bp, Artificial Sequences
  Synthetic
cgtttcggcgcgtattatttgtttcgttgt

SEQ ID NO: 9138 - DNA, 27 bp, Artificial Sequences
  Synthetic
gttagtttttcggggtttcggggggcg

SEQ ID NO: 9139 - DNA, 27 bp, Artificial Sequences
  Synthetic
gttcgcggcggttaggagaggttcgta

SEQ ID NO: 9140 - DNA, 27 bp, Artificial Sequences
  Synthetic
tgttagtttttcggggtttcggggggc

SEQ ID NO: 9141 - DNA, 27 bp, Artificial Sequences
  Synthetic
ttagtttttcggggtttcggggggcgc

SEQ ID NO: 9142 - DNA, 26 bp, Artificial Sequences
  Synthetic
ttcgcggcggttaggagaggttcgta

SEQ ID NO: 9143 - DNA, 27 bp, Artificial Sequences
  Synthetic
tcggggtttcggaaagttggtattcgt

SEQ ID NO: 9144 - DNA, 28 bp, Artificial Sequences
  Synthetic
tcggggtttcggaaagttggtattcgtt

SEQ ID NO: 9145 - DNA, 29 bp, Artificial Sequences
  Synthetic
cggggtttcggaaagttggtattcgttgt

SEQ ID NO: 9146 - DNA, 28 bp, Artificial Sequences
  Synthetic
cggggtttcggaaagttggtattcgttg

SEQ ID NO: 9147 - DNA, 29 bp, Artificial Sequences
  Synthetic
tcggggtttcggaaagttggtattcgttg

SEQ ID NO: 9148 - DNA, 27 bp, Artificial Sequences
  Synthetic
gttcgcggcggttaggagaggttcgta

SEQ ID NO: 9149 - DNA, 27 bp, Artificial Sequences
  Synthetic
ttcggttcgttgattgtcgcgcggttc

SEQ ID NO: 9150 - DNA, 27 bp, Artificial Sequences
  Synthetic
gttcggttcgttgattgtcgcgcggtt

SEQ ID NO: 9151 - DNA, 27 bp, Artificial Sequences
  Synthetic
gtggttcggttcgttgattgtcgcgcg

SEQ ID NO: 9152 - DNA, 26 bp, Artificial Sequences
  Synthetic
ttcggttcgttgattgtcgcgcggtt

SEQ ID NO: 9153 - DNA, 27 bp, Artificial Sequences
  Synthetic
tcggggtttcggaaagttggtattcgt

SEQ ID NO: 9154 - DNA, 28 bp, Artificial Sequences
  Synthetic
tcggggtttcggaaagttggtattcgtt

SEQ ID NO: 9155 - DNA, 24 bp, Artificial Sequences
  Synthetic
cgttgggatttgtagggcgcgtcg

SEQ ID NO: 9156 - DNA, 29 bp, Artificial Sequences
  Synthetic
cggggtttcggaaagttggtattcgttgt

SEQ ID NO: 9157 - DNA, 28 bp, Artificial Sequences
  Synthetic
cggggtttcggaaagttggtattcgttg

SEQ ID NO: 9158 - DNA, 27 bp, Artificial Sequences
  Synthetic
ttcggttcgttgattgtcgcgcggttc

SEQ ID NO: 9159 - DNA, 27 bp, Artificial Sequences
  Synthetic
gttcggttcgttgattgtcgcgcggtt

SEQ ID NO: 9160 - DNA, 27 bp, Artificial Sequences
  Synthetic
gtggttcggttcgttgattgtcgcgcg

SEQ ID NO: 9161 - DNA, 26 bp, Artificial Sequences
  Synthetic
ttcggttcgttgattgtcgcgcggtt

SEQ ID NO: 9162 - DNA, 26 bp, Artificial Sequences
  Synthetic
tcggttcgttgattgtcgcgcggttc

SEQ ID NO: 9163 - DNA, 26 bp, Artificial Sequences
  Synthetic
cgttgggatttgtagggcgcgtcgtc

SEQ ID NO: 9164 - DNA, 25 bp, Artificial Sequences
  Synthetic
cgttgggatttgtagggcgcgtcgt

SEQ ID NO: 9165 - DNA, 25 bp, Artificial Sequences
  Synthetic
gttgggatttgtagggcgcgtcgtc

SEQ ID NO: 9166 - DNA, 24 bp, Artificial Sequences
  Synthetic
cgttgggatttgtagggcgcgtcg

SEQ ID NO: 9167 - DNA, 24 bp, Artificial Sequences
  Synthetic
gttgggatttgtagggcgcgtcgt

SEQ ID NO: 9168 - DNA, 27 bp, Artificial Sequences
  Synthetic
gtcgggggcggagggtagacgattttt

SEQ ID NO: 9169 - DNA, 27 bp, Artificial Sequences
  Synthetic
gaggagtttttagggtcgggggcggag

SEQ ID NO: 9170 - DNA, 27 bp, Artificial Sequences
  Synthetic
gtttttagggtcgggggcggagggtag

SEQ ID NO: 9171 - DNA, 27 bp, Artificial Sequences
  Synthetic
cgtaaagagaaggttgagcgcggcgtt

SEQ ID NO: 9172 - DNA, 27 bp, Artificial Sequences
  Synthetic
tttttagggtcgggggcggagggtaga

SEQ ID NO: 9173 - DNA, 34 bp, Artificial Sequences
  Synthetic
cgcgtaggaaatttaggtgattttttggaagtcg

SEQ ID NO: 9174 - DNA, 35 bp, Artificial Sequences
  Synthetic
cgcgtaggaaatttaggtgattttttggaagtcgt

SEQ ID NO: 9175 - DNA, 35 bp, Artificial Sequences
  Synthetic
tcgcgtaggaaatttaggtgattttttggaagtcg

SEQ ID NO: 9176 - DNA, 36 bp, Artificial Sequences
  Synthetic
tcgcgtaggaaatttaggtgattttttggaagtcgt

SEQ ID NO: 9177 - DNA, 34 bp, Artificial Sequences
  Synthetic
gcgtaggaaatttaggtgattttttggaagtcgt

SEQ ID NO: 9178 - DNA, 27 bp, Artificial Sequences
  Synthetic
gtcgggggcggagggtagacgattttt

SEQ ID NO: 9179 - DNA, 27 bp, Artificial Sequences
  Synthetic
gaggagtttttagggtcgggggcggag

SEQ ID NO: 9180 - DNA, 27 bp, Artificial Sequences
  Synthetic
gtttttagggtcgggggcggagggtag

SEQ ID NO: 9181 - DNA, 27 bp, Artificial Sequences
  Synthetic
cggttcgggcgtttcgtgggtttagtt

SEQ ID NO: 9182 - DNA, 27 bp, Artificial Sequences
  Synthetic
gacggaggagtttttagggtcgggggc

SEQ ID NO: 9183 - DNA, 27 bp, Artificial Sequences
  Synthetic
cggttttggggattttttcgtcggagt

SEQ ID NO: 9184 - DNA, 28 bp, Artificial Sequences
  Synthetic
tcggttttggggattttttcgtcggagt

SEQ ID NO: 9185 - DNA, 27 bp, Artificial Sequences
  Synthetic
tcggttttggggattttttcgtcggag

SEQ ID NO: 9186 - DNA, 28 bp, Artificial Sequences
  Synthetic
cggttttggggattttttcgtcggagtt

SEQ ID NO: 9187 - DNA, 29 bp, Artificial Sequences
  Synthetic
tcggttttggggattttttcgtcggagtt

SEQ ID NO: 9188 - DNA, 27 bp, Artificial Sequences
  Synthetic
agagaggtcgaggtttttgcggggagg

SEQ ID NO: 9189 - DNA, 27 bp, Artificial Sequences
  Synthetic
agaggtcgaggtttttgcggggaggtc

SEQ ID NO: 9190 - DNA, 27 bp, Artificial Sequences
  Synthetic
gagaggtcgaggtttttgcggggaggt

SEQ ID NO: 9191 - DNA, 27 bp, Artificial Sequences
  Synthetic
cgaggtttttgcggggaggtcggtttt

SEQ ID NO: 9192 - DNA, 27 bp, Artificial Sequences
  Synthetic
cggttcgggcgtttcgtgggtttagtt

SEQ ID NO: 9193 - DNA, 27 bp, Artificial Sequences
  Synthetic
ggattttcggtcggtgggcgggagtta

SEQ ID NO: 9194 - DNA, 27 bp, Artificial Sequences
  Synthetic
attttcggtcggtgggcgggagttagg

SEQ ID NO: 9195 - DNA, 27 bp, Artificial Sequences
  Synthetic
gtcggtgggcgggagttaggtttacgg

SEQ ID NO: 9196 - DNA, 27 bp, Artificial Sequences
  Synthetic
ggtcggtgggcgggagttaggtttacg

SEQ ID NO: 9197 - DNA, 27 bp, Artificial Sequences
  Synthetic
cggtcggtgggcgggagttaggtttac

SEQ ID NO: 9198 - DNA, 27 bp, Artificial Sequences
  Synthetic
agagaggtcgaggtttttgcggggagg

SEQ ID NO: 9199 - DNA, 27 bp, Artificial Sequences
  Synthetic
agaggtcgaggtttttgcggggaggtc

SEQ ID NO: 9200 - DNA, 27 bp, Artificial Sequences
  Synthetic
gagaggtcgaggtttttgcggggaggt

SEQ ID NO: 9201 - DNA, 27 bp, Artificial Sequences
  Synthetic
cgaggtttttgcggggaggtcggtttt

SEQ ID NO: 9202 - DNA, 27 bp, Artificial Sequences
  Synthetic
tcgaggtttttgcggggaggtcggttt

SEQ ID NO: 9203 - DNA, 27 bp, Artificial Sequences
  Synthetic
ggattttcggtcggtgggcgggagtta

SEQ ID NO: 9204 - DNA, 27 bp, Artificial Sequences
  Synthetic
attttcggtcggtgggcgggagttagg

SEQ ID NO: 9205 - DNA, 27 bp, Artificial Sequences
  Synthetic
gtcggtgggcgggagttaggtttacgg

SEQ ID NO: 9206 - DNA, 27 bp, Artificial Sequences
  Synthetic
ggtcggtgggcgggagttaggtttacg

SEQ ID NO: 9207 - DNA, 27 bp, Artificial Sequences
  Synthetic
cggtcggtgggcgggagttaggtttac

SEQ ID NO: 9208 - DNA, 27 bp, Artificial Sequences
  Synthetic
tgaaggaggtttagggattcgcggtgt

SEQ ID NO: 9209 - DNA, 28 bp, Artificial Sequences
  Synthetic
tgaaggaggtttagggattcgcggtgtt

SEQ ID NO: 9210 - DNA, 28 bp, Artificial Sequences
  Synthetic
ttgaaggaggtttagggattcgcggtgt

SEQ ID NO: 9211 - DNA, 27 bp, Artificial Sequences
  Synthetic
gaaggaggtttagggattcgcggtgtt

SEQ ID NO: 9212 - DNA, 27 bp, Artificial Sequences
  Synthetic
ttgaaggaggtttagggattcgcggtg

SEQ ID NO: 9213 - DNA, 27 bp, Artificial Sequences
  Synthetic
cgaggaggaagggatcggttttttcgt

SEQ ID NO: 9214 - DNA, 28 bp, Artificial Sequences
  Synthetic
ggaggaagggatcggttttttcgtaggg

SEQ ID NO: 9215 - DNA, 29 bp, Artificial Sequences
  Synthetic
aggaggaagggatcggttttttcgtaggg

SEQ ID NO: 9216 - DNA, 29 bp, Artificial Sequences
  Synthetic
ggaggaagggatcggttttttcgtaggga

SEQ ID NO: 9217 - DNA, 31 bp, Artificial Sequences
  Synthetic
cgaggaggaagggatcggttttttcgtaggg

SEQ ID NO: 9218 - DNA, 27 bp, Artificial Sequences
  Synthetic
tgggtatgggttggacgggatttcggt

SEQ ID NO: 9219 - DNA, 28 bp, Artificial Sequences
  Synthetic
tgggtatgggttggacgggatttcggtt

SEQ ID NO: 9220 - DNA, 28 bp, Artificial Sequences
  Synthetic
ttgggtatgggttggacgggatttcggt

SEQ ID NO: 9221 - DNA, 27 bp, Artificial Sequences
  Synthetic
gggtatgggttggacgggatttcggtt

SEQ ID NO: 9222 - DNA, 27 bp, Artificial Sequences
  Synthetic
ttgggtatgggttggacgggatttcgg

SEQ ID NO: 9223 - DNA, 27 bp, Artificial Sequences
  Synthetic
ggttcgaaggagatggtggtcggggtt

SEQ ID NO: 9224 - DNA, 27 bp, Artificial Sequences
  Synthetic
cgaaggagatggtggtcggggtttcgt

SEQ ID NO: 9225 - DNA, 27 bp, Artificial Sequences
  Synthetic
aggttcgaaggagatggtggtcggggt

SEQ ID NO: 9226 - DNA, 27 bp, Artificial Sequences
  Synthetic
taggttcgaaggagatggtggtcgggg

SEQ ID NO: 9227 - DNA, 28 bp, Artificial Sequences
  Synthetic
ggttcgaaggagatggtggtcggggttt

SEQ ID NO: 9228 - DNA, 27 bp, Artificial Sequences
  Synthetic
tttgtttcggagggttgtgggggaaga

SEQ ID NO: 9229 - DNA, 27 bp, Artificial Sequences
  Synthetic
tgtttcggagggttgtgggggaagatt

SEQ ID NO: 9230 - DNA, 27 bp, Artificial Sequences
  Synthetic
ttgtttcggagggttgtgggggaagat

SEQ ID NO: 9231 - DNA, 27 bp, Artificial Sequences
  Synthetic
atttgtttcggagggttgtgggggaag

SEQ ID NO: 9232 - DNA, 28 bp, Artificial Sequences
  Synthetic
ttgtttcggagggttgtgggggaagatt

SEQ ID NO: 9233 - DNA, 29 bp, Artificial Sequences
  Synthetic
gggtaagtgtttgtgtgtatttgtcgggg

SEQ ID NO: 9234 - DNA, 30 bp, Artificial Sequences
  Synthetic
agggtaagtgtttgtgtgtatttgtcgggg

SEQ ID NO: 9235 - DNA, 30 bp, Artificial Sequences
  Synthetic
gggtaagtgtttgtgtgtatttgtcgggga

SEQ ID NO: 9236 - DNA, 31 bp, Artificial Sequences
  Synthetic
agggtaagtgtttgtgtgtatttgtcgggga

SEQ ID NO: 9237 - DNA, 32 bp, Artificial Sequences
  Synthetic
ggagggtaagtgtttgtgtgtatttgtcgggg

SEQ ID NO: 9238 - DNA, 31 bp, Artificial Sequences
  Synthetic
cgaaattggggagatttggaaaacgttgagg

SEQ ID NO: 9239 - DNA, 32 bp, Artificial Sequences
  Synthetic
cgaaattggggagatttggaaaacgttgaggt

SEQ ID NO: 9240 - DNA, 31 bp, Artificial Sequences
  Synthetic
gaaattggggagatttggaaaacgttgaggt

SEQ ID NO: 9241 - DNA, 31 bp, Artificial Sequences
  Synthetic
aaattggggagatttggaaaacgttgaggtt

SEQ ID NO: 9242 - DNA, 33 bp, Artificial Sequences
  Synthetic
cgaaattggggagatttggaaaacgttgaggtt

SEQ ID NO: 9243 - DNA, 32 bp, Artificial Sequences
  Synthetic
cgggagaatgaaaggttgggaagattttgggg

SEQ ID NO: 9244 - DNA, 33 bp, Artificial Sequences
  Synthetic
cgggagaatgaaaggttgggaagattttggggt

SEQ ID NO: 9245 - DNA, 31 bp, Artificial Sequences
  Synthetic
cgggagaatgaaaggttgggaagattttggg

SEQ ID NO: 9246 - DNA, 31 bp, Artificial Sequences
  Synthetic
gggagaatgaaaggttgggaagattttgggg

SEQ ID NO: 9247 - DNA, 32 bp, Artificial Sequences
  Synthetic
gggagaatgaaaggttgggaagattttggggt

SEQ ID NO: 9248 - DNA, 27 bp, Artificial Sequences
  Synthetic
ggtcggggttttaggggaggttacggg

SEQ ID NO: 9249 - DNA, 27 bp, Artificial Sequences
  Synthetic
gggtcggggttttaggggaggttacgg

SEQ ID NO: 9250 - DNA, 27 bp, Artificial Sequences
  Synthetic
ggggtcggggttttaggggaggttacg

SEQ ID NO: 9251 - DNA, 27 bp, Artificial Sequences
  Synthetic
agtaggggtcggggttttaggggaggt

SEQ ID NO: 9252 - DNA, 27 bp, Artificial Sequences
  Synthetic
cggggttttaggggaggttacgggtcg

SEQ ID NO: 9253 - DNA, 27 bp, Artificial Sequences
  Synthetic
cggtttcgcgcgggattttgaggaagt

SEQ ID NO: 9254 - DNA, 27 bp, Artificial Sequences
  Synthetic
agtcgttgagtgtgaggttgtggcgga

SEQ ID NO: 9255 - DNA, 27 bp, Artificial Sequences
  Synthetic
ttggggttgtcgcggtagaaggggaag

SEQ ID NO: 9256 - DNA, 27 bp, Artificial Sequences
  Synthetic
tttggggttgtcgcggtagaaggggaa

SEQ ID NO: 9257 - DNA, 27 bp, Artificial Sequences
  Synthetic
ttttggggttgtcgcggtagaagggga

SEQ ID NO: 9258 - DNA, 27 bp, Artificial Sequences
  Synthetic
ggtagtagattggaggcggcgcggtta

SEQ ID NO: 9259 - DNA, 27 bp, Artificial Sequences
  Synthetic
cgacgtcgcggggtagtagattggagg

SEQ ID NO: 9260 - DNA, 27 bp, Artificial Sequences
  Synthetic
gacgtcgcggggtagtagattggaggc

SEQ ID NO: 9261 - DNA, 27 bp, Artificial Sequences
  Synthetic
cgacggcggcgcgtagtttgtatagac

SEQ ID NO: 9262 - DNA, 26 bp, Artificial Sequences
  Synthetic
acgtcgcggggtagtagattggaggc

SEQ ID NO: 9263 - DNA, 27 bp, Artificial Sequences
  Synthetic
ggtagtagattggaggcggcgcggtta

SEQ ID NO: 9264 - DNA, 27 bp, Artificial Sequences
  Synthetic
cgacgtcgcggggtagtagattggagg

SEQ ID NO: 9265 - DNA, 27 bp, Artificial Sequences
  Synthetic
gacgtcgcggggtagtagattggaggc

SEQ ID NO: 9266 - DNA, 27 bp, Artificial Sequences
  Synthetic
cgacggcggcgcgtagtttgtatagac

SEQ ID NO: 9267 - DNA, 26 bp, Artificial Sequences
  Synthetic
acgtcgcggggtagtagattggaggc

SEQ ID NO: 9268 - DNA, 27 bp, Artificial Sequences
  Synthetic
ggtagtagattggaggcggcgcggtta

SEQ ID NO: 9269 - DNA, 27 bp, Artificial Sequences
  Synthetic
cgacgtcgcggggtagtagattggagg

SEQ ID NO: 9270 - DNA, 27 bp, Artificial Sequences
  Synthetic
gacgtcgcggggtagtagattggaggc

SEQ ID NO: 9271 - DNA, 27 bp, Artificial Sequences
  Synthetic
cgacggcggcgcgtagtttgtatagac

SEQ ID NO: 9272 - DNA, 26 bp, Artificial Sequences
  Synthetic
acgtcgcggggtagtagattggaggc

SEQ ID NO: 9273 - DNA, 27 bp, Artificial Sequences
  Synthetic
ggtagtagattggaggcggcgcggtta

SEQ ID NO: 9274 - DNA, 27 bp, Artificial Sequences
  Synthetic
cgacgtcgcggggtagtagattggagg

SEQ ID NO: 9275 - DNA, 27 bp, Artificial Sequences
  Synthetic
gacgtcgcggggtagtagattggaggc

SEQ ID NO: 9276 - DNA, 27 bp, Artificial Sequences
  Synthetic
tcgacggtgcgggttttagttttgggt

SEQ ID NO: 9277 - DNA, 26 bp, Artificial Sequences
  Synthetic
acgtcgcggggtagtagattggaggc

SEQ ID NO: 9278 - DNA, 34 bp, Artificial Sequences
  Synthetic
cgttggtcgcgtcgtttttagtttattatttcgc

SEQ ID NO: 9279 - DNA, 33 bp, Artificial Sequences
  Synthetic
gttggtcgcgtcgtttttagtttattatttcgc

SEQ ID NO: 9280 - DNA, 27 bp, Artificial Sequences
  Synthetic
tcgacggtgcgggttttagttttgggt

SEQ ID NO: 9281 - DNA, 26 bp, Artificial Sequences
  Synthetic
tgcgggttggtagtcggtggtggtag

SEQ ID NO: 9282 - DNA, 28 bp, Artificial Sequences
  Synthetic
tgcgggttttagttttgggttgagcggt

SEQ ID NO: 9283 - DNA, 27 bp, Artificial Sequences
  Synthetic
gcgggttttagttttgggttgagcggt

SEQ ID NO: 9284 - DNA, 27 bp, Artificial Sequences
  Synthetic
tgcgggttttagttttgggttgagcgg

SEQ ID NO: 9285 - DNA, 27 bp, Artificial Sequences
  Synthetic
tggtggaggaggggatgagagattgaa

SEQ ID NO: 9286 - DNA, 27 bp, Artificial Sequences
  Synthetic
atggtggaggaggggatgagagattga

SEQ ID NO: 9287 - DNA, 28 bp, Artificial Sequences
  Synthetic
tggtggaggaggggatgagagattgaaa

SEQ ID NO: 9288 - DNA, 28 bp, Artificial Sequences
  Synthetic
atggtggaggaggggatgagagattgaa

SEQ ID NO: 9289 - DNA, 26 bp, Artificial Sequences
  Synthetic
tggtggaggaggggatgagagattga

SEQ ID NO: 9290 - DNA, 27 bp, Artificial Sequences
  Synthetic
tcgtgtagtggtagtcggtggttcggt

SEQ ID NO: 9291 - DNA, 28 bp, Artificial Sequences
  Synthetic
cgtgtagtggtagtcggtggttcggtgt

SEQ ID NO: 9292 - DNA, 27 bp, Artificial Sequences
  Synthetic
cgtgtagtggtagtcggtggttcggtg

SEQ ID NO: 9293 - DNA, 28 bp, Artificial Sequences
  Synthetic
tcgtgtagtggtagtcggtggttcggtg

SEQ ID NO: 9294 - DNA, 28 bp, Artificial Sequences
  Synthetic
gcggaggggaaggaggtagttgattcgt

SEQ ID NO: 9295 - DNA, 35 bp, Artificial Sequences
  Synthetic
cgttggttttgttagtatacgcgttttgatatcgg

SEQ ID NO: 9296 - DNA, 36 bp, Artificial Sequences
  Synthetic
tcgttggttttgttagtatacgcgttttgatatcgg

SEQ ID NO: 9297 - DNA, 35 bp, Artificial Sequences
  Synthetic
tcgttggttttgttagtatacgcgttttgatatcg

SEQ ID NO: 9298 - DNA, 36 bp, Artificial Sequences
  Synthetic
ttcgttggttttgttagtatacgcgttttgatatcg

SEQ ID NO: 9299 - DNA, 27 bp, Artificial Sequences
  Synthetic
cgatggggtttagaggttgaggtgtgg

SEQ ID NO: 9300 - DNA, 28 bp, Artificial Sequences
  Synthetic
cgatggggtttagaggttgaggtgtgga

SEQ ID NO: 9301 - DNA, 28 bp, Artificial Sequences
  Synthetic
tcgatggggtttagaggttgaggtgtgg

SEQ ID NO: 9302 - DNA, 29 bp, Artificial Sequences
  Synthetic
tcgatggggtttagaggttgaggtgtgga

SEQ ID NO: 9303 - DNA, 29 bp, Artificial Sequences
  Synthetic
cgcgtgtttgaggattttttcgatggggt

SEQ ID NO: 9304 - DNA, 27 bp, Artificial Sequences
  Synthetic
cgtggtgttaggtaagggacgaggggt

SEQ ID NO: 9305 - DNA, 27 bp, Artificial Sequences
  Synthetic
tcgtggtgttaggtaagggacgagggg

SEQ ID NO: 9306 - DNA, 28 bp, Artificial Sequences
  Synthetic
tcgtggtgttaggtaagggacgaggggt

SEQ ID NO: 9307 - DNA, 28 bp, Artificial Sequences
  Synthetic
cgtggtgttaggtaagggacgaggggtt

SEQ ID NO: 9308 - DNA, 27 bp, Artificial Sequences
  Synthetic
acggagggtagtaggaaggttttggcg

SEQ ID NO: 9309 - DNA, 27 bp, Artificial Sequences
  Synthetic
ggggtggcgtgtcgttgtgtgtgtatg

SEQ ID NO: 9310 - DNA, 27 bp, Artificial Sequences
  Synthetic
ggagggatggatggggcgggtaaagtt

SEQ ID NO: 9311 - DNA, 27 bp, Artificial Sequences
  Synthetic
gagggaaagacggagggatggatgggg

SEQ ID NO: 9312 - DNA, 27 bp, Artificial Sequences
  Synthetic
gggtggcgtgtcgttgtgtgtgtatgt

SEQ ID NO: 9313 - DNA, 27 bp, Artificial Sequences
  Synthetic
agggatggatggggcgggtaaagttga

SEQ ID NO: 9314 - DNA, 27 bp, Artificial Sequences
  Synthetic
gcggggttgtttagattttgcgggcga

SEQ ID NO: 9315 - DNA, 27 bp, Artificial Sequences
  Synthetic
cggggttgtttagattttgcgggcgag

SEQ ID NO: 9316 - DNA, 26 bp, Artificial Sequences
  Synthetic
gcggggttgtttagattttgcgggcg

SEQ ID NO: 9317 - DNA, 28 bp, Artificial Sequences
  Synthetic
gcggggttgtttagattttgcgggcgag

SEQ ID NO: 9318 - DNA, 26 bp, Artificial Sequences
  Synthetic
cggggttgtttagattttgcgggcga

SEQ ID NO: 9319 - DNA, 28 bp, Artificial Sequences
  Synthetic
ggagacgtcggggttttcggttttgagt

SEQ ID NO: 9320 - DNA, 27 bp, Artificial Sequences
  Synthetic
ggagacgtcggggttttcggttttgag

SEQ ID NO: 9321 - DNA, 27 bp, Artificial Sequences
  Synthetic
gagacgtcggggttttcggttttgagt

SEQ ID NO: 9322 - DNA, 27 bp, Artificial Sequences
  Synthetic
agacgtcggggttttcggttttgagtt

SEQ ID NO: 9323 - DNA, 27 bp, Artificial Sequences
  Synthetic
tcggttttgagtttttggagcgttcgc

SEQ ID NO: 9324 - DNA, 27 bp, Artificial Sequences
  Synthetic
gcggggttgtttagattttgcgggcga

SEQ ID NO: 9325 - DNA, 27 bp, Artificial Sequences
  Synthetic
cggggttgtttagattttgcgggcgag

SEQ ID NO: 9326 - DNA, 26 bp, Artificial Sequences
  Synthetic
gcggggttgtttagattttgcgggcg

SEQ ID NO: 9327 - DNA, 28 bp, Artificial Sequences
  Synthetic
gcggggttgtttagattttgcgggcgag

SEQ ID NO: 9328 - DNA, 26 bp, Artificial Sequences
  Synthetic
cggggttgtttagattttgcgggcga

SEQ ID NO: 9329 - DNA, 28 bp, Artificial Sequences
  Synthetic
ggagacgtcggggttttcggttttgagt

SEQ ID NO: 9330 - DNA, 27 bp, Artificial Sequences
  Synthetic
ggagacgtcggggttttcggttttgag

SEQ ID NO: 9331 - DNA, 27 bp, Artificial Sequences
  Synthetic
gagacgtcggggttttcggttttgagt

SEQ ID NO: 9332 - DNA, 27 bp, Artificial Sequences
  Synthetic
agacgtcggggttttcggttttgagtt

SEQ ID NO: 9333 - DNA, 27 bp, Artificial Sequences
  Synthetic
tcggttttgagtttttggagcgttcgc

SEQ ID NO: 9334 - DNA, 27 bp, Artificial Sequences
  Synthetic
gcggggttgtttagattttgcgggcga

SEQ ID NO: 9335 - DNA, 27 bp, Artificial Sequences
  Synthetic
cggggttgtttagattttgcgggcgag

SEQ ID NO: 9336 - DNA, 26 bp, Artificial Sequences
  Synthetic
gcggggttgtttagattttgcgggcg

SEQ ID NO: 9337 - DNA, 28 bp, Artificial Sequences
  Synthetic
gcggggttgtttagattttgcgggcgag

SEQ ID NO: 9338 - DNA, 26 bp, Artificial Sequences
  Synthetic
cggggttgtttagattttgcgggcga

SEQ ID NO: 9339 - DNA, 27 bp, Artificial Sequences
  Synthetic
cgcgttcgttcgttcgtaggatttggg

SEQ ID NO: 9340 - DNA, 28 bp, Artificial Sequences
  Synthetic
cgcgttcgttcgttcgtaggatttgggt

SEQ ID NO: 9341 - DNA, 27 bp, Artificial Sequences
  Synthetic
cgtaggatttgggtagtttcgcgggga

SEQ ID NO: 9342 - DNA, 27 bp, Artificial Sequences
  Synthetic
tcgtaggatttgggtagtttcgcgggg

SEQ ID NO: 9343 - DNA, 28 bp, Artificial Sequences
  Synthetic
tcgtaggatttgggtagtttcgcgggga

SEQ ID NO: 9344 - DNA, 27 bp, Artificial Sequences
  Synthetic
tgtataatgggttgcgcgtagagtcgg

SEQ ID NO: 9345 - DNA, 27 bp, Artificial Sequences
  Synthetic
agtagtcggcggtttgaaaggaggttt

SEQ ID NO: 9346 - DNA, 27 bp, Artificial Sequences
  Synthetic
aagtagtcggcggtttgaaaggaggtt

SEQ ID NO: 9347 - DNA, 27 bp, Artificial Sequences
  Synthetic
aaagtagtcggcggtttgaaaggaggt

SEQ ID NO: 9348 - DNA, 27 bp, Artificial Sequences
  Synthetic
gcgttagttgtataatgggttgcgcgt

SEQ ID NO: 9349 - DNA, 28 bp, Artificial Sequences
  Synthetic
gggtagtttcgcggggattcggttttgc

SEQ ID NO: 9350 - DNA, 27 bp, Artificial Sequences
  Synthetic
tgggtagtttcgcggggattcggtttt

SEQ ID NO: 9351 - DNA, 27 bp, Artificial Sequences
  Synthetic
ttgggtagtttcgcggggattcggttt

SEQ ID NO: 9352 - DNA, 27 bp, Artificial Sequences
  Synthetic
tttgggtagtttcgcggggattcggtt

SEQ ID NO: 9353 - DNA, 27 bp, Artificial Sequences
  Synthetic
ggtagtttcgcggggattcggttttgc

SEQ ID NO: 9354 - DNA, 27 bp, Artificial Sequences
  Synthetic
agtagtcggcggtttgaaaggaggttt

SEQ ID NO: 9355 - DNA, 27 bp, Artificial Sequences
  Synthetic
aagtagtcggcggtttgaaaggaggtt

SEQ ID NO: 9356 - DNA, 27 bp, Artificial Sequences
  Synthetic
aaagtagtcggcggtttgaaaggaggt

SEQ ID NO: 9357 - DNA, 27 bp, Artificial Sequences
  Synthetic
agtcggcggtttgaaaggaggtttaga

SEQ ID NO: 9358 - DNA, 29 bp, Artificial Sequences
  Synthetic
tgaaagtagtcggcggtttgaaaggaggt

SEQ ID NO: 9359 - DNA, 27 bp, Artificial Sequences
  Synthetic
ggagttcggtttgggttcgtggttggc

SEQ ID NO: 9360 - DNA, 27 bp, Artificial Sequences
  Synthetic
gtggggggaagcgcgtcgtatgttttg

SEQ ID NO: 9361 - DNA, 27 bp, Artificial Sequences
  Synthetic
aatgggttttttggggtggggggaagc

SEQ ID NO: 9362 - DNA, 27 bp, Artificial Sequences
  Synthetic
gagttcggtttgggttcgtggttggcg

SEQ ID NO: 9363 - DNA, 27 bp, Artificial Sequences
  Synthetic
tggcgagggttgcgtaggtaggtttgg

SEQ ID NO: 9364 - DNA, 27 bp, Artificial Sequences
  Synthetic
acggtatggtttgcgaagggagggagg

SEQ ID NO: 9365 - DNA, 27 bp, Artificial Sequences
  Synthetic
ggacggtatggtttgcgaagggaggga

SEQ ID NO: 9366 - DNA, 27 bp, Artificial Sequences
  Synthetic
agggagggaggcggaagatagtagcgt

SEQ ID NO: 9367 - DNA, 27 bp, Artificial Sequences
  Synthetic
tggacggtatggtttgcgaagggaggg

SEQ ID NO: 9368 - DNA, 27 bp, Artificial Sequences
  Synthetic
ttgcgaagggagggaggcggaagatag

SEQ ID NO: 9369 - DNA, 27 bp, Artificial Sequences
  Synthetic
gtggggggaagcgcgtcgtatgttttg

SEQ ID NO: 9370 - DNA, 27 bp, Artificial Sequences
  Synthetic
aatgggttttttggggtggggggaagc

SEQ ID NO: 9371 - DNA, 27 bp, Artificial Sequences
  Synthetic
tggaaatgggttttttggggtgggggg

SEQ ID NO: 9372 - DNA, 27 bp, Artificial Sequences
  Synthetic
ggaaatgggttttttggggtgggggga

SEQ ID NO: 9373 - DNA, 27 bp, Artificial Sequences
  Synthetic
gggggaagcgcgtcgtatgttttggta

SEQ ID NO: 9374 - DNA, 27 bp, Artificial Sequences
  Synthetic
acggtatggtttgcgaagggagggagg

SEQ ID NO: 9375 - DNA, 27 bp, Artificial Sequences
  Synthetic
ggacggtatggtttgcgaagggaggga

SEQ ID NO: 9376 - DNA, 27 bp, Artificial Sequences
  Synthetic
agggagggaggcggaagatagtagcgt

SEQ ID NO: 9377 - DNA, 27 bp, Artificial Sequences
  Synthetic
tggacggtatggtttgcgaagggaggg

SEQ ID NO: 9378 - DNA, 27 bp, Artificial Sequences
  Synthetic
ttgcgaagggagggaggcggaagatag

SEQ ID NO: 9379 - DNA, 27 bp, Artificial Sequences
  Synthetic
agggagttgtgggtgtcggtttttcgg

SEQ ID NO: 9380 - DNA, 28 bp, Artificial Sequences
  Synthetic
gagggagttgtgggtgtcggtttttcgg

SEQ ID NO: 9381 - DNA, 27 bp, Artificial Sequences
  Synthetic
gagggagttgtgggtgtcggtttttcg

SEQ ID NO: 9382 - DNA, 29 bp, Artificial Sequences
  Synthetic
agagggagttgtgggtgtcggtttttcgg

SEQ ID NO: 9383 - DNA, 28 bp, Artificial Sequences
  Synthetic
agagggagttgtgggtgtcggtttttcg

SEQ ID NO: 9384 - DNA, 27 bp, Artificial Sequences
  Synthetic
cggcgcggttattgttgatggacggta

SEQ ID NO: 9385 - DNA, 26 bp, Artificial Sequences
  Synthetic
cggcgcggttattgttgatggacggt

SEQ ID NO: 9386 - DNA, 28 bp, Artificial Sequences
  Synthetic
cggcgcggttattgttgatggacggtat

SEQ ID NO: 9387 - DNA, 27 bp, Artificial Sequences
  Synthetic
gcggcgcggttattgttgatggacggt

SEQ ID NO: 9388 - DNA, 26 bp, Artificial Sequences
  Synthetic
gcggcgcggttattgttgatggacgg

SEQ ID NO: 9389 - DNA, 27 bp, Artificial Sequences
  Synthetic
cggttgcgggggtaagatttcggatcg

SEQ ID NO: 9390 - DNA, 27 bp, Artificial Sequences
  Synthetic
cgtcggttgcgggggtaagatttcgga

SEQ ID NO: 9391 - DNA, 27 bp, Artificial Sequences
  Synthetic
ggttgcgggggtaagatttcggatcgt

SEQ ID NO: 9392 - DNA, 27 bp, Artificial Sequences
  Synthetic
gtcggttgcgggggtaagatttcggat

SEQ ID NO: 9393 - DNA, 26 bp, Artificial Sequences
  Synthetic
gcgtcggttgcgggggtaagatttcg

SEQ ID NO: 9394 - DNA, 27 bp, Artificial Sequences
  Synthetic
ggggaggggttttgaggggtagttggg

SEQ ID NO: 9395 - DNA, 27 bp, Artificial Sequences
  Synthetic
gggggaggggttttgaggggtagttgg

SEQ ID NO: 9396 - DNA, 27 bp, Artificial Sequences
  Synthetic
ggggggaggggttttgaggggtagttg

SEQ ID NO: 9397 - DNA, 27 bp, Artificial Sequences
  Synthetic
gagattggggggaggggttttgagggg

SEQ ID NO: 9398 - DNA, 27 bp, Artificial Sequences
  Synthetic
aggggttttgaggggtagttgggtggg

SEQ ID NO: 9399 - DNA, 27 bp, Artificial Sequences
  Synthetic
gggtcgggaattggggtagcgaaggaa

SEQ ID NO: 9400 - DNA, 27 bp, Artificial Sequences
  Synthetic
gttgagggtcgggaattggggtagcga

SEQ ID NO: 9401 - DNA, 27 bp, Artificial Sequences
  Synthetic
cgaggtagggcggcgagggttttaaga

SEQ ID NO: 9402 - DNA, 27 bp, Artificial Sequences
  Synthetic
aacgaggtagggcggcgagggttttaa

SEQ ID NO: 9403 - DNA, 27 bp, Artificial Sequences
  Synthetic
gaacgaggtagggcggcgagggtttta

SEQ ID NO: 9404 - DNA, 27 bp, Artificial Sequences
  Synthetic
aagggcggtaggtttggggaattcggg

SEQ ID NO: 9405 - DNA, 27 bp, Artificial Sequences
  Synthetic
gggcggtaggtttggggaattcgggtt

SEQ ID NO: 9406 - DNA, 27 bp, Artificial Sequences
  Synthetic
ggcggtaggtttggggaattcgggttt

SEQ ID NO: 9407 - DNA, 28 bp, Artificial Sequences
  Synthetic
taagggcggtaggtttggggaattcggg

SEQ ID NO: 9408 - DNA, 28 bp, Artificial Sequences
  Synthetic
gcggtaggtttggggaattcgggtttgg

SEQ ID NO: 9409 - DNA, 27 bp, Artificial Sequences
  Synthetic
cggcgcgaggttaggtttgtttcggtt

SEQ ID NO: 9410 - DNA, 27 bp, Artificial Sequences
  Synthetic
tcggcgcgaggttaggtttgtttcggt

SEQ ID NO: 9411 - DNA, 28 bp, Artificial Sequences
  Synthetic
cggcgcgaggttaggtttgtttcggttt

SEQ ID NO: 9412 - DNA, 26 bp, Artificial Sequences
  Synthetic
cggcgcgaggttaggtttgtttcggt

SEQ ID NO: 9413 - DNA, 26 bp, Artificial Sequences
  Synthetic
tcggcgcgaggttaggtttgtttcgg

SEQ ID NO: 9414 - DNA, 27 bp, Artificial Sequences
  Synthetic
ttttggcgtttgttggggtgagggtcg

SEQ ID NO: 9415 - DNA, 27 bp, Artificial Sequences
  Synthetic
aagggcggtaggtttggggaattcggg

SEQ ID NO: 9416 - DNA, 27 bp, Artificial Sequences
  Synthetic
gggcggtaggtttggggaattcgggtt

SEQ ID NO: 9417 - DNA, 27 bp, Artificial Sequences
  Synthetic
ggcggtaggtttggggaattcgggttt

SEQ ID NO: 9418 - DNA, 28 bp, Artificial Sequences
  Synthetic
tttttggcgtttgttggggtgagggtcg

SEQ ID NO: 9419 - DNA, 27 bp, Artificial Sequences
  Synthetic
cggcgcgaggttaggtttgtttcggtt

SEQ ID NO: 9420 - DNA, 27 bp, Artificial Sequences
  Synthetic
tcggcgcgaggttaggtttgtttcggt

SEQ ID NO: 9421 - DNA, 28 bp, Artificial Sequences
  Synthetic
cggcgcgaggttaggtttgtttcggttt

SEQ ID NO: 9422 - DNA, 26 bp, Artificial Sequences
  Synthetic
cggcgcgaggttaggtttgtttcggt

SEQ ID NO: 9423 - DNA, 26 bp, Artificial Sequences
  Synthetic
tcggcgcgaggttaggtttgtttcgg

SEQ ID NO: 9424 - DNA, 27 bp, Artificial Sequences
  Synthetic
ggtggggggtttggttcggattttcgg

SEQ ID NO: 9425 - DNA, 27 bp, Artificial Sequences
  Synthetic
ggtgaggtggggggtttggttcggatt

SEQ ID NO: 9426 - DNA, 27 bp, Artificial Sequences
  Synthetic
gtggggggtttggttcggattttcggt

SEQ ID NO: 9427 - DNA, 27 bp, Artificial Sequences
  Synthetic
aggtggggggtttggttcggattttcg

SEQ ID NO: 9428 - DNA, 27 bp, Artificial Sequences
  Synthetic
gtgaggtggggggtttggttcggattt

SEQ ID NO: 9429 - DNA, 33 bp, Artificial Sequences
  Synthetic
cgggttttgtagatttcgggtagatgttgacgg

SEQ ID NO: 9430 - DNA, 34 bp, Artificial Sequences
  Synthetic
cgggttttgtagatttcgggtagatgttgacggt

SEQ ID NO: 9431 - DNA, 32 bp, Artificial Sequences
  Synthetic
cgggttttgtagatttcgggtagatgttgacg

SEQ ID NO: 9432 - DNA, 34 bp, Artificial Sequences
  Synthetic
tcgggttttgtagatttcgggtagatgttgacgg

SEQ ID NO: 9433 - DNA, 32 bp, Artificial Sequences
  Synthetic
gggttttgtagatttcgggtagatgttgacgg

SEQ ID NO: 9434 - DNA, 27 bp, Artificial Sequences
  Synthetic
tcgtgcgtttgaagaagttttgcggga

SEQ ID NO: 9435 - DNA, 27 bp, Artificial Sequences
  Synthetic
tgcgggagttgagagttagcgaggttt

SEQ ID NO: 9436 - DNA, 27 bp, Artificial Sequences
  Synthetic
ttgcgggagttgagagttagcgaggtt

SEQ ID NO: 9437 - DNA, 27 bp, Artificial Sequences
  Synthetic
tttgcgggagttgagagttagcgaggt

SEQ ID NO: 9438 - DNA, 28 bp, Artificial Sequences
  Synthetic
cgtgcgtttgaagaagttttgcgggagt

SEQ ID NO: 9439 - DNA, 27 bp, Artificial Sequences
  Synthetic
cgtgtgagagttgtaaggtgagcggcg

SEQ ID NO: 9440 - DNA, 27 bp, Artificial Sequences
  Synthetic
acgtgtgagagttgtaaggtgagcggc

SEQ ID NO: 9441 - DNA, 27 bp, Artificial Sequences
  Synthetic
cgtgtgcggggataaggtgttcggtta

SEQ ID NO: 9442 - DNA, 28 bp, Artificial Sequences
  Synthetic
cgtgtgagagttgtaaggtgagcggcga

SEQ ID NO: 9443 - DNA, 27 bp, Artificial Sequences
  Synthetic
gtgtgagagttgtaaggtgagcggcga

SEQ ID NO: 9444 - DNA, 30 bp, Artificial Sequences
  Synthetic
cggggtatagttcgtttaggttttcgtcgt

SEQ ID NO: 9445 - DNA, 31 bp, Artificial Sequences
  Synthetic
cggggtatagttcgtttaggttttcgtcgta

SEQ ID NO: 9446 - DNA, 32 bp, Artificial Sequences
  Synthetic
cggggtatagttcgtttaggttttcgtcgtac

SEQ ID NO: 9447 - DNA, 34 bp, Artificial Sequences
  Synthetic
cgtgagtagttcgtagtggtagtcggatattttg

SEQ ID NO: 9448 - DNA, 34 bp, Artificial Sequences
  Synthetic
agttcgtagtggtagtcggatattttgttttcgt

SEQ ID NO: 9449 - DNA, 27 bp, Artificial Sequences
  Synthetic
cggtcgcggggattttaggttgtcggt

SEQ ID NO: 9450 - DNA, 27 bp, Artificial Sequences
  Synthetic
ggtcgcggggattttaggttgtcggtt

SEQ ID NO: 9451 - DNA, 26 bp, Artificial Sequences
  Synthetic
gcggtcgcggggattttaggttgtcg

SEQ ID NO: 9452 - DNA, 26 bp, Artificial Sequences
  Synthetic
cggtcgcggggattttaggttgtcgg

SEQ ID NO: 9453 - DNA, 27 bp, Artificial Sequences
  Synthetic
cggacgtcgcgggtatggattattcgt

SEQ ID NO: 9454 - DNA, 27 bp, Artificial Sequences
  Synthetic
gtttgcggagggatagcgggttaggga

SEQ ID NO: 9455 - DNA, 27 bp, Artificial Sequences
  Synthetic
tttgcggagggatagcgggttagggag

SEQ ID NO: 9456 - DNA, 27 bp, Artificial Sequences
  Synthetic
atcggtagtttggggttttcgcggtcg

SEQ ID NO: 9457 - DNA, 27 bp, Artificial Sequences
  Synthetic
cgtttgcggagggatagcgggttaggg

SEQ ID NO: 9458 - DNA, 27 bp, Artificial Sequences
  Synthetic
gagggatagcgggttagggagggtcgg

SEQ ID NO: 9459 - DNA, 27 bp, Artificial Sequences
  Synthetic
tcgggcgcggggattgtatcggattta

SEQ ID NO: 9460 - DNA, 27 bp, Artificial Sequences
  Synthetic
gagcgtggggtttggtaggggaaggtc

SEQ ID NO: 9461 - DNA, 27 bp, Artificial Sequences
  Synthetic
gtcgggcgcggggattgtatcggattt

SEQ ID NO: 9462 - DNA, 27 bp, Artificial Sequences
  Synthetic
cgggcgcggggattgtatcggatttat

SEQ ID NO: 9463 - DNA, 26 bp, Artificial Sequences
  Synthetic
agcgtggggtttggtaggggaaggtc

SEQ ID NO: 9464 - DNA, 27 bp, Artificial Sequences
  Synthetic
atcggtagtttggggttttcgcggtcg

SEQ ID NO: 9465 - DNA, 28 bp, Artificial Sequences
  Synthetic
gatcggtagtttggggttttcgcggtcg

SEQ ID NO: 9466 - DNA, 27 bp, Artificial Sequences
  Synthetic
agatcggtagtttggggttttcgcggt

SEQ ID NO: 9467 - DNA, 26 bp, Artificial Sequences
  Synthetic
tcggtagtttggggttttcgcggtcg

SEQ ID NO: 9468 - DNA, 28 bp, Artificial Sequences
  Synthetic
ggagatcggtagtttggggttttcgcgg

SEQ ID NO: 9469 - DNA, 27 bp, Artificial Sequences
  Synthetic
tcgggcgcggggattgtatcggattta

SEQ ID NO: 9470 - DNA, 27 bp, Artificial Sequences
  Synthetic
gagcgtggggtttggtaggggaaggtc

SEQ ID NO: 9471 - DNA, 27 bp, Artificial Sequences
  Synthetic
gtcgggcgcggggattgtatcggattt

SEQ ID NO: 9472 - DNA, 27 bp, Artificial Sequences
  Synthetic
cgggcgcggggattgtatcggatttat

SEQ ID NO: 9473 - DNA, 26 bp, Artificial Sequences
  Synthetic
gttttagatcgggcgcgacggggttc

SEQ ID NO: 9474 - DNA, 27 bp, Artificial Sequences
  Synthetic
tagcgtttcggggtgggttcggtgtag

SEQ ID NO: 9475 - DNA, 27 bp, Artificial Sequences
  Synthetic
gtagcgtttcggggtgggttcggtgta

SEQ ID NO: 9476 - DNA, 27 bp, Artificial Sequences
  Synthetic
gggtgggttcggtgtagttttcgcgtt

SEQ ID NO: 9477 - DNA, 27 bp, Artificial Sequences
  Synthetic
tcggggtgggttcggtgtagttttcgc

SEQ ID NO: 9478 - DNA, 27 bp, Artificial Sequences
  Synthetic
ggggtgggttcggtgtagttttcgcgt

SEQ ID NO: 9479 - DNA, 26 bp, Artificial Sequences
  Synthetic
gttttagatcgggcgcgacggggttc

SEQ ID NO: 9480 - DNA, 27 bp, Artificial Sequences
  Synthetic
ggttttagatcgggcgcgacggggttc

SEQ ID NO: 9481 - DNA, 26 bp, Artificial Sequences
  Synthetic
ggttttagatcgggcgcgacggggtt

SEQ ID NO: 9482 - DNA, 25 bp, Artificial Sequences
  Synthetic
cgagggttttagatcgggcgcgacg

SEQ ID NO: 9483 - DNA, 26 bp, Artificial Sequences
  Synthetic
gagggttttagatcgggcgcgacggg

SEQ ID NO: 9484 - DNA, 27 bp, Artificial Sequences
  Synthetic
cgttggcgggggagtttattgtggagt

SEQ ID NO: 9485 - DNA, 27 bp, Artificial Sequences
  Synthetic
agttgtttcggaagggtggtgtgtggt

SEQ ID NO: 9486 - DNA, 28 bp, Artificial Sequences
  Synthetic
gcgggggagtttattgtggagttgtggg

SEQ ID NO: 9487 - DNA, 28 bp, Artificial Sequences
  Synthetic
ggcgggggagtttattgtggagttgtgg

SEQ ID NO: 9488 - DNA, 27 bp, Artificial Sequences
  Synthetic
tggcgggggagtttattgtggagttgt

SEQ ID NO: 9489 - DNA, 30 bp, Artificial Sequences
  Synthetic
ggggggattgtaaatcgtttagggttgcgg

SEQ ID NO: 9490 - DNA, 29 bp, Artificial Sequences
  Synthetic
gggggattgtaaatcgtttagggttgcgg

SEQ ID NO: 9491 - DNA, 29 bp, Artificial Sequences
  Synthetic
ggggggattgtaaatcgtttagggttgcg

SEQ ID NO: 9492 - DNA, 30 bp, Artificial Sequences
  Synthetic
gggggattgtaaatcgtttagggttgcggt

SEQ ID NO: 9493 - DNA, 31 bp, Artificial Sequences
  Synthetic
ggggggattgtaaatcgtttagggttgcggt

SEQ ID NO: 9494 - DNA, 27 bp, Artificial Sequences
  Synthetic
tcggagaggatatggggtgggtggata

SEQ ID NO: 9495 - DNA, 26 bp, Artificial Sequences
  Synthetic
tcggagaggatatggggtgggtggat

SEQ ID NO: 9496 - DNA, 27 bp, Artificial Sequences
  Synthetic
cggagaggatatggggtgggtggatat

SEQ ID NO: 9497 - DNA, 28 bp, Artificial Sequences
  Synthetic
tcggagaggatatggggtgggtggatat

SEQ ID NO: 9498 - DNA, 25 bp, Artificial Sequences
  Synthetic
tcggagaggatatggggtgggtgga

SEQ ID NO: 9499 - DNA, 27 bp, Artificial Sequences
  Synthetic
tttagggtatgcggtgggaggggttgg

SEQ ID NO: 9500 - DNA, 27 bp, Artificial Sequences
  Synthetic
cggtgggaggggttgggggttataggt

SEQ ID NO: 9501 - DNA, 27 bp, Artificial Sequences
  Synthetic
atgcggtgggaggggttgggggttata

SEQ ID NO: 9502 - DNA, 27 bp, Artificial Sequences
  Synthetic
tatgcggtgggaggggttgggggttat

SEQ ID NO: 9503 - DNA, 26 bp, Artificial Sequences
  Synthetic
cggtgggaggggttgggggttatagg

SEQ ID NO: 9504 - DNA, 27 bp, Artificial Sequences
  Synthetic
ggttgggttcggttttatcgtcgcggt

SEQ ID NO: 9505 - DNA, 27 bp, Artificial Sequences
  Synthetic
aggttgggttcggttttatcgtcgcgg

SEQ ID NO: 9506 - DNA, 28 bp, Artificial Sequences
  Synthetic
ggttgggttcggttttatcgtcgcggtt

SEQ ID NO: 9507 - DNA, 28 bp, Artificial Sequences
  Synthetic
aggttgggttcggttttatcgtcgcggt

SEQ ID NO: 9508 - DNA, 27 bp, Artificial Sequences
  Synthetic
gttgggttcggttttatcgtcgcggtt

SEQ ID NO: 9509 - DNA, 29 bp, Artificial Sequences
  Synthetic
cgagaattttagtttttgcgtcgcgttcg

SEQ ID NO: 9510 - DNA, 32 bp, Artificial Sequences
  Synthetic
cgaagttggcgagaattttagtttttgcgtcg

SEQ ID NO: 9511 - DNA, 31 bp, Artificial Sequences
  Synthetic
cgttttgttcgcgttttttggagggataaac

SEQ ID NO: 9512 - DNA, 31 bp, Artificial Sequences
  Synthetic
gaagttggcgagaattttagtttttgcgtcg

SEQ ID NO: 9513 - DNA, 31 bp, Artificial Sequences
  Synthetic
cgaagttggcgagaattttagtttttgcgtc

SEQ ID NO: 9514 - DNA, 27 bp, Artificial Sequences
  Synthetic
ggttgggttcggttttatcgtcgcggt

SEQ ID NO: 9515 - DNA, 27 bp, Artificial Sequences
  Synthetic
aggttgggttcggttttatcgtcgcgg

SEQ ID NO: 9516 - DNA, 28 bp, Artificial Sequences
  Synthetic
ggttgggttcggttttatcgtcgcggtt

SEQ ID NO: 9517 - DNA, 28 bp, Artificial Sequences
  Synthetic
aggttgggttcggttttatcgtcgcggt

SEQ ID NO: 9518 - DNA, 27 bp, Artificial Sequences
  Synthetic
gttgggttcggttttatcgtcgcggtt

SEQ ID NO: 9519 - DNA, 27 bp, Artificial Sequences
  Synthetic
aattttgaggggaataggacggcggcg

SEQ ID NO: 9520 - DNA, 27 bp, Artificial Sequences
  Synthetic
attttgaggggaataggacggcggcgg

SEQ ID NO: 9521 - DNA, 28 bp, Artificial Sequences
  Synthetic
gaattttgaggggaataggacggcggcg

SEQ ID NO: 9522 - DNA, 28 bp, Artificial Sequences
  Synthetic
aattttgaggggaataggacggcggcgg

SEQ ID NO: 9523 - DNA, 26 bp, Artificial Sequences
  Synthetic
ttttgaggggaataggacggcggcgg

SEQ ID NO: 9524 - DNA, 27 bp, Artificial Sequences
  Synthetic
gagcgcggcgtagggattggagttttc

SEQ ID NO: 9525 - DNA, 27 bp, Artificial Sequences
  Synthetic
cgcggcgtagggattggagttttcgtt

SEQ ID NO: 9526 - DNA, 27 bp, Artificial Sequences
  Synthetic
ggttgggttcggttttatcgtcgcggt

SEQ ID NO: 9527 - DNA, 27 bp, Artificial Sequences
  Synthetic
aggttgggttcggttttatcgtcgcgg

SEQ ID NO: 9528 - DNA, 27 bp, Artificial Sequences
  Synthetic
agcgcggcgtagggattggagttttcg

SEQ ID NO: 9529 - DNA, 27 bp, Artificial Sequences
  Synthetic
aattttgaggggaataggacggcggcg

SEQ ID NO: 9530 - DNA, 27 bp, Artificial Sequences
  Synthetic
attttgaggggaataggacggcggcgg

SEQ ID NO: 9531 - DNA, 28 bp, Artificial Sequences
  Synthetic
gaattttgaggggaataggacggcggcg

SEQ ID NO: 9532 - DNA, 28 bp, Artificial Sequences
  Synthetic
aattttgaggggaataggacggcggcgg

SEQ ID NO: 9533 - DNA, 26 bp, Artificial Sequences
  Synthetic
ttttgaggggaataggacggcggcgg

SEQ ID NO: 9534 - DNA, 27 bp, Artificial Sequences
  Synthetic
gagcgcggcgtagggattggagttttc

SEQ ID NO: 9535 - DNA, 27 bp, Artificial Sequences
  Synthetic
tcggagttgttcggggggtttcggttt

SEQ ID NO: 9536 - DNA, 27 bp, Artificial Sequences
  Synthetic
ttcggagttgttcggggggtttcggtt

SEQ ID NO: 9537 - DNA, 27 bp, Artificial Sequences
  Synthetic
tttcggagttgttcggggggtttcggt

SEQ ID NO: 9538 - DNA, 27 bp, Artificial Sequences
  Synthetic
cggagttgttcggggggtttcggtttc

SEQ ID NO: 9539 - DNA, 27 bp, Artificial Sequences
  Synthetic
aattttgaggggaataggacggcggcg

SEQ ID NO: 9540 - DNA, 27 bp, Artificial Sequences
  Synthetic
attttgaggggaataggacggcggcgg

SEQ ID NO: 9541 - DNA, 28 bp, Artificial Sequences
  Synthetic
gaattttgaggggaataggacggcggcg

SEQ ID NO: 9542 - DNA, 28 bp, Artificial Sequences
  Synthetic
aattttgaggggaataggacggcggcgg

SEQ ID NO: 9543 - DNA, 26 bp, Artificial Sequences
  Synthetic
ttttgaggggaataggacggcggcgg

SEQ ID NO: 9544 - DNA, 27 bp, Artificial Sequences
  Synthetic
tcggagttgttcggggggtttcggttt

SEQ ID NO: 9545 - DNA, 27 bp, Artificial Sequences
  Synthetic
ttcggagttgttcggggggtttcggtt

SEQ ID NO: 9546 - DNA, 27 bp, Artificial Sequences
  Synthetic
tttcggagttgttcggggggtttcggt

SEQ ID NO: 9547 - DNA, 27 bp, Artificial Sequences
  Synthetic
cggagttgttcggggggtttcggtttc

SEQ ID NO: 9548 - DNA, 27 bp, Artificial Sequences
  Synthetic
ttttcggagttgttcggggggtttcgg

SEQ ID NO: 9549 - DNA, 27 bp, Artificial Sequences
  Synthetic
tgttcgtggcgtttgtgtaatttcggt

SEQ ID NO: 9550 - DNA, 28 bp, Artificial Sequences
  Synthetic
cggtgttttttcgtttttgttcgtggcg

SEQ ID NO: 9551 - DNA, 29 bp, Artificial Sequences
  Synthetic
cggtgttttttcgtttttgttcgtggcgt

SEQ ID NO: 9552 - DNA, 29 bp, Artificial Sequences
  Synthetic
tcggtgttttttcgtttttgttcgtggcg

SEQ ID NO: 9553 - DNA, 31 bp, Artificial Sequences
  Synthetic
cgtcggtgttttttcgtttttgttcgtggcg

SEQ ID NO: 9554 - DNA, 26 bp, Artificial Sequences
  Synthetic
ggagttgttcggggggtttcggtttc

SEQ ID NO: 9555 - DNA, 25 bp, Artificial Sequences
  Synthetic
ggagttgttcggggggtttcggttt

SEQ ID NO: 9556 - DNA, 26 bp, Artificial Sequences
  Synthetic
cgagtttgggtgtcgcggaattatcg

SEQ ID NO: 9557 - DNA, 28 bp, Artificial Sequences
  Synthetic
cggggttttagaggtttcgtttgagagc

SEQ ID NO: 9558 - DNA, 29 bp, Artificial Sequences
  Synthetic
tcggggttttagaggtttcgtttgagagc

SEQ ID NO: 9559 - DNA, 27 bp, Artificial Sequences
  Synthetic
tgttcgtggcgtttgtgtaatttcggt

SEQ ID NO: 9560 - DNA, 28 bp, Artificial Sequences
  Synthetic
cggtgttttttcgtttttgttcgtggcg

SEQ ID NO: 9561 - DNA, 29 bp, Artificial Sequences
  Synthetic
cggtgttttttcgtttttgttcgtggcgt

SEQ ID NO: 9562 - DNA, 29 bp, Artificial Sequences
  Synthetic
tcggtgttttttcgtttttgttcgtggcg

SEQ ID NO: 9563 - DNA, 31 bp, Artificial Sequences; identical to SEQ ID NO: 9553
  Synthetic

SEQ ID NO: 9564 - DNA, 27 bp, Artificial Sequences
  Synthetic
acgttacgggtaggagcgggagggtat

SEQ ID NO: 9565 - DNA, 27 bp, Artificial Sequences
  Synthetic
aacgttacgggtaggagcgggagggta

SEQ ID NO: 9566 - DNA, 27 bp, Artificial Sequences
  Synthetic
ttacgggtaggagcgggagggtatcgg

SEQ ID NO: 9567 - DNA, 27 bp, Artificial Sequences
  Synthetic
gttacgggtaggagcgggagggtatcg

SEQ ID NO: 9568 - DNA, 27 bp, Artificial Sequences
  Synthetic
cgttacgggtaggagcgggagggtatc

SEQ ID NO: 9569 - DNA, 27 bp, Artificial Sequences
  Synthetic
agttgatggtcggtgaaggtcgtgcgc

SEQ ID NO: 9570 - DNA, 26 bp, Artificial Sequences
  Synthetic
gttgatggtcggtgaaggtcgtgcgc

SEQ ID NO: 9571 - DNA, 27 bp, Artificial Sequences
  Synthetic
tagttgatggtcggtgaaggtcgtgcg

SEQ ID NO: 9572 - DNA, 28 bp, Artificial Sequences
  Synthetic
tagttgatggtcggtgaaggtcgtgcgc

SEQ ID NO: 9573 - DNA, 26 bp, Artificial Sequences
  Synthetic
agttgatggtcggtgaaggtcgtgcg

SEQ ID NO: 9574 - DNA, 27 bp, Artificial Sequences
  Synthetic
acgttacgggtaggagcgggagggtat

SEQ ID NO: 9575 - DNA, 27 bp, Artificial Sequences
  Synthetic
aacgttacgggtaggagcgggagggta

SEQ ID NO: 9576 - DNA, 27 bp, Artificial Sequences
  Synthetic
ttacgggtaggagcgggagggtatcgg

SEQ ID NO: 9577 - DNA, 27 bp, Artificial Sequences
  Synthetic
gttacgggtaggagcgggagggtatcg

SEQ ID NO: 9578 - DNA, 27 bp, Artificial Sequences
  Synthetic
cgttacgggtaggagcgggagggtatc

SEQ ID NO: 9579 - DNA, 27 bp, Artificial Sequences
  Synthetic
agttgatggtcggtgaaggtcgtgcgc

SEQ ID NO: 9580 - DNA, 26 bp, Artificial Sequences
  Synthetic
gttgatggtcggtgaaggtcgtgcgc

SEQ ID NO: 9581 - DNA, 27 bp, Artificial Sequences
  Synthetic
tagttgatggtcggtgaaggtcgtgcg

SEQ ID NO: 9582 - DNA, 27 bp, Artificial Sequences
  Synthetic
gaggcggcgagttttatgcggttttgt

SEQ ID NO: 9583 - DNA, 28 bp, Artificial Sequences
  Synthetic
tagttgatggtcggtgaaggtcgtgcgc

SEQ ID NO: 9584 - DNA, 25 bp, Artificial Sequences
  Synthetic
tcgtagtgaaggaggagggcgatcg

SEQ ID NO: 9585 - DNA, 29 bp, Artificial Sequences
  Synthetic
ggtcgggttttgatatgtcgttgtgttcg

SEQ ID NO: 9586 - DNA, 30 bp, Artificial Sequences
  Synthetic
ggtcgggttttgatatgtcgttgtgttcgt

SEQ ID NO: 9587 - DNA, 30 bp, Artificial Sequences
  Synthetic
aggtcgggttttgatatgtcgttgtgttcg

SEQ ID NO: 9588 - DNA, 31 bp, Artificial Sequences
  Synthetic
aggtcgggttttgatatgtcgttgtgttcgt

SEQ ID NO: 9589 - DNA, 27 bp, Artificial Sequences
  Synthetic
agttgatggtcggtgaaggtcgtgcgt

SEQ ID NO: 9590 - DNA, 27 bp, Artificial Sequences
  Synthetic
gcgaggcggcgagttttatgcggtttt

SEQ ID NO: 9591 - DNA, 27 bp, Artificial Sequences
  Synthetic
cgaggcggcgagttttatgcggttttg

SEQ ID NO: 9592 - DNA, 28 bp, Artificial Sequences
  Synthetic
cgaggcggcgagttttatgcggttttgt

SEQ ID NO: 9593 - DNA, 28 bp, Artificial Sequences
  Synthetic
tagttgatggtcggtgaaggtcgtgcgt

SEQ ID NO: 9594 - DNA, 27 bp, Artificial Sequences
  Synthetic
tggcgtagttggagcgtagtttcgagc

SEQ ID NO: 9595 - DNA, 28 bp, Artificial Sequences
  Synthetic
ttggcgtagttggagcgtagtttcgagc

SEQ ID NO: 9596 - DNA, 29 bp, Artificial Sequences
  Synthetic
gttggcgtagttggagcgtagtttcgagc

SEQ ID NO: 9597 - DNA, 27 bp, Artificial Sequences
  Synthetic
agttggcgtagttggagcgtagtttcg

SEQ ID NO: 9598 - DNA, 27 bp, Artificial Sequences
  Synthetic
gttggcgtagttggagcgtagtttcga

SEQ ID NO: 9599 - DNA, 27 bp, Artificial Sequences
  Synthetic
aggttttgatttgcgtgtcggtgaggt

SEQ ID NO: 9600 - DNA, 27 bp, Artificial Sequences
  Synthetic
ttgatttgcgtgtcggtgaggttgagt

SEQ ID NO: 9601 - DNA, 27 bp, Artificial Sequences
  Synthetic
ggttttgatttgcgtgtcggtgaggtt

SEQ ID NO: 9602 - DNA, 28 bp, Artificial Sequences
  Synthetic
aggttttgatttgcgtgtcggtgaggtt

SEQ ID NO: 9603 - DNA, 28 bp, Artificial Sequences
  Synthetic
ggttttgatttgcgtgtcggtgaggttg

SEQ ID NO: 9604 - DNA, 28 bp, Artificial Sequences
  Synthetic
tgatcgtttgggttgtgggggagtttgt

SEQ ID NO: 9605 - DNA, 27 bp, Artificial Sequences
  Synthetic
gatcgtttgggttgtgggggagtttgt

SEQ ID NO: 9606 - DNA, 27 bp, Artificial Sequences
  Synthetic
tgatcgtttgggttgtgggggagtttg

SEQ ID NO: 9607 - DNA, 27 bp, Artificial Sequences
  Synthetic
tcgtttgggttgtgggggagtttgttt

SEQ ID NO: 9608 - DNA, 27 bp, Artificial Sequences
  Synthetic
atcgtttgggttgtgggggagtttgtt

SEQ ID NO: 9609 - DNA, 27 bp, Artificial Sequences
  Synthetic
agggagttacggcggggagatttggtt

SEQ ID NO: 9610 - DNA, 27 bp, Artificial Sequences
  Synthetic
tagggagttacggcggggagatttggt

SEQ ID NO: 9611 - DNA, 27 bp, Artificial Sequences
  Synthetic
gggagttacggcggggagatttggttt

SEQ ID NO: 9612 - DNA, 28 bp, Artificial Sequences
  Synthetic
agggagttacggcggggagatttggttt

SEQ ID NO: 9613 - DNA, 26 bp, Artificial Sequences
  Synthetic
agggagttacggcggggagatttggt

SEQ ID NO: 9614 - DNA, 27 bp, Artificial Sequences
  Synthetic
gggcgggtgtttgtggttcgggttatg

SEQ ID NO: 9615 - DNA, 27 bp, Artificial Sequences
  Synthetic
tcgtcgtggttttttgggcgggtgttt

SEQ ID NO: 9616 - DNA, 27 bp, Artificial Sequences
  Synthetic
ttcgtcgtggttttttgggcgggtgtt

SEQ ID NO: 9617 - DNA, 27 bp, Artificial Sequences
  Synthetic
tttcgtcgtggttttttgggcgggtgt

SEQ ID NO: 9618 - DNA, 27 bp, Artificial Sequences
  Synthetic
tttttgggcgggtgtttgtggttcggg

SEQ ID NO: 9619 - DNA, 27 bp, Artificial Sequences
  Synthetic
agggagttacggcggggagatttggtt

SEQ ID NO: 9620 - DNA, 27 bp, Artificial Sequences
  Synthetic
tagggagttacggcggggagatttggt

SEQ ID NO: 9621 - DNA, 27 bp, Artificial Sequences
  Synthetic
gggagttacggcggggagatttggttt

SEQ ID NO: 9622 - DNA, 28 bp, Artificial Sequences
  Synthetic
agggagttacggcggggagatttggttt

SEQ ID NO: 9623 - DNA, 26 bp, Artificial Sequences
  Synthetic
agggagttacggcggggagatttggt

SEQ ID NO: 9624 - DNA, 27 bp, Artificial Sequences
  Synthetic
tgggttgtgtgtgagttttcgttgcgg

SEQ ID NO: 9625 - DNA, 28 bp, Artificial Sequences
  Synthetic
tgggttgtgtgtgagttttcgttgcgga

SEQ ID NO: 9626 - DNA, 27 bp, Artificial Sequences
  Synthetic
gggttgtgtgtgagttttcgttgcgga

SEQ ID NO: 9627 - DNA, 28 bp, Artificial Sequences
  Synthetic
atgggttgtgtgtgagttttcgttgcgg

SEQ ID NO: 9628 - DNA, 28 bp, Artificial Sequences
  Synthetic
gggttgtgtgtgagttttcgttgcggaa

SEQ ID NO: 9629 - DNA, 27 bp, Artificial Sequences
  Synthetic
tggggatagagagggggaaggatggtt

SEQ ID NO: 9630 - DNA, 27 bp, Artificial Sequences
  Synthetic
ttggggatagagagggggaaggatggt

SEQ ID NO: 9631 - DNA, 29 bp, Artificial Sequences
  Synthetic
tgttggggatagagagggggaaggatggt

SEQ ID NO: 9632 - DNA, 28 bp, Artificial Sequences
  Synthetic
gttggggatagagagggggaaggatggt

SEQ ID NO: 9633 - DNA, 28 bp, Artificial Sequences
  Synthetic
tgttggggatagagagggggaaggatgg

SEQ ID NO: 9634 - DNA, 28 bp, Artificial Sequences
  Synthetic
ggtcggtaggttcgggaagttttttcgt

SEQ ID NO: 9635 - DNA, 27 bp, Artificial Sequences
  Synthetic
ggtcggtaggttcgggaagttttttcg

SEQ ID NO: 9636 - DNA, 29 bp, Artificial Sequences
  Synthetic
aggtcggtaggttcgggaagttttttcgt

SEQ ID NO: 9637 - DNA, 28 bp, Artificial Sequences
  Synthetic
aggtcggtaggttcgggaagttttttcg

SEQ ID NO: 9638 - DNA, 29 bp, Artificial Sequences
  Synthetic
aaggtcggtaggttcgggaagttttttcg

SEQ ID NO: 9639 - DNA, 34 bp, Artificial Sequences
  Synthetic
tgaattttacgtgggatgggttttgttagagaga

SEQ ID NO: 9640 - DNA, 35 bp, Artificial Sequences
  Synthetic
ttgaattttacgtgggatgggttttgttagagaga

SEQ ID NO: 9641 - DNA, 35 bp, Artificial Sequences
  Synthetic
tgaattttacgtgggatgggttttgttagagagat

SEQ ID NO: 9642 - DNA, 36 bp, Artificial Sequences
  Synthetic
tttgaattttacgtgggatgggttttgttagagaga

SEQ ID NO: 9643 - DNA, 36 bp, Artificial Sequences
  Synthetic
tgaattttacgtgggatgggttttgttagagagatt

SEQ ID NO: 9644 - DNA, 34 bp, Artificial Sequences
  Synthetic
cgtcgtatggatttgtagaggtagtcgtttttgt

SEQ ID NO: 9645 - DNA, 34 bp, Artificial Sequences
  Synthetic
tcgtatggatttgtagaggtagtcgtttttgtcg

SEQ ID NO: 9646 - DNA, 34 bp, Artificial Sequences
  Synthetic
tcgtcgtatggatttgtagaggtagtcgtttttg

SEQ ID NO: 9647 - DNA, 35 bp, Artificial Sequences
  Synthetic
tcgtcgtatggatttgtagaggtagtcgtttttgt

SEQ ID NO: 9648 - DNA, 36 bp, Artificial Sequences
  Synthetic
cgtcgtatggatttgtagaggtagtcgtttttgtcg

SEQ ID NO: 9649 - DNA, 27 bp, Artificial Sequences
  Synthetic
agggcggagggggttggatttgttgag

SEQ ID NO: 9650 - DNA, 27 bp, Artificial Sequences
  Synthetic
tagggcggagggggttggatttgttga

SEQ ID NO: 9651 - DNA, 27 bp, Artificial Sequences
  Synthetic
gggcggagggggttggatttgttgagt

SEQ ID NO: 9652 - DNA, 27 bp, Artificial Sequences
  Synthetic
ggcggagggggttggatttgttgagtt

SEQ ID NO: 9653 - DNA, 28 bp, Artificial Sequences
  Synthetic
tagggcggagggggttggatttgttgag

SEQ ID NO: 9654 - DNA, 28 bp, Artificial Sequences
  Synthetic
tggttgattttggttggtggtgagagga

SEQ ID NO: 9655 - DNA, 28 bp, Artificial Sequences
  Synthetic
tgtagaggtagtcgtttttgtcgggtgg

SEQ ID NO: 9656 - DNA, 30 bp, Artificial Sequences
  Synthetic
cgtttttgtcgggtggatttgtttttcgcg

SEQ ID NO: 9657 - DNA, 29 bp, Artificial Sequences
  Synthetic
tgtagaggtagtcgtttttgtcgggtgga

SEQ ID NO: 9658 - DNA, 28 bp, Artificial Sequences
  Synthetic
gtagaggtagtcgtttttgtcgggtgga

SEQ ID NO: 9659 - DNA, 28 bp, Artificial Sequences
  Synthetic
tggagagttgggagaattggttttcggt

SEQ ID NO: 9660 - DNA, 28 bp, Artificial Sequences
  Synthetic
tggtgtttggagagttgggagaattggt

SEQ ID NO: 9661 - DNA, 30 bp, Artificial Sequences
  Synthetic
tggagagttgggagaattggttttcggtgt

SEQ ID NO: 9662 - DNA, 29 bp, Artificial Sequences
  Synthetic
ggagagttgggagaattggttttcggtgt

SEQ ID NO: 9663 - DNA, 29 bp, Artificial Sequences
  Synthetic
tggagagttgggagaattggttttcggtg

SEQ ID NO: 9664 - DNA, 30 bp, Artificial Sequences
  Synthetic
ggttttttagcgtcgtttcgggattttcgg

SEQ ID NO: 9665 - DNA, 24 bp, Artificial Sequences
  Synthetic
cgggcggtcgatcgttagggttac

SEQ ID NO: 9666 - DNA, 31 bp, Artificial Sequences
  Synthetic
aggttttttagcgtcgtttcgggattttcgg

SEQ ID NO: 9667 - DNA, 29 bp, Artificial Sequences
  Synthetic
ttttttagcgtcgtttcgggattttcgga

SEQ ID NO: 9668 - DNA, 31 bp, Artificial Sequences
  Synthetic
ggttttttagcgtcgtttcgggattttcgga

SEQ ID NO: 9669 - DNA, 27 bp, Artificial Sequences
  Synthetic
cgtggttgatggcgtttgtggtgttcg

SEQ ID NO: 9670 - DNA, 27 bp, Artificial Sequences
  Synthetic
cggtgttcgtggttgatggcgtttgtg

SEQ ID NO: 9671 - DNA, 27 bp, Artificial Sequences
  Synthetic
ggtgttcgtggttgatggcgtttgtgg

SEQ ID NO: 9672 - DNA, 28 bp, Artificial Sequences
  Synthetic
ggtgttcgtggttgatggcgtttgtggt

SEQ ID NO: 9673 - DNA, 28 bp, Artificial Sequences
  Synthetic
cgtggttgatggcgtttgtggtgttcga

SEQ ID NO: 9674 - DNA, 29 bp, Artificial Sequences
  Synthetic
tgcgtttcgagtttttaggtgttagagcg

SEQ ID NO: 9675 - DNA, 29 bp, Artificial Sequences
  Synthetic
ttttttagcgtcgtttcgggattttcgga

SEQ ID NO: 9676 - DNA, 31 bp, Artificial Sequences; identical to SEQ ID NO: 9668
  Synthetic

SEQ ID NO: 9677 - DNA, 31 bp, Artificial Sequences
  Synthetic
ggtgcgtttcgagtttttaggtgttagagcg

SEQ ID NO: 9678 - DNA, 32 bp, Artificial Sequences
  Synthetic
tggtgcgtttcgagtttttaggtgttagagcg

SEQ ID NO: 9679 - DNA, 27 bp, Artificial Sequences
  Synthetic
tggggaggagggaggagtcgagattgg

SEQ ID NO: 9680 - DNA, 27 bp, Artificial Sequences
  Synthetic
gggaggagggaggagtcgagattgggt

SEQ ID NO: 9681 - DNA, 27 bp, Artificial Sequences
  Synthetic
ggtggggaggagggaggagtcgagatt

SEQ ID NO: 9682 - DNA, 27 bp, Artificial Sequences
  Synthetic
ttttggtggggaggagggaggagtcga

SEQ ID NO: 9683 - DNA, 27 bp, Artificial Sequences
  Synthetic
tttggtggggaggagggaggagtcgag

SEQ ID NO: 9684 - DNA, 27 bp, Artificial Sequences
  Synthetic
ggtggtcggtcgggtttttgtttagtt

SEQ ID NO: 9685 - DNA, 29 bp, Artificial Sequences
  Synthetic
ggtcggtcgggtttttgtttagtttcggt

SEQ ID NO: 9686 - DNA, 29 bp, Artificial Sequences
  Synthetic
tggtcggtcgggtttttgtttagtttcgg

SEQ ID NO: 9687 - DNA, 28 bp, Artificial Sequences
  Synthetic
ggtcggtcgggtttttgtttagtttcgg

SEQ ID NO: 9688 - DNA, 30 bp, Artificial Sequences
  Synthetic
tggtcggtcgggtttttgtttagtttcggt

SEQ ID NO: 9689 - DNA, 28 bp, Artificial Sequences
  Synthetic
cgcgaggtggggagtagtttaaaatggt

SEQ ID NO: 9690 - DNA, 29 bp, Artificial Sequences
  Synthetic
cgcgaggtggggagtagtttaaaatggtt

SEQ ID NO: 9691 - DNA, 30 bp, Artificial Sequences
  Synthetic
cgcgaggtggggagtagtttaaaatggttt

SEQ ID NO: 9692 - DNA, 33 bp, Artificial Sequences
  Synthetic
tggttttgtgttgcgaagttgtagttttagtcg

SEQ ID NO: 9693 - DNA, 34 bp, Artificial Sequences
  Synthetic
atggttttgtgttgcgaagttgtagttttagtcg

SEQ ID NO: 9694 - DNA, 27 bp, Artificial Sequences
  Synthetic
gcgacgttaggaggataaggggagggg

SEQ ID NO: 9695 - DNA, 27 bp, Artificial Sequences
  Synthetic
ggcgacgttaggaggataaggggaggg

SEQ ID NO: 9696 - DNA, 27 bp, Artificial Sequences
  Synthetic
tcgcggggtttatgggaaagtcggttt

SEQ ID NO: 9697 - DNA, 28 bp, Artificial Sequences
  Synthetic
gcgacgttaggaggataaggggaggggt

SEQ ID NO: 9698 - DNA, 27 bp, Artificial Sequences
  Synthetic
cgacgttaggaggataaggggaggggt

SEQ ID NO: 9699 - DNA, 27 bp, Artificial Sequences
  Synthetic
tgggtttcgcgaggtggggagtagttt

SEQ ID NO: 9700 - DNA, 27 bp, Artificial Sequences
  Synthetic
atgggtttcgcgaggtggggagtagtt

SEQ ID NO: 9701 - DNA, 27 bp, Artificial Sequences
  Synthetic
tatgggtttcgcgaggtggggagtagt

SEQ ID NO: 9702 - DNA, 28 bp, Artificial Sequences
  Synthetic
atgggtttcgcgaggtggggagtagttt

SEQ ID NO: 9703 - DNA, 26 bp, Artificial Sequences
  Synthetic
tgggtttcgcgaggtggggagtagtt

SEQ ID NO: 9704 - DNA, 27 bp, Artificial Sequences
  Synthetic
atagcggggtttgtggaaagggagggg

SEQ ID NO: 9705 - DNA, 27 bp, Artificial Sequences
  Synthetic
gggtttgtggaaagggaggggtcgaga

SEQ ID NO: 9706 - DNA, 27 bp, Artificial Sequences
  Synthetic
ggggtttgtggaaagggaggggtcgag

SEQ ID NO: 9707 - DNA, 28 bp, Artificial Sequences
  Synthetic
gggtttgtggaaagggaggggtcgagag

SEQ ID NO: 9708 - DNA, 26 bp, Artificial Sequences
  Synthetic
ggggtttgtggaaagggaggggtcga

SEQ ID NO: 9709 - DNA, 27 bp, Artificial Sequences
  Synthetic
gcgcgggttaagagtgggaggtttagg

SEQ ID NO: 9710 - DNA, 28 bp, Artificial Sequences
  Synthetic
agcgcgggttaagagtgggaggtttagg

SEQ ID NO: 9711 - DNA, 28 bp, Artificial Sequences
  Synthetic
cgcgggttaagagtgggaggtttagggt

SEQ ID NO: 9712 - DNA, 27 bp, Artificial Sequences
  Synthetic
cgcgggttaagagtgggaggtttaggg

SEQ ID NO: 9713 - DNA, 27 bp, Artificial Sequences
  Synthetic
gtagcgcgggttaagagtgggaggttt

SEQ ID NO: 9714 - DNA, 27 bp, Artificial Sequences
  Synthetic
atagcggggtttgtggaaagggagggg

SEQ ID NO: 9715 - DNA, 27 bp, Artificial Sequences
  Synthetic
gggtttgtggaaagggaggggtcgaga

SEQ ID NO: 9716 - DNA, 27 bp, Artificial Sequences
  Synthetic
ggggtttgtggaaagggaggggtcgag

SEQ ID NO: 9717 - DNA, 28 bp, Artificial Sequences
  Synthetic
gggtttgtggaaagggaggggtcgagag

SEQ ID NO: 9718 - DNA, 26 bp, Artificial Sequences
  Synthetic
ggggtttgtggaaagggaggggtcga

SEQ ID NO: 9719 - DNA, 27 bp, Artificial Sequences
  Synthetic
tgcggggttagggttattgggtaggcg

SEQ ID NO: 9720 - DNA, 27 bp, Artificial Sequences
  Synthetic
gcggggttagggttattgggtaggcgt

SEQ ID NO: 9721 - DNA, 27 bp, Artificial Sequences
  Synthetic
cgcggtttgggacgtaaatgggaggga

SEQ ID NO: 9722 - DNA, 27 bp, Artificial Sequences
  Synthetic
gcggtttgggacgtaaatgggagggag

SEQ ID NO: 9723 - DNA, 27 bp, Artificial Sequences
  Synthetic
gcgcgggttaagagtgggaggtttagg

SEQ ID NO: 9724 - DNA, 27 bp, Artificial Sequences
  Synthetic
atagcggggtttgtggaaagggagggg

SEQ ID NO: 9725 - DNA, 27 bp, Artificial Sequences
  Synthetic
gggtttgtggaaagggaggggtcgaga

SEQ ID NO: 9726 - DNA, 27 bp, Artificial Sequences
  Synthetic
ggggtttgtggaaagggaggggtcgag

SEQ ID NO: 9727 - DNA, 28 bp, Artificial Sequences
  Synthetic
gggtttgtggaaagggaggggtcgagag

SEQ ID NO: 9728 - DNA, 26 bp, Artificial Sequences
  Synthetic
ggggtttgtggaaagggaggggtcga

SEQ ID NO: 9729 - DNA, 27 bp, Artificial Sequences
  Synthetic
tgcggggttagggttattgggtaggcg

SEQ ID NO: 9730 - DNA, 27 bp, Artificial Sequences
  Synthetic
gcggggttagggttattgggtaggcgt

SEQ ID NO: 9731 - DNA, 27 bp, Artificial Sequences
  Synthetic
cgcggtttgggacgtaaatgggaggga

SEQ ID NO: 9732 - DNA, 27 bp, Artificial Sequences
  Synthetic
gcggtttgggacgtaaatgggagggag

SEQ ID NO: 9733 - DNA, 27 bp, Artificial Sequences
  Synthetic
gcgcgggttaagagtgggaggtttagg

SEQ ID NO: 9734 - DNA, 31 bp, Artificial Sequences
  Synthetic
gcgttgcgtttatttagtggttttggtttcg

SEQ ID NO: 9735 - DNA, 32 bp, Artificial Sequences
  Synthetic
gcgttgcgtttatttagtggttttggtttcgt

SEQ ID NO: 9736 - DNA, 32 bp, Artificial Sequences
  Synthetic
gcgtttatttagtggttttggtttcgtagggc

SEQ ID NO: 9737 - DNA, 33 bp, Artificial Sequences
  Synthetic
tgcgtttatttagtggttttggtttcgtagggc

SEQ ID NO: 9738 - DNA, 32 bp, Artificial Sequences
  Synthetic
tgcgtttatttagtggttttggtttcgtaggg

SEQ ID NO: 9739 - DNA, 28 bp, Artificial Sequences
  Synthetic
tcgggaagttttgcgttggtattagggt

SEQ ID NO: 9740 - DNA, 29 bp, Artificial Sequences
  Synthetic
ttcgggaagttttgcgttggtattagggt

SEQ ID NO: 9741 - DNA, 32 bp, Artificial Sequences
  Synthetic
cgggaagttttgcgttggtattagggtaagcg

SEQ ID NO: 9742 - DNA, 29 bp, Artificial Sequences
  Synthetic
tcgggaagttttgcgttggtattagggta

SEQ ID NO: 9743 - DNA, 30 bp, Artificial Sequences
  Synthetic
tttcgggaagttttgcgttggtattagggt

SEQ ID NO: 9744 - DNA, 28 bp, Artificial Sequences
  Synthetic
ggtgaggaggtttttcggtgtaagggcg

SEQ ID NO: 9745 - DNA, 27 bp, Artificial Sequences
  Synthetic
tgaggaggtttttcggtgtaagggcgt

SEQ ID NO: 9746 - DNA, 28 bp, Artificial Sequences
  Synthetic
gtgaggaggtttttcggtgtaagggcgt

SEQ ID NO: 9747 - DNA, 27 bp, Artificial Sequences
  Synthetic
gtgaggaggtttttcggtgtaagggcg

SEQ ID NO: 9748 - DNA, 29 bp, Artificial Sequences
  Synthetic
tggtgaggaggtttttcggtgtaagggcg

SEQ ID NO: 9749 - DNA, 28 bp, Artificial Sequences
  Synthetic
ggtgaggaggtttttcggtgtaagggcg

SEQ ID NO: 9750 - DNA, 27 bp, Artificial Sequences
  Synthetic
tgaggaggtttttcggtgtaagggcgt

SEQ ID NO: 9751 - DNA, 28 bp, Artificial Sequences
  Synthetic
gtgaggaggtttttcggtgtaagggcgt

SEQ ID NO: 9752 - DNA, 27 bp, Artificial Sequences
  Synthetic
gtgaggaggtttttcggtgtaagggcg

SEQ ID NO: 9753 - DNA, 29 bp, Artificial Sequences
  Synthetic
tggtgaggaggtttttcggtgtaagggcg

SEQ ID NO: 9754 - DNA, 28 bp, Artificial Sequences
  Synthetic
gcggataggcgtttttgtatcggaaggt

SEQ ID NO: 9755 - DNA, 27 bp, Artificial Sequences
  Synthetic
gcggataggcgtttttgtatcggaagg

SEQ ID NO: 9756 - DNA, 29 bp, Artificial Sequences
  Synthetic
gcggataggcgtttttgtatcggaaggtt

SEQ ID NO: 9757 - DNA, 30 bp, Artificial Sequences
  Synthetic
gcggataggcgtttttgtatcggaaggttt

SEQ ID NO: 9758 - DNA, 31 bp, Artificial Sequences
  Synthetic
gcggataggcgtttttgtatcggaaggtttt

SEQ ID NO: 9759 - DNA, 27 bp, Artificial Sequences
  Synthetic
agttgttatgggttttgcgcgcggaga

SEQ ID NO: 9760 - DNA, 27 bp, Artificial Sequences
  Synthetic
aagttgttatgggttttgcgcgcggag

SEQ ID NO: 9761 - DNA, 27 bp, Artificial Sequences
  Synthetic
gttgttatgggttttgcgcgcggagat

SEQ ID NO: 9762 - DNA, 28 bp, Artificial Sequences
  Synthetic
aagttgttatgggttttgcgcgcggaga

SEQ ID NO: 9763 - DNA, 27 bp, Artificial Sequences
  Synthetic
aatcgaggggtggatgcgttacgtagc

SEQ ID NO: 9764 - DNA, 27 bp, Artificial Sequences
  Synthetic
ttttttcggttttgaggttttcgcgcg

SEQ ID NO: 9765 - DNA, 26 bp, Artificial Sequences
  Synthetic
tttttcggttttgaggttttcgcgcg

SEQ ID NO: 9766 - DNA, 25 bp, Artificial Sequences
  Synthetic
ttttcggttttgaggttttcgcgcg

SEQ ID NO: 9767 - DNA, 27 bp, Artificial Sequences
  Synthetic
agttgttatgggttttgcgcgcggaga

SEQ ID NO: 9768 - DNA, 27 bp, Artificial Sequences
  Synthetic
aagttgttatgggttttgcgcgcggag

SEQ ID NO: 9769 - DNA, 27 bp, Artificial Sequences
  Synthetic
gttgttatgggttttgcgcgcggagat

SEQ ID NO: 9770 - DNA, 28 bp, Artificial Sequences
  Synthetic
aagttgttatgggttttgcgcgcggaga

SEQ ID NO: 9771 - DNA, 27 bp, Artificial Sequences
  Synthetic
aatcgaggggtggatgcgttacgtagc

SEQ ID NO: 9772 - DNA, 27 bp, Artificial Sequences
  Synthetic
acgcgtggttgtgagttgggtttacgt

SEQ ID NO: 9773 - DNA, 28 bp, Artificial Sequences
  Synthetic
acgcgtggttgtgagttgggtttacgtt

SEQ ID NO: 9774 - DNA, 27 bp, Artificial Sequences
  Synthetic
cgcgtggttgtgagttgggtttacgtt

SEQ ID NO: 9775 - DNA, 28 bp, Artificial Sequences
  Synthetic
tggttttacgcgtggttgtgagttgggt

SEQ ID NO: 9776 - DNA, 27 bp, Artificial Sequences
  Synthetic
ggttttacgcgtggttgtgagttgggt

SEQ ID NO: 9777 - DNA, 27 bp, Artificial Sequences
  Synthetic
aatcgaggggtggatgcgttacgtagc

SEQ ID NO: 9778 - DNA, 26 bp, Artificial Sequences
  Synthetic
atcgaggggtggatgcgttacgtagc

SEQ ID NO: 9779 - DNA, 28 bp, Artificial Sequences
  Synthetic
taatcgaggggtggatgcgttacgtagc

SEQ ID NO: 9780 - DNA, 27 bp, Artificial Sequences
  Synthetic
gttaatcgaggggtggatgcgttacgt

SEQ ID NO: 9781 - DNA, 25 bp, Artificial Sequences
  Synthetic
tcgaggggtggatgcgttacgtagc

SEQ ID NO: 9782 - DNA, 34 bp, Artificial Sequences
  Synthetic
tgatagttttcgggaggattgtttggtttttgtt

SEQ ID NO: 9783 - DNA, 34 bp, Artificial Sequences
  Synthetic
ttgatagttttcgggaggattgtttggtttttgt

SEQ ID NO: 9784 - DNA, 35 bp, Artificial Sequences
  Synthetic
tgatagttttcgggaggattgtttggtttttgttt

SEQ ID NO: 9785 - DNA, 35 bp, Artificial Sequences
  Synthetic
ttgatagttttcgggaggattgtttggtttttgtt

SEQ ID NO: 9786 - DNA, 35 bp, Artificial Sequences
  Synthetic
attgatagttttcgggaggattgtttggtttttgt

SEQ ID NO: 9787 - DNA, 34 bp, Artificial Sequences
  Synthetic
agtttttagtagaatttaggtcggagtttcgcgt

SEQ ID NO: 9788 - DNA, 34 bp, Artificial Sequences
  Synthetic
cgtagtgggagtgggttcggattattttttaatg

SEQ ID NO: 9789 - DNA, 35 bp, Artificial Sequences
  Synthetic
cgtagtgggagtgggttcggattattttttaatga

SEQ ID NO: 9790 - DNA, 35 bp, Artificial Sequences
  Synthetic
aagtttttagtagaatttaggtcggagtttcgcgt

SEQ ID NO: 9791 - DNA, 35 bp, Artificial Sequences
  Synthetic
gaagtttttagtagaatttaggtcggagtttcgcg

SEQ ID NO: 9792 - DNA, 29 bp, Artificial Sequences
  Synthetic
tcgcggtagtttgggtaatttaagggtgt

SEQ ID NO: 9793 - DNA, 29 bp, Artificial Sequences
  Synthetic
agggtgttgtttttagggattaggtgggt

SEQ ID NO: 9794 - DNA, 30 bp, Artificial Sequences
  Synthetic
gggtgttgtttttagggattaggtgggtgt

SEQ ID NO: 9795 - DNA, 30 bp, Artificial Sequences
  Synthetic
agggtgttgtttttagggattaggtgggtg

SEQ ID NO: 9796 - DNA, 31 bp, Artificial Sequences
  Synthetic
agggtgttgtttttagggattaggtgggtgt

SEQ ID NO: 9797 - DNA, 27 bp, Artificial Sequences
  Synthetic
atttcggataagggggtggcggaatgt

SEQ ID NO: 9798 - DNA, 27 bp, Artificial Sequences
  Synthetic
tttcggataagggggtggcggaatgta

SEQ ID NO: 9799 - DNA, 27 bp, Artificial Sequences
  Synthetic
tcggataagggggtggcggaatgtatt

SEQ ID NO: 9800 - DNA, 27 bp, Artificial Sequences
  Synthetic
ttcggataagggggtggcggaatgtat

SEQ ID NO: 9801 - DNA, 26 bp, Artificial Sequences
  Synthetic
tttcggataagggggtggcggaatgt

SEQ ID NO: 9802 - DNA, 27 bp, Artificial Sequences
  Synthetic
tttaggggtgcgcgtcggtggtttaga

SEQ ID NO: 9803 - DNA, 27 bp, Artificial Sequences
  Synthetic
gtttttaggggtgcgcgtcggtggttt

SEQ ID NO: 9804 - DNA, 27 bp, Artificial Sequences
  Synthetic
gaagtttttaggggtgcgcgtcggtgg

SEQ ID NO: 9805 - DNA, 27 bp, Artificial Sequences
  Synthetic
agaagtttttaggggtgcgcgtcggtg

SEQ ID NO: 9806 - DNA, 27 bp, Artificial Sequences
  Synthetic
ttaggggtgcgcgtcggtggtttagac

SEQ ID NO: 9807 - DNA, 27 bp, Artificial Sequences
  Synthetic
ggcgcgcggttgttttagttttagggc

SEQ ID NO: 9808 - DNA, 27 bp, Artificial Sequences
  Synthetic
cggcgcgcggttgttttagttttaggg

SEQ ID NO: 9809 - DNA, 27 bp, Artificial Sequences
  Synthetic
atttcggataagggggtggcggaatgt

SEQ ID NO: 9810 - DNA, 28 bp, Artificial Sequences
  Synthetic
cggcgcgcggttgttttagttttagggc

SEQ ID NO: 9811 - DNA, 27 bp, Artificial Sequences
  Synthetic
tttcggataagggggtggcggaatgta

SEQ ID NO: 9812 - DNA, 27 bp, Artificial Sequences
  Synthetic
tttaggggtgcgcgtcggtggtttaga

SEQ ID NO: 9813 - DNA, 27 bp, Artificial Sequences
  Synthetic
gtttttaggggtgcgcgtcggtggttt

SEQ ID NO: 9814 - DNA, 27 bp, Artificial Sequences
  Synthetic
gaagtttttaggggtgcgcgtcggtgg

SEQ ID NO: 9815 - DNA, 27 bp, Artificial Sequences
  Synthetic
gagtttttggggcgaggaaaaggcggg

SEQ ID NO: 9816 - DNA, 27 bp, Artificial Sequences
  Synthetic
ggagtttttggggcgaggaaaaggcgg

SEQ ID NO: 9817 - DNA, 27 bp, Artificial Sequences
  Synthetic
agggaagagagcggtgcgaggagtttc

SEQ ID NO: 9818 - DNA, 27 bp, Artificial Sequences
  Synthetic
gagggaagagagcggtgcgaggagttt

SEQ ID NO: 9819 - DNA, 27 bp, Artificial Sequences
  Synthetic
tagaggagagggaagagagcggtgcga

SEQ ID NO: 9820 - DNA, 27 bp, Artificial Sequences
  Synthetic
gtagaggagagggaagagagcggtgcg

SEQ ID NO: 9821 - DNA, 27 bp, Artificial Sequences
  Synthetic
agagggaagagagcggtgcgaggagtt

SEQ ID NO: 9822 - DNA, 27 bp, Artificial Sequences
  Synthetic
gagtttttggggcgaggaaaaggcggg

SEQ ID NO: 9823 - DNA, 27 bp, Artificial Sequences
  Synthetic
ggagtttttggggcgaggaaaaggcgg

SEQ ID NO: 9824 - DNA, 27 bp, Artificial Sequences
  Synthetic
gggagtttttggggcgaggaaaaggcg

SEQ ID NO: 9825 - DNA, 27 bp, Artificial Sequences
  Synthetic
tgggagtttttggggcgaggaaaaggc

SEQ ID NO: 9826 - DNA, 26 bp, Artificial Sequences
  Synthetic
agtttttggggcgaggaaaaggcggg

SEQ ID NO: 9827 - DNA, 27 bp, Artificial Sequences
  Synthetic
agggaagagagcggtgcgaggagtttc

SEQ ID NO: 9828 - DNA, 27 bp, Artificial Sequences
  Synthetic
gagggaagagagcggtgcgaggagttt

SEQ ID NO: 9829 - DNA, 27 bp, Artificial Sequences
  Synthetic
tagaggagagggaagagagcggtgcga

SEQ ID NO: 9830 - DNA, 27 bp, Artificial Sequences
  Synthetic
gtagaggagagggaagagagcggtgcg

SEQ ID NO: 9831 - DNA, 27 bp, Artificial Sequences
  Synthetic
agagggaagagagcggtgcgaggagtt

SEQ ID NO: 9832 - DNA, 27 bp, Artificial Sequences
  Synthetic
tggggagggttgtggcggattttttgg

SEQ ID NO: 9833 - DNA, 27 bp, Artificial Sequences
  Synthetic
ggggagggttgtggcggattttttgga

SEQ ID NO: 9834 - DNA, 28 bp, Artificial Sequences
  Synthetic
ggggagggttgtggcggattttttggag

SEQ ID NO: 9835 - DNA, 28 bp, Artificial Sequences
  Synthetic
ttggggagggttgtggcggattttttgg

SEQ ID NO: 9836 - DNA, 28 bp, Artificial Sequences
  Synthetic
tggggagggttgtggcggattttttgga

SEQ ID NO: 9837 - DNA, 27 bp, Artificial Sequences
  Synthetic
tggttggcgcgatgggtttttggtacg

SEQ ID NO: 9838 - DNA, 27 bp, Artificial Sequences
  Synthetic
cgttttgattggttggcgcgatgggtt

SEQ ID NO: 9839 - DNA, 28 bp, Artificial Sequences
  Synthetic
tgattggttggcgcgatgggtttttggt

SEQ ID NO: 9840 - DNA, 27 bp, Artificial Sequences
  Synthetic
gattggttggcgcgatgggtttttggt

SEQ ID NO: 9841 - DNA, 27 bp, Artificial Sequences
  Synthetic
tgattggttggcgcgatgggtttttgg

SEQ ID NO: 9842 - DNA, 27 bp, Artificial Sequences
  Synthetic
cgttggggagggttgtggcggattttt

SEQ ID NO: 9843 - DNA, 27 bp, Artificial Sequences
  Synthetic
tggggagggttgtggcggattttttgg

SEQ ID NO: 9844 - DNA, 27 bp, Artificial Sequences
  Synthetic
ggggagggttgtggcggattttttgga

SEQ ID NO: 9845 - DNA, 28 bp, Artificial Sequences
  Synthetic
cgttggggagggttgtggcggatttttt

SEQ ID NO: 9846 - DNA, 28 bp, Artificial Sequences
  Synthetic
ggggagggttgtggcggattttttggag

SEQ ID NO: 9847 - DNA, 27 bp, Artificial Sequences
  Synthetic
cgtaaggggttcgggggcgtgtgaatt

SEQ ID NO: 9848 - DNA, 28 bp, Artificial Sequences
  Synthetic
cgtaaggggttcgggggcgtgtgaatta

SEQ ID NO: 9849 - DNA, 27 bp, Artificial Sequences
  Synthetic
gtaaggggttcgggggcgtgtgaatta

SEQ ID NO: 9850 - DNA, 26 bp, Artificial Sequences
  Synthetic
cgtaaggggttcgggggcgtgtgaat

SEQ ID NO: 9851 - DNA, 26 bp, Artificial Sequences
  Synthetic
gtaaggggttcgggggcgtgtgaatt

SEQ ID NO: 9852 - DNA, 27 bp, Artificial Sequences
  Synthetic
agtgatttgagaagaggcgcgggtggt

SEQ ID NO: 9853 - DNA, 27 bp, Artificial Sequences
  Synthetic
tcggcgttgggggagggggatattttt

SEQ ID NO: 9854 - DNA, 27 bp, Artificial Sequences
  Synthetic
gtcggcgttgggggagggggatatttt

SEQ ID NO: 9855 - DNA, 27 bp, Artificial Sequences
  Synthetic
gtgatttgagaagaggcgcgggtggtc

SEQ ID NO: 9856 - DNA, 27 bp, Artificial Sequences
  Synthetic
cggcgttgggggagggggatatttttg

SEQ ID NO: 9857 - DNA, 27 bp, Artificial Sequences
  Synthetic
agtaaaggaggcgcggttaggtgggtt

SEQ ID NO: 9858 - DNA, 27 bp, Artificial Sequences
  Synthetic
aagtaaaggaggcgcggttaggtgggt

SEQ ID NO: 9859 - DNA, 27 bp, Artificial Sequences
  Synthetic
aaaggaggcgcggttaggtgggttttt

SEQ ID NO: 9860 - DNA, 27 bp, Artificial Sequences
  Synthetic
gtaaaggaggcgcggttaggtgggttt

SEQ ID NO: 9861 - DNA, 28 bp, Artificial Sequences
  Synthetic
agtaaaggaggcgcggttaggtgggttt

SEQ ID NO: 9862 - DNA, 27 bp, Artificial Sequences
  Synthetic
aggtttggtggagaggcgttcgggtag

SEQ ID NO: 9863 - DNA, 27 bp, Artificial Sequences
  Synthetic
aaggtttggtggagaggcgttcgggta

SEQ ID NO: 9864 - DNA, 27 bp, Artificial Sequences
  Synthetic
taaggtttggtggagaggcgttcgggt

SEQ ID NO: 9865 - DNA, 27 bp, Artificial Sequences
  Synthetic
ggtttttgcgttttgggcgtcggtgtt

SEQ ID NO: 9866 - DNA, 27 bp, Artificial Sequences
  Synthetic
ttggtttttgcgttttgggcgtcggtg

SEQ ID NO: 9867 - DNA, 27 bp, Artificial Sequences
  Synthetic
agtaaaggaggcgcggttaggtgggtt

SEQ ID NO: 9868 - DNA, 27 bp, Artificial Sequences
  Synthetic
aagtaaaggaggcgcggttaggtgggt

SEQ ID NO: 9869 - DNA, 27 bp, Artificial Sequences
  Synthetic
aaaggaggcgcggttaggtgggttttt

SEQ ID NO: 9870 - DNA, 27 bp, Artificial Sequences
  Synthetic
gtaaaggaggcgcggttaggtgggttt

SEQ ID NO: 9871 - DNA, 28 bp, Artificial Sequences
  Synthetic
agtaaaggaggcgcggttaggtgggttt

SEQ ID NO: 9872 - DNA, 27 bp, Artificial Sequences
  Synthetic
ggtttggtggagaggcgttcgggtagt

SEQ ID NO: 9873 - DNA, 27 bp, Artificial Sequences
  Synthetic
aggtttggtggagaggcgttcgggtag

SEQ ID NO: 9874 - DNA, 27 bp, Artificial Sequences
  Synthetic
aaggtttggtggagaggcgttcgggta

SEQ ID NO: 9875 - DNA, 27 bp, Artificial Sequences
  Synthetic
taaggtttggtggagaggcgttcgggt

SEQ ID NO: 9876 - DNA, 27 bp, Artificial Sequences
  Synthetic
ggtttttgcgttttgggcgtcggtgtt

SEQ ID NO: 9877 - DNA, 27 bp, Artificial Sequences
  Synthetic
agtaaaggaggcgcggttaggtgggtt

SEQ ID NO: 9878 - DNA, 27 bp, Artificial Sequences
  Synthetic
aagtaaaggaggcgcggttaggtgggt

SEQ ID NO: 9879 - DNA, 27 bp, Artificial Sequences
  Synthetic
aagttgggggaagggcgggagagtatc

SEQ ID NO: 9880 - DNA, 27 bp, Artificial Sequences
  Synthetic
gaagttgggggaagggcgggagagtat

SEQ ID NO: 9881 - DNA, 27 bp, Artificial Sequences
  Synthetic
ttttggagggaagttgggggaagggcg

SEQ ID NO: 9882 - DNA, 27 bp, Artificial Sequences
  Synthetic
ggtttttgcgttttgggcgtcggtgtt

SEQ ID NO: 9883 - DNA, 27 bp, Artificial Sequences
  Synthetic
ttggtttttgcgttttgggcgtcggtg

SEQ ID NO: 9884 - DNA, 27 bp, Artificial Sequences
  Synthetic
tggtttttgcgttttgggcgtcggtgt

SEQ ID NO: 9885 - DNA, 27 bp, Artificial Sequences
  Synthetic
tttggtttttgcgttttgggcgtcggt

SEQ ID NO: 9886 - DNA, 28 bp, Artificial Sequences
  Synthetic
ggtttttgcgttttgggcgtcggtgttt

SEQ ID NO: 9887 - DNA, 27 bp, Artificial Sequences
  Synthetic
gcgtttagggcgtaggggttagagcga

SEQ ID NO: 9888 - DNA, 27 bp, Artificial Sequences
  Synthetic
gggggttgtatttgtggttgcggggtc

SEQ ID NO: 9889 - DNA, 27 bp, Artificial Sequences
  Synthetic
agggcgtaggggttagagcgagtttgg

SEQ ID NO: 9890 - DNA, 27 bp, Artificial Sequences
  Synthetic
cggtcggttgtagggcggttggttttt

SEQ ID NO: 9891 - DNA, 27 bp, Artificial Sequences
  Synthetic
aagttgggggaagggcgggagagtatc

SEQ ID NO: 9892 - DNA, 27 bp, Artificial Sequences
  Synthetic
gcggggatgggagtgcgtttagtttcg

SEQ ID NO: 9893 - DNA, 27 bp, Artificial Sequences
  Synthetic
ggcggggatgggagtgcgtttagtttc

SEQ ID NO: 9894 - DNA, 27 bp, Artificial Sequences
  Synthetic
gggagtgcgtttagtttcgaggcggga

SEQ ID NO: 9895 - DNA, 27 bp, Artificial Sequences
  Synthetic
ggagaatatgcggcggggatgggagtg

SEQ ID NO: 9896 - DNA, 27 bp, Artificial Sequences
  Synthetic
gtggagaatatgcggcggggatgggag

SEQ ID NO: 9897 - DNA, 27 bp, Artificial Sequences
  Synthetic
gggggttgtatttgtggttgcggggtc

SEQ ID NO: 9898 - DNA, 27 bp, Artificial Sequences
  Synthetic
cggtcggttgtagggcggttggttttt

SEQ ID NO: 9899 - DNA, 27 bp, Artificial Sequences
  Synthetic
cgacgcgggggttgtatttgtggttgc

SEQ ID NO: 9900 - DNA, 27 bp, Artificial Sequences
  Synthetic
gcgacgcgggggttgtatttgtggttg

SEQ ID NO: 9901 - DNA, 27 bp, Artificial Sequences
  Synthetic
acggtcggttgtagggcggttggtttt

SEQ ID NO: 9902 - DNA, 27 bp, Artificial Sequences
  Synthetic
gagaatatgcggcggggatgggagtgt

SEQ ID NO: 9903 - DNA, 27 bp, Artificial Sequences
  Synthetic
cgcgttcgtaggatgttcgtcggttgg

SEQ ID NO: 9904 - DNA, 27 bp, Artificial Sequences
  Synthetic
gcgttcgtaggatgttcgtcggttggg

SEQ ID NO: 9905 - DNA, 27 bp, Artificial Sequences
  Synthetic
ggagaatatgcggcggggatgggagtg

SEQ ID NO: 9906 - DNA, 27 bp, Artificial Sequences
  Synthetic
gtggagaatatgcggcggggatgggag

SEQ ID NO: 9907 - DNA, 27 bp, Artificial Sequences
  Synthetic
cgttcggtcgcgggggttgttgttaat

SEQ ID NO: 9908 - DNA, 27 bp, Artificial Sequences
  Synthetic
tcgttcggtcgcgggggttgttgttaa

SEQ ID NO: 9909 - DNA, 27 bp, Artificial Sequences
  Synthetic
ttcgttcggtcgcgggggttgttgtta

SEQ ID NO: 9910 - DNA, 28 bp, Artificial Sequences
  Synthetic
cgttcggtcgcgggggttgttgttaatt

SEQ ID NO: 9911 - DNA, 26 bp, Artificial Sequences
  Synthetic
cgttcggtcgcgggggttgttgttaa

SEQ ID NO: 9912 - DNA, 27 bp, Artificial Sequences
  Synthetic
cgcgttcgtaggatgttcgtcggttgg

SEQ ID NO: 9913 - DNA, 27 bp, Artificial Sequences
  Synthetic
gggttcggggtttttcggtagcggttt

SEQ ID NO: 9914 - DNA, 27 bp, Artificial Sequences
  Synthetic
gcgttcgtaggatgttcgtcggttggg

SEQ ID NO: 9915 - DNA, 27 bp, Artificial Sequences
  Synthetic
cgggttcggggtttttcggtagcggtt

SEQ ID NO: 9916 - DNA, 28 bp, Artificial Sequences
  Synthetic
cgtaggatgttcgtcggttgggatcggt

SEQ ID NO: 9917 - DNA, 31 bp, Artificial Sequences
  Synthetic
tgttagttaggtcggaggtttgagatgttcg

SEQ ID NO: 9918 - DNA, 31 bp, Artificial Sequences
  Synthetic
cgatgttagttaggtcggaggtttgagatgt

SEQ ID NO: 9919 - DNA, 31 bp, Artificial Sequences
  Synthetic
gttagttaggtcggaggtttgagatgttcga

SEQ ID NO: 9920 - DNA, 32 bp, Artificial Sequences
  Synthetic
tgttagttaggtcggaggtttgagatgttcga

SEQ ID NO: 9921 - DNA, 32 bp, Artificial Sequences
  Synthetic
atgttagttaggtcggaggtttgagatgttcg

SEQ ID NO: 9922 - DNA, 27 bp, Artificial Sequences
  Synthetic
aagagggttaggagaggtggtcggggt

SEQ ID NO: 9923 - DNA, 27 bp, Artificial Sequences
  Synthetic
agagggttaggagaggtggtcggggta

SEQ ID NO: 9924 - DNA, 27 bp, Artificial Sequences
  Synthetic
gaagagggttaggagaggtggtcgggg

SEQ ID NO: 9925 - DNA, 28 bp, Artificial Sequences
  Synthetic
agaagagggttaggagaggtggtcgggg

SEQ ID NO: 9926 - DNA, 28 bp, Artificial Sequences
  Synthetic
gaagagggttaggagaggtggtcggggt

SEQ ID NO: 9927 - DNA, 30 bp, Artificial Sequences
  Synthetic
tggtaagtgttgggtatgtggagatgagga

SEQ ID NO: 9928 - DNA, 30 bp, Artificial Sequences
  Synthetic
ttggtaagtgttgggtatgtggagatgagg

SEQ ID NO: 9929 - DNA, 31 bp, Artificial Sequences
  Synthetic
tggtaagtgttgggtatgtggagatgaggaa

SEQ ID NO: 9930 - DNA, 31 bp, Artificial Sequences
  Synthetic
ttggtaagtgttgggtatgtggagatgagga

SEQ ID NO: 9931 - DNA, 31 bp, Artificial Sequences
  Synthetic
tttggtaagtgttgggtatgtggagatgagg

SEQ ID NO: 9932 - DNA, 27 bp, Artificial Sequences
  Synthetic
tggggtggagaggtggtgaagtaggaa

SEQ ID NO: 9933 - DNA, 27 bp, Artificial Sequences
  Synthetic
ttggggtggagaggtggtgaagtagga

SEQ ID NO: 9934 - DNA, 27 bp, Artificial Sequences
  Synthetic
tttggggtggagaggtggtgaagtagg

SEQ ID NO: 9935 - DNA, 28 bp, Artificial Sequences
  Synthetic
tggggtggagaggtggtgaagtaggaaa

SEQ ID NO: 9936 - DNA, 28 bp, Artificial Sequences
  Synthetic
ttggggtggagaggtggtgaagtaggaa

SEQ ID NO: 9937 - DNA, 27 bp, Artificial Sequences
  Synthetic
tggagacggcggcggagttagagtttt

SEQ ID NO: 9938 - DNA, 27 bp, Artificial Sequences
  Synthetic
tttcggcgggattagagtgggatcggg

SEQ ID NO: 9939 - DNA, 27 bp, Artificial Sequences
  Synthetic
gtggagacggcggcggagttagagttt

SEQ ID NO: 9940 - DNA, 26 bp, Artificial Sequences
  Synthetic
ggcgggattagagtgggatcggggtc

SEQ ID NO: 9941 - DNA, 28 bp, Artificial Sequences
  Synthetic
tggagacggcggcggagttagagttttt

SEQ ID NO: 9942 - DNA, 27 bp, Artificial Sequences
  Synthetic
tggcgtcgaggaggatttttggttcgt

SEQ ID NO: 9943 - DNA, 28 bp, Artificial Sequences
  Synthetic
cggagttggcgtcgaggaggatttttgg

SEQ ID NO: 9944 - DNA, 27 bp, Artificial Sequences
  Synthetic
cggagttggcgtcgaggaggatttttg

SEQ ID NO: 9945 - DNA, 28 bp, Artificial Sequences
  Synthetic
ggagttggcgtcgaggaggatttttggt

SEQ ID NO: 9946 - DNA, 27 bp, Artificial Sequences
  Synthetic
ggagttggcgtcgaggaggatttttgg

SEQ ID NO: 9947 - DNA, 27 bp, Artificial Sequences
  Synthetic
tgtagtcgtgaggttggcgttgggagg

SEQ ID NO: 9948 - DNA, 27 bp, Artificial Sequences
  Synthetic
ttcgggttttggtcgggcgggtttttt

SEQ ID NO: 9949 - DNA, 27 bp, Artificial Sequences
  Synthetic
gtagtcgtgaggttggcgttgggagga

SEQ ID NO: 9950 - DNA, 27 bp, Artificial Sequences
  Synthetic
tggagacggcggcggagttagagtttt

SEQ ID NO: 9951 - DNA, 27 bp, Artificial Sequences
  Synthetic
ttcgtagtgttcgggaggtcgttgggg

SEQ ID NO: 9952 - DNA, 27 bp, Artificial Sequences
  Synthetic
ttttgtagaagcgcggcgggagtttgg

SEQ ID NO: 9953 - DNA, 27 bp, Artificial Sequences
  Synthetic
tttcgttttgtagaagcgcggcgggag

SEQ ID NO: 9954 - DNA, 27 bp, Artificial Sequences
  Synthetic
gtttcgttttgtagaagcgcggcggga

SEQ ID NO: 9955 - DNA, 27 bp, Artificial Sequences
  Synthetic
tgggttcgggcgtagttttttgtggcg

SEQ ID NO: 9956 - DNA, 27 bp, Artificial Sequences
  Synthetic
cgttttgtagaagcgcggcgggagttt

SEQ ID NO: 9957 - DNA, 27 bp, Artificial Sequences
  Synthetic
gaggaggtaggagcgaggagggaggag

SEQ ID NO: 9958 - DNA, 27 bp, Artificial Sequences
  Synthetic
tgtcgggtttggcgaaggagaagggag

SEQ ID NO: 9959 - DNA, 27 bp, Artificial Sequences
  Synthetic
aggagggttaagggcgggtaggaaggt

SEQ ID NO: 9960 - DNA, 27 bp, Artificial Sequences
  Synthetic
aggagcgaggagggaggagggttaagg

SEQ ID NO: 9961 - DNA, 27 bp, Artificial Sequences
  Synthetic
ttgtcgggtttggcgaaggagaaggga

SEQ ID NO: 9962 - DNA, 29 bp, Artificial Sequences
  Synthetic
gggaacgtattttttagttttcggcgcgg

SEQ ID NO: 9963 - DNA, 30 bp, Artificial Sequences
  Synthetic
agggaacgtattttttagttttcggcgcgg

SEQ ID NO: 9964 - DNA, 30 bp, Artificial Sequences
  Synthetic
gggaacgtattttttagttttcggcgcgga

SEQ ID NO: 9965 - DNA, 28 bp, Artificial Sequences
  Synthetic
ggaacgtattttttagttttcggcgcgg

SEQ ID NO: 9966 - DNA, 28 bp, Artificial Sequences
  Synthetic
gggaacgtattttttagttttcggcgcg

SEQ ID NO: 9967 - DNA, 27 bp, Artificial Sequences
  Synthetic
gggtaggaaggtttaggttcggcgcgt

SEQ ID NO: 9968 - DNA, 27 bp, Artificial Sequences
  Synthetic
cgggtaggaaggtttaggttcggcgcg

SEQ ID NO: 9969 - DNA, 27 bp, Artificial Sequences
  Synthetic
agggttggaggatgcgttttttggggt

SEQ ID NO: 9970 - DNA, 28 bp, Artificial Sequences
  Synthetic
cgagggttggaggatgcgttttttgggg

SEQ ID NO: 9971 - DNA, 27 bp, Artificial Sequences
  Synthetic
ggtaggaaggtttaggttcggcgcgtt

SEQ ID NO: 9972 - DNA, 27 bp, Artificial Sequences
  Synthetic
tcgggtcgggtagtttttggtttcggt

SEQ ID NO: 9973 - DNA, 27 bp, Artificial Sequences
  Synthetic
cgggtcgggtagtttttggtttcggtt

SEQ ID NO: 9974 - DNA, 28 bp, Artificial Sequences
  Synthetic
tcgggtcgggtagtttttggtttcggtt

SEQ ID NO: 9975 - DNA, 26 bp, Artificial Sequences
  Synthetic
cgggtcgggtagtttttggtttcggt

SEQ ID NO: 9976 - DNA, 26 bp, Artificial Sequences
  Synthetic
tcgggtcgggtagtttttggtttcgg

SEQ ID NO: 9977 - DNA, 27 bp, Artificial Sequences
  Synthetic
gagttattggggaaagagggtcgtggt

SEQ ID NO: 9978 - DNA, 29 bp, Artificial Sequences
  Synthetic
cgagagttattggggaaagagggtcgtgg

SEQ ID NO: 9979 - DNA, 30 bp, Artificial Sequences
  Synthetic
cgagagttattggggaaagagggtcgtggt

SEQ ID NO: 9980 - DNA, 28 bp, Artificial Sequences
  Synthetic
agagttattggggaaagagggtcgtggt

SEQ ID NO: 9981 - DNA, 27 bp, Artificial Sequences
  Synthetic
cgagagttattggggaaagagggtcgt

SEQ ID NO: 9982 - DNA, 27 bp, Artificial Sequences
  Synthetic
tgtgtgtcggtgggaacgtgttaggtt

SEQ ID NO: 9983 - DNA, 27 bp, Artificial Sequences
  Synthetic
ttgtgtgtcggtgggaacgtgttaggt

SEQ ID NO: 9984 - DNA, 28 bp, Artificial Sequences
  Synthetic
gggtatgtttgtgtgtcggtgggaacgt

SEQ ID NO: 9985 - DNA, 28 bp, Artificial Sequences
  Synthetic
tgggtatgtttgtgtgtcggtgggaacg

SEQ ID NO: 9986 - DNA, 29 bp, Artificial Sequences
  Synthetic
tgggtatgtttgtgtgtcggtgggaacgt

SEQ ID NO: 9987 - DNA, 27 bp, Artificial Sequences
  Synthetic
gcgggaagagcggcgtttatttattgt

SEQ ID NO: 9988 - DNA, 28 bp, Artificial Sequences
  Synthetic
gcgggaagagcggcgtttatttattgtt

SEQ ID NO: 9989 - DNA, 29 bp, Artificial Sequences
  Synthetic
gcggcgtttatttattgttttggagcggt

SEQ ID NO: 9990 - DNA, 28 bp, Artificial Sequences
  Synthetic
gcggcgtttatttattgttttggagcgg

SEQ ID NO: 9991 - DNA, 29 bp, Artificial Sequences
  Synthetic
agcggcgtttatttattgttttggagcgg

SEQ ID NO: 9992 - DNA, 32 bp, Artificial Sequences
  Synthetic
aggaaaggcggttaggtgagattttttaacga

SEQ ID NO: 9993 - DNA, 32 bp, Artificial Sequences
  Synthetic
aaggaaaggcggttaggtgagattttttaacg

SEQ ID NO: 9994 - DNA, 33 bp, Artificial Sequences
  Synthetic
aaggaaaggcggttaggtgagattttttaacga

SEQ ID NO: 9995 - DNA, 33 bp, Artificial Sequences
  Synthetic
aggaaaggcggttaggtgagattttttaacgat

SEQ ID NO: 9996 - DNA, 33 bp, Artificial Sequences
  Synthetic
aaaggaaaggcggttaggtgagattttttaacg

SEQ ID NO: 9997 - DNA, 27 bp, Artificial Sequences
  Synthetic
gggacgtgttagagggtagggtggttt

SEQ ID NO: 9998 - DNA, 28 bp, Artificial Sequences
  Synthetic
gggacgtgttagagggtagggtggtttt

SEQ ID NO: 9999 - DNA, 26 bp, Artificial Sequences
  Synthetic
gggacgtgttagagggtagggtggtt

SEQ ID NO: 10000 - DNA, 27 bp, Artificial Sequences
  Synthetic
ggacgtgttagagggtagggtggtttt

SEQ ID NO: 10001 - DNA, 29 bp, Artificial Sequences
  Synthetic
gggacgtgttagagggtagggtggttttt

SEQ ID NO: 10002 - DNA, 27 bp, Artificial Sequences
  Synthetic
tttgtagggggcgttgcggtatgaggt

SEQ ID NO: 10003 - DNA, 27 bp, Artificial Sequences
  Synthetic
ggtaattagcgggtggttttgggcggg

SEQ ID NO: 10004 - DNA, 27 bp, Artificial Sequences
  Synthetic
aattagcgggtggttttgggcgggttc

SEQ ID NO: 10005 - DNA, 27 bp, Artificial Sequences
  Synthetic
tgggttaggtcggggtttcggtgttgg

SEQ ID NO: 10006 - DNA, 27 bp, Artificial Sequences
  Synthetic
cgtttgtagggggcgttgcggtatgag

SEQ ID NO: 10007 - DNA, 27 bp, Artificial Sequences
  Synthetic
gagggcgtttcgtttgggtttgggagg

SEQ ID NO: 10008 - DNA, 27 bp, Artificial Sequences
  Synthetic
gggcgtttcgtttgggtttgggaggtt

SEQ ID NO: 10009 - DNA, 27 bp, Artificial Sequences
  Synthetic
aggtttggagtcggggcggtcgtattt

SEQ ID NO: 10010 - DNA, 27 bp, Artificial Sequences
  Synthetic
aaggtttggagtcggggcggtcgtatt

SEQ ID NO: 10011 - DNA, 27 bp, Artificial Sequences
  Synthetic
gaaggtttggagtcggggcggtcgtat

SEQ ID NO: 10012 - DNA, 28 bp, Artificial Sequences
  Synthetic
acggttgcggtgtatcgtagttttttcg

SEQ ID NO: 10013 - DNA, 29 bp, Artificial Sequences
  Synthetic
gacggttgcggtgtatcgtagttttttcg

SEQ ID NO: 10014 - DNA, 29 bp, Artificial Sequences
  Synthetic
gggttggagcgtgatgtatagtattcggg

SEQ ID NO: 10015 - DNA, 30 bp, Artificial Sequences
  Synthetic
agacggttgcggtgtatcgtagttttttcg

SEQ ID NO: 10016 - DNA, 30 bp, Artificial Sequences
  Synthetic
agggttggagcgtgatgtatagtattcggg

SEQ ID NO: 10017 - DNA, 27 bp, Artificial Sequences
  Synthetic
gaagcggttggaggcgtttcgggaatt

SEQ ID NO: 10018 - DNA, 27 bp, Artificial Sequences
  Synthetic
agcggttggaggcgtttcgggaatttt

SEQ ID NO: 10019 - DNA, 27 bp, Artificial Sequences
  Synthetic
aagcggttggaggcgtttcgggaattt

SEQ ID NO: 10020 - DNA, 27 bp, Artificial Sequences
  Synthetic
gggatgtaatggaagcggttggaggcg

SEQ ID NO: 10021 - DNA, 27 bp, Artificial Sequences
  Synthetic
cgggatgtaatggaagcggttggaggc

SEQ ID NO: 10022 - DNA, 27 bp, Artificial Sequences
  Synthetic
ggtttggtcggtggttatggcgcgtac

SEQ ID NO: 10023 - DNA, 27 bp, Artificial Sequences
  Synthetic
atacggtttggtcggtggttatggcgc

SEQ ID NO: 10024 - DNA, 27 bp, Artificial Sequences
  Synthetic
ggattcgaggaaggaggagggcgagtt

SEQ ID NO: 10025 - DNA, 27 bp, Artificial Sequences
  Synthetic
cggtgcgcgtagttgtttcggttagga

SEQ ID NO: 10026 - DNA, 27 bp, Artificial Sequences
  Synthetic
cggtttggtcggtggttatggcgcgta

SEQ ID NO: 10027 - DNA, 27 bp, Artificial Sequences
  Synthetic
ataatggggagcggtagatgggtggcg

SEQ ID NO: 10028 - DNA, 27 bp, Artificial Sequences
  Synthetic
aggcgggtgtggttagtttttagcgcg

SEQ ID NO: 10029 - DNA, 27 bp, Artificial Sequences
  Synthetic
aggcgtgagggggtggaaaaagagtcg

SEQ ID NO: 10030 - DNA, 27 bp, Artificial Sequences
  Synthetic
tgttgaacgagtgaaagagtgggcgcg

SEQ ID NO: 10031 - DNA, 27 bp, Artificial Sequences
  Synthetic
gggatgtaatggaagcggttggaggcg

SEQ ID NO: 10032 - DNA, 27 bp, Artificial Sequences
  Synthetic
aatggtggtggaagggtagagaggcgc

SEQ ID NO: 10033 - DNA, 27 bp, Artificial Sequences
  Synthetic
ggggaaggttgtacgatacgggtgggg

SEQ ID NO: 10034 - DNA, 27 bp, Artificial Sequences
  Synthetic
gggggaaggttgtacgatacgggtggg

SEQ ID NO: 10035 - DNA, 27 bp, Artificial Sequences
  Synthetic
gggcggggagtattgaatggtggtgga

SEQ ID NO: 10036 - DNA, 27 bp, Artificial Sequences
  Synthetic
gaaaggaggtgggggcggggagtattg

SEQ ID NO: 10037 - DNA, 27 bp, Artificial Sequences
  Synthetic
gtgattttgaatcgaggagaggcgggt

SEQ ID NO: 10038 - DNA, 28 bp, Artificial Sequences
  Synthetic
agtgattttgaatcgaggagaggcgggt

SEQ ID NO: 10039 - DNA, 27 bp, Artificial Sequences
  Synthetic
agtgattttgaatcgaggagaggcggg

SEQ ID NO: 10040 - DNA, 27 bp, Artificial Sequences
  Synthetic
tgattttgaatcgaggagaggcgggtt

SEQ ID NO: 10041 - DNA, 28 bp, Artificial Sequences
  Synthetic
gtgattttgaatcgaggagaggcgggtt

SEQ ID NO: 10042 - DNA, 27 bp, Artificial Sequences
  Synthetic
cgtgttgggcggttgtgtttcggtagg

SEQ ID NO: 10043 - DNA, 27 bp, Artificial Sequences
  Synthetic
acgtgttgggcggttgtgtttcggtag

SEQ ID NO: 10044 - DNA, 27 bp, Artificial Sequences
  Synthetic
gacgtgttgggcggttgtgtttcggta

SEQ ID NO: 10045 - DNA, 27 bp, Artificial Sequences
  Synthetic
gtgttgggcggttgtgtttcggtaggc

SEQ ID NO: 10046 - DNA, 27 bp, Artificial Sequences
  Synthetic
tgggcggttgtgtttcggtaggcgatt

SEQ ID NO: 10047 - DNA, 26 bp, Artificial Sequences
  Synthetic
cgtgaaagttcggagcgcggttaggg

SEQ ID NO: 10048 - DNA, 26 bp, Artificial Sequences
  Synthetic
gtgaaagttcggagcgcggttagggg

SEQ ID NO: 10049 - DNA, 27 bp, Artificial Sequences
  Synthetic
cgtgaaagttcggagcgcggttagggg

SEQ ID NO: 10050 - DNA, 25 bp, Artificial Sequences
  Synthetic
tgaaagttcggagcgcggttagggg

SEQ ID NO: 10051 - DNA, 25 bp, Artificial Sequences
  Synthetic
cgtgaaagttcggagcgcggttagg

SEQ ID NO: 10052 - DNA, 27 bp, Artificial Sequences
  Synthetic
tggtcgttcgaaggttttgcgtcgttt

SEQ ID NO: 10053 - DNA, 27 bp, Artificial Sequences
  Synthetic
ttggtcgttcgaaggttttgcgtcgtt

SEQ ID NO: 10054 - DNA, 27 bp, Artificial Sequences
  Synthetic
tttggtcgttcgaaggttttgcgtcgt

SEQ ID NO: 10055 - DNA, 28 bp, Artificial Sequences
  Synthetic
tggtcgttcgaaggttttgcgtcgtttt

SEQ ID NO: 10056 - DNA, 28 bp, Artificial Sequences
  Synthetic
ttggtcgttcgaaggttttgcgtcgttt

SEQ ID NO: 10057 - DNA, 29 bp, Artificial Sequences
  Synthetic
gggattcggattgggagattttggttggg

SEQ ID NO: 10058 - DNA, 30 bp, Artificial Sequences
  Synthetic
gggattcggattgggagattttggttgggt

SEQ ID NO: 10059 - DNA, 29 bp, Artificial Sequences
  Synthetic
cggattgggagattttggttgggtagtgg

SEQ ID NO: 10060 - DNA, 29 bp, Artificial Sequences
  Synthetic
ggattcggattgggagattttggttgggt

SEQ ID NO: 10061 - DNA, 30 bp, Artificial Sequences
  Synthetic
cggattgggagattttggttgggtagtgga

SEQ ID NO: 10062 - DNA, 27 bp, Artificial Sequences
  Synthetic
cgtagtcgggcgttattagatcgggtt

SEQ ID NO: 10063 - DNA, 28 bp, Artificial Sequences
  Synthetic
cgtagtcgggcgttattagatcgggttt

SEQ ID NO: 10064 - DNA, 26 bp, Artificial Sequences
  Synthetic
cgtagtcgggcgttattagatcgggt

SEQ ID NO: 10065 - DNA, 28 bp, Artificial Sequences
  Synthetic
tttcggattttttggagggtgcgtagtc

SEQ ID NO: 10066 - DNA, 29 bp, Artificial Sequences
  Synthetic
cgtagtcgggcgttattagatcgggtttt

SEQ ID NO: 10067 - DNA, 27 bp, Artificial Sequences
  Synthetic
ggcggagtttcggggggcggtattata

SEQ ID NO: 10068 - DNA, 27 bp, Artificial Sequences
  Synthetic
tttttcggggtggggttagacggggac

SEQ ID NO: 10069 - DNA, 28 bp, Artificial Sequences
  Synthetic
ggcggagtttcggggggcggtattataa

SEQ ID NO: 10070 - DNA, 26 bp, Artificial Sequences
  Synthetic
ttttcggggtggggttagacggggac

SEQ ID NO: 10071 - DNA, 26 bp, Artificial Sequences
  Synthetic
tttttcggggtggggttagacgggga

SEQ ID NO: 10072 - DNA, 28 bp, Artificial Sequences
  Synthetic
cggggtttcgtttttgtcgttgttgtcg

SEQ ID NO: 10073 - DNA, 29 bp, Artificial Sequences
  Synthetic
cggggtttcgtttttgtcgttgttgtcgt

SEQ ID NO: 10074 - DNA, 29 bp, Artificial Sequences
  Synthetic
tcggggtttcgtttttgtcgttgttgtcg

SEQ ID NO: 10075 - DNA, 30 bp, Artificial Sequences
  Synthetic
tcggggtttcgtttttgtcgttgttgtcgt

SEQ ID NO: 10076 - DNA, 27 bp, Artificial Sequences
  Synthetic
tcggggtttcgtttttgtcgttgttgt

SEQ ID NO: 10077 - DNA, 27 bp, Artificial Sequences
  Synthetic
tttttcggggtggggttagacggggac

SEQ ID NO: 10078 - DNA, 27 bp, Artificial Sequences
  Synthetic
ttttttcggggtggggttagacgggga

SEQ ID NO: 10079 - DNA, 27 bp, Artificial Sequences
  Synthetic
ttcgaggggggtgatgtgaagggttgc

SEQ ID NO: 10080 - DNA, 26 bp, Artificial Sequences
  Synthetic
ttttcggggtggggttagacggggac

SEQ ID NO: 10081 - DNA, 28 bp, Artificial Sequences
  Synthetic
ttttttcggggtggggttagacggggac

SEQ ID NO: 10082 - DNA, 30 bp, Artificial Sequences
  Synthetic
cgtttgattttatttcggagggagggagga

SEQ ID NO: 10083 - DNA, 30 bp, Artificial Sequences
  Synthetic
tcgtttgattttatttcggagggagggagg

SEQ ID NO: 10084 - DNA, 31 bp, Artificial Sequences
  Synthetic
tcgtttgattttatttcggagggagggagga

SEQ ID NO: 10085 - DNA, 31 bp, Artificial Sequences
  Synthetic
ttcgtttgattttatttcggagggagggagg

SEQ ID NO: 10086 - DNA, 31 bp, Artificial Sequences
  Synthetic
cgtttgattttatttcggagggagggaggat

SEQ ID NO: 10087 - DNA, 27 bp, Artificial Sequences
  Synthetic
ttcgaggggggtgatgtgaagggttgc

SEQ ID NO: 10088 - DNA, 26 bp, Artificial Sequences
  Synthetic
tcgaggggggtgatgtgaagggttgc

SEQ ID NO: 10089 - DNA, 28 bp, Artificial Sequences
  Synthetic
tttcgaggggggtgatgtgaagggttgc

SEQ ID NO: 10090 - DNA, 27 bp, Artificial Sequences
  Synthetic
tttcgaggggggtgatgtgaagggttg

SEQ ID NO: 10091 - DNA, 27 bp, Artificial Sequences
  Synthetic
ttttcgaggggggtgatgtgaagggtt

SEQ ID NO: 10092 - DNA, 27 bp, Artificial Sequences
  Synthetic
cgtgggcgggatttttaggttcgggtt

SEQ ID NO: 10093 - DNA, 28 bp, Artificial Sequences
  Synthetic
cgtgggcgggatttttaggttcgggttc

SEQ ID NO: 10094 - DNA, 26 bp, Artificial Sequences
  Synthetic
cgtgggcgggatttttaggttcgggt

SEQ ID NO: 10095 - DNA, 27 bp, Artificial Sequences
  Synthetic
gtgggcgggatttttaggttcgggttc

SEQ ID NO: 10096 - DNA, 26 bp, Artificial Sequences
  Synthetic
gtgggcgggatttttaggttcgggtt

SEQ ID NO: 10097 - DNA, 27 bp, Artificial Sequences
  Synthetic
gtttcggggttggtttggtggaggtcg

SEQ ID NO: 10098 - DNA, 27 bp, Artificial Sequences
  Synthetic
ggtttcggggttggtttggtggaggtc

SEQ ID NO: 10099 - DNA, 27 bp, Artificial Sequences
  Synthetic
agttcggtagggtggttggcgggtttc

SEQ ID NO: 10100 - DNA, 27 bp, Artificial Sequences
  Synthetic
gagttcggtagggtggttggcgggttt

SEQ ID NO: 10101 - DNA, 27 bp, Artificial Sequences
  Synthetic
tttcggggttggtttggtggaggtcgg

SEQ ID NO: 10102 - DNA, 27 bp, Artificial Sequences
  Synthetic
tcgggcgttaggaggtttcgttggagg

SEQ ID NO: 10103 - DNA, 27 bp, Artificial Sequences
  Synthetic
ggcgttaggaggtttcgttggaggggt

SEQ ID NO: 10104 - DNA, 27 bp, Artificial Sequences
  Synthetic
ggcgtcgtgagggggattcggtttagt

SEQ ID NO: 10105 - DNA, 27 bp, Artificial Sequences
  Synthetic
cgttcgggcgttaggaggtttcgttgg

SEQ ID NO: 10106 - DNA, 27 bp, Artificial Sequences
  Synthetic
aggaggtttcgttggaggggttgggtt

SEQ ID NO: 10107 - DNA, 27 bp, Artificial Sequences
  Synthetic
agttcggtagggtggttggcgggtttc

SEQ ID NO: 10108 - DNA, 27 bp, Artificial Sequences
  Synthetic
gagttcggtagggtggttggcgggttt

SEQ ID NO: 10109 - DNA, 27 bp, Artificial Sequences
  Synthetic
tttcggggttggtttggtggaggtcgg

SEQ ID NO: 10110 - DNA, 26 bp, Artificial Sequences
  Synthetic
agttcggtagggtggttggcgggttt

SEQ ID NO: 10111 - DNA, 26 bp, Artificial Sequences
  Synthetic
gttcggtagggtggttggcgggtttc

SEQ ID NO: 10112 - DNA, 27 bp, Artificial Sequences
  Synthetic
gggggtgtgggggttcggttttaggaa

SEQ ID NO: 10113 - DNA, 27 bp, Artificial Sequences
  Synthetic
atgggggtgtgggggttcggttttagg

SEQ ID NO: 10114 - DNA, 27 bp, Artificial Sequences
  Synthetic
cggttttaggaacgggttttgggggcg

SEQ ID NO: 10115 - DNA, 27 bp, Artificial Sequences
  Synthetic
aagatggaatgggggtgtgggggttcg

SEQ ID NO: 10116 - DNA, 27 bp, Artificial Sequences
  Synthetic
taggaacgggttttgggggcgttaggt

SEQ ID NO: 10117 - DNA, 27 bp, Artificial Sequences
  Synthetic
gttcgatcggtgcgggttgttgggttt

SEQ ID NO: 10118 - DNA, 27 bp, Artificial Sequences
  Synthetic
gcgagttagggaggaggatgtagggcg

SEQ ID NO: 10119 - DNA, 27 bp, Artificial Sequences
  Synthetic
tcgatcggtgcgggttgttgggttttt

SEQ ID NO: 10120 - DNA, 27 bp, Artificial Sequences
  Synthetic
ttcgatcggtgcgggttgttgggtttt

SEQ ID NO: 10121 - DNA, 27 bp, Artificial Sequences
  Synthetic
ggggttgcgagttagggaggaggatgt

SEQ ID NO: 10122 - DNA, 27 bp, Artificial Sequences
  Synthetic
gttcgcgttttggtggggtagttgggt

SEQ ID NO: 10123 - DNA, 27 bp, Artificial Sequences
  Synthetic
ttcgcgttttggtggggtagttgggtg

SEQ ID NO: 10124 - DNA, 27 bp, Artificial Sequences
  Synthetic
tgttcgcgttttggtggggtagttggg

SEQ ID NO: 10125 - DNA, 27 bp, Artificial Sequences
  Synthetic
ggggtagttgggtgggtaagtttgcgg

SEQ ID NO: 10126 - DNA, 27 bp, Artificial Sequences
  Synthetic
tcgcgttttggtggggtagttgggtgg

SEQ ID NO: 10127 - DNA, 27 bp, Artificial Sequences
  Synthetic
aagggggaggcggtaggagttttggtg

SEQ ID NO: 10128 - DNA, 27 bp, Artificial Sequences
  Synthetic
gggggaggcggtaggagttttggtgtt

SEQ ID NO: 10129 - DNA, 27 bp, Artificial Sequences
  Synthetic
agggggaggcggtaggagttttggtgt

SEQ ID NO: 10130 - DNA, 26 bp, Artificial Sequences
  Synthetic
gggggaggcggtaggagttttggtgt

SEQ ID NO: 10131 - DNA, 26 bp, Artificial Sequences
  Synthetic
agggggaggcggtaggagttttggtg

SEQ ID NO: 10132 - DNA, 27 bp, Artificial Sequences
  Synthetic
ggggagacgaaggtggttggttttgtt

SEQ ID NO: 10133 - DNA, 28 bp, Artificial Sequences
  Synthetic
ggaattagttttgggttgcggggagacg

SEQ ID NO: 10134 - DNA, 28 bp, Artificial Sequences
  Synthetic
ggggagacgaaggtggttggttttgttt

SEQ ID NO: 10135 - DNA, 27 bp, Artificial Sequences
  Synthetic
gaattagttttgggttgcggggagacg

SEQ ID NO: 10136 - DNA, 26 bp, Artificial Sequences
  Synthetic
ggggagacgaaggtggttggttttgt

SEQ ID NO: 10137 - DNA, 27 bp, Artificial Sequences
  Synthetic
gggagtgggggtaggagtttggttggg

SEQ ID NO: 10138 - DNA, 27 bp, Artificial Sequences
  Synthetic
ggggagtgggggtaggagtttggttgg

SEQ ID NO: 10139 - DNA, 27 bp, Artificial Sequences
  Synthetic
cggggagtgggggtaggagtttggttg

SEQ ID NO: 10140 - DNA, 27 bp, Artificial Sequences
  Synthetic
ggttgggagagaggaagggggtgagga

SEQ ID NO: 10141 - DNA, 27 bp, Artificial Sequences
  Synthetic
aggttgggagagaggaagggggtgagg

SEQ ID NO: 10142 - DNA, 36 bp, Artificial Sequences
  Synthetic
gggattgtaaaattagatgggatagggtttagtcgt

SEQ ID NO: 10143 - DNA, 29 bp, Artificial Sequences
  Synthetic
gaaatgattcgggagggttttatgcggtt

SEQ ID NO: 10144 - DNA, 29 bp, Artificial Sequences
  Synthetic
cgtattgtgattttgggttaggttggggg

SEQ ID NO: 10145 - DNA, 30 bp, Artificial Sequences
  Synthetic
cgtattgtgattttgggttaggttggggga

SEQ ID NO: 10146 - DNA, 30 bp, Artificial Sequences
  Synthetic
tcgtattgtgattttgggttaggttggggg

SEQ ID NO: 10147 - DNA, 31 bp, Artificial Sequences
  Synthetic
tcgtattgtgattttgggttaggttggggga

SEQ ID NO: 10148 - DNA, 27 bp, Artificial Sequences
  Synthetic
tcgcggagagtatatgtaggtcggagt

SEQ ID NO: 10149 - DNA, 28 bp, Artificial Sequences
  Synthetic
tcgcggagagtatatgtaggtcggagtt

SEQ ID NO: 10150 - DNA, 28 bp, Artificial Sequences
  Synthetic
atcgcggagagtatatgtaggtcggagt

SEQ ID NO: 10151 - DNA, 29 bp, Artificial Sequences
  Synthetic
tcgcggagagtatatgtaggtcggagttt

SEQ ID NO: 10152 - DNA, 29 bp, Artificial Sequences
  Synthetic
atcgcggagagtatatgtaggtcggagtt

SEQ ID NO: 10153 - DNA, 27 bp, Artificial Sequences
  Synthetic
agtttcgggagtaggcgagcggtattc

SEQ ID NO: 10154 - DNA, 27 bp, Artificial Sequences
  Synthetic
gaatagtttcgggagtaggcgagcggt

SEQ ID NO: 10155 - DNA, 27 bp, Artificial Sequences
  Synthetic
tagtttcgggagtaggcgagcggtatt

SEQ ID NO: 10156 - DNA, 27 bp, Artificial Sequences
  Synthetic
aatagtttcgggagtaggcgagcggta

SEQ ID NO: 10157 - DNA, 27 bp, Artificial Sequences
  Synthetic
atagtttcgggagtaggcgagcggtat

SEQ ID NO: 10158 - DNA, 27 bp, Artificial Sequences
  Synthetic
ttttagcgttggggtttggggcgttcg

SEQ ID NO: 10159 - DNA, 26 bp, Artificial Sequences
  Synthetic
tttagcgttggggtttggggcgttcg

SEQ ID NO: 10160 - DNA, 28 bp, Artificial Sequences
  Synthetic
attttagcgttggggtttggggcgttcg

SEQ ID NO: 10161 - DNA, 27 bp, Artificial Sequences
  Synthetic
attttagcgttggggtttggggcgttc

SEQ ID NO: 10162 - DNA, 27 bp, Artificial Sequences
  Synthetic
tttagcgttggggtttggggcgttcgg

SEQ ID NO: 10163 - DNA, 27 bp, Artificial Sequences
  Synthetic
agtttcgggagtaggcgagcggtattc

SEQ ID NO: 10164 - DNA, 27 bp, Artificial Sequences
  Synthetic
gaatagtttcgggagtaggcgagcggt

SEQ ID NO: 10165 - DNA, 27 bp, Artificial Sequences
  Synthetic
tagtttcgggagtaggcgagcggtatt

SEQ ID NO: 10166 - DNA, 27 bp, Artificial Sequences
  Synthetic
aatagtttcgggagtaggcgagcggta

SEQ ID NO: 10167 - DNA, 27 bp, Artificial Sequences
  Synthetic
atagtttcgggagtaggcgagcggtat

SEQ ID NO: 10168 - DNA, 27 bp, Artificial Sequences
  Synthetic
atttttggggacgttgggattcgcggc

SEQ ID NO: 10169 - DNA, 27 bp, Artificial Sequences
  Synthetic
ggtcgtcggttgttcgggtcgtgtatt

SEQ ID NO: 10170 - DNA, 27 bp, Artificial Sequences
  Synthetic
gatttttggggacgttgggattcgcgg

SEQ ID NO: 10171 - DNA, 26 bp, Artificial Sequences
  Synthetic
tttttggggacgttgggattcgcggc

SEQ ID NO: 10172 - DNA, 28 bp, Artificial Sequences
  Synthetic
agatttttggggacgttgggattcgcgg

SEQ ID NO: 10173 - DNA, 27 bp, Artificial Sequences
  Synthetic
cggagaggcgggagttttgcgtgtttc

SEQ ID NO: 10174 - DNA, 26 bp, Artificial Sequences
  Synthetic
cggagaggcgggagttttgcgtgttt

SEQ ID NO: 10175 - DNA, 27 bp, Artificial Sequences
  Synthetic
gcggagaggcgggagttttgcgtgttt

SEQ ID NO: 10176 - DNA, 25 bp, Artificial Sequences
  Synthetic
cggagaggcgggagttttgcgtgtt

SEQ ID NO: 10177 - DNA, 26 bp, Artificial Sequences
  Synthetic
ggagaggcgggagttttgcgtgtttc

SEQ ID NO: 10178 - DNA, 29 bp, Artificial Sequences
  Synthetic
cgcggttttaatagagttgtcggttgggt

SEQ ID NO: 10179 - DNA, 28 bp, Artificial Sequences
  Synthetic
cgcggttttaatagagttgtcggttggg

SEQ ID NO: 10180 - DNA, 29 bp, Artificial Sequences
  Synthetic
tcgcggttttaatagagttgtcggttggg

SEQ ID NO: 10181 - DNA, 30 bp, Artificial Sequences
  Synthetic
tcgcggttttaatagagttgtcggttgggt

SEQ ID NO: 10182 - DNA, 30 bp, Artificial Sequences
  Synthetic
cgcggttttaatagagttgtcggttgggtt

SEQ ID NO: 10183 - DNA, 27 bp, Artificial Sequences
  Synthetic
tcgggtgggttttcggagtttagtcga

SEQ ID NO: 10184 - DNA, 27 bp, Artificial Sequences
  Synthetic
ttcgggtgggttttcggagtttagtcg

SEQ ID NO: 10185 - DNA, 28 bp, Artificial Sequences
  Synthetic
ttcgggtgggttttcggagtttagtcga

SEQ ID NO: 10186 - DNA, 27 bp, Artificial Sequences
  Synthetic
aggtttcgggtgggttttcggagttta

SEQ ID NO: 10187 - DNA, 27 bp, Artificial Sequences
  Synthetic
taggtttcgggtgggttttcggagttt

SEQ ID NO: 10188 - DNA, 27 bp, Artificial Sequences
  Synthetic
agagttgtcggttgggtttcggaagtt

SEQ ID NO: 10189 - DNA, 27 bp, Artificial Sequences
  Synthetic
tagagttgtcggttgggtttcggaagt

SEQ ID NO: 10190 - DNA, 27 bp, Artificial Sequences
  Synthetic
gagttgtcggttgggtttcggaagttt

SEQ ID NO: 10191 - DNA, 28 bp, Artificial Sequences
  Synthetic
agagttgtcggttgggtttcggaagttt

SEQ ID NO: 10192 - DNA, 28 bp, Artificial Sequences
  Synthetic
tcggttgggtttcggaagtttattcgga

SEQ ID NO: 10193 - DNA, 27 bp, Artificial Sequences
  Synthetic
gaaggattagagttgcggcggggggaa

SEQ ID NO: 10194 - DNA, 27 bp, Artificial Sequences
  Synthetic
aaggattagagttgcggcggggggaag

SEQ ID NO: 10195 - DNA, 27 bp, Artificial Sequences
  Synthetic
aaggaaggattagagttgcggcggggg

SEQ ID NO: 10196 - DNA, 27 bp, Artificial Sequences
  Synthetic
gaaggaaggattagagttgcggcgggg

SEQ ID NO: 10197 - DNA, 27 bp, Artificial Sequences
  Synthetic
ggaaggaaggattagagttgcggcggg

SEQ ID NO: 10198 - DNA, 29 bp, Artificial Sequences
  Synthetic
agagtagaggatattgcggagaggttcga

SEQ ID NO: 10199 - DNA, 30 bp, Artificial Sequences
  Synthetic
agagtagaggatattgcggagaggttcgaa

SEQ ID NO: 10200 - DNA, 31 bp, Artificial Sequences
  Synthetic
agagtagaggatattgcggagaggttcgaat

SEQ ID NO: 10201 - DNA, 31 bp, Artificial Sequences
  Synthetic
tagagtagaggatattgcggagaggttcgaa

SEQ ID NO: 10202 - DNA, 31 bp, Artificial Sequences
  Synthetic
ttagagtagaggatattgcggagaggttcga

SEQ ID NO: 10203 - DNA, 27 bp, Artificial Sequences
  Synthetic
gaaggattagagttgcggcggggggaa

SEQ ID NO: 10204 - DNA, 27 bp, Artificial Sequences
  Synthetic
aaggattagagttgcggcggggggaag

SEQ ID NO: 10205 - DNA, 27 bp, Artificial Sequences
  Synthetic
aaggaaggattagagttgcggcggggg

SEQ ID NO: 10206 - DNA, 27 bp, Artificial Sequences
  Synthetic
gaaggaaggattagagttgcggcgggg

SEQ ID NO: 10207 - DNA, 27 bp, Artificial Sequences
  Synthetic
ggaaggaaggattagagttgcggcggg

SEQ ID NO: 10208 - DNA, 27 bp, Artificial Sequences
  Synthetic
gggggaggggcgtttgtttgcgtatag

SEQ ID NO: 10209 - DNA, 27 bp, Artificial Sequences
  Synthetic
cgggggaggggcgtttgtttgcgtata

SEQ ID NO: 10210 - DNA, 27 bp, Artificial Sequences
  Synthetic
ggggaggggcgtttgtttgcgtatagt

SEQ ID NO: 10211 - DNA, 28 bp, Artificial Sequences
  Synthetic
gggggaggggcgtttgtttgcgtatagt

SEQ ID NO: 10212 - DNA, 26 bp, Artificial Sequences
  Synthetic
gggggaggggcgtttgtttgcgtata

SEQ ID NO: 10213 - DNA, 29 bp, Artificial Sequences
  Synthetic
gcggttttttcgtcgggttttagttgcgc

SEQ ID NO: 10214 - DNA, 29 bp, Artificial Sequences
  Synthetic
cgcggttttttcgtcgggttttagttgcg

SEQ ID NO: 10215 - DNA, 28 bp, Artificial Sequences
  Synthetic
cggttttttcgtcgggttttagttgcgc

SEQ ID NO: 10216 - DNA, 28 bp, Artificial Sequences
  Synthetic
gcggttttttcgtcgggttttagttgcg

SEQ ID NO: 10217 - DNA, 28 bp, Artificial Sequences
  Synthetic
cgcggttttttcgtcgggttttagttgc

SEQ ID NO: 10218 - DNA, 27 bp, Artificial Sequences
  Synthetic
gcgtagttggagttcggcgagagggtc

SEQ ID NO: 10219 - DNA, 27 bp, Artificial Sequences
  Synthetic
tgaggagttggagtcgagtcggggatc

SEQ ID NO: 10220 - DNA, 26 bp, Artificial Sequences
  Synthetic
gcgtagttggagttcggcgagagggt

SEQ ID NO: 10221 - DNA, 27 bp, Artificial Sequences
  Synthetic
ttgaggagttggagtcgagtcggggat

SEQ ID NO: 10222 - DNA, 27 bp, Artificial Sequences
  Synthetic
attgaggagttggagtcgagtcgggga

SEQ ID NO: 10223 - DNA, 27 bp, Artificial Sequences
  Synthetic
ggttttttcgtcgggttttagttgcgc

SEQ ID NO: 10224 - DNA, 27 bp, Artificial Sequences
  Synthetic
cgcggttttttcgtcgggttttagttg

SEQ ID NO: 10225 - DNA, 27 bp, Artificial Sequences
  Synthetic
gaggggtattgcgcggttgggtttgtt

SEQ ID NO: 10226 - DNA, 27 bp, Artificial Sequences
  Synthetic
tattgcgcggttgggtttgtttcgggg

SEQ ID NO: 10227 - DNA, 27 bp, Artificial Sequences
  Synthetic
gcggttgggtttgtttcggggtttcgt

SEQ ID NO: 10228 - DNA, 27 bp, Artificial Sequences
  Synthetic
aggggtattgcgcggttgggtttgttt

SEQ ID NO: 10229 - DNA, 27 bp, Artificial Sequences
  Synthetic
gcgtagttggagttcggcgagagggtc

SEQ ID NO: 10230 - DNA, 27 bp, Artificial Sequences
  Synthetic
gggttggaggcgaggtaggtacgttgg

SEQ ID NO: 10231 - DNA, 27 bp, Artificial Sequences
  Synthetic
cgggttggaggcgaggtaggtacgttg

SEQ ID NO: 10232 - DNA, 27 bp, Artificial Sequences
  Synthetic
tttcgggttggaggcgaggtaggtacg

SEQ ID NO: 10233 - DNA, 27 bp, Artificial Sequences
  Synthetic
ggttggaggcgaggtaggtacgttggt

SEQ ID NO: 10234 - DNA, 27 bp, Artificial Sequences
  Synthetic
tcgggttggaggcgaggtaggtacgtt

SEQ ID NO: 10235 - DNA, 27 bp, Artificial Sequences
  Synthetic
ttattcgggattgtaacggtgcgcgcg

SEQ ID NO: 10236 - DNA, 26 bp, Artificial Sequences
  Synthetic
tattcgggattgtaacggtgcgcgcg

SEQ ID NO: 10237 - DNA, 27 bp, Artificial Sequences
  Synthetic
gttattcgggattgtaacggtgcgcgc

SEQ ID NO: 10238 - DNA, 28 bp, Artificial Sequences
  Synthetic
gttattcgggattgtaacggtgcgcgcg

SEQ ID NO: 10239 - DNA, 25 bp, Artificial Sequences
  Synthetic
gggattgtaacggtgcgcgcgtagg

SEQ ID NO: 10240 - DNA, 27 bp, Artificial Sequences
  Synthetic
tgttacgtagggttttcgggaggcggt

SEQ ID NO: 10241 - DNA, 27 bp, Artificial Sequences
  Synthetic
tgagttttgcgggatggggtagtcggc

SEQ ID NO: 10242 - DNA, 27 bp, Artificial Sequences
  Synthetic
gtgagttttgcgggatggggtagtcgg

SEQ ID NO: 10243 - DNA, 27 bp, Artificial Sequences
  Synthetic
gtgttacgtagggttttcgggaggcgg

SEQ ID NO: 10244 - DNA, 28 bp, Artificial Sequences
  Synthetic
agtgttacgtagggttttcgggaggcgg

SEQ ID NO: 10245 - DNA, 27 bp, Artificial Sequences
  Synthetic
gagtagacggtggcgcgcgtggagtac

SEQ ID NO: 10246 - DNA, 26 bp, Artificial Sequences
  Synthetic
gagtagacggtggcgcgcgtggagta

SEQ ID NO: 10247 - DNA, 26 bp, Artificial Sequences
  Synthetic
agtagacggtggcgcgcgtggagtac

SEQ ID NO: 10248 - DNA, 25 bp, Artificial Sequences
  Synthetic
gtagacggtggcgcgcgtggagtac

SEQ ID NO: 10249 - DNA, 27 bp, Artificial Sequences
  Synthetic
cgagtagacggtggcgcgcgtggagta

SEQ ID NO: 10250 - DNA, 27 bp, Artificial Sequences
  Synthetic
atgtcgtcgttgtgtaggggttcgggt

SEQ ID NO: 10251 - DNA, 27 bp, Artificial Sequences
  Synthetic
tgtcgtcgttgtgtaggggttcgggta

SEQ ID NO: 10252 - DNA, 28 bp, Artificial Sequences
  Synthetic
gatgtcgtcgttgtgtaggggttcgggt

SEQ ID NO: 10253 - DNA, 27 bp, Artificial Sequences
  Synthetic
gatgtcgtcgttgtgtaggggttcggg

SEQ ID NO: 10254 - DNA, 27 bp, Artificial Sequences
  Synthetic
ggatgtcgtcgttgtgtaggggttcgg

SEQ ID NO: 10255 - DNA, 27 bp, Artificial Sequences
  Synthetic
ggtacgttgcggtcggtcgatttgttt

SEQ ID NO: 10256 - DNA, 28 bp, Artificial Sequences
  Synthetic
ggtacgttgcggtcggtcgatttgtttt

SEQ ID NO: 10257 - DNA, 26 bp, Artificial Sequences
  Synthetic
ggtacgttgcggtcggtcgatttgtt

SEQ ID NO: 10258 - DNA, 27 bp, Artificial Sequences
  Synthetic
acgttgcggtcggtcgatttgtttttt

SEQ ID NO: 10259 - DNA, 27 bp, Artificial Sequences
  Synthetic
gtacgttgcggtcggtcgatttgtttt

SEQ ID NO: 10260 - DNA, 27 bp, Artificial Sequences
  Synthetic
gcggtcgcgttattgtggttgaggtgt

SEQ ID NO: 10261 - DNA, 27 bp, Artificial Sequences
  Synthetic
atgtcgtcgttgtgtaggggttcgggt

SEQ ID NO: 10262 - DNA, 27 bp, Artificial Sequences
  Synthetic
tgtcgtcgttgtgtaggggttcgggta

SEQ ID NO: 10263 - DNA, 28 bp, Artificial Sequences
  Synthetic
gatgtcgtcgttgtgtaggggttcgggt

SEQ ID NO: 10264 - DNA, 27 bp, Artificial Sequences
  Synthetic
gatgtcgtcgttgtgtaggggttcggg

SEQ ID NO: 10265 - DNA, 31 bp, Artificial Sequences
  Synthetic
ggtttggttgtgtgttgagtttttcgttagc

SEQ ID NO: 10266 - DNA, 32 bp, Artificial Sequences
  Synthetic
tggtttggttgtgtgttgagtttttcgttagc

SEQ ID NO: 10267 - DNA, 33 bp, Artificial Sequences
  Synthetic
atggtttggttgtgtgttgagtttttcgttagc

SEQ ID NO: 10268 - DNA, 33 bp, Artificial Sequences
  Synthetic
agtggattatggtttggttgtgtgttgagtttt

SEQ ID NO: 10269 - DNA, 34 bp, Artificial Sequences
  Synthetic
ggattatggtttggttgtgtgttgagtttttcgt

SEQ ID NO: 10270 - DNA, 27 bp, Artificial Sequences
  Synthetic
aggagtttgggattcgggagcgggatt

SEQ ID NO: 10271 - DNA, 27 bp, Artificial Sequences
  Synthetic
agtaggagtttgggattcgggagcggg

SEQ ID NO: 10272 - DNA, 27 bp, Artificial Sequences
  Synthetic
gtaggagtttgggattcgggagcggga

SEQ ID NO: 10273 - DNA, 27 bp, Artificial Sequences
  Synthetic
aggagaaggtagaacggggagagggcg

SEQ ID NO: 10274 - DNA, 27 bp, Artificial Sequences
  Synthetic
ggagtttgggattcgggagcgggattc

SEQ ID NO: 10275 - DNA, 24 bp, Artificial Sequences
  Synthetic
agcgggtggttttgttcgggtttc

SEQ ID NO: 10276 - DNA, 27 bp, Artificial Sequences
  Synthetic
gcggttgttgtacgtttcggtcggagg

SEQ ID NO: 10277 - DNA, 27 bp, Artificial Sequences
  Synthetic
ggcggttgttgtacgtttcggtcggag

SEQ ID NO: 10278 - DNA, 27 bp, Artificial Sequences
  Synthetic
atggcggttgttgtacgtttcggtcgg

SEQ ID NO: 10279 - DNA, 27 bp, Artificial Sequences
  Synthetic
aggagaaggtagaacggggagagggcg

SEQ ID NO: 10280 - DNA, 27 bp, Artificial Sequences
  Synthetic
tggcggttgttgtacgtttcggtcgga

SEQ ID NO: 10281 - DNA, 24 bp, Artificial Sequences
  Synthetic
agcgggtggttttgttcgggtttc

SEQ ID NO: 10282 - DNA, 27 bp, Artificial Sequences
  Synthetic
gcggttgttgtacgtttcggtcggagg

SEQ ID NO: 10283 - DNA, 27 bp, Artificial Sequences
  Synthetic
ggcggttgttgtacgtttcggtcggag

SEQ ID NO: 10284 - DNA, 27 bp, Artificial Sequences
  Synthetic
atggcggttgttgtacgtttcggtcgg

SEQ ID NO: 10285 - DNA, 27 bp, Artificial Sequences
  Synthetic
tggcggttgttgtacgtttcggtcgga

SEQ ID NO: 10286 - DNA, 27 bp, Artificial Sequences
  Synthetic
cggttgttgtacgtttcggtcggagga

SEQ ID NO: 10287 - DNA, 28 bp, Artificial Sequences
  Synthetic
ggtcggagcgtgtagtaatcgttatgga

SEQ ID NO: 10288 - DNA, 29 bp, Artificial Sequences
  Synthetic
ggtcggagcgtgtagtaatcgttatggat

SEQ ID NO: 10289 - DNA, 30 bp, Artificial Sequences
  Synthetic
ggtcggagcgtgtagtaatcgttatggatg

SEQ ID NO: 10290 - DNA, 31 bp, Artificial Sequences
  Synthetic
ggtcggagcgtgtagtaatcgttatggatgt

SEQ ID NO: 10291 - DNA, 30 bp, Artificial Sequences
  Synthetic
gtcggagcgtgtagtaatcgttatggatgt

SEQ ID NO: 10292 - DNA, 29 bp, Artificial Sequences
  Synthetic
ggggcggttaggtagggtttttgttacgt

SEQ ID NO: 10293 - DNA, 28 bp, Artificial Sequences
  Synthetic
ggggcggttaggtagggtttttgttacg

SEQ ID NO: 10294 - DNA, 29 bp, Artificial Sequences
  Synthetic
aggggcggttaggtagggtttttgttacg

SEQ ID NO: 10295 - DNA, 30 bp, Artificial Sequences
  Synthetic
aggggcggttaggtagggtttttgttacgt

SEQ ID NO: 10296 - DNA, 28 bp, Artificial Sequences
  Synthetic
gggcggttaggtagggtttttgttacgt

SEQ ID NO: 10297 - DNA, 27 bp, Artificial Sequences
  Synthetic
ggggtaggggcgtggtaggagttttgt

SEQ ID NO: 10298 - DNA, 27 bp, Artificial Sequences
  Synthetic
aggggtaggggcgtggtaggagttttg

SEQ ID NO: 10299 - DNA, 27 bp, Artificial Sequences
  Synthetic
gaggggtaggggcgtggtaggagtttt

SEQ ID NO: 10300 - DNA, 27 bp, Artificial Sequences
  Synthetic
cgaggggtaggggcgtggtaggagttt

SEQ ID NO: 10301 - DNA, 28 bp, Artificial Sequences
  Synthetic
gaggggtaggggcgtggtaggagttttg

SEQ ID NO: 10302 - DNA, 27 bp, Artificial Sequences
  Synthetic
cgtcggcggcggtttttaagttcggtt

SEQ ID NO: 10303 - DNA, 27 bp, Artificial Sequences
  Synthetic
tcggcggcggtttttaagttcggttga

SEQ ID NO: 10304 - DNA, 27 bp, Artificial Sequences
  Synthetic
gcggcggtttttaagttcggttgagcg

SEQ ID NO: 10305 - DNA, 27 bp, Artificial Sequences
  Synthetic
ggcggcggtttttaagttcggttgagc

SEQ ID NO: 10306 - DNA, 27 bp, Artificial Sequences
  Synthetic
gtcggcggcggtttttaagttcggttg

SEQ ID NO: 10307 - DNA, 27 bp, Artificial Sequences
  Synthetic
ggggtaggggcgtggtaggagttttgt

SEQ ID NO: 10308 - DNA, 27 bp, Artificial Sequences
  Synthetic
aggggtaggggcgtggtaggagttttg

SEQ ID NO: 10309 - DNA, 27 bp, Artificial Sequences
  Synthetic
gcgtttagtcgggtttgggagtcgtcg

SEQ ID NO: 10310 - DNA, 27 bp, Artificial Sequences
  Synthetic
gaggggtaggggcgtggtaggagtttt

SEQ ID NO: 10311 - DNA, 27 bp, Artificial Sequences
  Synthetic
cgaggggtaggggcgtggtaggagttt

SEQ ID NO: 10312 - DNA, 27 bp, Artificial Sequences
  Synthetic
cgcggcgtaatttggatggagttgggg

SEQ ID NO: 10313 - DNA, 27 bp, Artificial Sequences
  Synthetic
cgtcggcggcggtttttaagttcggtt

SEQ ID NO: 10314 - DNA, 27 bp, Artificial Sequences
  Synthetic
ggatggagttggggttttgagcgtcgg

SEQ ID NO: 10315 - DNA, 27 bp, Artificial Sequences
  Synthetic
gcggcgtaatttggatggagttggggt

SEQ ID NO: 10316 - DNA, 27 bp, Artificial Sequences
  Synthetic
tcggcggcggtttttaagttcggttga

SEQ ID NO: 10317 - DNA, 27 bp, Artificial Sequences
  Synthetic
gtaggagttcggcgtaggtggtgggtt

SEQ ID NO: 10318 - DNA, 27 bp, Artificial Sequences
  Synthetic
aggagttcggcgtaggtggtgggttta

SEQ ID NO: 10319 - DNA, 27 bp, Artificial Sequences
  Synthetic
taggagttcggcgtaggtggtgggttt

SEQ ID NO: 10320 - DNA, 28 bp, Artificial Sequences
  Synthetic
gtaggagttcggcgtaggtggtgggttt

SEQ ID NO: 10321 - DNA, 26 bp, Artificial Sequences
  Synthetic
cgtaggagttcggcgtaggtggtggg

SEQ ID NO: 10322 - DNA, 27 bp, Artificial Sequences
  Synthetic
tgggaaaggttggtagatagcggcgtt

SEQ ID NO: 10323 - DNA, 27 bp, Artificial Sequences
  Synthetic
ttgggaaaggttggtagatagcggcgt

SEQ ID NO: 10324 - DNA, 28 bp, Artificial Sequences
  Synthetic
gttgggaaaggttggtagatagcggcgt

SEQ ID NO: 10325 - DNA, 27 bp, Artificial Sequences
  Synthetic
gttgggaaaggttggtagatagcggcg

SEQ ID NO: 10326 - DNA, 28 bp, Artificial Sequences
  Synthetic
agttgggaaaggttggtagatagcggcg

SEQ ID NO: 10327 - DNA, 27 bp, Artificial Sequences
  Synthetic
gcgaagatagttttagggtgggcggcg

SEQ ID NO: 10328 - DNA, 27 bp, Artificial Sequences
  Synthetic
cgaagatagttttagggtgggcggcgg

SEQ ID NO: 10329 - DNA, 27 bp, Artificial Sequences
  Synthetic
agcgaagatagttttagggtgggcggc

SEQ ID NO: 10330 - DNA, 28 bp, Artificial Sequences
  Synthetic
cgaagatagttttagggtgggcggcggt

SEQ ID NO: 10331 - DNA, 27 bp, Artificial Sequences
  Synthetic
aagatagttttagggtgggcggcggtc

SEQ ID NO: 10332 - DNA, 30 bp, Artificial Sequences
  Synthetic
cggtggttgtggtttttgttttgttagcgg

SEQ ID NO: 10333 - DNA, 31 bp, Artificial Sequences
  Synthetic
cggtggttgtggtttttgttttgttagcggt

SEQ ID NO: 10334 - DNA, 31 bp, Artificial Sequences
  Synthetic
tcggtggttgtggtttttgttttgttagcgg

SEQ ID NO: 10335 - DNA, 32 bp, Artificial Sequences
  Synthetic
tcggtggttgtggtttttgttttgttagcggt

SEQ ID NO: 10336 - DNA, 29 bp, Artificial Sequences
  Synthetic
cggtggttgtggtttttgttttgttagcg

SEQ ID NO: 10337 - DNA, 27 bp, Artificial Sequences
  Synthetic
ggggttgcgggttggttgtttgggtag

SEQ ID NO: 10338 - DNA, 27 bp, Artificial Sequences
  Synthetic
tagtcgttgtggggatttcggttgcgc

SEQ ID NO: 10339 - DNA, 27 bp, Artificial Sequences
  Synthetic
gggttgcgggttggttgtttgggtagt

SEQ ID NO: 10340 - DNA, 26 bp, Artificial Sequences
  Synthetic
agtcgttgtggggatttcggttgcgc

SEQ ID NO: 10341 - DNA, 27 bp, Artificial Sequences
  Synthetic
gggggttgcgggttggttgtttgggta

SEQ ID NO: 10342 - DNA, 27 bp, Artificial Sequences
  Synthetic
aatgtggggttgggtgcgggattaggt

SEQ ID NO: 10343 - DNA, 27 bp, Artificial Sequences
  Synthetic
ggcgggttagtggggatagtggcgtag

SEQ ID NO: 10344 - DNA, 27 bp, Artificial Sequences
  Synthetic
agagaaaatgtggggttgggtgcggga

SEQ ID NO: 10345 - DNA, 27 bp, Artificial Sequences
  Synthetic
atgtggggttgggtgcgggattaggtg

SEQ ID NO: 10346 - DNA, 27 bp, Artificial Sequences
  Synthetic
ttggtaaattcggcgggcgggttagtg

SEQ ID NO: 10347 - DNA, 27 bp, Artificial Sequences
  Synthetic
atgtgggtggtcgtggttgtagggacg

SEQ ID NO: 10348 - DNA, 27 bp, Artificial Sequences
  Synthetic
agggtaaggaaagagggtgtcgcggtt

SEQ ID NO: 10349 - DNA, 28 bp, Artificial Sequences
  Synthetic
cgtagggtaaggaaagagggtgtcgcgg

SEQ ID NO: 10350 - DNA, 27 bp, Artificial Sequences
  Synthetic
gggtaaggaaagagggtgtcgcggttc

SEQ ID NO: 10351 - DNA, 26 bp, Artificial Sequences
  Synthetic
tgtgggtggtcgtggttgtagggacg

SEQ ID NO: 10352 - DNA, 34 bp, Artificial Sequences
  Synthetic
agtagtttcggagtttagatagcgttttgtgtga

SEQ ID NO: 10353 - DNA, 34 bp, Artificial Sequences
  Synthetic
agtttcggagtttagatagcgttttgtgtgattg

SEQ ID NO: 10354 - DNA, 34 bp, Artificial Sequences
  Synthetic
gtttcggagtttagatagcgttttgtgtgattga

SEQ ID NO: 10355 - DNA, 35 bp, Artificial Sequences
  Synthetic
agtttcggagtttagatagcgttttgtgtgattga

SEQ ID NO: 10356 - DNA, 35 bp, Artificial Sequences
  Synthetic
cggagtttagatagcgttttgtgtgattgatagga

SEQ ID NO: 10357 - DNA, 27 bp, Artificial Sequences
  Synthetic
agaggaggttcgattatttagcggcgt

SEQ ID NO: 10358 - DNA, 28 bp, Artificial Sequences
  Synthetic
agaggaggttcgattatttagcggcgtt

SEQ ID NO: 10359 - DNA, 28 bp, Artificial Sequences
  Synthetic
tgcgtgtaggaagggttttgtgaattcg

SEQ ID NO: 10360 - DNA, 29 bp, Artificial Sequences
  Synthetic
agaggaggttcgattatttagcggcgttt

SEQ ID NO: 10361 - DNA, 29 bp, Artificial Sequences
  Synthetic
ttgcgtgtaggaagggttttgtgaattcg

SEQ ID NO: 10362 - DNA, 26 bp, Artificial Sequences
  Synthetic
ggttgtcggcggtagtttgcgtagtc

SEQ ID NO: 10363 - DNA, 27 bp, Artificial Sequences
  Synthetic
tacggttttttaggcgcgtagtttcgg

SEQ ID NO: 10364 - DNA, 26 bp, Artificial Sequences
  Synthetic
acggttttttaggcgcgtagtttcgg

SEQ ID NO: 10365 - DNA, 25 bp, Artificial Sequences
  Synthetic
ggttgtcggcggtagtttgcgtagt

SEQ ID NO: 10366 - DNA, 28 bp, Artificial Sequences
  Synthetic
ttacggttttttaggcgcgtagtttcgg

SEQ ID NO: 10367 - DNA, 27 bp, Artificial Sequences
  Synthetic
tgaattcgggtgtttgggagaggaggt

SEQ ID NO: 10368 - DNA, 29 bp, Artificial Sequences
  Synthetic
tgtgaattcgggtgtttgggagaggaggt

SEQ ID NO: 10369 - DNA, 28 bp, Artificial Sequences
  Synthetic
gtgaattcgggtgtttgggagaggaggt

SEQ ID NO: 10370 - DNA, 28 bp, Artificial Sequences
  Synthetic
tgtgaattcgggtgtttgggagaggagg

SEQ ID NO: 10371 - DNA, 27 bp, Artificial Sequences
  Synthetic
gtgaattcgggtgtttgggagaggagg

SEQ ID NO: 10372 - DNA, 26 bp, Artificial Sequences
  Synthetic
ggttgtcggcggtagtttgcgtagtc

SEQ ID NO: 10373 - DNA, 25 bp, Artificial Sequences
  Synthetic
ggttgtcggcggtagtttgcgtagt

SEQ ID NO: 10374 - DNA, 25 bp, Artificial Sequences
  Synthetic
gttgtcggcggtagtttgcgtagtc

SEQ ID NO: 10375 - DNA, 24 bp, Artificial Sequences
  Synthetic
ggttgtcggcggtagtttgcgtag

SEQ ID NO: 10376 - DNA, 22 bp, Artificial Sequences
  Synthetic
gagtttgttcggggcggtggtc

SEQ ID NO: 10377 - DNA, 27 bp, Artificial Sequences
  Synthetic
tttgggaggtcgtagggtgaagcgtcg

SEQ ID NO: 10378 - DNA, 27 bp, Artificial Sequences
  Synthetic
cgtttgggaggtcgtagggtgaagcgt

SEQ ID NO: 10379 - DNA, 27 bp, Artificial Sequences
  Synthetic
acgcgtttgggaggtcgtagggtgaag

SEQ ID NO: 10380 - DNA, 27 bp, Artificial Sequences
  Synthetic
ggaggtcgtagggtgaagcgtcggttg

SEQ ID NO: 10381 - DNA, 27 bp, Artificial Sequences
  Synthetic
gcgtcggttgcgtaggttatcgtcggt

SEQ ID NO: 10382 - DNA, 22 bp, Artificial Sequences
  Synthetic
gagtttgttcggggcggtggtc

SEQ ID NO: 10383 - DNA, 27 bp, Artificial Sequences
  Synthetic
tttgggaggtcgtagggtgaagcgtcg

SEQ ID NO: 10384 - DNA, 27 bp, Artificial Sequences
  Synthetic
cgtttgggaggtcgtagggtgaagcgt

SEQ ID NO: 10385 - DNA, 27 bp, Artificial Sequences
  Synthetic
acgcgtttgggaggtcgtagggtgaag

SEQ ID NO: 10386 - DNA, 27 bp, Artificial Sequences
  Synthetic
ggaggtcgtagggtgaagcgtcggttg

SEQ ID NO: 10387 - DNA, 27 bp, Artificial Sequences
  Synthetic
gcgtcggttgcgtaggttatcgtcggt

SEQ ID NO: 10388 - DNA, 22 bp, Artificial Sequences
  Synthetic
gagtttgttcggggcggtggtt

SEQ ID NO: 10389 - DNA, 27 bp, Artificial Sequences
  Synthetic
tttttagttcggggtagggacgggcgg

SEQ ID NO: 10390 - DNA, 27 bp, Artificial Sequences
  Synthetic
gcgagttggggtagaggatttgcggga

SEQ ID NO: 10391 - DNA, 27 bp, Artificial Sequences
  Synthetic
gcggtcgcgagttggggtagaggattt

SEQ ID NO: 10392 - DNA, 27 bp, Artificial Sequences
  Synthetic
ggtcgcgagttggggtagaggatttgc

SEQ ID NO: 10393 - DNA, 27 bp, Artificial Sequences
  Synthetic
cggtcgcgagttggggtagaggatttg

SEQ ID NO: 10394 - DNA, 27 bp, Artificial Sequences
  Synthetic
tagtttgggtgttcgatgcggaggggt

SEQ ID NO: 10395 - DNA, 27 bp, Artificial Sequences
  Synthetic
ttcgatgcggaggggtttggtagagcg

SEQ ID NO: 10396 - DNA, 27 bp, Artificial Sequences
  Synthetic
gggtgttcgatgcggaggggtttggta

SEQ ID NO: 10397 - DNA, 27 bp, Artificial Sequences
  Synthetic
tttgggtgttcgatgcggaggggtttg

SEQ ID NO: 10398 - DNA, 27 bp, Artificial Sequences
  Synthetic
gatgcggaggggtttggtagagcggag

SEQ ID NO: 10399 - DNA, 29 bp, Artificial Sequences
  Synthetic
tttgagagtgtggtttttgggacgttagc

SEQ ID NO: 10400 - DNA, 30 bp, Artificial Sequences
  Synthetic
ttttgagagtgtggtttttgggacgttagc

SEQ ID NO: 10401 - DNA, 30 bp, Artificial Sequences
  Synthetic
agtttttgagagtgtggtttttgggacgtt

SEQ ID NO: 10402 - DNA, 30 bp, Artificial Sequences
  Synthetic
aagtttttgagagtgtggtttttgggacgt

SEQ ID NO: 10403 - DNA, 31 bp, Artificial Sequences
  Synthetic
tttttgagagtgtggtttttgggacgttagc

SEQ ID NO: 10404 - DNA, 30 bp, Artificial Sequences
  Synthetic
tgtaaggcgttatttgggtttgttagcgtt

SEQ ID NO: 10405 - DNA, 31 bp, Artificial Sequences
  Synthetic
atgtaaggcgttatttgggtttgttagcgtt

SEQ ID NO: 10406 - DNA, 31 bp, Artificial Sequences
  Synthetic
aatgtaaggcgttatttgggtttgttagcgt

SEQ ID NO: 10407 - DNA, 31 bp, Artificial Sequences
  Synthetic
agcgttttttggtttttcgtgtttgaggttt

SEQ ID NO: 10408 - DNA, 32 bp, Artificial Sequences
  Synthetic
tgtagcgttttttggtttttcgtgtttgaggt

SEQ ID NO: 10409 - DNA, 28 bp, Artificial Sequences
  Synthetic
agtagcgttttatattgtcgggcgagga

SEQ ID NO: 10410 - DNA, 29 bp, Artificial Sequences
  Synthetic
aagtagcgttttatattgtcgggcgagga

SEQ ID NO: 10411 - DNA, 29 bp, Artificial Sequences
  Synthetic
agtagcgttttatattgtcgggcgaggat

SEQ ID NO: 10412 - DNA, 29 bp, Artificial Sequences
  Synthetic
tttgagagtgtggtttttgggacgttagc

SEQ ID NO: 10413 - DNA, 30 bp, Artificial Sequences
  Synthetic
agtagcgttttatattgtcgggcgaggatt

SEQ ID NO: 10414 - DNA, 31 bp, Artificial Sequences; identical to SEQ ID NO: 10407
  Synthetic

SEQ ID NO: 10415 - DNA, 32 bp, Artificial Sequences; identical to SEQ ID NO: 10408
  Synthetic

SEQ ID NO: 10416 - DNA, 32 bp, Artificial Sequences
  Synthetic
agcgttttttggtttttcgtgtttgaggtttt

SEQ ID NO: 10417 - DNA, 32 bp, Artificial Sequences
  Synthetic
agttcggtcggttttttaatttggagtttggt

SEQ ID NO: 10418 - DNA, 32 bp, Artificial Sequences
  Synthetic
gtagcgttttttggtttttcgtgtttgaggtt

SEQ ID NO: 10419 - DNA, 25 bp, Artificial Sequences
  Synthetic
gcgttgtagaggcgtggaaggtgcg

SEQ ID NO: 10420 - DNA, 24 bp, Artificial Sequences
  Synthetic
gcgttgtagaggcgtggaaggtgc

SEQ ID NO: 10421 - DNA, 28 bp, Artificial Sequences
  Synthetic
agtagcgttttatattgtcgggcgagga

SEQ ID NO: 10422 - DNA, 28 bp, Artificial Sequences
  Synthetic
aggtcggtcgggttattagtggtagaga

SEQ ID NO: 10423 - DNA, 24 bp, Artificial Sequences
  Synthetic
cgttgtagaggcgtggaaggtgcg

SEQ ID NO: 10424 - DNA, 27 bp, Artificial Sequences
  Synthetic
agggtgggtgggagcgtggtaagtttt

SEQ ID NO: 10425 - DNA, 27 bp, Artificial Sequences
  Synthetic
gagggtgggtgggagcgtggtaagttt

SEQ ID NO: 10426 - DNA, 27 bp, Artificial Sequences
  Synthetic
gggtgggtgggagcgtggtaagttttt

SEQ ID NO: 10427 - DNA, 28 bp, Artificial Sequences
  Synthetic
agggtgggtgggagcgtggtaagttttt

SEQ ID NO: 10428 - DNA, 26 bp, Artificial Sequences
  Synthetic
gagggtgggtgggagcgtggtaagtt

SEQ ID NO: 10429 - DNA, 27 bp, Artificial Sequences
  Synthetic
tgtagaggcgtggaaggtgcgtttcgt

SEQ ID NO: 10430 - DNA, 27 bp, Artificial Sequences
  Synthetic
agaggcgtggaaggtgcgtttcgtttc

SEQ ID NO: 10431 - DNA, 27 bp, Artificial Sequences
  Synthetic
ggcgtggaaggtgcgtttcgtttcgtt

SEQ ID NO: 10432 - DNA, 27 bp, Artificial Sequences
  Synthetic
cgttgtagaggcgtggaaggtgcgttt

SEQ ID NO: 10433 - DNA, 27 bp, Artificial Sequences
  Synthetic
gaggcgtggaaggtgcgtttcgtttcg

SEQ ID NO: 10434 - DNA, 27 bp, Artificial Sequences
  Synthetic
tttttcgggatggagggtgggtgggag

SEQ ID NO: 10435 - DNA, 27 bp, Artificial Sequences
  Synthetic
agggtgggtgggagcgtggtaagtttt

SEQ ID NO: 10436 - DNA, 27 bp, Artificial Sequences
  Synthetic
gagggtgggtgggagcgtggtaagttt

SEQ ID NO: 10437 - DNA, 27 bp, Artificial Sequences
  Synthetic
ttttttcgggatggagggtgggtggga

SEQ ID NO: 10438 - DNA, 27 bp, Artificial Sequences
  Synthetic
gggtgggtgggagcgtggtaagttttt

SEQ ID NO: 10439 - DNA, 28 bp, Artificial Sequences
  Synthetic
tgggggcgatgggaaggatttgttacgt

SEQ ID NO: 10440 - DNA, 27 bp, Artificial Sequences
  Synthetic
gggggcgatgggaaggatttgttacgt

SEQ ID NO: 10441 - DNA, 27 bp, Artificial Sequences
  Synthetic
tgggggcgatgggaaggatttgttacg

SEQ ID NO: 10442 - DNA, 28 bp, Artificial Sequences
  Synthetic
gggggcgatgggaaggatttgttacgtt

SEQ ID NO: 10443 - DNA, 28 bp, Artificial Sequences
  Synthetic
ttgggggcgatgggaaggatttgttacg

SEQ ID NO: 10444 - DNA, 27 bp, Artificial Sequences
  Synthetic
agacggtggtgtaggagttagggaaga

SEQ ID NO: 10445 - DNA, 28 bp, Artificial Sequences
  Synthetic
acggtggtgtaggagttagggaagaagt

SEQ ID NO: 10446 - DNA, 28 bp, Artificial Sequences
  Synthetic
agacggtggtgtaggagttagggaagaa

SEQ ID NO: 10447 - DNA, 29 bp, Artificial Sequences
  Synthetic
gacggtggtgtaggagttagggaagaagt

SEQ ID NO: 10448 - DNA, 28 bp, Artificial Sequences
  Synthetic
gacggtggtgtaggagttagggaagaag

SEQ ID NO: 10449 - DNA, 27 bp, Artificial Sequences
  Synthetic
cgggttggcgttcgaattagagagtgt

SEQ ID NO: 10450 - DNA, 28 bp, Artificial Sequences
  Synthetic
tcgggttggcgttcgaattagagagtgt

SEQ ID NO: 10451 - DNA, 27 bp, Artificial Sequences
  Synthetic
tcgggttggcgttcgaattagagagtg

SEQ ID NO: 10452 - DNA, 28 bp, Artificial Sequences
  Synthetic
cgggttggcgttcgaattagagagtgta

SEQ ID NO: 10453 - DNA, 29 bp, Artificial Sequences
  Synthetic
tcgggttggcgttcgaattagagagtgta

SEQ ID NO: 10454 - DNA, 30 bp, Artificial Sequences
  Synthetic
agtttaggatcgagtaaggattgggaggga

SEQ ID NO: 10455 - DNA, 31 bp, Artificial Sequences
  Synthetic
aagtttaggatcgagtaaggattgggaggga

SEQ ID NO: 10456 - DNA, 31 bp, Artificial Sequences
  Synthetic
cgagtaaggattgggagggatagatagacgt

SEQ ID NO: 10457 - DNA, 31 bp, Artificial Sequences
  Synthetic
agtttaggatcgagtaaggattgggagggat

SEQ ID NO: 10458 - DNA, 31 bp, Artificial Sequences
  Synthetic
tcgagtaaggattgggagggatagatagacg

SEQ ID NO: 10459 - DNA, 27 bp, Artificial Sequences
  Synthetic
tagcgtgtgtgtggtgagggagtgacg

SEQ ID NO: 10460 - DNA, 27 bp, Artificial Sequences
  Synthetic
cgtgtgtgtggtgagggagtgacgagt

SEQ ID NO: 10461 - DNA, 27 bp, Artificial Sequences
  Synthetic
gcgtgtgtgtggtgagggagtgacgag

SEQ ID NO: 10462 - DNA, 28 bp, Artificial Sequences
  Synthetic
cgtgtgtgtggtgagggagtgacgagtt

SEQ ID NO: 10463 - DNA, 27 bp, Artificial Sequences
  Synthetic
tcgagatagcgtgtgtgtggtgaggga

SEQ ID NO: 10464 - DNA, 27 bp, Artificial Sequences
  Synthetic
gcgggtggttgtaggggcgttgttttt

SEQ ID NO: 10465 - DNA, 26 bp, Artificial Sequences
  Synthetic
gcgggtggttgtaggggcgttgtttt

SEQ ID NO: 10466 - DNA, 28 bp, Artificial Sequences
  Synthetic
gcgggtggttgtaggggcgttgtttttt

SEQ ID NO: 10467 - DNA, 27 bp, Artificial Sequences
  Synthetic
cgggtggttgtaggggcgttgtttttt

SEQ ID NO: 10468 - DNA, 25 bp, Artificial Sequences
  Synthetic
gcgggtggttgtaggggcgttgttt

SEQ ID NO: 10469 - DNA, 27 bp, Artificial Sequences
  Synthetic
tagcgtgtgtgtggtgagggagtgacg

SEQ ID NO: 10470 - DNA, 27 bp, Artificial Sequences
  Synthetic
cgtgtgtgtggtgagggagtgacgagt

SEQ ID NO: 10471 - DNA, 27 bp, Artificial Sequences
  Synthetic
ggagacgtagaggttcgcgcggatgtt

SEQ ID NO: 10472 - DNA, 27 bp, Artificial Sequences
  Synthetic
aggttcgcgcggatgtttagaggagga

SEQ ID NO: 10473 - DNA, 27 bp, Artificial Sequences
  Synthetic
gcgtgtgtgtggtgagggagtgacgag

SEQ ID NO: 10474 - DNA, 27 bp, Artificial Sequences
  Synthetic
ttggttttgggtttcgcgggtggttgt

SEQ ID NO: 10475 - DNA, 27 bp, Artificial Sequences
  Synthetic
gcgggtggttgtaggggcgttgttttt

SEQ ID NO: 10476 - DNA, 27 bp, Artificial Sequences
  Synthetic
ttttgggtttcgcgggtggttgtaggg

SEQ ID NO: 10477 - DNA, 27 bp, Artificial Sequences
  Synthetic
tggttttgggtttcgcgggtggttgta

SEQ ID NO: 10478 - DNA, 27 bp, Artificial Sequences
  Synthetic
tttgggtttcgcgggtggttgtagggg

SEQ ID NO: 10479 - DNA, 27 bp, Artificial Sequences
  Synthetic
aggttcgcgcggatgtttagaggagga

SEQ ID NO: 10480 - DNA, 27 bp, Artificial Sequences
  Synthetic
gaggttcgcgcggatgtttagaggagg

SEQ ID NO: 10481 - DNA, 27 bp, Artificial Sequences
  Synthetic
gagacgtagaggttcgcgcggatgttt

SEQ ID NO: 10482 - DNA, 28 bp, Artificial Sequences
  Synthetic
agaggttcgcgcggatgtttagaggagg

SEQ ID NO: 10483 - DNA, 28 bp, Artificial Sequences
  Synthetic
gaggttcgcgcggatgtttagaggagga

SEQ ID NO: 10484 - DNA, 27 bp, Artificial Sequences
  Synthetic
tcggtgatgtggggtcgtggaattcgt

SEQ ID NO: 10485 - DNA, 27 bp, Artificial Sequences
  Synthetic
cggtgatgtggggtcgtggaattcgtt

SEQ ID NO: 10486 - DNA, 28 bp, Artificial Sequences
  Synthetic
tcggtgatgtggggtcgtggaattcgtt

SEQ ID NO: 10487 - DNA, 28 bp, Artificial Sequences
  Synthetic
ttcggtgatgtggggtcgtggaattcgt

SEQ ID NO: 10488 - DNA, 27 bp, Artificial Sequences
  Synthetic
ttcggtgatgtggggtcgtggaattcg

SEQ ID NO: 10489 - DNA, 27 bp, Artificial Sequences
  Synthetic
gcgttggggttgttcggcgatgatgat

SEQ ID NO: 10490 - DNA, 27 bp, Artificial Sequences
  Synthetic
ggtcggggtagagggagggttttcgtt

SEQ ID NO: 10491 - DNA, 27 bp, Artificial Sequences
  Synthetic
aggggtcggggtagagggagggttttc

SEQ ID NO: 10492 - DNA, 27 bp, Artificial Sequences
  Synthetic
gaggggtcggggtagagggagggtttt

SEQ ID NO: 10493 - DNA, 27 bp, Artificial Sequences
  Synthetic
tacgtcggttatattcgggcgcgcgtc

SEQ ID NO: 10494 - DNA, 27 bp, Artificial Sequences
  Synthetic
aggggagtagttgcgggtattcgtggc

SEQ ID NO: 10495 - DNA, 27 bp, Artificial Sequences
  Synthetic
cggggcggttcgggcggagtatttata

SEQ ID NO: 10496 - DNA, 27 bp, Artificial Sequences
  Synthetic
gttttgttcggggcgtgcgggtatgag

SEQ ID NO: 10497 - DNA, 27 bp, Artificial Sequences
  Synthetic
ggttgggggtggggaggcgaagatttt

SEQ ID NO: 10498 - DNA, 27 bp, Artificial Sequences
  Synthetic
gttgggggtggggaggcgaagattttt

SEQ ID NO: 10499 - DNA, 27 bp, Artificial Sequences
  Synthetic
ttcggggaggaggagaggatgttcggg

SEQ ID NO: 10500 - DNA, 27 bp, Artificial Sequences
  Synthetic
cggggaggaggagaggatgttcgggtt

SEQ ID NO: 10501 - DNA, 27 bp, Artificial Sequences
  Synthetic
ggggaggaggagaggatgttcgggttt

SEQ ID NO: 10502 - DNA, 27 bp, Artificial Sequences
  Synthetic
tttcggggaggaggagaggatgttcgg

SEQ ID NO: 10503 - DNA, 26 bp, Artificial Sequences
  Synthetic
tcggggaggaggagaggatgttcggg

SEQ ID NO: 10504 - DNA, 28 bp, Artificial Sequences
  Synthetic
cgggggtgtagaggaaagatgttgacgg

SEQ ID NO: 10505 - DNA, 29 bp, Artificial Sequences
  Synthetic
cgggggtgtagaggaaagatgttgacggt

SEQ ID NO: 10506 - DNA, 29 bp, Artificial Sequences
  Synthetic
tcgggggtgtagaggaaagatgttgacgg

SEQ ID NO: 10507 - DNA, 27 bp, Artificial Sequences
  Synthetic
tgtgtcgggggtgtagaggaaagatgt

SEQ ID NO: 10508 - DNA, 27 bp, Artificial Sequences
  Synthetic
cgggggtgtagaggaaagatgttgacg

SEQ ID NO: 10509 - DNA, 27 bp, Artificial Sequences
  Synthetic
gcgtttgtggttgggtagatggcgtgg

SEQ ID NO: 10510 - DNA, 27 bp, Artificial Sequences
  Synthetic
tgcgtttgtggttgggtagatggcgtg

SEQ ID NO: 10511 - DNA, 27 bp, Artificial Sequences
  Synthetic
cgtttgtggttgggtagatggcgtggt

SEQ ID NO: 10512 - DNA, 27 bp, Artificial Sequences
  Synthetic
ttgcgtttgtggttgggtagatggcgt

SEQ ID NO: 10513 - DNA, 27 bp, Artificial Sequences
  Synthetic
ttcgggtagttgcgtttgtggttgggt

SEQ ID NO: 10514 - DNA, 27 bp, Artificial Sequences
  Synthetic
agtgggggtaggtgaggttgggaggtt

SEQ ID NO: 10515 - DNA, 27 bp, Artificial Sequences
  Synthetic
aagtgggggtaggtgaggttgggaggt

SEQ ID NO: 10516 - DNA, 27 bp, Artificial Sequences
  Synthetic
gtgggggtaggtgaggttgggaggttt

SEQ ID NO: 10517 - DNA, 27 bp, Artificial Sequences
  Synthetic
aaagtgggggtaggtgaggttgggagg

SEQ ID NO: 10518 - DNA, 26 bp, Artificial Sequences
  Synthetic
agtgggggtaggtgaggttgggaggt

SEQ ID NO: 10519 - DNA, 27 bp, Artificial Sequences
  Synthetic
gttgcgacgtggtttaggagtttgcgt

SEQ ID NO: 10520 - DNA, 27 bp, Artificial Sequences
  Synthetic
agcggggtggttggtattgtttttcga

SEQ ID NO: 10521 - DNA, 28 bp, Artificial Sequences
  Synthetic
gcggggtggttggtattgtttttcgagt

SEQ ID NO: 10522 - DNA, 27 bp, Artificial Sequences
  Synthetic
gcggggtggttggtattgtttttcgag

SEQ ID NO: 10523 - DNA, 29 bp, Artificial Sequences
  Synthetic
agcggggtggttggtattgtttttcgagt

SEQ ID NO: 10524 - DNA, 27 bp, Artificial Sequences
  Synthetic
ttcgggaggttagcgaggggtaggtgt

SEQ ID NO: 10525 - DNA, 27 bp, Artificial Sequences
  Synthetic
gttcgggaggttagcgaggggtaggtg

SEQ ID NO: 10526 - DNA, 27 bp, Artificial Sequences
  Synthetic
tcgggaggttagcgaggggtaggtgtc

SEQ ID NO: 10527 - DNA, 26 bp, Artificial Sequences
  Synthetic
tcgggaggttagcgaggggtaggtgt

SEQ ID NO: 10528 - DNA, 26 bp, Artificial Sequences
  Synthetic
cgggaggttagcgaggggtaggtgtc

SEQ ID NO: 10529 - DNA, 30 bp, Artificial Sequences
  Synthetic
gtcgttgagttttgaagaggttaatgcggt

SEQ ID NO: 10530 - DNA, 30 bp, Artificial Sequences
  Synthetic
tcgttgagttttgaagaggttaatgcggtg

SEQ ID NO: 10531 - DNA, 30 bp, Artificial Sequences
  Synthetic
tgtcgttgagttttgaagaggttaatgcgg

SEQ ID NO: 10532 - DNA, 31 bp, Artificial Sequences
  Synthetic
tgtcgttgagttttgaagaggttaatgcggt

SEQ ID NO: 10533 - DNA, 31 bp, Artificial Sequences
  Synthetic
cgttgagttttgaagaggttaatgcggtgac

SEQ ID NO: 10534 - DNA, 27 bp, Artificial Sequences
  Synthetic
ttcgggaggttagcgaggggtaggtgt

SEQ ID NO: 10535 - DNA, 27 bp, Artificial Sequences
  Synthetic
gttcgggaggttagcgaggggtaggtg

SEQ ID NO: 10536 - DNA, 27 bp, Artificial Sequences
  Synthetic
tcgggaggttagcgaggggtaggtgtc

SEQ ID NO: 10537 - DNA, 27 bp, Artificial Sequences
  Synthetic
ggttcgggaggttagcgaggggtaggt

SEQ ID NO: 10538 - DNA, 26 bp, Artificial Sequences
  Synthetic
tcgggaggttagcgaggggtaggtgt

SEQ ID NO: 10539 - DNA, 27 bp, Artificial Sequences
  Synthetic
tttcgttggtttttcgggtcgttgcgc

SEQ ID NO: 10540 - DNA, 28 bp, Artificial Sequences
  Synthetic
ttttcgttggtttttcgggtcgttgcgc

SEQ ID NO: 10541 - DNA, 26 bp, Artificial Sequences
  Synthetic
ttcgttggtttttcgggtcgttgcgc

SEQ ID NO: 10542 - DNA, 27 bp, Artificial Sequences
  Synthetic
ttttcgttggtttttcgggtcgttgcg

SEQ ID NO: 10543 - DNA, 29 bp, Artificial Sequences
  Synthetic
tttttcgttggtttttcgggtcgttgcgc

SEQ ID NO: 10544 - DNA, 26 bp, Artificial Sequences
  Synthetic
gtagtcggggtaggggtaggcgaggg

SEQ ID NO: 10545 - DNA, 26 bp, Artificial Sequences
  Synthetic
cgtagtcggggtaggggtaggcgagg

SEQ ID NO: 10546 - DNA, 25 bp, Artificial Sequences
  Synthetic
tagtcggggtaggggtaggcgaggg

SEQ ID NO: 10547 - DNA, 27 bp, Artificial Sequences
  Synthetic
gtagtcggggtaggggtaggcgagggg

SEQ ID NO: 10548 - DNA, 27 bp, Artificial Sequences
  Synthetic
cgtagtcggggtaggggtaggcgaggg

SEQ ID NO: 10549 - DNA, 28 bp, Artificial Sequences
  Synthetic
cgtttgtttttgtttcggttgcgcggtc

SEQ ID NO: 10550 - DNA, 27 bp, Artificial Sequences
  Synthetic
gtttgtttttgtttcggttgcgcggtc

SEQ ID NO: 10551 - DNA, 26 bp, Artificial Sequences
  Synthetic
gtttgtttttgtttcggttgcgcggt

SEQ ID NO: 10552 - DNA, 26 bp, Artificial Sequences
  Synthetic
tttgtttttgtttcggttgcgcggtc

SEQ ID NO: 10553 - DNA, 25 bp, Artificial Sequences
  Synthetic
ttgtttttgtttcggttgcgcggtc

SEQ ID NO: 10554 - DNA, 29 bp, Artificial Sequences
  Synthetic
tgggttaattgattaggagtcggtcgcgt

SEQ ID NO: 10555 - DNA, 28 bp, Artificial Sequences
  Synthetic
gggttaattgattaggagtcggtcgcgt

SEQ ID NO: 10556 - DNA, 28 bp, Artificial Sequences
  Synthetic
tgggttaattgattaggagtcggtcgcg

SEQ ID NO: 10557 - DNA, 29 bp, Artificial Sequences
  Synthetic
atgggttaattgattaggagtcggtcgcg

SEQ ID NO: 10558 - DNA, 30 bp, Artificial Sequences
  Synthetic
atgggttaattgattaggagtcggtcgcgt

SEQ ID NO: 10559 - DNA, 27 bp, Artificial Sequences
  Synthetic
cgtttgtttttgtttcggttgcgcggt

SEQ ID NO: 10560 - DNA, 27 bp, Artificial Sequences
  Synthetic
tcgtttgtttttgtttcggttgcgcgg

SEQ ID NO: 10561 - DNA, 28 bp, Artificial Sequences
  Synthetic
tcgtttgtttttgtttcggttgcgcggt

SEQ ID NO: 10562 - DNA, 28 bp, Artificial Sequences
  Synthetic
cgtttgtttttgtttcggttgcgcggtc

SEQ ID NO: 10563 - DNA, 29 bp, Artificial Sequences
  Synthetic
tcgtttgtttttgtttcggttgcgcggtc

SEQ ID NO: 10564 - DNA, 34 bp, Artificial Sequences
  Synthetic
agggtgttttttaagtgtagttaagggtgagtgg

SEQ ID NO: 10565 - DNA, 34 bp, Artificial Sequences
  Synthetic
gggtgttttttaagtgtagttaagggtgagtgga

SEQ ID NO: 10566 - DNA, 35 bp, Artificial Sequences
  Synthetic
agggtgttttttaagtgtagttaagggtgagtgga

SEQ ID NO: 10567 - DNA, 35 bp, Artificial Sequences
  Synthetic
gggtgttttttaagtgtagttaagggtgagtggag

SEQ ID NO: 10568 - DNA, 36 bp, Artificial Sequences
  Synthetic
agggtgttttttaagtgtagttaagggtgagtggag

SEQ ID NO: 10569 - DNA, 27 bp, Artificial Sequences
  Synthetic
agggaattgggcgcggtgaggtagttt

SEQ ID NO: 10570 - DNA, 27 bp, Artificial Sequences
  Synthetic
gagggaattgggcgcggtgaggtagtt

SEQ ID NO: 10571 - DNA, 27 bp, Artificial Sequences
  Synthetic
gagagggaattgggcgcggtgaggtag

SEQ ID NO: 10572 - DNA, 27 bp, Artificial Sequences
  Synthetic
gggaattgggcgcggtgaggtagtttt

SEQ ID NO: 10573 - DNA, 28 bp, Artificial Sequences
  Synthetic
gggaattgggcgcggtgaggtagttttg

SEQ ID NO: 10574 - DNA, 27 bp, Artificial Sequences
  Synthetic
ttggagaggaagtgcgcggtatagggt

SEQ ID NO: 10575 - DNA, 27 bp, Artificial Sequences
  Synthetic
tggagaggaagtgcgcggtatagggta

SEQ ID NO: 10576 - DNA, 27 bp, Artificial Sequences
  Synthetic
tttgttatcggtcgggtagttgggcgt

SEQ ID NO: 10577 - DNA, 28 bp, Artificial Sequences
  Synthetic
tttggagaggaagtgcgcggtatagggt

SEQ ID NO: 10578 - DNA, 27 bp, Artificial Sequences
  Synthetic
tttggagaggaagtgcgcggtataggg

SEQ ID NO: 10579 - DNA, 27 bp, Artificial Sequences
  Synthetic
agggaattgggcgcggtgaggtagttt

SEQ ID NO: 10580 - DNA, 27 bp, Artificial Sequences
  Synthetic
gagggaattgggcgcggtgaggtagtt

SEQ ID NO: 10581 - DNA, 27 bp, Artificial Sequences
  Synthetic
gagagggaattgggcgcggtgaggtag

SEQ ID NO: 10582 - DNA, 27 bp, Artificial Sequences
  Synthetic
gggaattgggcgcggtgaggtagtttt

SEQ ID NO: 10583 - DNA, 28 bp, Artificial Sequences
  Synthetic
gggaattgggcgcggtgaggtagttttg

SEQ ID NO: 10584 - DNA, 27 bp, Artificial Sequences
  Synthetic
gcggtcgtaggtgttagggcgaggaag

SEQ ID NO: 10585 - DNA, 27 bp, Artificial Sequences
  Synthetic
cggtcgtaggtgttagggcgaggaagt

SEQ ID NO: 10586 - DNA, 26 bp, Artificial Sequences
  Synthetic
gcggtcgtaggtgttagggcgaggaa

SEQ ID NO: 10587 - DNA, 28 bp, Artificial Sequences
  Synthetic
cggtcgtaggtgttagggcgaggaagtt

SEQ ID NO: 10588 - DNA, 28 bp, Artificial Sequences
  Synthetic
gcggtcgcgtgttagtcggtgatttagt

SEQ ID NO: 10589 - DNA, 27 bp, Artificial Sequences
  Synthetic
ggggttgggagggcgttgtatcgagag

SEQ ID NO: 10590 - DNA, 27 bp, Artificial Sequences
  Synthetic
cgtaggggttgggagggcgttgtatcg

SEQ ID NO: 10591 - DNA, 27 bp, Artificial Sequences
  Synthetic
gtaggggttgggagggcgttgtatcga

SEQ ID NO: 10592 - DNA, 27 bp, Artificial Sequences
  Synthetic
taggggttgggagggcgttgtatcgag

SEQ ID NO: 10593 - DNA, 27 bp, Artificial Sequences
  Synthetic
gcgtaggggttgggagggcgttgtatc

SEQ ID NO: 10594 - DNA, 27 bp, Artificial Sequences
  Synthetic
aggtcggaggagttcgttttaggtggt

SEQ ID NO: 10595 - DNA, 28 bp, Artificial Sequences
  Synthetic
ggtcggaggagttcgttttaggtggtgt

SEQ ID NO: 10596 - DNA, 27 bp, Artificial Sequences
  Synthetic
ggtcggaggagttcgttttaggtggtg

SEQ ID NO: 10597 - DNA, 29 bp, Artificial Sequences
  Synthetic
aggtcggaggagttcgttttaggtggtgt

SEQ ID NO: 10598 - DNA, 28 bp, Artificial Sequences
  Synthetic
aggtcggaggagttcgttttaggtggtg

SEQ ID NO: 10599 - DNA, 27 bp, Artificial Sequences
  Synthetic
ttttttatcgggggtgtaggtgcgcgg

SEQ ID NO: 10600 - DNA, 27 bp, Artificial Sequences
  Synthetic
tttttatcgggggtgtaggtgcgcggg

SEQ ID NO: 10601 - DNA, 26 bp, Artificial Sequences
  Synthetic
tttttatcgggggtgtaggtgcgcgg

SEQ ID NO: 10602 - DNA, 26 bp, Artificial Sequences
  Synthetic
ttttatcgggggtgtaggtgcgcggg

SEQ ID NO: 10603 - DNA, 27 bp, Artificial Sequences
  Synthetic
ttttatcgggggtgtaggtgcgcgggt

SEQ ID NO: 10604 - DNA, 31 bp, Artificial Sequences
  Synthetic
agatttttgattttttggtggttcgcgagga

SEQ ID NO: 10605 - DNA, 31 bp, Artificial Sequences
  Synthetic
cggtagatttttgattttttggtggttcgcg

SEQ ID NO: 10606 - DNA, 32 bp, Artificial Sequences
  Synthetic
acggtagatttttgattttttggtggttcgcg

SEQ ID NO: 10607 - DNA, 32 bp, Artificial Sequences
  Synthetic
cggtagatttttgattttttggtggttcgcga

SEQ ID NO: 10608 - DNA, 33 bp, Artificial Sequences
  Synthetic
acggtagatttttgattttttggtggttcgcga

SEQ ID NO: 10609 - DNA, 27 bp, Artificial Sequences
  Synthetic
ttttttatcgggggtgtaggtgcgcgg

SEQ ID NO: 10610 - DNA, 27 bp, Artificial Sequences
  Synthetic
tttttatcgggggtgtaggtgcgcggg

SEQ ID NO: 10611 - DNA, 26 bp, Artificial Sequences
  Synthetic
tttttatcgggggtgtaggtgcgcgg

SEQ ID NO: 10612 - DNA, 26 bp, Artificial Sequences
  Synthetic
ttttatcgggggtgtaggtgcgcggg

SEQ ID NO: 10613 - DNA, 27 bp, Artificial Sequences
  Synthetic
ttttatcgggggtgtaggtgcgcgggt

SEQ ID NO: 10614 - DNA, 27 bp, Artificial Sequences
  Synthetic
cggcgggtaggggtgcgttgatattcg

SEQ ID NO: 10615 - DNA, 27 bp, Artificial Sequences
  Synthetic
gcggcgggtaggggtgcgttgatattc

SEQ ID NO: 10616 - DNA, 26 bp, Artificial Sequences
  Synthetic
ggcgggtaggggtgcgttgatattcg

SEQ ID NO: 10617 - DNA, 26 bp, Artificial Sequences
  Synthetic
cggcgggtaggggtgcgttgatattc

SEQ ID NO: 10618 - DNA, 26 bp, Artificial Sequences
  Synthetic
gcggcgggtaggggtgcgttgatatt

SEQ ID NO: 10619 - DNA, 27 bp, Artificial Sequences
  Synthetic
ttttttatcgggggtgtaggtgcgcgg

SEQ ID NO: 10620 - DNA, 27 bp, Artificial Sequences
  Synthetic
tttttatcgggggtgtaggtgcgcggg

SEQ ID NO: 10621 - DNA, 26 bp, Artificial Sequences
  Synthetic
tttttatcgggggtgtaggtgcgcgg

SEQ ID NO: 10622 - DNA, 26 bp, Artificial Sequences
  Synthetic
ttttatcgggggtgtaggtgcgcggg

SEQ ID NO: 10623 - DNA, 27 bp, Artificial Sequences
  Synthetic
ttttatcgggggtgtaggtgcgcgggt

SEQ ID NO: 10624 - DNA, 27 bp, Artificial Sequences
  Synthetic
cggcgggtaggggtgcgttgatattcg

SEQ ID NO: 10625 - DNA, 27 bp, Artificial Sequences
  Synthetic
gcggcgggtaggggtgcgttgatattc

SEQ ID NO: 10626 - DNA, 26 bp, Artificial Sequences
  Synthetic
ggcgggtaggggtgcgttgatattcg

SEQ ID NO: 10627 - DNA, 26 bp, Artificial Sequences
  Synthetic
cggcgggtaggggtgcgttgatattc

SEQ ID NO: 10628 - DNA, 26 bp, Artificial Sequences
  Synthetic
gcggcgggtaggggtgcgttgatatt

SEQ ID NO: 10629 - DNA, 27 bp, Artificial Sequences
  Synthetic
tcgcgggatttacgagggattggtatc

SEQ ID NO: 10630 - DNA, 28 bp, Artificial Sequences
  Synthetic
gggagttttttcgcgtcgttttttgggt

SEQ ID NO: 10631 - DNA, 27 bp, Artificial Sequences
  Synthetic
gggagttttttcgcgtcgttttttggg

SEQ ID NO: 10632 - DNA, 29 bp, Artificial Sequences
  Synthetic
gggagttttttcgcgtcgttttttgggtt

SEQ ID NO: 10633 - DNA, 28 bp, Artificial Sequences
  Synthetic
ggagttttttcgcgtcgttttttgggtt

SEQ ID NO: 10634 - DNA, 27 bp, Artificial Sequences
  Synthetic
cggcgggtaggggtgcgttgatattcg

SEQ ID NO: 10635 - DNA, 27 bp, Artificial Sequences
  Synthetic
gcggcgggtaggggtgcgttgatattc

SEQ ID NO: 10636 - DNA, 26 bp, Artificial Sequences
  Synthetic
ggcgggtaggggtgcgttgatattcg

SEQ ID NO: 10637 - DNA, 26 bp, Artificial Sequences
  Synthetic
cggcgggtaggggtgcgttgatattc

SEQ ID NO: 10638 - DNA, 26 bp, Artificial Sequences
  Synthetic
gcggcgggtaggggtgcgttgatatt

SEQ ID NO: 10639 - DNA, 28 bp, Artificial Sequences
  Synthetic
gggagttttttcgcgtcgttttttgggt

SEQ ID NO: 10640 - DNA, 27 bp, Artificial Sequences
  Synthetic
gggagttttttcgcgtcgttttttggg

SEQ ID NO: 10641 - DNA, 29 bp, Artificial Sequences
  Synthetic
gggagttttttcgcgtcgttttttgggtt

SEQ ID NO: 10642 - DNA, 28 bp, Artificial Sequences
  Synthetic
ggagttttttcgcgtcgttttttgggtt

SEQ ID NO: 10643 - DNA, 30 bp, Artificial Sequences
  Synthetic
gggagttttttcgcgtcgttttttgggttt

SEQ ID NO: 10644 - DNA, 27 bp, Artificial Sequences
  Synthetic
cggcgggtaggggtgcgttgatattcg

SEQ ID NO: 10645 - DNA, 27 bp, Artificial Sequences
  Synthetic
gcggcgggtaggggtgcgttgatattc

SEQ ID NO: 10646 - DNA, 27 bp, Artificial Sequences
  Synthetic
ttcgcgaaagaggggttagggggtttc

SEQ ID NO: 10647 - DNA, 26 bp, Artificial Sequences
  Synthetic
ggcgggtaggggtgcgttgatattcg

SEQ ID NO: 10648 - DNA, 26 bp, Artificial Sequences
  Synthetic
cggcgggtaggggtgcgttgatattc

SEQ ID NO: 10649 - DNA, 28 bp, Artificial Sequences
  Synthetic
gggagttttttcgcgtcgttttttgggt

SEQ ID NO: 10650 - DNA, 27 bp, Artificial Sequences
  Synthetic
gggagttttttcgcgtcgttttttggg

SEQ ID NO: 10651 - DNA, 29 bp, Artificial Sequences
  Synthetic
gggagttttttcgcgtcgttttttgggtt

SEQ ID NO: 10652 - DNA, 28 bp, Artificial Sequences
  Synthetic
ggagttttttcgcgtcgttttttgggtt

SEQ ID NO: 10653 - DNA, 30 bp, Artificial Sequences; identical to SEQ ID NO: 10643
  Synthetic

SEQ ID NO: 10654 - DNA, 27 bp, Artificial Sequences
  Synthetic
cggggcgtagaagggggttaggtagga

SEQ ID NO: 10655 - DNA, 27 bp, Artificial Sequences
  Synthetic
ggggtttcggatttatagacgcggggc

SEQ ID NO: 10656 - DNA, 26 bp, Artificial Sequences
  Synthetic
gcggggcgtagaagggggttaggtag

SEQ ID NO: 10657 - DNA, 27 bp, Artificial Sequences
  Synthetic
gggggtttcggatttatagacgcgggg

SEQ ID NO: 10658 - DNA, 28 bp, Artificial Sequences
  Synthetic
agggggtttcggatttatagacgcgggg

SEQ ID NO: 10659 - DNA, 27 bp, Artificial Sequences
  Synthetic
cggggcgtagaagggggttaggtagga

SEQ ID NO: 10660 - DNA, 27 bp, Artificial Sequences
  Synthetic
ggggtttcggatttatagacgcggggc

SEQ ID NO: 10661 - DNA, 26 bp, Artificial Sequences
  Synthetic
gcggggcgtagaagggggttaggtag

SEQ ID NO: 10662 - DNA, 27 bp, Artificial Sequences
  Synthetic
gggggtttcggatttatagacgcgggg

SEQ ID NO: 10663 - DNA, 28 bp, Artificial Sequences
  Synthetic
agggggtttcggatttatagacgcgggg

SEQ ID NO: 10664 - DNA, 27 bp, Artificial Sequences
  Synthetic
taggtggggggtggcgcgttttagtta

SEQ ID NO: 10665 - DNA, 27 bp, Artificial Sequences
  Synthetic
ggcggttcggggggtagttttggtttt

SEQ ID NO: 10666 - DNA, 27 bp, Artificial Sequences
  Synthetic
aggtggggggtggcgcgttttagttag

SEQ ID NO: 10667 - DNA, 27 bp, Artificial Sequences
  Synthetic
gtaggtggggggtggcgcgttttagtt

SEQ ID NO: 10668 - DNA, 28 bp, Artificial Sequences
  Synthetic
taggtggggggtggcgcgttttagttag

SEQ ID NO: 10669 - DNA, 27 bp, Artificial Sequences
  Synthetic
cggggcgtagaagggggttaggtagga

SEQ ID NO: 10670 - DNA, 27 bp, Artificial Sequences
  Synthetic
ggcggacgggaagaggatattggtcgc

SEQ ID NO: 10671 - DNA, 27 bp, Artificial Sequences
  Synthetic
tggtcgcggagtaggaggggaaagttt

SEQ ID NO: 10672 - DNA, 27 bp, Artificial Sequences
  Synthetic
ttggtcgcggagtaggaggggaaagtt

SEQ ID NO: 10673 - DNA, 27 bp, Artificial Sequences
  Synthetic
attggtcgcggagtaggaggggaaagt

SEQ ID NO: 10674 - DNA, 27 bp, Artificial Sequences
  Synthetic
taggtggggggtggcgcgttttagtta

SEQ ID NO: 10675 - DNA, 27 bp, Artificial Sequences
  Synthetic
ggcggttcggggggtagttttggtttt

SEQ ID NO: 10676 - DNA, 27 bp, Artificial Sequences
  Synthetic
aggtggggggtggcgcgttttagttag

SEQ ID NO: 10677 - DNA, 27 bp, Artificial Sequences
  Synthetic
gtaggtggggggtggcgcgttttagtt

SEQ ID NO: 10678 - DNA, 28 bp, Artificial Sequences
  Synthetic
taggtggggggtggcgcgttttagttag

SEQ ID NO: 10679 - DNA, 27 bp, Artificial Sequences
  Synthetic
ggcggacgggaagaggatattggtcgc

SEQ ID NO: 10680 - DNA, 27 bp, Artificial Sequences
  Synthetic
tggtcgcggagtaggaggggaaagttt

SEQ ID NO: 10681 - DNA, 27 bp, Artificial Sequences
  Synthetic
ttggtcgcggagtaggaggggaaagtt

SEQ ID NO: 10682 - DNA, 27 bp, Artificial Sequences
  Synthetic
attggtcgcggagtaggaggggaaagt

SEQ ID NO: 10683 - DNA, 27 bp, Artificial Sequences
  Synthetic
tcgcggagtaggaggggaaagtttgga

SEQ ID NO: 10684 - DNA, 27 bp, Artificial Sequences
  Synthetic
taggtggggggtggcgcgttttagtta

SEQ ID NO: 10685 - DNA, 27 bp, Artificial Sequences
  Synthetic
aggtggggggtggcgcgttttagttag

SEQ ID NO: 10686 - DNA, 27 bp, Artificial Sequences
  Synthetic
gtaggtggggggtggcgcgttttagtt

SEQ ID NO: 10687 - DNA, 28 bp, Artificial Sequences
  Synthetic
taggtggggggtggcgcgttttagttag

SEQ ID NO: 10688 - DNA, 28 bp, Artificial Sequences
  Synthetic
gtaggtggggggtggcgcgttttagtta

SEQ ID NO: 10689 - DNA, 27 bp, Artificial Sequences
  Synthetic
tttttcgtcgtttttggttggggcgcg

SEQ ID NO: 10690 - DNA, 27 bp, Artificial Sequences
  Synthetic
ggcggacgggaagaggatattggtcgc

SEQ ID NO: 10691 - DNA, 27 bp, Artificial Sequences
  Synthetic
tggtcgcggagtaggaggggaaagttt

SEQ ID NO: 10692 - DNA, 27 bp, Artificial Sequences
  Synthetic
ttggtcgcggagtaggaggggaaagtt

SEQ ID NO: 10693 - DNA, 27 bp, Artificial Sequences
  Synthetic
attggtcgcggagtaggaggggaaagt

SEQ ID NO: 10694 - DNA, 27 bp, Artificial Sequences
  Synthetic
taggtggggggtggcgcgttttagtta

SEQ ID NO: 10695 - DNA, 27 bp, Artificial Sequences
  Synthetic
aggtggggggtggcgcgttttagttag

SEQ ID NO: 10696 - DNA, 27 bp, Artificial Sequences
  Synthetic
gtaggtggggggtggcgcgttttagtt

SEQ ID NO: 10697 - DNA, 28 bp, Artificial Sequences
  Synthetic
taggtggggggtggcgcgttttagttag

SEQ ID NO: 10698 - DNA, 28 bp, Artificial Sequences
  Synthetic
gtaggtggggggtggcgcgttttagtta

SEQ ID NO: 10699 - DNA, 27 bp, Artificial Sequences
  Synthetic
ttcgtcgtttttggttggggcgcgtta

SEQ ID NO: 10700 - DNA, 27 bp, Artificial Sequences
  Synthetic
tcgtcgtttttggttggggcgcgttat

SEQ ID NO: 10701 - DNA, 27 bp, Artificial Sequences
  Synthetic
tttttcgtcgtttttggttggggcgcg

SEQ ID NO: 10702 - DNA, 27 bp, Artificial Sequences
  Synthetic
tttcgtcgtttttggttggggcgcgtt

SEQ ID NO: 10703 - DNA, 27 bp, Artificial Sequences
  Synthetic
ttttcgtcgtttttggttggggcgcgt

SEQ ID NO: 10704 - DNA, 28 bp, Artificial Sequences
  Synthetic
gcgttatttgttagtgtgcgagcgtttg

SEQ ID NO: 10705 - DNA, 29 bp, Artificial Sequences
  Synthetic
gcgttatttgttagtgtgcgagcgtttga

SEQ ID NO: 10706 - DNA, 30 bp, Artificial Sequences
  Synthetic
gcgttatttgttagtgtgcgagcgtttgaa

SEQ ID NO: 10707 - DNA, 31 bp, Artificial Sequences
  Synthetic
gcgttatttgttagtgtgcgagcgtttgaat

SEQ ID NO: 10708 - DNA, 32 bp, Artificial Sequences
  Synthetic
gcgttatttgttagtgtgcgagcgtttgaatt

SEQ ID NO: 10709 - DNA, 27 bp, Artificial Sequences
  Synthetic
ttcgtcgtttttggttggggcgcgtta

SEQ ID NO: 10710 - DNA, 27 bp, Artificial Sequences
  Synthetic
tcgtcgtttttggttggggcgcgttat

SEQ ID NO: 10711 - DNA, 27 bp, Artificial Sequences
  Synthetic
tttttcgtcgtttttggttggggcgcg

SEQ ID NO: 10712 - DNA, 27 bp, Artificial Sequences
  Synthetic
tttcgtcgtttttggttggggcgcgtt

SEQ ID NO: 10713 - DNA, 27 bp, Artificial Sequences
  Synthetic
ttttcgtcgtttttggttggggcgcgt

SEQ ID NO: 10714 - DNA, 27 bp, Artificial Sequences
  Synthetic
cgtcggcgtttggagtttaattgcgtt

SEQ ID NO: 10715 - DNA, 26 bp, Artificial Sequences
  Synthetic
cgtcggcgtttggagtttaattgcgt

SEQ ID NO: 10716 - DNA, 28 bp, Artificial Sequences
  Synthetic
cgtcggcgtttggagtttaattgcgtta

SEQ ID NO: 10717 - DNA, 28 bp, Artificial Sequences
  Synthetic
gcgttatttgttagtgtgcgagcgtttg

SEQ ID NO: 10718 - DNA, 29 bp, Artificial Sequences
  Synthetic
cgtcggcgtttggagtttaattgcgttaa

SEQ ID NO: 10719 - DNA, 27 bp, Artificial Sequences
  Synthetic
ttatagcgcggggagtaggggaggtcg

SEQ ID NO: 10720 - DNA, 27 bp, Artificial Sequences
  Synthetic
tttatagcgcggggagtaggggaggtc

SEQ ID NO: 10721 - DNA, 26 bp, Artificial Sequences
  Synthetic
gcggggagtaggggaggtcgaaagtc

SEQ ID NO: 10722 - DNA, 27 bp, Artificial Sequences
  Synthetic
ttttatagcgcggggagtaggggaggt

SEQ ID NO: 10723 - DNA, 27 bp, Artificial Sequences
  Synthetic
tatagcgcggggagtaggggaggtcga

SEQ ID NO: 10724 - DNA, 28 bp, Artificial Sequences
  Synthetic
tgtcgttcggggttgttgtagttcgggt

SEQ ID NO: 10725 - DNA, 27 bp, Artificial Sequences
  Synthetic
gtcgttcggggttgttgtagttcgggt

SEQ ID NO: 10726 - DNA, 27 bp, Artificial Sequences
  Synthetic
tgtcgttcggggttgttgtagttcggg

SEQ ID NO: 10727 - DNA, 27 bp, Artificial Sequences
  Synthetic
tcgttcggggttgttgtagttcgggtt

SEQ ID NO: 10728 - DNA, 28 bp, Artificial Sequences
  Synthetic
gtcgttcggggttgttgtagttcgggtt

SEQ ID NO: 10729 - DNA, 27 bp, Artificial Sequences
  Synthetic
agtcgggtagtttggggggtcgggata

SEQ ID NO: 10730 - DNA, 27 bp, Artificial Sequences
  Synthetic
ttggggggtcgggataattcgggttgt

SEQ ID NO: 10731 - DNA, 27 bp, Artificial Sequences
  Synthetic
ttatagcgcggggagtaggggaggtcg

SEQ ID NO: 10732 - DNA, 27 bp, Artificial Sequences
  Synthetic
agtttggggggtcgggataattcgggt

SEQ ID NO: 10733 - DNA, 27 bp, Artificial Sequences
  Synthetic
gtcgggtagtttggggggtcgggataa

SEQ ID NO: 10734 - DNA, 27 bp, Artificial Sequences
  Synthetic
gtcggggagttcggggtttcgttaggt

SEQ ID NO: 10735 - DNA, 27 bp, Artificial Sequences
  Synthetic
agtcggggagttcggggtttcgttagg

SEQ ID NO: 10736 - DNA, 27 bp, Artificial Sequences
  Synthetic
tcggggagttcggggtttcgttaggtt

SEQ ID NO: 10737 - DNA, 28 bp, Artificial Sequences
  Synthetic
gtcggggagttcggggtttcgttaggtt

SEQ ID NO: 10738 - DNA, 28 bp, Artificial Sequences
  Synthetic
aagtcggggagttcggggtttcgttagg

SEQ ID NO: 10739 - DNA, 27 bp, Artificial Sequences
  Synthetic
tggcggggtttcggatttttcggtttg

SEQ ID NO: 10740 - DNA, 27 bp, Artificial Sequences
  Synthetic
ttggcggggtttcggatttttcggttt

SEQ ID NO: 10741 - DNA, 27 bp, Artificial Sequences
  Synthetic
tttggcggggtttcggatttttcggtt

SEQ ID NO: 10742 - DNA, 27 bp, Artificial Sequences
  Synthetic
ttcgttgtttttcgggttgagggagcg

SEQ ID NO: 10743 - DNA, 28 bp, Artificial Sequences
  Synthetic
ttggcggggtttcggatttttcggtttg

SEQ ID NO: 10744 - DNA, 27 bp, Artificial Sequences
  Synthetic
gcggggttgggtttggatagcggtttt

SEQ ID NO: 10745 - DNA, 27 bp, Artificial Sequences
  Synthetic
gggtttggatagcggttttggggtcgt

SEQ ID NO: 10746 - DNA, 27 bp, Artificial Sequences
  Synthetic
tgggtttggatagcggttttggggtcg

SEQ ID NO: 10747 - DNA, 28 bp, Artificial Sequences
  Synthetic
cggggttgggtttggatagcggttttgg

SEQ ID NO: 10748 - DNA, 28 bp, Artificial Sequences
  Synthetic
gggttgggtttggatagcggttttgggg

SEQ ID NO: 10749 - DNA, 28 bp, Artificial Sequences
  Synthetic
cgttgtttttcgggttgagggagcgagg

SEQ ID NO: 10750 - DNA, 27 bp, Artificial Sequences
  Synthetic
tcgttgtttttcgggttgagggagcga

SEQ ID NO: 10751 - DNA, 27 bp, Artificial Sequences
  Synthetic
ttgtttttcgggttgagggagcgagga

SEQ ID NO: 10752 - DNA, 27 bp, Artificial Sequences
  Synthetic
cgttgtttttcgggttgagggagcgag

SEQ ID NO: 10753 - DNA, 27 bp, Artificial Sequences
  Synthetic
tgtttttcgggttgagggagcgaggat

SEQ ID NO: 10754 - DNA, 27 bp, Artificial Sequences
  Synthetic
gggattcggggttagggatagagggcg

SEQ ID NO: 10755 - DNA, 27 bp, Artificial Sequences
  Synthetic
ggattcggggttagggatagagggcga

SEQ ID NO: 10756 - DNA, 28 bp, Artificial Sequences
  Synthetic
gggattcggggttagggatagagggcga

SEQ ID NO: 10757 - DNA, 27 bp, Artificial Sequences
  Synthetic
tcgtcggggtttttgggttattcggga

SEQ ID NO: 10758 - DNA, 28 bp, Artificial Sequences
  Synthetic
ggattcggggttagggatagagggcgat

SEQ ID NO: 10759 - DNA, 27 bp, Artificial Sequences
  Synthetic
gggtaatttaggggtttcggcgaggcg

SEQ ID NO: 10760 - DNA, 27 bp, Artificial Sequences
  Synthetic
cgggtaatttaggggtttcggcgaggc

SEQ ID NO: 10761 - DNA, 27 bp, Artificial Sequences
  Synthetic
taggggtttcggcgaggcgagtttttt

SEQ ID NO: 10762 - DNA, 27 bp, Artificial Sequences
  Synthetic
ttaggggtttcggcgaggcgagttttt

SEQ ID NO: 10763 - DNA, 27 bp, Artificial Sequences
  Synthetic
tttaggggtttcggcgaggcgagtttt

SEQ ID NO: 10764 - DNA, 28 bp, Artificial Sequences
  Synthetic
ggtttgggagtttcgtttaatgcgcggt

SEQ ID NO: 10765 - DNA, 28 bp, Artificial Sequences
  Synthetic
tggtttgggagtttcgtttaatgcgcgg

SEQ ID NO: 10766 - DNA, 29 bp, Artificial Sequences
  Synthetic
tggtttgggagtttcgtttaatgcgcggt

SEQ ID NO: 10767 - DNA, 27 bp, Artificial Sequences
  Synthetic
ggtttgggagtttcgtttaatgcgcgg

SEQ ID NO: 10768 - DNA, 29 bp, Artificial Sequences
  Synthetic
gtggtttgggagtttcgtttaatgcgcgg

SEQ ID NO: 10769 - DNA, 27 bp, Artificial Sequences
  Synthetic
cgtagggtgtaattcggacgcgttttc

SEQ ID NO: 10770 - DNA, 30 bp, Artificial Sequences
  Synthetic
tgttatttcggggaaggttacgtagggtgt

SEQ ID NO: 10771 - DNA, 29 bp, Artificial Sequences
  Synthetic
gttatttcggggaaggttacgtagggtgt

SEQ ID NO: 10772 - DNA, 29 bp, Artificial Sequences
  Synthetic
tgttatttcggggaaggttacgtagggtg

SEQ ID NO: 10773 - DNA, 30 bp, Artificial Sequences
  Synthetic
ttgttatttcggggaaggttacgtagggtg

SEQ ID NO: 10774 - DNA, 27 bp, Artificial Sequences
  Synthetic
atggggtgggcgttagtgtaggttggg

SEQ ID NO: 10775 - DNA, 27 bp, Artificial Sequences
  Synthetic
gtgtaggttgggggtgtggttgttgcg

SEQ ID NO: 10776 - DNA, 27 bp, Artificial Sequences
  Synthetic
tgggcgttagtgtaggttgggggtgtg

SEQ ID NO: 10777 - DNA, 27 bp, Artificial Sequences
  Synthetic
ggcgttagtgtaggttgggggtgtggt

SEQ ID NO: 10778 - DNA, 27 bp, Artificial Sequences
  Synthetic
gtgggcgttagtgtaggttgggggtgt

SEQ ID NO: 10779 - DNA, 27 bp, Artificial Sequences
  Synthetic
cgtagggtgtaattcggacgcgttttc

SEQ ID NO: 10780 - DNA, 30 bp, Artificial Sequences; identical to SEQ ID NO: 10770
  Synthetic

SEQ ID NO: 10781 - DNA, 29 bp, Artificial Sequences
  Synthetic
gttatttcggggaaggttacgtagggtgt

SEQ ID NO: 10782 - DNA, 29 bp, Artificial Sequences
  Synthetic
tgttatttcggggaaggttacgtagggtg

SEQ ID NO: 10783 - DNA, 30 bp, Artificial Sequences; identical to SEQ ID NO: 10773
  Synthetic

SEQ ID NO: 10784 - DNA, 27 bp, Artificial Sequences
  Synthetic
tagggagggcgtttttggtcgggttgt

SEQ ID NO: 10785 - DNA, 27 bp, Artificial Sequences
  Synthetic
gtagggagggcgtttttggtcgggttg

SEQ ID NO: 10786 - DNA, 27 bp, Artificial Sequences
  Synthetic
ggtagggagggcgtttttggtcgggtt

SEQ ID NO: 10787 - DNA, 27 bp, Artificial Sequences
  Synthetic
cgtttttggtcgggttgtgcgttggtc

SEQ ID NO: 10788 - DNA, 27 bp, Artificial Sequences
  Synthetic
gcgtttttggtcgggttgtgcgttggt

SEQ ID NO: 10789 - DNA, 27 bp, Artificial Sequences
  Synthetic
cgtagggtgtaattcggacgcgttttc

SEQ ID NO: 10790 - DNA, 25 bp, Artificial Sequences
  Synthetic
gggtagggagcgcgcgtttttatcg

SEQ ID NO: 10791 - DNA, 30 bp, Artificial Sequences; identical to SEQ ID NO: 10770
  Synthetic

SEQ ID NO: 10792 - DNA, 29 bp, Artificial Sequences
  Synthetic
gttatttcggggaaggttacgtagggtgt

SEQ ID NO: 10793 - DNA, 29 bp, Artificial Sequences
  Synthetic
tgttatttcggggaaggttacgtagggtg

SEQ ID NO: 10794 - DNA, 27 bp, Artificial Sequences
  Synthetic
tagggagggcgtttttggtcgggttgt

SEQ ID NO: 10795 - DNA, 27 bp, Artificial Sequences
  Synthetic
gtagggagggcgtttttggtcgggttg

SEQ ID NO: 10796 - DNA, 27 bp, Artificial Sequences
  Synthetic
gattaaagggtcggcggcggtagggag

SEQ ID NO: 10797 - DNA, 27 bp, Artificial Sequences
  Synthetic
ggtagggagggcgtttttggtcgggtt

SEQ ID NO: 10798 - DNA, 27 bp, Artificial Sequences
  Synthetic
cgtttttggtcgggttgtgcgttggtc

SEQ ID NO: 10799 - DNA, 27 bp, Artificial Sequences
  Synthetic
ggtagggagcgcgcgtttttatcggtt

SEQ ID NO: 10800 - DNA, 27 bp, Artificial Sequences
  Synthetic
gggtagggagcgcgcgtttttatcggt

SEQ ID NO: 10801 - DNA, 26 bp, Artificial Sequences
  Synthetic
gggtagggagcgcgcgtttttatcgg

SEQ ID NO: 10802 - DNA, 27 bp, Artificial Sequences
  Synthetic
tagggagcgcgcgtttttatcggttga

SEQ ID NO: 10803 - DNA, 28 bp, Artificial Sequences
  Synthetic
ggtagggagcgcgcgtttttatcggttg

SEQ ID NO: 10804 - DNA, 27 bp, Artificial Sequences
  Synthetic
atagcgttggttgtggtttgcgggtcg

SEQ ID NO: 10805 - DNA, 27 bp, Artificial Sequences
  Synthetic
tagggagggcgtttttggtcgggttgt

SEQ ID NO: 10806 - DNA, 27 bp, Artificial Sequences
  Synthetic
gtagggagggcgtttttggtcgggttg

SEQ ID NO: 10807 - DNA, 27 bp, Artificial Sequences
  Synthetic
gattaaagggtcggcggcggtagggag

SEQ ID NO: 10808 - DNA, 27 bp, Artificial Sequences
  Synthetic
ggtagggagggcgtttttggtcgggtt

SEQ ID NO: 10809 - DNA, 27 bp, Artificial Sequences
  Synthetic
ggtagggagcgcgcgtttttatcggtt

SEQ ID NO: 10810 - DNA, 27 bp, Artificial Sequences
  Synthetic
gggtagggagcgcgcgtttttatcggt

SEQ ID NO: 10811 - DNA, 26 bp, Artificial Sequences
  Synthetic
gggtagggagcgcgcgtttttatcgg

SEQ ID NO: 10812 - DNA, 27 bp, Artificial Sequences
  Synthetic
tagggagcgcgcgtttttatcggttga

SEQ ID NO: 10813 - DNA, 28 bp, Artificial Sequences
  Synthetic
ggtagggagcgcgcgtttttatcggttg

SEQ ID NO: 10814 - DNA, 27 bp, Artificial Sequences
  Synthetic
atagcgttggttgtggtttgcgggtcg

SEQ ID NO: 10815 - DNA, 26 bp, Artificial Sequences
  Synthetic
tagcgttggttgtggtttgcgggtcg

SEQ ID NO: 10816 - DNA, 26 bp, Artificial Sequences
  Synthetic
gtcggtcggtcgggttttgatgtgcg

SEQ ID NO: 10817 - DNA, 28 bp, Artificial Sequences
  Synthetic
tatagcgttggttgtggtttgcgggtcg

SEQ ID NO: 10818 - DNA, 26 bp, Artificial Sequences
  Synthetic
gcggttcggggattcgtgcgtttgag

SEQ ID NO: 10819 - DNA, 27 bp, Artificial Sequences
  Synthetic
gttagcgttgtgttgggtaggtggcgg

SEQ ID NO: 10820 - DNA, 27 bp, Artificial Sequences
  Synthetic
ttagcgttgtgttgggtaggtggcggt

SEQ ID NO: 10821 - DNA, 27 bp, Artificial Sequences
  Synthetic
tagcgttgtgttgggtaggtggcggta

SEQ ID NO: 10822 - DNA, 27 bp, Artificial Sequences
  Synthetic
agcgttgtgttgggtaggtggcggtag

SEQ ID NO: 10823 - DNA, 28 bp, Artificial Sequences
  Synthetic
tagcgttgtgttgggtaggtggcggtag

SEQ ID NO: 10824 - DNA, 26 bp, Artificial Sequences
  Synthetic
gtcggtcggtcgggttttgatgtgcg

SEQ ID NO: 10825 - DNA, 26 bp, Artificial Sequences
  Synthetic
gcggttcggggattcgtgcgtttgag

SEQ ID NO: 10826 - DNA, 27 bp, Artificial Sequences
  Synthetic
gtcggtcggtcgggttttgatgtgcgg

SEQ ID NO: 10827 - DNA, 25 bp, Artificial Sequences
  Synthetic
gcggttcggggattcgtgcgtttga

SEQ ID NO: 10828 - DNA, 26 bp, Artificial Sequences
  Synthetic
tcggtcggtcgggttttgatgtgcgg

SEQ ID NO: 10829 - DNA, 27 bp, Artificial Sequences
  Synthetic
gttagcgttgtgttgggtaggtggcgg

SEQ ID NO: 10830 - DNA, 27 bp, Artificial Sequences
  Synthetic
ttagcgttgtgttgggtaggtggcggt

SEQ ID NO: 10831 - DNA, 27 bp, Artificial Sequences
  Synthetic
tagcgttgtgttgggtaggtggcggta

SEQ ID NO: 10832 - DNA, 27 bp, Artificial Sequences
  Synthetic
agcgttgtgttgggtaggtggcggtag

SEQ ID NO: 10833 - DNA, 27 bp, Artificial Sequences
  Synthetic
agttagcgttgtgttgggtaggtggcg

SEQ ID NO: 10834 - DNA, 26 bp, Artificial Sequences
  Synthetic
gtcggtcggtcgggttttgatgtgcg

SEQ ID NO: 10835 - DNA, 27 bp, Artificial Sequences
  Synthetic
gtcggtcggtcgggttttgatgtgcgg

SEQ ID NO: 10836 - DNA, 26 bp, Artificial Sequences
  Synthetic
tcggtcggtcgggttttgatgtgcgg

SEQ ID NO: 10837 - DNA, 25 bp, Artificial Sequences
  Synthetic
tcggtcggtcgggttttgatgtgcg

SEQ ID NO: 10838 - DNA, 27 bp, Artificial Sequences
  Synthetic
gtcggtcgggttttgatgtgcggcgtg

SEQ ID NO: 10839 - DNA, 33 bp, Artificial Sequences
  Synthetic
gtgttttttggtttttgttgacgttggttgaga

SEQ ID NO: 10840 - DNA, 34 bp, Artificial Sequences
  Synthetic
tgtgttttttggtttttgttgacgttggttgaga

SEQ ID NO: 10841 - DNA, 34 bp, Artificial Sequences
  Synthetic
ggattgtgttttttggtttttgttgacgttggtt

SEQ ID NO: 10842 - DNA, 35 bp, Artificial Sequences
  Synthetic
tggattgtgttttttggtttttgttgacgttggtt

SEQ ID NO: 10843 - DNA, 34 bp, Artificial Sequences
  Synthetic
tgttttttggtttttgttgacgttggttgagaaa

SEQ ID NO: 10844 - DNA, 27 bp, Artificial Sequences
  Synthetic
gagtgtatgtgggtcgtggagggggaa

SEQ ID NO: 10845 - DNA, 27 bp, Artificial Sequences
  Synthetic
ggagtgtatgtgggtcgtggaggggga

SEQ ID NO: 10846 - DNA, 27 bp, Artificial Sequences
  Synthetic
aggagtgtatgtgggtcgtggaggggg

SEQ ID NO: 10847 - DNA, 27 bp, Artificial Sequences
  Synthetic
agtgtatgtgggtcgtggagggggaaa

SEQ ID NO: 10848 - DNA, 26 bp, Artificial Sequences
  Synthetic
ggagtgtatgtgggtcgtggaggggg

SEQ ID NO: 10849 - DNA, 27 bp, Artificial Sequences
  Synthetic
aggttaacgtcgggaaaagttcggggt

SEQ ID NO: 10850 - DNA, 27 bp, Artificial Sequences
  Synthetic
ggttaacgtcgggaaaagttcggggtt

SEQ ID NO: 10851 - DNA, 28 bp, Artificial Sequences
  Synthetic
aggttaacgtcgggaaaagttcggggtt

SEQ ID NO: 10852 - DNA, 28 bp, Artificial Sequences
  Synthetic
aaggttaacgtcgggaaaagttcggggt

SEQ ID NO: 10853 - DNA, 27 bp, Artificial Sequences
  Synthetic
aaggttaacgtcgggaaaagttcgggg

SEQ ID NO: 10854 - DNA, 27 bp, Artificial Sequences
  Synthetic
ttggagtggaattcgggaggtttcgga

SEQ ID NO: 10855 - DNA, 27 bp, Artificial Sequences
  Synthetic
tggagtggaattcgggaggtttcggat

SEQ ID NO: 10856 - DNA, 27 bp, Artificial Sequences
  Synthetic
attggagtggaattcgggaggtttcgg

SEQ ID NO: 10857 - DNA, 28 bp, Artificial Sequences
  Synthetic
ttggagtggaattcgggaggtttcggat

SEQ ID NO: 10858 - DNA, 28 bp, Artificial Sequences
  Synthetic
attggagtggaattcgggaggtttcgga

SEQ ID NO: 10859 - DNA, 27 bp, Artificial Sequences
  Synthetic
tggaagggttgggttgtaggaggggtt

SEQ ID NO: 10860 - DNA, 27 bp, Artificial Sequences
  Synthetic
ttggaagggttgggttgtaggaggggt

SEQ ID NO: 10861 - DNA, 28 bp, Artificial Sequences
  Synthetic
ttggaagggttgggttgtaggaggggtt

SEQ ID NO: 10862 - DNA, 28 bp, Artificial Sequences
  Synthetic
tttggaagggttgggttgtaggaggggt

SEQ ID NO: 10863 - DNA, 27 bp, Artificial Sequences
  Synthetic
tttggaagggttgggttgtaggagggg

SEQ ID NO: 10864 - DNA, 30 bp, Artificial Sequences
  Synthetic
cgagggcgttgataggtagaggaagtttcg

SEQ ID NO: 10865 - DNA, 28 bp, Artificial Sequences
  Synthetic
agggcgttgataggtagaggaagtttcg

SEQ ID NO: 10866 - DNA, 28 bp, Artificial Sequences
  Synthetic
cgagggcgttgataggtagaggaagttt

SEQ ID NO: 10867 - DNA, 28 bp, Artificial Sequences
  Synthetic
gggcgttgataggtagaggaagtttcga

SEQ ID NO: 10868 - DNA, 29 bp, Artificial Sequences
  Synthetic
agggcgttgataggtagaggaagtttcga

SEQ ID NO: 10869 - DNA, 27 bp, Artificial Sequences
  Synthetic
tcgaagagttggcggagagaagcggtt

SEQ ID NO: 10870 - DNA, 27 bp, Artificial Sequences
  Synthetic
cgaagagttggcggagagaagcggttt

SEQ ID NO: 10871 - DNA, 28 bp, Artificial Sequences
  Synthetic
tcgaagagttggcggagagaagcggttt

SEQ ID NO: 10872 - DNA, 26 bp, Artificial Sequences
  Synthetic
tcgaagagttggcggagagaagcggt

SEQ ID NO: 10873 - DNA, 28 bp, Artificial Sequences
  Synthetic
cgaagagttggcggagagaagcggtttt

SEQ ID NO: 10874 - DNA, 27 bp, Artificial Sequences
  Synthetic
tggagtggttgttgtggaggttttcgg

SEQ ID NO: 10875 - DNA, 28 bp, Artificial Sequences
  Synthetic
tggagtggttgttgtggaggttttcgga

SEQ ID NO: 10876 - DNA, 27 bp, Artificial Sequences
  Synthetic
ggagtggttgttgtggaggttttcgga

SEQ ID NO: 10877 - DNA, 29 bp, Artificial Sequences
  Synthetic
tggagtggttgttgtggaggttttcggag

SEQ ID NO: 10878 - DNA, 28 bp, Artificial Sequences
  Synthetic
ggagtggttgttgtggaggttttcggag

SEQ ID NO: 10879 - DNA, 27 bp, Artificial Sequences
  Synthetic
agcgcgcgtgtatgtgagaattggatt

SEQ ID NO: 10880 - DNA, 28 bp, Artificial Sequences
  Synthetic
gcgcgcgtgtatgtgagaattggattgt

SEQ ID NO: 10881 - DNA, 27 bp, Artificial Sequences
  Synthetic
gcgcgcgtgtatgtgagaattggattg

SEQ ID NO: 10882 - DNA, 28 bp, Artificial Sequences
  Synthetic
agcgcgcgtgtatgtgagaattggattg

SEQ ID NO: 10883 - DNA, 29 bp, Artificial Sequences
  Synthetic
agcgcgcgtgtatgtgagaattggattgt

SEQ ID NO: 10884 - DNA, 27 bp, Artificial Sequences
  Synthetic
aggatgcgagcgtttgagaaggaagta

SEQ ID NO: 10885 - DNA, 27 bp, Artificial Sequences
  Synthetic
taggatgcgagcgtttgagaaggaagt

SEQ ID NO: 10886 - DNA, 28 bp, Artificial Sequences
  Synthetic
ggatgcgagcgtttgagaaggaagtagt

SEQ ID NO: 10887 - DNA, 29 bp, Artificial Sequences
  Synthetic
aggatgcgagcgtttgagaaggaagtagt

SEQ ID NO: 10888 - DNA, 28 bp, Artificial Sequences
  Synthetic
aggatgcgagcgtttgagaaggaagtag

SEQ ID NO: 10889 - DNA, 27 bp, Artificial Sequences
  Synthetic
agcggattaatatgtgggtcgtgtcgt

SEQ ID NO: 10890 - DNA, 27 bp, Artificial Sequences
  Synthetic
tgtgggtcgtgtcgttgtagtgtagtt

SEQ ID NO: 10891 - DNA, 28 bp, Artificial Sequences
  Synthetic
gagcggattaatatgtgggtcgtgtcgt

SEQ ID NO: 10892 - DNA, 29 bp, Artificial Sequences
  Synthetic
agagcggattaatatgtgggtcgtgtcgt

SEQ ID NO: 10893 - DNA, 28 bp, Artificial Sequences
  Synthetic
agagcggattaatatgtgggtcgtgtcg

SEQ ID NO: 10894 - DNA, 28 bp, Artificial Sequences
  Synthetic
aggcgtcgttatttcgtttagtttcggg

SEQ ID NO: 10895 - DNA, 28 bp, Artificial Sequences
  Synthetic
ggcgtcgttatttcgtttagtttcggga

SEQ ID NO: 10896 - DNA, 29 bp, Artificial Sequences
  Synthetic
aggcgtcgttatttcgtttagtttcggga

SEQ ID NO: 10897 - DNA, 22 bp, Artificial Sequences
  Synthetic
cgtcgggtcgcggaggagttcg

SEQ ID NO: 10898 - DNA, 32 bp, Artificial Sequences
  Synthetic
ggcgtcgttatttcgtttagtttcgggaaggg

SEQ ID NO: 10899 - DNA, 27 bp, Artificial Sequences
  Synthetic
ttggggggaaggagcgcgggttttttc

SEQ ID NO: 10900 - DNA, 27 bp, Artificial Sequences
  Synthetic
gttggggggaaggagcgcgggtttttt

SEQ ID NO: 10901 - DNA, 26 bp, Artificial Sequences
  Synthetic
ttggggggaaggagcgcgggtttttt

SEQ ID NO: 10902 - DNA, 25 bp, Artificial Sequences
  Synthetic
ggggggaaggagcgcgggttttttc

SEQ ID NO: 10903 - DNA, 26 bp, Artificial Sequences
  Synthetic
tggggggaaggagcgcgggttttttc

SEQ ID NO: 10904 - DNA, 27 bp, Artificial Sequences
  Synthetic
gcgggttgtttcggcgttagttgcgtt

SEQ ID NO: 10905 - DNA, 27 bp, Artificial Sequences
  Synthetic
cgggttgtttcggcgttagttgcgttt

SEQ ID NO: 10906 - DNA, 26 bp, Artificial Sequences
  Synthetic
gcgggttgtttcggcgttagttgcgt

SEQ ID NO: 10907 - DNA, 28 bp, Artificial Sequences
  Synthetic
gcgggttgtttcggcgttagttgcgttt

SEQ ID NO: 10908 - DNA, 26 bp, Artificial Sequences
  Synthetic
cgggttgtttcggcgttagttgcgtt

SEQ ID NO: 10909 - DNA, 27 bp, Artificial Sequences
  Synthetic
ttggggggaaggagcgcgggttttttc

SEQ ID NO: 10910 - DNA, 27 bp, Artificial Sequences
  Synthetic
gttggggggaaggagcgcgggtttttt

SEQ ID NO: 10911 - DNA, 26 bp, Artificial Sequences
  Synthetic
ttggggggaaggagcgcgggtttttt

SEQ ID NO: 10912 - DNA, 25 bp, Artificial Sequences
  Synthetic
ggggggaaggagcgcgggttttttc

SEQ ID NO: 10913 - DNA, 26 bp, Artificial Sequences
  Synthetic
tggggggaaggagcgcgggttttttc

SEQ ID NO: 10914 - DNA, 27 bp, Artificial Sequences
  Synthetic
gcgggttgtttcggcgttagttgcgtt

SEQ ID NO: 10915 - DNA, 27 bp, Artificial Sequences
  Synthetic
cgggttgtttcggcgttagttgcgttt

SEQ ID NO: 10916 - DNA, 28 bp, Artificial Sequences
  Synthetic
acgagattatgtgtaggtgagcggcggg

SEQ ID NO: 10917 - DNA, 27 bp, Artificial Sequences
  Synthetic
cgagattatgtgtaggtgagcggcggg

SEQ ID NO: 10918 - DNA, 27 bp, Artificial Sequences
  Synthetic
acgagattatgtgtaggtgagcggcgg

SEQ ID NO: 10919 - DNA, 27 bp, Artificial Sequences
  Synthetic
tcgtggggttttcgtgggtgttgggta

SEQ ID NO: 10920 - DNA, 27 bp, Artificial Sequences
  Synthetic
gtagataggtgcgtaggaggcggcgtt

SEQ ID NO: 10921 - DNA, 27 bp, Artificial Sequences
  Synthetic
tagataggtgcgtaggaggcggcgttg

SEQ ID NO: 10922 - DNA, 27 bp, Artificial Sequences
  Synthetic
ttgtcgtggggttttcgtgggtgttgg

SEQ ID NO: 10923 - DNA, 27 bp, Artificial Sequences
  Synthetic
cgtggggttttcgtgggtgttgggtag

SEQ ID NO: 10924 - DNA, 27 bp, Artificial Sequences
  Synthetic
gtttagtcgggttgcggggttgtcgag

SEQ ID NO: 10925 - DNA, 27 bp, Artificial Sequences
  Synthetic
tttagtcgggttgcggggttgtcgagg

SEQ ID NO: 10926 - DNA, 27 bp, Artificial Sequences
  Synthetic
cgtttagtcgggttgcggggttgtcga

SEQ ID NO: 10927 - DNA, 26 bp, Artificial Sequences
  Synthetic
cgtttagtcgggttgcggggttgtcg

SEQ ID NO: 10928 - DNA, 26 bp, Artificial Sequences
  Synthetic
ggttgcggggttgtcgaggtggtttc

SEQ ID NO: 10929 - DNA, 27 bp, Artificial Sequences
  Synthetic
ttttcgggatgagaggagggtcgagcg

SEQ ID NO: 10930 - DNA, 28 bp, Artificial Sequences
  Synthetic
attttcgggatgagaggagggtcgagcg

SEQ ID NO: 10931 - DNA, 26 bp, Artificial Sequences
  Synthetic
tttcgggatgagaggagggtcgagcg

SEQ ID NO: 10932 - DNA, 27 bp, Artificial Sequences
  Synthetic
tttcgggatgagaggagggtcgagcgc

SEQ ID NO: 10933 - DNA, 27 bp, Artificial Sequences
  Synthetic
cgaggtgcgcggttttttcgataagga

SEQ ID NO: 10934 - DNA, 29 bp, Artificial Sequences
  Synthetic
ggtttcgatcgagttttagttgttggcgt

SEQ ID NO: 10935 - DNA, 29 bp, Artificial Sequences
  Synthetic
aggtttcgatcgagttttagttgttggcg

SEQ ID NO: 10936 - DNA, 30 bp, Artificial Sequences
  Synthetic
aggtttcgatcgagttttagttgttggcgt

SEQ ID NO: 10937 - DNA, 30 bp, Artificial Sequences
  Synthetic
ggtttcgatcgagttttagttgttggcgta

SEQ ID NO: 10938 - DNA, 31 bp, Artificial Sequences
  Synthetic
aggtttcgatcgagttttagttgttggcgta

SEQ ID NO: 10939 - DNA, 27 bp, Artificial Sequences
  Synthetic
ttttcgggatgagaggagggtcgagcg

SEQ ID NO: 10940 - DNA, 28 bp, Artificial Sequences
  Synthetic
attttcgggatgagaggagggtcgagcg

SEQ ID NO: 10941 - DNA, 26 bp, Artificial Sequences
  Synthetic
tttcgggatgagaggagggtcgagcg

SEQ ID NO: 10942 - DNA, 27 bp, Artificial Sequences
  Synthetic
tttcgggatgagaggagggtcgagcgc

SEQ ID NO: 10943 - DNA, 27 bp, Artificial Sequences
  Synthetic
cgaggtgcgcggttttttcgataagga

SEQ ID NO: 10944 - DNA, 29 bp, Artificial Sequences
  Synthetic
ggtttcgatcgagttttagttgttggcgt

SEQ ID NO: 10945 - DNA, 29 bp, Artificial Sequences
  Synthetic
aggtttcgatcgagttttagttgttggcg

SEQ ID NO: 10946 - DNA, 30 bp, Artificial Sequences; identical to SEQ ID NO: 10936
  Synthetic

SEQ ID NO: 10947 - DNA, 30 bp, Artificial Sequences; identical to SEQ ID NO: 10937
  Synthetic

SEQ ID NO: 10948 - DNA, 22 bp, Artificial Sequences
  Synthetic
cgtggtggttttggacgtgcgc

SEQ ID NO: 10949 - DNA, 27 bp, Artificial Sequences
  Synthetic
agttggagttcggtcgggatttgtcgc

SEQ ID NO: 10950 - DNA, 28 bp, Artificial Sequences
  Synthetic
tagttggagttcggtcgggatttgtcgc

SEQ ID NO: 10951 - DNA, 26 bp, Artificial Sequences
  Synthetic
gttggagttcggtcgggatttgtcgc

SEQ ID NO: 10952 - DNA, 29 bp, Artificial Sequences
  Synthetic
gtagttggagttcggtcgggatttgtcgc

SEQ ID NO: 10953 - DNA, 30 bp, Artificial Sequences
  Synthetic
agtagttggagttcggtcgggatttgtcgc

SEQ ID NO: 10954 - DNA, 28 bp, Artificial Sequences
  Synthetic
gcgggttaggcggtatagattgcgtagg

SEQ ID NO: 10955 - DNA, 29 bp, Artificial Sequences
  Synthetic
gcgggttaggcggtatagattgcgtaggt

SEQ ID NO: 10956 - DNA, 27 bp, Artificial Sequences
  Synthetic
gcgggttaggcggtatagattgcgtag

SEQ ID NO: 10957 - DNA, 28 bp, Artificial Sequences
  Synthetic
cgggttaggcggtatagattgcgtaggt

SEQ ID NO: 10958 - DNA, 30 bp, Artificial Sequences
  Synthetic
gcgggttaggcggtatagattgcgtaggtt

SEQ ID NO: 10959 - DNA, 27 bp, Artificial Sequences
  Synthetic
gcgtaatttgtgtcgtttggttcgcga

SEQ ID NO: 10960 - DNA, 26 bp, Artificial Sequences
  Synthetic
gcgtaatttgtgtcgtttggttcgcg

SEQ ID NO: 10961 - DNA, 27 bp, Artificial Sequences
  Synthetic
ttggaggacggcggggtgtttaggatc

SEQ ID NO: 10962 - DNA, 27 bp, Artificial Sequences
  Synthetic
cggcgttgggatatttttgcgtgggga

SEQ ID NO: 10963 - DNA, 27 bp, Artificial Sequences
  Synthetic
gttggaggacggcggggtgtttaggat

SEQ ID NO: 10964 - DNA, 27 bp, Artificial Sequences
  Synthetic
ggttggcggcgttgggatatttttgcg

SEQ ID NO: 10965 - DNA, 27 bp, Artificial Sequences
  Synthetic
cggttggcggcgttgggatatttttgc

SEQ ID NO: 10966 - DNA, 27 bp, Artificial Sequences
  Synthetic
tcgaagaggaagcgcgtggtgagtatt

SEQ ID NO: 10967 - DNA, 29 bp, Artificial Sequences
  Synthetic
cgcgtggtgagtattaagtggttgtgcgg

SEQ ID NO: 10968 - DNA, 28 bp, Artificial Sequences
  Synthetic
gcgcgtggtgagtattaagtggttgtgc

SEQ ID NO: 10969 - DNA, 29 bp, Artificial Sequences
  Synthetic
agcgcgtggtgagtattaagtggttgtgc

SEQ ID NO: 10970 - DNA, 28 bp, Artificial Sequences
  Synthetic
cgcgtggtgagtattaagtggttgtgcg

SEQ ID NO: 10971 - DNA, 27 bp, Artificial Sequences
  Synthetic
ttggaggacggcggggtgtttaggatc

SEQ ID NO: 10972 - DNA, 27 bp, Artificial Sequences
  Synthetic
cggcgttgggatatttttgcgtgggga

SEQ ID NO: 10973 - DNA, 27 bp, Artificial Sequences
  Synthetic
gttggaggacggcggggtgtttaggat

SEQ ID NO: 10974 - DNA, 27 bp, Artificial Sequences
  Synthetic
ggttggcggcgttgggatatttttgcg

SEQ ID NO: 10975 - DNA, 27 bp, Artificial Sequences
  Synthetic
cggttggcggcgttgggatatttttgc

SEQ ID NO: 10976 - DNA, 31 bp, Artificial Sequences
  Synthetic
cggtgttttcgagttttttggttttttcggt

SEQ ID NO: 10977 - DNA, 32 bp, Artificial Sequences
  Synthetic
acgttttgaaattatgtagtcgaagtggcgtt

SEQ ID NO: 10978 - DNA, 33 bp, Artificial Sequences
  Synthetic
acgttttgaaattatgtagtcgaagtggcgttc

SEQ ID NO: 10979 - DNA, 33 bp, Artificial Sequences
  Synthetic
cggtgttttcgagttttttggttttttcggtta

SEQ ID NO: 10980 - DNA, 34 bp, Artificial Sequences
  Synthetic
tacgttttgaaattatgtagtcgaagtggcgttc

SEQ ID NO: 10981 - DNA, 27 bp, Artificial Sequences
  Synthetic
cgggggaggcgggtagagtttgagttt

SEQ ID NO: 10982 - DNA, 27 bp, Artificial Sequences
  Synthetic
ggtggattagggtgagcgttcgagggt

SEQ ID NO: 10983 - DNA, 27 bp, Artificial Sequences
  Synthetic
aggtggattagggtgagcgttcgaggg

SEQ ID NO: 10984 - DNA, 27 bp, Artificial Sequences
  Synthetic
cgcgcgttttagggtttggtttggtcg

SEQ ID NO: 10985 - DNA, 28 bp, Artificial Sequences
  Synthetic
ggtggattagggtgagcgttcgagggtc

SEQ ID NO: 10986 - DNA, 27 bp, Artificial Sequences
  Synthetic
agagacgggaatgaagcgaggtggtgg

SEQ ID NO: 10987 - DNA, 27 bp, Artificial Sequences
  Synthetic
agacgggaatgaagcgaggtggtggtt

SEQ ID NO: 10988 - DNA, 27 bp, Artificial Sequences
  Synthetic
gagacgggaatgaagcgaggtggtggt

SEQ ID NO: 10989 - DNA, 27 bp, Artificial Sequences
  Synthetic
attcggttcgtgcgtgcgtttcggttt

SEQ ID NO: 10990 - DNA, 27 bp, Artificial Sequences
  Synthetic
tattcggttcgtgcgtgcgtttcggtt

SEQ ID NO: 10991 - DNA, 27 bp, Artificial Sequences
  Synthetic
ttcgggcgcgttatggggaatcgtagt

SEQ ID NO: 10992 - DNA, 27 bp, Artificial Sequences
  Synthetic
gttcgttcgggcgcgttatggggaatc

SEQ ID NO: 10993 - DNA, 27 bp, Artificial Sequences
  Synthetic
gttcgggcgcgttatggggaatcgtag

SEQ ID NO: 10994 - DNA, 27 bp, Artificial Sequences
  Synthetic
cgcgcgttttagggtttggtttggtcg

SEQ ID NO: 10995 - DNA, 27 bp, Artificial Sequences
  Synthetic
tcgggcgcgttatggggaatcgtagta

SEQ ID NO: 10996 - DNA, 27 bp, Artificial Sequences
  Synthetic
agagacgggaatgaagcgaggtggtgg

SEQ ID NO: 10997 - DNA, 27 bp, Artificial Sequences
  Synthetic
agacgggaatgaagcgaggtggtggtt

SEQ ID NO: 10998 - DNA, 27 bp, Artificial Sequences
  Synthetic
gagacgggaatgaagcgaggtggtggt

SEQ ID NO: 10999 - DNA, 27 bp, Artificial Sequences
  Synthetic
cgtttcggtttaggggggttttcgcgg

SEQ ID NO: 11000 - DNA, 27 bp, Artificial Sequences
  Synthetic
ggtttaggggggttttcgcggcgtttt

SEQ ID NO: 11001 - DNA, 29 bp, Artificial Sequences
  Synthetic
cgttggttgtatttttaggagtcgggcgt

SEQ ID NO: 11002 - DNA, 28 bp, Artificial Sequences
  Synthetic
cgttggttgtatttttaggagtcgggcg

SEQ ID NO: 11003 - DNA, 29 bp, Artificial Sequences
  Synthetic
tcgttggttgtatttttaggagtcgggcg

SEQ ID NO: 11004 - DNA, 30 bp, Artificial Sequences
  Synthetic
tcgttggttgtatttttaggagtcgggcgt

SEQ ID NO: 11005 - DNA, 30 bp, Artificial Sequences
  Synthetic
cgttggttgtatttttaggagtcgggcgtt

SEQ ID NO: 11006 - DNA, 28 bp, Artificial Sequences
  Synthetic
cgggatttaagtttcgggtttgttgcgt

SEQ ID NO: 11007 - DNA, 29 bp, Artificial Sequences
  Synthetic
tcgggatttaagtttcgggtttgttgcgt

SEQ ID NO: 11008 - DNA, 28 bp, Artificial Sequences
  Synthetic
tcgggatttaagtttcgggtttgttgcg

SEQ ID NO: 11009 - DNA, 29 bp, Artificial Sequences
  Synthetic
atcgggatttaagtttcgggtttgttgcg

SEQ ID NO: 11010 - DNA, 30 bp, Artificial Sequences
  Synthetic
atcgggatttaagtttcgggtttgttgcgt

SEQ ID NO: 11011 - DNA, 29 bp, Artificial Sequences
  Synthetic
cgttggttgtatttttaggagtcgggcgt

SEQ ID NO: 11012 - DNA, 28 bp, Artificial Sequences
  Synthetic
cgttggttgtatttttaggagtcgggcg

SEQ ID NO: 11013 - DNA, 29 bp, Artificial Sequences
  Synthetic
tcgttggttgtatttttaggagtcgggcg

SEQ ID NO: 11014 - DNA, 30 bp, Artificial Sequences; identical to SEQ ID NO: 11004
  Synthetic

SEQ ID NO: 11015 - DNA, 30 bp, Artificial Sequences; identical to SEQ ID NO: 11005
  Synthetic

SEQ ID NO: 11016 - DNA, 28 bp, Artificial Sequences
  Synthetic
agatgtttgcggaggataggcgttatgt

SEQ ID NO: 11017 - DNA, 29 bp, Artificial Sequences
  Synthetic
agatgtttgcggaggataggcgttatgta

SEQ ID NO: 11018 - DNA, 29 bp, Artificial Sequences
  Synthetic
tagatgtttgcggaggataggcgttatgt

SEQ ID NO: 11019 - DNA, 30 bp, Artificial Sequences
  Synthetic
gcggaggataggcgttatgtaaagattggt

SEQ ID NO: 11020 - DNA, 30 bp, Artificial Sequences
  Synthetic
tgcggaggataggcgttatgtaaagattgg

SEQ ID NO: 11021 - DNA, 28 bp, Artificial Sequences
  Synthetic
cgggggagacgtgttgtattatttgggt

SEQ ID NO: 11022 - DNA, 29 bp, Artificial Sequences
  Synthetic
cgggggagacgtgttgtattatttgggtt

SEQ ID NO: 11023 - DNA, 31 bp, Artificial Sequences
  Synthetic
cgggggagacgtgttgtattatttgggttcg

SEQ ID NO: 11024 - DNA, 32 bp, Artificial Sequences
  Synthetic
cgggggagacgtgttgtattatttgggttcgt

SEQ ID NO: 11025 - DNA, 30 bp, Artificial Sequences
  Synthetic
gggggagacgtgttgtattatttgggttcg

SEQ ID NO: 11026 - DNA, 29 bp, Artificial Sequences
  Synthetic
tggtgttttggatggggagtgaagaaagt

SEQ ID NO: 11027 - DNA, 30 bp, Artificial Sequences
  Synthetic
atggtgttttggatggggagtgaagaaagt

SEQ ID NO: 11028 - DNA, 30 bp, Artificial Sequences
  Synthetic
tggtgttttggatggggagtgaagaaagta

SEQ ID NO: 11029 - DNA, 31 bp, Artificial Sequences
  Synthetic
tggtgttttggatggggagtgaagaaagtat

SEQ ID NO: 11030 - DNA, 31 bp, Artificial Sequences
  Synthetic
atggtgttttggatggggagtgaagaaagta

SEQ ID NO: 11031 - DNA, 27 bp, Artificial Sequences
  Synthetic
agaggtggggattttgttacggtgggt

SEQ ID NO: 11032 - DNA, 27 bp, Artificial Sequences
  Synthetic
gaggtggggattttgttacggtgggtt

SEQ ID NO: 11033 - DNA, 28 bp, Artificial Sequences
  Synthetic
agaggtggggattttgttacggtgggtt

SEQ ID NO: 11034 - DNA, 27 bp, Artificial Sequences
  Synthetic
aggtggggattttgttacggtgggttt

SEQ ID NO: 11035 - DNA, 28 bp, Artificial Sequences
  Synthetic
tagaggtggggattttgttacggtgggt

SEQ ID NO: 11036 - DNA, 27 bp, Artificial Sequences
  Synthetic
tcggggaggggagggttttttcgttga

SEQ ID NO: 11037 - DNA, 27 bp, Artificial Sequences
  Synthetic
ttcggggaggggagggttttttcgttg

SEQ ID NO: 11038 - DNA, 27 bp, Artificial Sequences
  Synthetic
tcgggtgggtgtaggttatttcgggga

SEQ ID NO: 11039 - DNA, 27 bp, Artificial Sequences
  Synthetic
cggggaggggagggttttttcgttgat

SEQ ID NO: 11040 - DNA, 28 bp, Artificial Sequences
  Synthetic
ttcggggaggggagggttttttcgttga

SEQ ID NO: 11041 - DNA, 27 bp, Artificial Sequences
  Synthetic
ggataggtagggtgttgcgttcgtggt

SEQ ID NO: 11042 - DNA, 28 bp, Artificial Sequences
  Synthetic
aggataggtagggtgttgcgttcgtggt

SEQ ID NO: 11043 - DNA, 27 bp, Artificial Sequences
  Synthetic
aggataggtagggtgttgcgttcgtgg

SEQ ID NO: 11044 - DNA, 28 bp, Artificial Sequences
  Synthetic
ggataggtagggtgttgcgttcgtggtt

SEQ ID NO: 11045 - DNA, 27 bp, Artificial Sequences
  Synthetic
aggtagggtgttgcgttcgtggttttt

SEQ ID NO: 11046 - DNA, 27 bp, Artificial Sequences
  Synthetic
gggttaggtgtgggcgaggtttgggat

SEQ ID NO: 11047 - DNA, 27 bp, Artificial Sequences
  Synthetic
atagttcggggttaggtgtgggcgagg

SEQ ID NO: 11048 - DNA, 27 bp, Artificial Sequences
  Synthetic
ttcggggttaggtgtgggcgaggtttg

SEQ ID NO: 11049 - DNA, 27 bp, Artificial Sequences
  Synthetic
gttcggggttaggtgtgggcgaggttt

SEQ ID NO: 11050 - DNA, 27 bp, Artificial Sequences
  Synthetic
tagttcggggttaggtgtgggcgaggt

SEQ ID NO: 11051 - DNA, 27 bp, Artificial Sequences
  Synthetic
cggggaggaggttgtttggtaggttgg

SEQ ID NO: 11052 - DNA, 28 bp, Artificial Sequences
  Synthetic
tcggggaggaggttgtttggtaggttgg

SEQ ID NO: 11053 - DNA, 27 bp, Artificial Sequences
  Synthetic
ttggggaggttggggaggtttttggtt

SEQ ID NO: 11054 - DNA, 27 bp, Artificial Sequences
  Synthetic
tttggggaggttggggaggtttttggt

SEQ ID NO: 11055 - DNA, 27 bp, Artificial Sequences
  Synthetic
tcggggaggaggttgtttggtaggttg

SEQ ID NO: 11056 - DNA, 27 bp, Artificial Sequences
  Synthetic
ggcggcggtttttatagggaggttggt

SEQ ID NO: 11057 - DNA, 28 bp, Artificial Sequences
  Synthetic
aggcggcggtttttatagggaggttggt

SEQ ID NO: 11058 - DNA, 27 bp, Artificial Sequences
  Synthetic
aggcggcggtttttatagggaggttgg

SEQ ID NO: 11059 - DNA, 27 bp, Artificial Sequences
  Synthetic
aggaggggttaggtgggacgtgttgta

SEQ ID NO: 11060 - DNA, 27 bp, Artificial Sequences
  Synthetic
taggaggggttaggtgggacgtgttgt

SEQ ID NO: 11061 - DNA, 29 bp, Artificial Sequences
  Synthetic
ggggggattttagtggagaggtacgtacg

SEQ ID NO: 11062 - DNA, 30 bp, Artificial Sequences
  Synthetic
ggggggattttagtggagaggtacgtacga

SEQ ID NO: 11063 - DNA, 28 bp, Artificial Sequences
  Synthetic
gggggattttagtggagaggtacgtacg

SEQ ID NO: 11064 - DNA, 29 bp, Artificial Sequences
  Synthetic
gggggattttagtggagaggtacgtacga

SEQ ID NO: 11065 - DNA, 31 bp, Artificial Sequences
  Synthetic
ggggggattttagtggagaggtacgtacgat

SEQ ID NO: 11066 - DNA, 27 bp, Artificial Sequences
  Synthetic
ggcgaggagaggcgagagttagggatt

SEQ ID NO: 11067 - DNA, 28 bp, Artificial Sequences
  Synthetic
ggcgaggagaggcgagagttagggattt

SEQ ID NO: 11068 - DNA, 26 bp, Artificial Sequences
  Synthetic
ggcgaggagaggcgagagttagggat

SEQ ID NO: 11069 - DNA, 29 bp, Artificial Sequences
  Synthetic
gcgaggagaggcgagagttagggatttgg

SEQ ID NO: 11070 - DNA, 29 bp, Artificial Sequences
  Synthetic
ggcgaggagaggcgagagttagggatttg

SEQ ID NO: 11071 - DNA, 27 bp, Artificial Sequences
  Synthetic
agggcgcgggtttgggattgttagaga

SEQ ID NO: 11072 - DNA, 27 bp, Artificial Sequences
  Synthetic
cgtttagggcgcgggtttgggattgtt

SEQ ID NO: 11073 - DNA, 27 bp, Artificial Sequences
  Synthetic
ttcgtttagggcgcgggtttgggattg

SEQ ID NO: 11074 - DNA, 27 bp, Artificial Sequences
  Synthetic
agatatatgttcgggtggggtggcggg

SEQ ID NO: 11075 - DNA, 27 bp, Artificial Sequences
  Synthetic
tggggtggcgggggaagggaatttaag

SEQ ID NO: 11076 - DNA, 28 bp, Artificial Sequences
  Synthetic
agtcgtagttgggtttagggaagaggga

SEQ ID NO: 11077 - DNA, 29 bp, Artificial Sequences
  Synthetic
tcgtagttgggtttagggaagagggaagt

SEQ ID NO: 11078 - DNA, 29 bp, Artificial Sequences
  Synthetic
agtcgtagttgggtttagggaagagggaa

SEQ ID NO: 11079 - DNA, 29 bp, Artificial Sequences
  Synthetic
agggaagagggaagtttgtgttttggagt

SEQ ID NO: 11080 - DNA, 30 bp, Artificial Sequences
  Synthetic
gtcgtagttgggtttagggaagagggaagt

SEQ ID NO: 11081 - DNA, 27 bp, Artificial Sequences
  Synthetic
agggggttagggagggagggggatttt

SEQ ID NO: 11082 - DNA, 27 bp, Artificial Sequences
  Synthetic
aagggggttagggagggagggggattt

SEQ ID NO: 11083 - DNA, 27 bp, Artificial Sequences
  Synthetic
aaagggggttagggagggagggggatt

SEQ ID NO: 11084 - DNA, 27 bp, Artificial Sequences
  Synthetic
gaaagggggttagggagggagggggat

SEQ ID NO: 11085 - DNA, 27 bp, Artificial Sequences
  Synthetic
gttgggaaagggggttagggagggagg

SEQ ID NO: 11086 - DNA, 27 bp, Artificial Sequences
  Synthetic
tatagagttgtcggcgtgggggtagcg

SEQ ID NO: 11087 - DNA, 28 bp, Artificial Sequences
  Synthetic
gtatagagttgtcggcgtgggggtagcg

SEQ ID NO: 11088 - DNA, 26 bp, Artificial Sequences
  Synthetic
atagagttgtcggcgtgggggtagcg

SEQ ID NO: 11089 - DNA, 28 bp, Artificial Sequences
  Synthetic
cgaagtatagagttgtcggcgtgggggt

SEQ ID NO: 11090 - DNA, 27 bp, Artificial Sequences
  Synthetic
cgaagtatagagttgtcggcgtggggg

SEQ ID NO: 11091 - DNA, 27 bp, Artificial Sequences
  Synthetic
agggggttagggagggagggggatttt

SEQ ID NO: 11092 - DNA, 27 bp, Artificial Sequences
  Synthetic
aagggggttagggagggagggggattt

SEQ ID NO: 11093 - DNA, 27 bp, Artificial Sequences
  Synthetic
aaagggggttagggagggagggggatt

SEQ ID NO: 11094 - DNA, 27 bp, Artificial Sequences
  Synthetic
gaaagggggttagggagggagggggat

SEQ ID NO: 11095 - DNA, 27 bp, Artificial Sequences
  Synthetic
gttgggaaagggggttagggagggagg

SEQ ID NO: 11096 - DNA, 27 bp, Artificial Sequences
  Synthetic
tatagagttgtcggcgtgggggtagcg

SEQ ID NO: 11097 - DNA, 28 bp, Artificial Sequences
  Synthetic
gtatagagttgtcggcgtgggggtagcg

SEQ ID NO: 11098 - DNA, 26 bp, Artificial Sequences
  Synthetic
atagagttgtcggcgtgggggtagcg

SEQ ID NO: 11099 - DNA, 28 bp, Artificial Sequences
  Synthetic
cgaagtatagagttgtcggcgtgggggt

SEQ ID NO: 11100 - DNA, 27 bp, Artificial Sequences
  Synthetic
cgaagtatagagttgtcggcgtggggg

SEQ ID NO: 11101 - DNA, 27 bp, Artificial Sequences
  Synthetic
aggggcgacggttttgtgtttgaggtg

SEQ ID NO: 11102 - DNA, 27 bp, Artificial Sequences
  Synthetic
ggggcgacggttttgtgtttgaggtga

SEQ ID NO: 11103 - DNA, 28 bp, Artificial Sequences
  Synthetic
ggggcgacggttttgtgtttgaggtgat

SEQ ID NO: 11104 - DNA, 27 bp, Artificial Sequences
  Synthetic
taggggcgacggttttgtgtttgaggt

SEQ ID NO: 11105 - DNA, 28 bp, Artificial Sequences
  Synthetic
aggggcgacggttttgtgtttgaggtga

SEQ ID NO: 11106 - DNA, 27 bp, Artificial Sequences
  Synthetic
cgtcggtagtttgagggcgggaagtga

SEQ ID NO: 11107 - DNA, 27 bp, Artificial Sequences
  Synthetic
tcgtcggtagtttgagggcgggaagtg

SEQ ID NO: 11108 - DNA, 27 bp, Artificial Sequences
  Synthetic
gtcgtcggtagtttgagggcgggaagt

SEQ ID NO: 11109 - DNA, 27 bp, Artificial Sequences
  Synthetic
gtgatggttggggtcggaggtggagtt

SEQ ID NO: 11110 - DNA, 27 bp, Artificial Sequences
  Synthetic
ttgtgatggttggggtcggaggtggag

SEQ ID NO: 11111 - DNA, 27 bp, Artificial Sequences
  Synthetic
tttagattgttgggggcggaggggtgg

SEQ ID NO: 11112 - DNA, 27 bp, Artificial Sequences
  Synthetic
ttagattgttgggggcggaggggtgga

SEQ ID NO: 11113 - DNA, 26 bp, Artificial Sequences
  Synthetic
ttagattgttgggggcggaggggtgg

SEQ ID NO: 11114 - DNA, 27 bp, Artificial Sequences
  Synthetic
ttttagattgttgggggcggaggggtg

SEQ ID NO: 11115 - DNA, 28 bp, Artificial Sequences
  Synthetic
ttttagattgttgggggcggaggggtgg

SEQ ID NO: 11116 - DNA, 28 bp, Artificial Sequences
  Synthetic
aggcggtagttagggattaaaagtcggg

SEQ ID NO: 11117 - DNA, 28 bp, Artificial Sequences
  Synthetic
ggcggtagttagggattaaaagtcggga

SEQ ID NO: 11118 - DNA, 29 bp, Artificial Sequences
  Synthetic
aggcggtagttagggattaaaagtcggga

SEQ ID NO: 11119 - DNA, 29 bp, Artificial Sequences
  Synthetic
gaggcggtagttagggattaaaagtcggg

SEQ ID NO: 11120 - DNA, 30 bp, Artificial Sequences
  Synthetic
agaggcggtagttagggattaaaagtcggg

SEQ ID NO: 11121 - DNA, 30 bp, Artificial Sequences
  Synthetic
gtgagattgggttaggaagtgacgaaaagc

SEQ ID NO: 11122 - DNA, 31 bp, Artificial Sequences
  Synthetic
tgtgagattgggttaggaagtgacgaaaagc

SEQ ID NO: 11123 - DNA, 32 bp, Artificial Sequences
  Synthetic
ttgtgagattgggttaggaagtgacgaaaagc

SEQ ID NO: 11124 - DNA, 33 bp, Artificial Sequences
  Synthetic
tttgtgagattgggttaggaagtgacgaaaagc

SEQ ID NO: 11125 - DNA, 34 bp, Artificial Sequences
  Synthetic
ttttgtgagattgggttaggaagtgacgaaaagc

SEQ ID NO: 11126 - DNA, 32 bp, Artificial Sequences
  Synthetic
agagggtgatttttaaatttggttagcgggga

SEQ ID NO: 11127 - DNA, 32 bp, Artificial Sequences
  Synthetic
gagggtgatttttaaatttggttagcggggaa

SEQ ID NO: 11128 - DNA, 33 bp, Artificial Sequences
  Synthetic
agagggtgatttttaaatttggttagcggggaa

SEQ ID NO: 11129 - DNA, 33 bp, Artificial Sequences
  Synthetic
tagagggtgatttttaaatttggttagcgggga

SEQ ID NO: 11130 - DNA, 33 bp, Artificial Sequences
  Synthetic
gagggtgatttttaaatttggttagcggggaaa

SEQ ID NO: 11131 - DNA, 27 bp, Artificial Sequences
  Synthetic
tgaggaattagaggtatcgggtcgcgc

SEQ ID NO: 11132 - DNA, 29 bp, Artificial Sequences
  Synthetic
cgtgaggaattagaggtatcgggtcgcgc

SEQ ID NO: 11133 - DNA, 28 bp, Artificial Sequences
  Synthetic
gtgaggaattagaggtatcgggtcgcgc

SEQ ID NO: 11134 - DNA, 28 bp, Artificial Sequences
  Synthetic
cgtgaggaattagaggtatcgggtcgcg

SEQ ID NO: 11135 - DNA, 27 bp, Artificial Sequences
  Synthetic
gggtcgcgcgggttgagaatttttaaa

SEQ ID NO: 11136 - DNA, 27 bp, Artificial Sequences
  Synthetic
aggggttgataggaattgcgggttggt

SEQ ID NO: 11137 - DNA, 28 bp, Artificial Sequences
  Synthetic
gaggggttgataggaattgcgggttggt

SEQ ID NO: 11138 - DNA, 27 bp, Artificial Sequences
  Synthetic
gaggggttgataggaattgcgggttgg

SEQ ID NO: 11139 - DNA, 27 bp, Artificial Sequences
  Synthetic
ggggttgataggaattgcgggttggtt

SEQ ID NO: 11140 - DNA, 29 bp, Artificial Sequences
  Synthetic
agaggggttgataggaattgcgggttggt

SEQ ID NO: 11141 - DNA, 27 bp, Artificial Sequences
  Synthetic
tgaggaattagaggtatcgggtcgcgc

SEQ ID NO: 11142 - DNA, 29 bp, Artificial Sequences
  Synthetic
cgtgaggaattagaggtatcgggtcgcgc

SEQ ID NO: 11143 - DNA, 28 bp, Artificial Sequences
  Synthetic
gtgaggaattagaggtatcgggtcgcgc

SEQ ID NO: 11144 - DNA, 28 bp, Artificial Sequences
  Synthetic
cgtgaggaattagaggtatcgggtcgcg

SEQ ID NO: 11145 - DNA, 27 bp, Artificial Sequences
  Synthetic
gggtcgcgcgggttgagaatttttaaa

SEQ ID NO: 11146 - DNA, 27 bp, Artificial Sequences
  Synthetic
aggggttgataggaattgcgggttggt

SEQ ID NO: 11147 - DNA, 28 bp, Artificial Sequences
  Synthetic
gaggggttgataggaattgcgggttggt

SEQ ID NO: 11148 - DNA, 27 bp, Artificial Sequences
  Synthetic
gaggggttgataggaattgcgggttgg

SEQ ID NO: 11149 - DNA, 27 bp, Artificial Sequences
  Synthetic
ggggttgataggaattgcgggttggtt

SEQ ID NO: 11150 - DNA, 29 bp, Artificial Sequences
  Synthetic
agaggggttgataggaattgcgggttggt

SEQ ID NO: 11151 - DNA, 27 bp, Artificial Sequences
  Synthetic
tcggcgttagagtcgggtttgaggagc

SEQ ID NO: 11152 - DNA, 27 bp, Artificial Sequences
  Synthetic
agagtcgggtttgaggagcggggtttg

SEQ ID NO: 11153 - DNA, 27 bp, Artificial Sequences
  Synthetic
gttagagtcgggtttgaggagcggggt

SEQ ID NO: 11154 - DNA, 27 bp, Artificial Sequences
  Synthetic
cgttagagtcgggtttgaggagcgggg

SEQ ID NO: 11155 - DNA, 27 bp, Artificial Sequences
  Synthetic
gcgttagagtcgggtttgaggagcggg

SEQ ID NO: 11156 - DNA, 27 bp, Artificial Sequences
  Synthetic
tttaggttcggttttggcgtcgggtgg

SEQ ID NO: 11157 - DNA, 27 bp, Artificial Sequences
  Synthetic
ttaggttcggttttggcgtcgggtggc

SEQ ID NO: 11158 - DNA, 28 bp, Artificial Sequences
  Synthetic
ttttaggttcggttttggcgtcgggtgg

SEQ ID NO: 11159 - DNA, 26 bp, Artificial Sequences
  Synthetic
ttaggttcggttttggcgtcgggtgg

SEQ ID NO: 11160 - DNA, 27 bp, Artificial Sequences
  Synthetic
ttttaggttcggttttggcgtcgggtg

SEQ ID NO: 11161 - DNA, 27 bp, Artificial Sequences
  Synthetic
ttttttcggggtagaagggggtagcgc

SEQ ID NO: 11162 - DNA, 28 bp, Artificial Sequences
  Synthetic
gttttttcggggtagaagggggtagcgc

SEQ ID NO: 11163 - DNA, 28 bp, Artificial Sequences
  Synthetic
cgttttttcggggtagaagggggtagcg

SEQ ID NO: 11164 - DNA, 26 bp, Artificial Sequences
  Synthetic
tttttcggggtagaagggggtagcgc

SEQ ID NO: 11165 - DNA, 27 bp, Artificial Sequences
  Synthetic
gttttttcggggtagaagggggtagcg

SEQ ID NO: 11166 - DNA, 27 bp, Artificial Sequences
  Synthetic
tttaggttcggttttggcgtcgggtgg

SEQ ID NO: 11167 - DNA, 27 bp, Artificial Sequences
  Synthetic
ttaggttcggttttggcgtcgggtggc

SEQ ID NO: 11168 - DNA, 28 bp, Artificial Sequences
  Synthetic
ttttaggttcggttttggcgtcgggtgg

SEQ ID NO: 11169 - DNA, 26 bp, Artificial Sequences
  Synthetic
ttaggttcggttttggcgtcgggtgg

SEQ ID NO: 11170 - DNA, 27 bp, Artificial Sequences
  Synthetic
ggcgtcgggtggcgtttagtttttgta

SEQ ID NO: 11171 - DNA, 27 bp, Artificial Sequences
  Synthetic
ttttttcggggtagaagggggtagcgc

SEQ ID NO: 11172 - DNA, 28 bp, Artificial Sequences
  Synthetic
gttttttcggggtagaagggggtagcgc

SEQ ID NO: 11173 - DNA, 28 bp, Artificial Sequences
  Synthetic
cgttttttcggggtagaagggggtagcg

SEQ ID NO: 11174 - DNA, 26 bp, Artificial Sequences
  Synthetic
tttttcggggtagaagggggtagcgc

SEQ ID NO: 11175 - DNA, 27 bp, Artificial Sequences
  Synthetic
gttttttcggggtagaagggggtagcg

SEQ ID NO: 11176 - DNA, 27 bp, Artificial Sequences
  Synthetic
tttaggttcggttttggcgtcgggtgg

SEQ ID NO: 11177 - DNA, 27 bp, Artificial Sequences
  Synthetic
ttaggttcggttttggcgtcgggtggc

SEQ ID NO: 11178 - DNA, 28 bp, Artificial Sequences
  Synthetic
ttttaggttcggttttggcgtcgggtgg

SEQ ID NO: 11179 - DNA, 26 bp, Artificial Sequences
  Synthetic
ttaggttcggttttggcgtcgggtgg

SEQ ID NO: 11180 - DNA, 27 bp, Artificial Sequences
  Synthetic
ggcgtcgggtggcgtttagtttttgta

SEQ ID NO: 11181 - DNA, 27 bp, Artificial Sequences
  Synthetic
ttttttcggggtagaagggggtagcgc

SEQ ID NO: 11182 - DNA, 28 bp, Artificial Sequences
  Synthetic
gttttttcggggtagaagggggtagcgc

SEQ ID NO: 11183 - DNA, 28 bp, Artificial Sequences
  Synthetic
cgttttttcggggtagaagggggtagcg

SEQ ID NO: 11184 - DNA, 26 bp, Artificial Sequences
  Synthetic
tttttcggggtagaagggggtagcgc

SEQ ID NO: 11185 - DNA, 27 bp, Artificial Sequences
  Synthetic
gttttttcggggtagaagggggtagcg

SEQ ID NO: 11186 - DNA, 27 bp, Artificial Sequences
  Synthetic
tattagcggtggaagacgaggaaagcg

SEQ ID NO: 11187 - DNA, 26 bp, Artificial Sequences
  Synthetic
attagcggtggaagacgaggaaagcg

SEQ ID NO: 11188 - DNA, 28 bp, Artificial Sequences
  Synthetic
ttattagcggtggaagacgaggaaagcg

SEQ ID NO: 11189 - DNA, 25 bp, Artificial Sequences
  Synthetic
ttagcggtggaagacgaggaaagcg

SEQ ID NO: 11190 - DNA, 29 bp, Artificial Sequences
  Synthetic
tttattagcggtggaagacgaggaaagcg

SEQ ID NO: 11191 - DNA, 33 bp, Artificial Sequences
  Synthetic
cggaggattttggtttttaagattagttgggcg

SEQ ID NO: 11192 - DNA, 34 bp, Artificial Sequences
  Synthetic
cggaggattttggtttttaagattagttgggcgt

SEQ ID NO: 11193 - DNA, 34 bp, Artificial Sequences
  Synthetic
tcggaggattttggtttttaagattagttgggcg

SEQ ID NO: 11194 - DNA, 35 bp, Artificial Sequences
  Synthetic
tcggaggattttggtttttaagattagttgggcgt

SEQ ID NO: 11195 - DNA, 33 bp, Artificial Sequences
  Synthetic
ggaggattttggtttttaagattagttgggcgt

SEQ ID NO: 11196 - DNA, 27 bp, Artificial Sequences
  Synthetic
gcggttgagggtaggaaggcgttgaga

SEQ ID NO: 11197 - DNA, 27 bp, Artificial Sequences
  Synthetic
taaagttgcgcgcggttgagggtagga

SEQ ID NO: 11198 - DNA, 27 bp, Artificial Sequences
  Synthetic
ataaagttgcgcgcggttgagggtagg

SEQ ID NO: 11199 - DNA, 27 bp, Artificial Sequences
  Synthetic
aaagttgcgcgcggttgagggtaggaa

SEQ ID NO: 11200 - DNA, 28 bp, Artificial Sequences
  Synthetic
gcggttgagggtaggaaggcgttgagat

SEQ ID NO: 11201 - DNA, 33 bp, Artificial Sequences; identical to SEQ ID NO: 11191
  Synthetic

SEQ ID NO: 11202 - DNA, 34 bp, Artificial Sequences; identical to SEQ ID NO: 11192
  Synthetic

SEQ ID NO: 11203 - DNA, 34 bp, Artificial Sequences; identical to SEQ ID NO: 11193
  Synthetic

SEQ ID NO: 11204 - DNA, 35 bp, Artificial Sequences; identical to SEQ ID NO: 11194
  Synthetic

SEQ ID NO: 11205 - DNA, 33 bp, Artificial Sequences; identical to SEQ ID NO: 11195
  Synthetic

SEQ ID NO: 11206 - DNA, 27 bp, Artificial Sequences
  Synthetic
cgtagacgcgggtgtagtttgttttgc

SEQ ID NO: 11207 - DNA, 30 bp, Artificial Sequences
  Synthetic
tgttgttgtcgttggatttcgtttggatgt

SEQ ID NO: 11208 - DNA, 31 bp, Artificial Sequences
  Synthetic
ttgttgttgtcgttggatttcgtttggatgt

SEQ ID NO: 11209 - DNA, 32 bp, Artificial Sequences
  Synthetic
tttgttgttgtcgttggatttcgtttggatgt

SEQ ID NO: 11210 - DNA, 32 bp, Artificial Sequences
  Synthetic
tgttgttgtcgttggatttcgtttggatgtac

SEQ ID NO: 11211 - DNA, 27 bp, Artificial Sequences
  Synthetic
cgagtgggagtagcgcgttgaggagag

SEQ ID NO: 11212 - DNA, 27 bp, Artificial Sequences
  Synthetic
tcgggtgggtatgggagatgtttggcg

SEQ ID NO: 11213 - DNA, 27 bp, Artificial Sequences
  Synthetic
gggtgggtatgggagatgtttggcggt

SEQ ID NO: 11214 - DNA, 27 bp, Artificial Sequences
  Synthetic
tggaagttaaggaggggttgcgcggta

SEQ ID NO: 11215 - DNA, 27 bp, Artificial Sequences
  Synthetic
gagtgggagtagcgcgttgaggagagt

SEQ ID NO: 11216 - DNA, 34 bp, Artificial Sequences
  Synthetic
cgtcgatttattagcggtagaagggtagtaatgg

SEQ ID NO: 11217 - DNA, 35 bp, Artificial Sequences
  Synthetic
cgtcgatttattagcggtagaagggtagtaatggt

SEQ ID NO: 11218 - DNA, 35 bp, Artificial Sequences
  Synthetic
tcgtcgatttattagcggtagaagggtagtaatgg

SEQ ID NO: 11219 - DNA, 36 bp, Artificial Sequences
  Synthetic
tcgtcgatttattagcggtagaagggtagtaatggt

SEQ ID NO: 11220 - DNA, 36 bp, Artificial Sequences
  Synthetic
gtcgtcgatttattagcggtagaagggtagtaatgg

SEQ ID NO: 11221 - DNA, 27 bp, Artificial Sequences
  Synthetic
tcgggtgggtatgggagatgtttggcg

SEQ ID NO: 11222 - DNA, 27 bp, Artificial Sequences
  Synthetic
gggtgggtatgggagatgtttggcggt

SEQ ID NO: 11223 - DNA, 27 bp, Artificial Sequences
  Synthetic
tggaagttaaggaggggttgcgcggta

SEQ ID NO: 11224 - DNA, 27 bp, Artificial Sequences
  Synthetic
agtggaagttaaggaggggttgcgcgg

SEQ ID NO: 11225 - DNA, 27 bp, Artificial Sequences
  Synthetic
gtggaagttaaggaggggttgcgcggt

SEQ ID NO: 11226 - DNA, 29 bp, Artificial Sequences
  Synthetic
tggtttttattgggagataggggacgtcg

SEQ ID NO: 11227 - DNA, 30 bp, Artificial Sequences
  Synthetic
ttggtttttattgggagataggggacgtcg

SEQ ID NO: 11228 - DNA, 31 bp, Artificial Sequences
  Synthetic
tttggtttttattgggagataggggacgtcg

SEQ ID NO: 11229 - DNA, 32 bp, Artificial Sequences
  Synthetic
ttttggtttttattgggagataggggacgtcg

SEQ ID NO: 11230 - DNA, 33 bp, Artificial Sequences
  Synthetic
tttttggtttttattgggagataggggacgtcg

SEQ ID NO: 11231 - DNA, 28 bp, Artificial Sequences
  Synthetic
tttagtggaagttaaggaggggttgcgt

SEQ ID NO: 11232 - DNA, 29 bp, Artificial Sequences
  Synthetic
ttttagtggaagttaaggaggggttgcgt

SEQ ID NO: 11233 - DNA, 25 bp, Artificial Sequences
  Synthetic
agtggaagttaaggaggggttgcgt

SEQ ID NO: 11234 - DNA, 30 bp, Artificial Sequences
  Synthetic
tttttagtggaagttaaggaggggttgcgt

SEQ ID NO: 11235 - DNA, 31 bp, Artificial Sequences
  Synthetic
ttttttagtggaagttaaggaggggttgcgt

SEQ ID NO: 11236 - DNA, 27 bp, Artificial Sequences
  Synthetic
tggtacgcgggaattggttgtggatcg

SEQ ID NO: 11237 - DNA, 28 bp, Artificial Sequences
  Synthetic
ttggtacgcgggaattggttgtggatcg

SEQ ID NO: 11238 - DNA, 27 bp, Artificial Sequences
  Synthetic
ttggtacgcgggaattggttgtggatc

SEQ ID NO: 11239 - DNA, 27 bp, Artificial Sequences
  Synthetic
ttttggtacgcgggaattggttgtgga

SEQ ID NO: 11240 - DNA, 29 bp, Artificial Sequences
  Synthetic
tttggtacgcgggaattggttgtggatcg

SEQ ID NO: 11241 - DNA, 27 bp, Artificial Sequences
  Synthetic
ggtcgaggggattgcgcgtttattcgt

SEQ ID NO: 11242 - DNA, 27 bp, Artificial Sequences
  Synthetic
aggtcgaggggattgcgcgtttattcg

SEQ ID NO: 11243 - DNA, 27 bp, Artificial Sequences
  Synthetic
cggttaggtcgaggggattgcgcgttt

SEQ ID NO: 11244 - DNA, 27 bp, Artificial Sequences
  Synthetic
ggttaggtcgaggggattgcgcgttta

SEQ ID NO: 11245 - DNA, 28 bp, Artificial Sequences
  Synthetic
aggtcgaggggattgcgcgtttattcgt

SEQ ID NO: 11246 - DNA, 27 bp, Artificial Sequences
  Synthetic
gataaatagggagggtgggcgggtggg

SEQ ID NO: 11247 - DNA, 27 bp, Artificial Sequences
  Synthetic
ggataaatagggagggtgggcgggtgg

SEQ ID NO: 11248 - DNA, 27 bp, Artificial Sequences
  Synthetic
tggataaatagggagggtgggcgggtg

SEQ ID NO: 11249 - DNA, 27 bp, Artificial Sequences
  Synthetic
ggtgggcgcgtagttttttcggtttgg

SEQ ID NO: 11250 - DNA, 27 bp, Artificial Sequences
  Synthetic
gggtgggcgcgtagttttttcggtttg

SEQ ID NO: 11251 - DNA, 29 bp, Artificial Sequences
  Synthetic
ggaaaagggatgagagtgtacgtttgggc

SEQ ID NO: 11252 - DNA, 30 bp, Artificial Sequences
  Synthetic
aggaaaagggatgagagtgtacgtttgggc

SEQ ID NO: 11253 - DNA, 28 bp, Artificial Sequences
  Synthetic
gaaaagggatgagagtgtacgtttgggc

SEQ ID NO: 11254 - DNA, 31 bp, Artificial Sequences
  Synthetic
gaggaaaagggatgagagtgtacgtttgggc

SEQ ID NO: 11255 - DNA, 29 bp, Artificial Sequences
  Synthetic
aggaaaagggatgagagtgtacgtttggg

SEQ ID NO: 11256 - DNA, 27 bp, Artificial Sequences
  Synthetic
ggggaaggtcgtgggtgtagtttgggt

SEQ ID NO: 11257 - DNA, 27 bp, Artificial Sequences
  Synthetic
tggggaaggtcgtgggtgtagtttggg

SEQ ID NO: 11258 - DNA, 27 bp, Artificial Sequences
  Synthetic
taagtgggtggttggggaaggtcgtgg

SEQ ID NO: 11259 - DNA, 27 bp, Artificial Sequences
  Synthetic
gtggttggggaaggtcgtgggtgtagt

SEQ ID NO: 11260 - DNA, 27 bp, Artificial Sequences
  Synthetic
ggtggttggggaaggtcgtgggtgtag

SEQ ID NO: 11261 - DNA, 27 bp, Artificial Sequences
  Synthetic
ttcggattgcggggagtttgttttcgt

SEQ ID NO: 11262 - DNA, 28 bp, Artificial Sequences
  Synthetic
attcggattgcggggagtttgttttcgt

SEQ ID NO: 11263 - DNA, 27 bp, Artificial Sequences
  Synthetic
attcggattgcggggagtttgttttcg

SEQ ID NO: 11264 - DNA, 26 bp, Artificial Sequences
  Synthetic
tcggattgcggggagtttgttttcgt

SEQ ID NO: 11265 - DNA, 29 bp, Artificial Sequences
  Synthetic
aattcggattgcggggagtttgttttcgt

SEQ ID NO: 11266 - DNA, 27 bp, Artificial Sequences
  Synthetic
tggggggatttgttttatgggttggga

SEQ ID NO: 11267 - DNA, 28 bp, Artificial Sequences
  Synthetic
ttggggggatttgttttatgggttggga

SEQ ID NO: 11268 - DNA, 28 bp, Artificial Sequences
  Synthetic
tggggggatttgttttatgggttgggat

SEQ ID NO: 11269 - DNA, 28 bp, Artificial Sequences
  Synthetic
tttggggggatttgttttatgggttggg

SEQ ID NO: 11270 - DNA, 29 bp, Artificial Sequences
  Synthetic
tttggggggatttgttttatgggttggga

SEQ ID NO: 11271 - DNA, 28 bp, Artificial Sequences
  Synthetic
ggtcgggtatttatagggtcggtggtgt

SEQ ID NO: 11272 - DNA, 27 bp, Artificial Sequences
  Synthetic
ggtcgggtatttatagggtcggtggtg

SEQ ID NO: 11273 - DNA, 29 bp, Artificial Sequences
  Synthetic
aggtcgggtatttatagggtcggtggtgt

SEQ ID NO: 11274 - DNA, 27 bp, Artificial Sequences
  Synthetic
tttttacggcgcggatattttggaggg

SEQ ID NO: 11275 - DNA, 28 bp, Artificial Sequences
  Synthetic
aggtcgggtatttatagggtcggtggtg

SEQ ID NO: 11276 - DNA, 30 bp, Artificial Sequences
  Synthetic
aggagattaggtagggttggttgatagcgt

SEQ ID NO: 11277 - DNA, 30 bp, Artificial Sequences
  Synthetic
ggagattaggtagggttggttgatagcgtg

SEQ ID NO: 11278 - DNA, 31 bp, Artificial Sequences
  Synthetic
ggagattaggtagggttggttgatagcgtgt

SEQ ID NO: 11279 - DNA, 31 bp, Artificial Sequences
  Synthetic
aggagattaggtagggttggttgatagcgtg

SEQ ID NO: 11280 - DNA, 32 bp, Artificial Sequences
  Synthetic
aggagattaggtagggttggttgatagcgtgt

SEQ ID NO: 11281 - DNA, 27 bp, Artificial Sequences
  Synthetic
tttttacggcgcggatattttggaggg

SEQ ID NO: 11282 - DNA, 28 bp, Artificial Sequences
  Synthetic
gcggatattttggagggcgagtagttgt

SEQ ID NO: 11283 - DNA, 28 bp, Artificial Sequences
  Synthetic
ttttttacggcgcggatattttggaggg

SEQ ID NO: 11284 - DNA, 29 bp, Artificial Sequences
  Synthetic
gcggatattttggagggcgagtagttgtc

SEQ ID NO: 11285 - DNA, 26 bp, Artificial Sequences
  Synthetic
ttttacggcgcggatattttggaggg

SEQ ID NO: 11286 - DNA, 30 bp, Artificial Sequences; identical to SEQ ID NO: 11276
  Synthetic

SEQ ID NO: 11287 - DNA, 30 bp, Artificial Sequences; identical to SEQ ID NO: 11277
  Synthetic

SEQ ID NO: 11288 - DNA, 31 bp, Artificial Sequences; identical to SEQ ID NO: 11278
  Synthetic

SEQ ID NO: 11289 - DNA, 31 bp, Artificial Sequences; identical to SEQ ID NO: 11279
  Synthetic

SEQ ID NO: 11290 - DNA, 32 bp, Artificial Sequences; identical to SEQ ID NO: 11280
  Synthetic

SEQ ID NO: 11291 - DNA, 29 bp, Artificial Sequences
  Synthetic
tgggaaaggggcgttagatgtgattttgt

SEQ ID NO: 11292 - DNA, 30 bp, Artificial Sequences
  Synthetic
tgggaaaggggcgttagatgtgattttgtt

SEQ ID NO: 11293 - DNA, 29 bp, Artificial Sequences
  Synthetic
gggaaaggggcgttagatgtgattttgtt

SEQ ID NO: 11294 - DNA, 30 bp, Artificial Sequences
  Synthetic
atgggaaaggggcgttagatgtgattttgt

SEQ ID NO: 11295 - DNA, 30 bp, Artificial Sequences
  Synthetic
gggaaaggggcgttagatgtgattttgttt

SEQ ID NO: 11296 - DNA, 27 bp, Artificial Sequences
  Synthetic
ggggaagcgggggtttcgttggttttt

SEQ ID NO: 11297 - DNA, 27 bp, Artificial Sequences
  Synthetic
tggggaagcgggggtttcgttggtttt

SEQ ID NO: 11298 - DNA, 26 bp, Artificial Sequences
  Synthetic
ggggaagcgggggtttcgttggtttt

SEQ ID NO: 11299 - DNA, 28 bp, Artificial Sequences
  Synthetic
ggggaagcgggggtttcgttggtttttt

SEQ ID NO: 11300 - DNA, 27 bp, Artificial Sequences
  Synthetic
gtggggaagcgggggtttcgttggttt

SEQ ID NO: 11301 - DNA, 28 bp, Artificial Sequences
  Synthetic
gcgtgttgtgttttatgggaaaggggcg

SEQ ID NO: 11302 - DNA, 29 bp, Artificial Sequences
  Synthetic
gcgtgttgtgttttatgggaaaggggcgt

SEQ ID NO: 11303 - DNA, 29 bp, Artificial Sequences
  Synthetic
tgcgtgttgtgttttatgggaaaggggcg

SEQ ID NO: 11304 - DNA, 28 bp, Artificial Sequences
  Synthetic
tgcgtgttgtgttttatgggaaaggggc

SEQ ID NO: 11305 - DNA, 27 bp, Artificial Sequences
  Synthetic
gcgtgttgtgttttatgggaaaggggc

SEQ ID NO: 11306 - DNA, 27 bp, Artificial Sequences
  Synthetic
ttttttgtcgtttcggggttgcggggc

SEQ ID NO: 11307 - DNA, 26 bp, Artificial Sequences
  Synthetic
tttttgtcgtttcggggttgcggggc

SEQ ID NO: 11308 - DNA, 27 bp, Artificial Sequences
  Synthetic
aggataaggggtttcggtcggtttggt

SEQ ID NO: 11309 - DNA, 26 bp, Artificial Sequences
  Synthetic
ttttttgtcgtttcggggttgcgggg

SEQ ID NO: 11310 - DNA, 27 bp, Artificial Sequences
  Synthetic
tttttgtcgtttcggggttgcggggcg

SEQ ID NO: 11311 - DNA, 27 bp, Artificial Sequences
  Synthetic
agtggagttagggaaaggtgggtggga

SEQ ID NO: 11312 - DNA, 27 bp, Artificial Sequences
  Synthetic
aagtggagttagggaaaggtgggtggg

SEQ ID NO: 11313 - DNA, 28 bp, Artificial Sequences
  Synthetic
aagtggagttagggaaaggtgggtggga

SEQ ID NO: 11314 - DNA, 27 bp, Artificial Sequences
  Synthetic
gtggagttagggaaaggtgggtgggat

SEQ ID NO: 11315 - DNA, 28 bp, Artificial Sequences
  Synthetic
agtggagttagggaaaggtgggtgggat

SEQ ID NO: 11316 - DNA, 27 bp, Artificial Sequences
  Synthetic
aggggagggaaggagaggtagttcggg

SEQ ID NO: 11317 - DNA, 27 bp, Artificial Sequences
  Synthetic
gggagggaaggagaggtagttcgggga

SEQ ID NO: 11318 - DNA, 27 bp, Artificial Sequences
  Synthetic
gtgtgggaggggagggaaggagaggta

SEQ ID NO: 11319 - DNA, 27 bp, Artificial Sequences
  Synthetic
aggggttaaggaagttgggtagcgcgg

SEQ ID NO: 11320 - DNA, 27 bp, Artificial Sequences
  Synthetic
aatatgggggtgtgggaggggagggaa

SEQ ID NO: 11321 - DNA, 27 bp, Artificial Sequences
  Synthetic
aggtgagggtttcgggttttcggtcgt

SEQ ID NO: 11322 - DNA, 27 bp, Artificial Sequences
  Synthetic
tggcggggagggtattttcgggagttt

SEQ ID NO: 11323 - DNA, 27 bp, Artificial Sequences
  Synthetic
atggcggggagggtattttcgggagtt

SEQ ID NO: 11324 - DNA, 27 bp, Artificial Sequences
  Synthetic
aatggcggggagggtattttcgggagt

SEQ ID NO: 11325 - DNA, 27 bp, Artificial Sequences
  Synthetic
tcggaggtagttcgggtaggtgagggt

SEQ ID NO: 11326 - DNA, 27 bp, Artificial Sequences
  Synthetic
aggggttaaggaagttgggtagcgcgg

SEQ ID NO: 11327 - DNA, 27 bp, Artificial Sequences
  Synthetic
ggggttaaggaagttgggtagcgcggt

SEQ ID NO: 11328 - DNA, 27 bp, Artificial Sequences
  Synthetic
gggttaaggaagttgggtagcgcggtc

SEQ ID NO: 11329 - DNA, 27 bp, Artificial Sequences
  Synthetic
aaggggttaaggaagttgggtagcgcg

SEQ ID NO: 11330 - DNA, 28 bp, Artificial Sequences
  Synthetic
aaggggttaaggaagttgggtagcgcgg

SEQ ID NO: 11331 - DNA, 27 bp, Artificial Sequences
  Synthetic
tggcggggagggtattttcgggagttt

SEQ ID NO: 11332 - DNA, 27 bp, Artificial Sequences
  Synthetic
atggcggggagggtattttcgggagtt

SEQ ID NO: 11333 - DNA, 27 bp, Artificial Sequences
  Synthetic
aatggcggggagggtattttcgggagt

SEQ ID NO: 11334 - DNA, 28 bp, Artificial Sequences
  Synthetic
tggcggggagggtattttcgggagtttt

SEQ ID NO: 11335 - DNA, 27 bp, Artificial Sequences
  Synthetic
ggcggggagggtattttcgggagtttt

SEQ ID NO: 11336 - DNA, 27 bp, Artificial Sequences
  Synthetic
aggggttaaggaagttgggtagcgcgg

SEQ ID NO: 11337 - DNA, 27 bp, Artificial Sequences
  Synthetic
ggggttaaggaagttgggtagcgcggt

SEQ ID NO: 11338 - DNA, 27 bp, Artificial Sequences
  Synthetic
gggttaaggaagttgggtagcgcggtc

SEQ ID NO: 11339 - DNA, 27 bp, Artificial Sequences
  Synthetic
gcgagtcggagggttttcgggaatgtt

SEQ ID NO: 11340 - DNA, 27 bp, Artificial Sequences
  Synthetic
aaggggttaaggaagttgggtagcgcg

SEQ ID NO: 11341 - DNA, 29 bp, Artificial Sequences
  Synthetic
gcggtttgcgttttggtttgtagttttcg

SEQ ID NO: 11342 - DNA, 30 bp, Artificial Sequences
  Synthetic
gcggtttgcgttttggtttgtagttttcga

SEQ ID NO: 11343 - DNA, 29 bp, Artificial Sequences
  Synthetic
tgtcgtttttagtggaagggtgagttcga

SEQ ID NO: 11344 - DNA, 29 bp, Artificial Sequences
  Synthetic
tcgtttttagtggaagggtgagttcgagt

SEQ ID NO: 11345 - DNA, 31 bp, Artificial Sequences
  Synthetic
cgttgtcgtttttagtggaagggtgagttcg

SEQ ID NO: 11346 - DNA, 27 bp, Artificial Sequences
  Synthetic
gcgagtcggagggttttcgggaatgtt

SEQ ID NO: 11347 - DNA, 28 bp, Artificial Sequences
  Synthetic
gcgagtcggagggttttcgggaatgttt

SEQ ID NO: 11348 - DNA, 26 bp, Artificial Sequences
  Synthetic
gcgagtcggagggttttcgggaatgt

SEQ ID NO: 11349 - DNA, 29 bp, Artificial Sequences
  Synthetic
gcgagtcggagggttttcgggaatgtttt

SEQ ID NO: 11350 - DNA, 27 bp, Artificial Sequences
  Synthetic
cgagtcggagggttttcgggaatgttt

SEQ ID NO: 11351 - DNA, 27 bp, Artificial Sequences
  Synthetic
tggcggaggtttgtgtaggggttgtgt

SEQ ID NO: 11352 - DNA, 27 bp, Artificial Sequences
  Synthetic
ttggcggaggtttgtgtaggggttgtg

SEQ ID NO: 11353 - DNA, 28 bp, Artificial Sequences
  Synthetic
ttggcggaggtttgtgtaggggttgtgt

SEQ ID NO: 11354 - DNA, 27 bp, Artificial Sequences
  Synthetic
tttggcggaggtttgtgtaggggttgt

SEQ ID NO: 11355 - DNA, 28 bp, Artificial Sequences
  Synthetic
tggcggaggtttgtgtaggggttgtgta

SEQ ID NO: 11356 - DNA, 29 bp, Artificial Sequences
  Synthetic
tgttttggatgtggttggtgtattggggt

SEQ ID NO: 11357 - DNA, 30 bp, Artificial Sequences
  Synthetic
tgttttggatgtggttggtgtattggggtt

SEQ ID NO: 11358 - DNA, 30 bp, Artificial Sequences
  Synthetic
ttgttttggatgtggttggtgtattggggt

SEQ ID NO: 11359 - DNA, 29 bp, Artificial Sequences
  Synthetic
gttttggatgtggttggtgtattggggtt

SEQ ID NO: 11360 - DNA, 29 bp, Artificial Sequences
  Synthetic
ttgttttggatgtggttggtgtattgggg

SEQ ID NO: 11361 - DNA, 27 bp, Artificial Sequences
  Synthetic
acgcgttgggaggagtgtaggttgtgg

SEQ ID NO: 11362 - DNA, 27 bp, Artificial Sequences
  Synthetic
ggaggagtgtaggttgtggggcgtgat

SEQ ID NO: 11363 - DNA, 27 bp, Artificial Sequences
  Synthetic
gttgggaggagtgtaggttgtggggcg

SEQ ID NO: 11364 - DNA, 27 bp, Artificial Sequences
  Synthetic
cgttgggaggagtgtaggttgtggggc

SEQ ID NO: 11365 - DNA, 27 bp, Artificial Sequences
  Synthetic
gcgttgggaggagtgtaggttgtgggg

SEQ ID NO: 11366 - DNA, 25 bp, Artificial Sequences
  Synthetic
gagggtttgggggcgcggtattgac

SEQ ID NO: 11367 - DNA, 26 bp, Artificial Sequences
  Synthetic
gagggtttgggggcgcggtattgacg

SEQ ID NO: 11368 - DNA, 26 bp, Artificial Sequences
  Synthetic
cgagggtttgggggcgcggtattgac

SEQ ID NO: 11369 - DNA, 27 bp, Artificial Sequences
  Synthetic
gagggtttgggggcgcggtattgacgg

SEQ ID NO: 11370 - DNA, 25 bp, Artificial Sequences
  Synthetic
cgagggtttgggggcgcggtattga

SEQ ID NO: 11371 - DNA, 27 bp, Artificial Sequences
  Synthetic
gaggttcggagggggtagaaaacgttt

SEQ ID NO: 11372 - DNA, 27 bp, Artificial Sequences
  Synthetic
aggttcggagggggtagaaaacgtttt

SEQ ID NO: 11373 - DNA, 28 bp, Artificial Sequences
  Synthetic
gaggttcggagggggtagaaaacgtttt

SEQ ID NO: 11374 - DNA, 28 bp, Artificial Sequences
  Synthetic
aggttcggagggggtagaaaacgttttt

SEQ ID NO: 11375 - DNA, 26 bp, Artificial Sequences
  Synthetic
gaggttcggagggggtagaaaacgtt

SEQ ID NO: 11376 - DNA, 27 bp, Artificial Sequences
  Synthetic
cgcgtagaaaggtgggtcggggttaga

SEQ ID NO: 11377 - DNA, 27 bp, Artificial Sequences
  Synthetic
gcgcgtagaaaggtgggtcggggttag

SEQ ID NO: 11378 - DNA, 28 bp, Artificial Sequences
  Synthetic
cgcgtagaaaggtgggtcggggttagaa

SEQ ID NO: 11379 - DNA, 26 bp, Artificial Sequences
  Synthetic
gcgcgtagaaaggtgggtcggggtta

SEQ ID NO: 11380 - DNA, 27 bp, Artificial Sequences
  Synthetic
gcgtagaaaggtgggtcggggttagaa

SEQ ID NO: 11381 - DNA, 26 bp, Artificial Sequences
  Synthetic
cgagtgcgcggggtttttcgttcgtc

SEQ ID NO: 11382 - DNA, 25 bp, Artificial Sequences
  Synthetic
cgagtgcgcggggtttttcgttcgt

SEQ ID NO: 11383 - DNA, 25 bp, Artificial Sequences
  Synthetic
gagtgcgcggggtttttcgttcgtc

SEQ ID NO: 11384 - DNA, 27 bp, Artificial Sequences
  Synthetic
gaggttcggagggggtagaaaacgttt

SEQ ID NO: 11385 - DNA, 24 bp, Artificial Sequences
  Synthetic
cgagtgcgcggggtttttcgttcg

SEQ ID NO: 11386 - DNA, 27 bp, Artificial Sequences
  Synthetic
cgggaatatttgtgggttgtcggcggg

SEQ ID NO: 11387 - DNA, 27 bp, Artificial Sequences
  Synthetic
gggaatatttgtgggttgtcggcgggg

SEQ ID NO: 11388 - DNA, 27 bp, Artificial Sequences
  Synthetic
tatttgtgggttgtcggcggggtaggc

SEQ ID NO: 11389 - DNA, 27 bp, Artificial Sequences
  Synthetic
ggaatatttgtgggttgtcggcggggt

SEQ ID NO: 11390 - DNA, 27 bp, Artificial Sequences
  Synthetic
tcgggaatatttgtgggttgtcggcgg

SEQ ID NO: 11391 - DNA, 27 bp, Artificial Sequences
  Synthetic
cgaggttgggggttcgggtcgtttttc

SEQ ID NO: 11392 - DNA, 27 bp, Artificial Sequences
  Synthetic
tttttcggttgcggacgggtcgaggtt

SEQ ID NO: 11393 - DNA, 27 bp, Artificial Sequences
  Synthetic
ttttttcggttgcggacgggtcgaggt

SEQ ID NO: 11394 - DNA, 26 bp, Artificial Sequences
  Synthetic
ttttttcggttgcggacgggtcgagg

SEQ ID NO: 11395 - DNA, 27 bp, Artificial Sequences
  Synthetic
ttttcggttgcggacgggtcgaggttg

SEQ ID NO: 11396 - DNA, 27 bp, Artificial Sequences
  Synthetic
gaggttgttcggcgggcgggaagtttc

SEQ ID NO: 11397 - DNA, 29 bp, Artificial Sequences
  Synthetic
gggaatatttgtgggttgtcggcggggta

SEQ ID NO: 11398 - DNA, 28 bp, Artificial Sequences
  Synthetic
ggaatatttgtgggttgtcggcggggta

SEQ ID NO: 11399 - DNA, 26 bp, Artificial Sequences
  Synthetic
aggttgttcggcgggcgggaagtttc

SEQ ID NO: 11400 - DNA, 26 bp, Artificial Sequences
  Synthetic
gaggttgttcggcgggcgggaagttt

SEQ ID NO: 11401 - DNA, 27 bp, Artificial Sequences
  Synthetic
cgaggttgggggttcgggtcgtttttc

SEQ ID NO: 11402 - DNA, 27 bp, Artificial Sequences
  Synthetic
tttttcggttgcggacgggtcgaggtt

SEQ ID NO: 11403 - DNA, 27 bp, Artificial Sequences
  Synthetic
ttttttcggttgcggacgggtcgaggt

SEQ ID NO: 11404 - DNA, 26 bp, Artificial Sequences
  Synthetic
ttttttcggttgcggacgggtcgagg

SEQ ID NO: 11405 - DNA, 27 bp, Artificial Sequences
  Synthetic
ttttcggttgcggacgggtcgaggttg

SEQ ID NO: 11406 - DNA, 27 bp, Artificial Sequences
  Synthetic
ggacggagaagggagggagtttgggag

SEQ ID NO: 11407 - DNA, 27 bp, Artificial Sequences
  Synthetic
gggacggagaagggagggagtttggga

SEQ ID NO: 11408 - DNA, 28 bp, Artificial Sequences
  Synthetic
gggagtttgggagagacgtaggtgtggc

SEQ ID NO: 11409 - DNA, 26 bp, Artificial Sequences
  Synthetic
gggacggagaagggagggagtttggg

SEQ ID NO: 11410 - DNA, 27 bp, Artificial Sequences
  Synthetic
acggagaagggagggagtttgggagag

SEQ ID NO: 11411 - DNA, 29 bp, Artificial Sequences
  Synthetic
agatttcgagggtgttacgtttcggttgt

SEQ ID NO: 11412 - DNA, 29 bp, Artificial Sequences
  Synthetic
gagatttcgagggtgttacgtttcggttg

SEQ ID NO: 11413 - DNA, 30 bp, Artificial Sequences
  Synthetic
gagatttcgagggtgttacgtttcggttgt

SEQ ID NO: 11414 - DNA, 29 bp, Artificial Sequences
  Synthetic
gatttcgagggtgttacgtttcggttgtt

SEQ ID NO: 11415 - DNA, 30 bp, Artificial Sequences
  Synthetic
agatttcgagggtgttacgtttcggttgtt

SEQ ID NO: 11416 - DNA, 27 bp, Artificial Sequences
  Synthetic
taggtgtggcgttcgtttgtgttggcg

SEQ ID NO: 11417 - DNA, 27 bp, Artificial Sequences
  Synthetic
cgttcgtttgtgttggcggggtggtag

SEQ ID NO: 11418 - DNA, 27 bp, Artificial Sequences
  Synthetic
ggacggagaagggagggagtttgggag

SEQ ID NO: 11419 - DNA, 27 bp, Artificial Sequences
  Synthetic
gttcgtttgtgttggcggggtggtagt

SEQ ID NO: 11420 - DNA, 27 bp, Artificial Sequences
  Synthetic
ttcgtttgtgttggcggggtggtagtc

SEQ ID NO: 11421 - DNA, 27 bp, Artificial Sequences
  Synthetic
tgaaggacgttgtgagtagcgggggtt

SEQ ID NO: 11422 - DNA, 27 bp, Artificial Sequences
  Synthetic
ttgaaggacgttgtgagtagcgggggt

SEQ ID NO: 11423 - DNA, 27 bp, Artificial Sequences
  Synthetic
gttgaaggacgttgtgagtagcggggg

SEQ ID NO: 11424 - DNA, 28 bp, Artificial Sequences
  Synthetic
tgttgaaggacgttgtgagtagcggggg

SEQ ID NO: 11425 - DNA, 28 bp, Artificial Sequences
  Synthetic
gttgaaggacgttgtgagtagcgggggt

SEQ ID NO: 11426 - DNA, 27 bp, Artificial Sequences
  Synthetic
cgcgggaggagaggttttcgtaggagg

SEQ ID NO: 11427 - DNA, 27 bp, Artificial Sequences
  Synthetic
tcgcgggaggagaggttttcgtaggag

SEQ ID NO: 11428 - DNA, 27 bp, Artificial Sequences
  Synthetic
ggttttcgcgggaggagaggttttcgt

SEQ ID NO: 11429 - DNA, 27 bp, Artificial Sequences
  Synthetic
gcgggaggagaggttttcgtaggagga

SEQ ID NO: 11430 - DNA, 27 bp, Artificial Sequences
  Synthetic
ttcgcgggaggagaggttttcgtagga

SEQ ID NO: 11431 - DNA, 27 bp, Artificial Sequences
  Synthetic
ggaagttttggatgcgcgcgggtagtt

SEQ ID NO: 11432 - DNA, 27 bp, Artificial Sequences
  Synthetic
atcgtaggaagttttggatgcgcgcgg

SEQ ID NO: 11433 - DNA, 27 bp, Artificial Sequences
  Synthetic
gatgcgcgcgggtagttgttcgaagtc

SEQ ID NO: 11434 - DNA, 27 bp, Artificial Sequences
  Synthetic
agttttggatgcgcgcgggtagttgtt

SEQ ID NO: 11435 - DNA, 27 bp, Artificial Sequences
  Synthetic
aagttttggatgcgcgcgggtagttgt

SEQ ID NO: 11436 - DNA, 27 bp, Artificial Sequences
  Synthetic
cgcgggaggagaggttttcgtaggagg

SEQ ID NO: 11437 - DNA, 27 bp, Artificial Sequences
  Synthetic
tcgcgggaggagaggttttcgtaggag

SEQ ID NO: 11438 - DNA, 27 bp, Artificial Sequences
  Synthetic
ggttttcgcgggaggagaggttttcgt

SEQ ID NO: 11439 - DNA, 27 bp, Artificial Sequences
  Synthetic
gcgggaggagaggttttcgtaggagga

SEQ ID NO: 11440 - DNA, 27 bp, Artificial Sequences
  Synthetic
ttcgcgggaggagaggttttcgtagga

SEQ ID NO: 11441 - DNA, 27 bp, Artificial Sequences
  Synthetic
ggaagttttggatgcgcgcgggtagtt

SEQ ID NO: 11442 - DNA, 27 bp, Artificial Sequences
  Synthetic
atcgtaggaagttttggatgcgcgcgg

SEQ ID NO: 11443 - DNA, 27 bp, Artificial Sequences
  Synthetic
gatgcgcgcgggtagttgttcgaagtc

SEQ ID NO: 11444 - DNA, 27 bp, Artificial Sequences
  Synthetic
agttttggatgcgcgcgggtagttgtt

SEQ ID NO: 11445 - DNA, 27 bp, Artificial Sequences
  Synthetic
aagttttggatgcgcgcgggtagttgt

SEQ ID NO: 11446 - DNA, 28 bp, Artificial Sequences
  Synthetic
aggtttgggagtcggaggatttgtttga

SEQ ID NO: 11447 - DNA, 28 bp, Artificial Sequences
  Synthetic
tgggagtcggaggatttgtttgaaggaa

SEQ ID NO: 11448 - DNA, 28 bp, Artificial Sequences
  Synthetic
ttgggagtcggaggatttgtttgaagga

SEQ ID NO: 11449 - DNA, 28 bp, Artificial Sequences
  Synthetic
ggttttggaaggaggtggaggtgatagt

SEQ ID NO: 11450 - DNA, 28 bp, Artificial Sequences
  Synthetic
tgataggttttggaaggaggtggaggtg

SEQ ID NO: 11451 - DNA, 32 bp, Artificial Sequences
  Synthetic
tttagttggggtgggagttaaatgtttttggg

SEQ ID NO: 11452 - DNA, 33 bp, Artificial Sequences
  Synthetic
tgtaggatgttttcgtagggagtgataggttga

SEQ ID NO: 11453 - DNA, 33 bp, Artificial Sequences
  Synthetic
ttttagttggggtgggagttaaatgtttttggg

SEQ ID NO: 11454 - DNA, 33 bp, Artificial Sequences
  Synthetic
gtttgtaggatgttttcgtagggagtgataggt

SEQ ID NO: 11455 - DNA, 33 bp, Artificial Sequences
  Synthetic
ttgtaggatgttttcgtagggagtgataggttg

SEQ ID NO: 11456 - DNA, 26 bp, Artificial Sequences
  Synthetic
aggtcggagttgggggttggaggaac

SEQ ID NO: 11457 - DNA, 27 bp, Artificial Sequences
  Synthetic
tggggagggtagtacgaggggttttgt

SEQ ID NO: 11458 - DNA, 27 bp, Artificial Sequences
  Synthetic
ttggaggaacgggtggcgtttttagga

SEQ ID NO: 11459 - DNA, 27 bp, Artificial Sequences
  Synthetic
tggaggaacgggtggcgtttttaggat

SEQ ID NO: 11460 - DNA, 27 bp, Artificial Sequences
  Synthetic
gttggaggaacgggtggcgtttttagg

SEQ ID NO: 11461 - DNA, 27 bp, Artificial Sequences
  Synthetic
attcggtttttggtgcgttcgggggag

SEQ ID NO: 11462 - DNA, 27 bp, Artificial Sequences
  Synthetic
tttttggtgcgttcgggggaggaggaa

SEQ ID NO: 11463 - DNA, 27 bp, Artificial Sequences
  Synthetic
cgttcgggggaggaggaagtttggagt

SEQ ID NO: 11464 - DNA, 27 bp, Artificial Sequences
  Synthetic
agtgggtcgaggagtttgggttgtggt

SEQ ID NO: 11465 - DNA, 27 bp, Artificial Sequences
  Synthetic
aattcggtttttggtgcgttcggggga

SEQ ID NO: 11466 - DNA, 27 bp, Artificial Sequences
  Synthetic
ttgtgggttttttagttcggcgcgggt

SEQ ID NO: 11467 - DNA, 27 bp, Artificial Sequences
  Synthetic
tgtgggttttttagttcggcgcgggta

SEQ ID NO: 11468 - DNA, 28 bp, Artificial Sequences
  Synthetic
tttgtgggttttttagttcggcgcgggt

SEQ ID NO: 11469 - DNA, 27 bp, Artificial Sequences
  Synthetic
tttgtgggttttttagttcggcgcggg

SEQ ID NO: 11470 - DNA, 26 bp, Artificial Sequences
  Synthetic
tgtgggttttttagttcggcgcgggt

SEQ ID NO: 11471 - DNA, 27 bp, Artificial Sequences
  Synthetic
tgatgggtgggaaaagatcggtgaagt

SEQ ID NO: 11472 - DNA, 28 bp, Artificial Sequences
  Synthetic
tggttattggggaatggttggttagcgt

SEQ ID NO: 11473 - DNA, 28 bp, Artificial Sequences
  Synthetic
tgagagaagggtagggaggtgtttacgt

SEQ ID NO: 11474 - DNA, 28 bp, Artificial Sequences
  Synthetic
ttgatgggtgggaaaagatcggtgaagt

SEQ ID NO: 11475 - DNA, 29 bp, Artificial Sequences
  Synthetic
atggttattggggaatggttggttagcgt

SEQ ID NO: 11476 - DNA, 31 bp, Artificial Sequences
  Synthetic
tggaggttgggttaagaaggtagagaagagt

SEQ ID NO: 11477 - DNA, 32 bp, Artificial Sequences
  Synthetic
gggattggattatgatgttgtttggaacgtgg

SEQ ID NO: 11478 - DNA, 32 bp, Artificial Sequences
  Synthetic
atggaggttgggttaagaaggtagagaagagt

SEQ ID NO: 11479 - DNA, 33 bp, Artificial Sequences
  Synthetic
agggattggattatgatgttgtttggaacgtgg

SEQ ID NO: 11480 - DNA, 33 bp, Artificial Sequences
  Synthetic
gggattggattatgatgttgtttggaacgtgga

SEQ ID NO: 11481 - DNA, 27 bp, Artificial Sequences
  Synthetic
gtggtcgagtggaagcggagaggagtg

SEQ ID NO: 11482 - DNA, 27 bp, Artificial Sequences
  Synthetic
gagtggaagcggagaggagtgagagcg

SEQ ID NO: 11483 - DNA, 27 bp, Artificial Sequences
  Synthetic
cgagtggaagcggagaggagtgagagc

SEQ ID NO: 11484 - DNA, 27 bp, Artificial Sequences
  Synthetic
gtggaagcggagaggagtgagagcgtt

SEQ ID NO: 11485 - DNA, 27 bp, Artificial Sequences
  Synthetic
tggaagcggagaggagtgagagcgttg

SEQ ID NO: 11486 - DNA, 27 bp, Artificial Sequences
  Synthetic
cggtttcgttttggttggtcgcgtcgt

SEQ ID NO: 11487 - DNA, 27 bp, Artificial Sequences
  Synthetic
tggtcgcggtgttgtttttcggaaggt

SEQ ID NO: 11488 - DNA, 27 bp, Artificial Sequences
  Synthetic
ggtttcgttttggttggtcgcgtcgtt

SEQ ID NO: 11489 - DNA, 28 bp, Artificial Sequences
  Synthetic
tggtcgcggtgttgtttttcggaaggtt

SEQ ID NO: 11490 - DNA, 28 bp, Artificial Sequences
  Synthetic
ttggtcgcggtgttgtttttcggaaggt

SEQ ID NO: 11491 - DNA, 27 bp, Artificial Sequences
  Synthetic
ggagttagtggcggtggaaggaagggg

SEQ ID NO: 11492 - DNA, 27 bp, Artificial Sequences
  Synthetic
ggcgttgcgggtgagatcgttcgtaag

SEQ ID NO: 11493 - DNA, 27 bp, Artificial Sequences
  Synthetic
gggcgtcgggttttggtgttgtcgttt

SEQ ID NO: 11494 - DNA, 27 bp, Artificial Sequences
  Synthetic
agtggcggtggaaggaaggggaagaat

SEQ ID NO: 11495 - DNA, 27 bp, Artificial Sequences
  Synthetic
aggagttagtggcggtggaaggaaggg

SEQ ID NO: 11496 - DNA, 27 bp, Artificial Sequences
  Synthetic
taatgtcgggcggggagttttaggcgt

SEQ ID NO: 11497 - DNA, 27 bp, Artificial Sequences
  Synthetic
gtcgagtcggggttgggttttaggggt

SEQ ID NO: 11498 - DNA, 27 bp, Artificial Sequences
  Synthetic
gttacgacggagggggttttttcgggc

SEQ ID NO: 11499 - DNA, 27 bp, Artificial Sequences
  Synthetic
cggggtaatgtcgggcggggagtttta

SEQ ID NO: 11500 - DNA, 27 bp, Artificial Sequences
  Synthetic
acgaggcgggtttggagttggggatta

SEQ ID NO: 11501 - DNA, 27 bp, Artificial Sequences
  Synthetic
agtagggggcgcgtttggggttagttt

SEQ ID NO: 11502 - DNA, 27 bp, Artificial Sequences
  Synthetic
aagtagggggcgcgtttggggttagtt

SEQ ID NO: 11503 - DNA, 27 bp, Artificial Sequences
  Synthetic
gggggcgcgtttggggttagtttgtag

SEQ ID NO: 11504 - DNA, 27 bp, Artificial Sequences
  Synthetic
gtagggggcgcgtttggggttagtttg

SEQ ID NO: 11505 - DNA, 27 bp, Artificial Sequences
  Synthetic
ggcgttgcgggtgagatcgttcgtaag

SEQ ID NO: 11506 - DNA, 27 bp, Artificial Sequences
  Synthetic
ttcgcggcgggattttgaggttggttc

SEQ ID NO: 11507 - DNA, 27 bp, Artificial Sequences
  Synthetic
cgggggttttgtcgtcggattttgggg

SEQ ID NO: 11508 - DNA, 27 bp, Artificial Sequences
  Synthetic
gtcgagtcggggttgggttttaggggt

SEQ ID NO: 11509 - DNA, 27 bp, Artificial Sequences
  Synthetic
gttacgacggagggggttttttcgggc

SEQ ID NO: 11510 - DNA, 27 bp, Artificial Sequences
  Synthetic
tttcgcggcgggattttgaggttggtt

SEQ ID NO: 11511 - DNA, 27 bp, Artificial Sequences
  Synthetic
ggggatcgggtattgaagttcggcggt

SEQ ID NO: 11512 - DNA, 27 bp, Artificial Sequences
  Synthetic
ggatcgggtattgaagttcggcggtgg

SEQ ID NO: 11513 - DNA, 27 bp, Artificial Sequences
  Synthetic
gggatcgggtattgaagttcggcggtg

SEQ ID NO: 11514 - DNA, 27 bp, Artificial Sequences
  Synthetic
cgggtattgaagttcggcggtggtagg

SEQ ID NO: 11515 - DNA, 28 bp, Artificial Sequences
  Synthetic
cgggtattgaagttcggcggtggtagga

SEQ ID NO: 11516 - DNA, 27 bp, Artificial Sequences
  Synthetic
ggcggtcgtgtatttcgggaggcgata

SEQ ID NO: 11517 - DNA, 27 bp, Artificial Sequences
  Synthetic
ttcgggagcggttggagtagtagtggc

SEQ ID NO: 11518 - DNA, 28 bp, Artificial Sequences
  Synthetic
ggcggtcgtgtatttcgggaggcgatat

SEQ ID NO: 11519 - DNA, 28 bp, Artificial Sequences
  Synthetic
gttcgggagcggttggagtagtagtggc

SEQ ID NO: 11520 - DNA, 27 bp, Artificial Sequences
  Synthetic
tcgggagcggttggagtagtagtggcg

SEQ ID NO: 11521 - DNA, 27 bp, Artificial Sequences
  Synthetic
agtcgtcgttgttttgtggtgtcgttt

SEQ ID NO: 11522 - DNA, 28 bp, Artificial Sequences
  Synthetic
tgtagtcgtcgttgttttgtggtgtcgt

SEQ ID NO: 11523 - DNA, 27 bp, Artificial Sequences
  Synthetic
gtagtcgtcgttgttttgtggtgtcgt

SEQ ID NO: 11524 - DNA, 27 bp, Artificial Sequences
  Synthetic
tgtagtcgtcgttgttttgtggtgtcg

SEQ ID NO: 11525 - DNA, 28 bp, Artificial Sequences
  Synthetic
agtcgtcgttgttttgtggtgtcgtttt

SEQ ID NO: 11526 - DNA, 27 bp, Artificial Sequences
  Synthetic
agagagagaagagggggcgggagttgt

SEQ ID NO: 11527 - DNA, 27 bp, Artificial Sequences
  Synthetic
tgagagagagaagagggggcgggagtt

SEQ ID NO: 11528 - DNA, 27 bp, Artificial Sequences
  Synthetic
ttcgggagcggttggagtagtagtggc

SEQ ID NO: 11529 - DNA, 27 bp, Artificial Sequences
  Synthetic
gagggggcgggagttgtttttggttgt

SEQ ID NO: 11530 - DNA, 27 bp, Artificial Sequences
  Synthetic
agagggggcgggagttgtttttggttg

SEQ ID NO: 11531 - DNA, 31 bp, Artificial Sequences
  Synthetic
tgtttttgtagtcgtcgttgttttgtggtgt

SEQ ID NO: 11532 - DNA, 32 bp, Artificial Sequences
  Synthetic
tgtttttgtagtcgtcgttgttttgtggtgtc

SEQ ID NO: 11533 - DNA, 32 bp, Artificial Sequences
  Synthetic
ttgtttttgtagtcgtcgttgttttgtggtgt

SEQ ID NO: 11534 - DNA, 32 bp, Artificial Sequences
  Synthetic
tgttgtttttgtagtcgtcgttgttttgtggt

SEQ ID NO: 11535 - DNA, 22 bp, Artificial Sequences
  Synthetic
gatattcgttcggtggcggcgg

SEQ ID NO: 11536 - DNA, 27 bp, Artificial Sequences
  Synthetic
agagagagaagagggggcgggagttgt

SEQ ID NO: 11537 - DNA, 27 bp, Artificial Sequences
  Synthetic
tgagagagagaagagggggcgggagtt

SEQ ID NO: 11538 - DNA, 27 bp, Artificial Sequences
  Synthetic
ttgagagagagaagagggggcgggagt

SEQ ID NO: 11539 - DNA, 27 bp, Artificial Sequences
  Synthetic
agttgagagagagaagagggggcggga

SEQ ID NO: 11540 - DNA, 27 bp, Artificial Sequences
  Synthetic
gagggggcgggagttgtttttggttgt

SEQ ID NO: 11541 - DNA, 27 bp, Artificial Sequences
  Synthetic
agagttggtgaggagttgggaggggga

SEQ ID NO: 11542 - DNA, 27 bp, Artificial Sequences
  Synthetic
gagttggtgaggagttgggagggggat

SEQ ID NO: 11543 - DNA, 28 bp, Artificial Sequences
  Synthetic
agagttggtgaggagttgggagggggat

SEQ ID NO: 11544 - DNA, 27 bp, Artificial Sequences
  Synthetic
agttggtgaggagttgggagggggatt

SEQ ID NO: 11545 - DNA, 27 bp, Artificial Sequences
  Synthetic
tagagttggtgaggagttgggaggggg

SEQ ID NO: 11546 - DNA, 28 bp, Artificial Sequences
  Synthetic
gggtagtgaagtggatttgggttagggt

SEQ ID NO: 11547 - DNA, 29 bp, Artificial Sequences
  Synthetic
agggtagtgaagtggatttgggttagggt

SEQ ID NO: 11548 - DNA, 29 bp, Artificial Sequences
  Synthetic
gggtagtgaagtggatttgggttagggtt

SEQ ID NO: 11549 - DNA, 30 bp, Artificial Sequences
  Synthetic
agggtagtgaagtggatttgggttagggtt

SEQ ID NO: 11550 - DNA, 30 bp, Artificial Sequences
  Synthetic
tagggtagtgaagtggatttgggttagggt

SEQ ID NO: 11551 - DNA, 27 bp, Artificial Sequences
  Synthetic
tgagggaagttagggggcgttagggga

SEQ ID NO: 11552 - DNA, 27 bp, Artificial Sequences
  Synthetic
gagggaagttagggggcgttaggggag

SEQ ID NO: 11553 - DNA, 27 bp, Artificial Sequences
  Synthetic
agggaagttagggggcgttaggggagg

SEQ ID NO: 11554 - DNA, 27 bp, Artificial Sequences
  Synthetic
ttgagggaagttagggggcgttagggg

SEQ ID NO: 11555 - DNA, 28 bp, Artificial Sequences
  Synthetic
ttgagggaagttagggggcgttagggga

SEQ ID NO: 11556 - DNA, 27 bp, Artificial Sequences
  Synthetic
ttggttggttgggtgtggtaaagtcgt

SEQ ID NO: 11557 - DNA, 27 bp, Artificial Sequences
  Synthetic
tggttggttgggtgtggtaaagtcgta

SEQ ID NO: 11558 - DNA, 28 bp, Artificial Sequences
  Synthetic
attggttggttgggtgtggtaaagtcgt

SEQ ID NO: 11559 - DNA, 26 bp, Artificial Sequences
  Synthetic
tggttggttgggtgtggtaaagtcgt

SEQ ID NO: 11560 - DNA, 28 bp, Artificial Sequences
  Synthetic
ttggttggttgggtgtggtaaagtcgta

SEQ ID NO: 11561 - DNA, 27 bp, Artificial Sequences
  Synthetic
aggagggaatggtgttgtacggttgga

SEQ ID NO: 11562 - DNA, 29 bp, Artificial Sequences
  Synthetic
gggtggtgttttttagggtgtttcggggt

SEQ ID NO: 11563 - DNA, 29 bp, Artificial Sequences
  Synthetic
tgggtggtgttttttagggtgtttcgggg

SEQ ID NO: 11564 - DNA, 28 bp, Artificial Sequences
  Synthetic
gggtggtgttttttagggtgtttcgggg

SEQ ID NO: 11565 - DNA, 27 bp, Artificial Sequences
  Synthetic
agggaatggtgttgtacggttggatcg

SEQ ID NO: 11566 - DNA, 27 bp, Artificial Sequences
  Synthetic
tttcggtagggtaggacggggtagggg

SEQ ID NO: 11567 - DNA, 27 bp, Artificial Sequences
  Synthetic
gggtaggacggggtagggggtcgattt

SEQ ID NO: 11568 - DNA, 27 bp, Artificial Sequences
  Synthetic
tagggtaggacggggtagggggtcgat

SEQ ID NO: 11569 - DNA, 26 bp, Artificial Sequences
  Synthetic
ttcggtagggtaggacggggtagggg

SEQ ID NO: 11570 - DNA, 28 bp, Artificial Sequences
  Synthetic
gggtaggacggggtagggggtcgattta

SEQ ID NO: 11571 - DNA, 27 bp, Artificial Sequences
  Synthetic
gtgttggggggttggagtgcgtttgtt

SEQ ID NO: 11572 - DNA, 27 bp, Artificial Sequences
  Synthetic
tgtgtgagtgtgttggggggttggagt

SEQ ID NO: 11573 - DNA, 27 bp, Artificial Sequences
  Synthetic
gtgtgttggggggttggagtgcgtttg

SEQ ID NO: 11574 - DNA, 27 bp, Artificial Sequences
  Synthetic
tggggggttggagtgcgtttgttttgt

SEQ ID NO: 11575 - DNA, 27 bp, Artificial Sequences
  Synthetic
tgttggggggttggagtgcgtttgttt

SEQ ID NO: 11576 - DNA, 28 bp, Artificial Sequences
  Synthetic
cggggtttattagagggtggtagcgggt

SEQ ID NO: 11577 - DNA, 27 bp, Artificial Sequences
  Synthetic
cggggtttattagagggtggtagcggg

SEQ ID NO: 11578 - DNA, 28 bp, Artificial Sequences
  Synthetic
tcggggtttattagagggtggtagcggg

SEQ ID NO: 11579 - DNA, 29 bp, Artificial Sequences
  Synthetic
tcggggtttattagagggtggtagcgggt

SEQ ID NO: 11580 - DNA, 27 bp, Artificial Sequences
  Synthetic
ggggtttattagagggtggtagcgggt

SEQ ID NO: 11581 - DNA, 32 bp, Artificial Sequences
  Synthetic
tggtgttagtttgttttaggtgttgagggagt

SEQ ID NO: 11582 - DNA, 33 bp, Artificial Sequences
  Synthetic
tggtgttagtttgttttaggtgttgagggagtt

SEQ ID NO: 11583 - DNA, 33 bp, Artificial Sequences
  Synthetic
ttggtgttagtttgttttaggtgttgagggagt

SEQ ID NO: 11584 - DNA, 33 bp, Artificial Sequences
  Synthetic
gtttgttttaggtgttgagggagttgttttggt

SEQ ID NO: 11585 - DNA, 33 bp, Artificial Sequences
  Synthetic
agtttgttttaggtgttgagggagttgttttgg

SEQ ID NO: 11586 - DNA, 27 bp, Artificial Sequences
  Synthetic
agatggtgtcgggtatgaagcgggtcg

SEQ ID NO: 11587 - DNA, 27 bp, Artificial Sequences
  Synthetic
gatggtgtcgggtatgaagcgggtcga

SEQ ID NO: 11588 - DNA, 27 bp, Artificial Sequences
  Synthetic
atagcggtcggtcgggcgtttagttgt

SEQ ID NO: 11589 - DNA, 27 bp, Artificial Sequences
  Synthetic
ttgtagatagcggtcggtcgggcgttt

SEQ ID NO: 11590 - DNA, 27 bp, Artificial Sequences
  Synthetic
ggggcgggtcgaggggaagttaatgat

SEQ ID NO: 11591 - DNA, 27 bp, Artificial Sequences
  Synthetic
tgtcgtgggtgtattcggatggggtgg

SEQ ID NO: 11592 - DNA, 27 bp, Artificial Sequences
  Synthetic
ggtcgcgagttggtgtgggtttcgaag

SEQ ID NO: 11593 - DNA, 27 bp, Artificial Sequences
  Synthetic
gggcgttcggtcggtcgttgtttgtag

SEQ ID NO: 11594 - DNA, 27 bp, Artificial Sequences
  Synthetic
tcgggggaggagatttgttttcggcgt

SEQ ID NO: 11595 - DNA, 27 bp, Artificial Sequences
  Synthetic
gagggtaagtagggtcggcggggtttg

SEQ ID NO: 11596 - DNA, 27 bp, Artificial Sequences
  Synthetic
tcgtttggattttagtcggggtggcgt

SEQ ID NO: 11597 - DNA, 27 bp, Artificial Sequences
  Synthetic
cgtttggattttagtcggggtggcgta

SEQ ID NO: 11598 - DNA, 28 bp, Artificial Sequences
  Synthetic
tcgtttggattttagtcggggtggcgta

SEQ ID NO: 11599 - DNA, 26 bp, Artificial Sequences
  Synthetic
cgtttggattttagtcggggtggcgt

SEQ ID NO: 11600 - DNA, 26 bp, Artificial Sequences
  Synthetic
tcgtttggattttagtcggggtggcg

SEQ ID NO: 11601 - DNA, 27 bp, Artificial Sequences
  Synthetic
cgggtgtggtggcgggtgtttgtaatt

SEQ ID NO: 11602 - DNA, 27 bp, Artificial Sequences
  Synthetic
attagtcgggtgtggtggcgggtgttt

SEQ ID NO: 11603 - DNA, 27 bp, Artificial Sequences
  Synthetic
aattagtcgggtgtggtggcgggtgtt

SEQ ID NO: 11604 - DNA, 27 bp, Artificial Sequences
  Synthetic
tcgggtgtggtggcgggtgtttgtaat

SEQ ID NO: 11605 - DNA, 27 bp, Artificial Sequences
  Synthetic
ttagtcgggtgtggtggcgggtgtttg

SEQ ID NO: 11606 - DNA, 27 bp, Artificial Sequences
  Synthetic
tgggttgcggtaggtgttagaggtagg

SEQ ID NO: 11607 - DNA, 28 bp, Artificial Sequences
  Synthetic
tgggttgcggtaggtgttagaggtagga

SEQ ID NO: 11608 - DNA, 27 bp, Artificial Sequences
  Synthetic
gggttgcggtaggtgttagaggtagga

SEQ ID NO: 11609 - DNA, 27 bp, Artificial Sequences
  Synthetic
agtcgaattttgggttgcggtaggtgt

SEQ ID NO: 11610 - DNA, 27 bp, Artificial Sequences
  Synthetic
agagagagggttgtttggagtggaggt

SEQ ID NO: 11611 - DNA, 27 bp, Artificial Sequences
  Synthetic
cggagcgggttttggggttcggttttt

SEQ ID NO: 11612 - DNA, 27 bp, Artificial Sequences
  Synthetic
ttggtttcggagcgggttttggggttc

SEQ ID NO: 11613 - DNA, 27 bp, Artificial Sequences
  Synthetic
tttggtttcggagcgggttttggggtt

SEQ ID NO: 11614 - DNA, 27 bp, Artificial Sequences
  Synthetic
ttttggtttcggagcgggttttggggt

SEQ ID NO: 11615 - DNA, 27 bp, Artificial Sequences
  Synthetic
gttttggtttcggagcgggttttgggg

SEQ ID NO: 11616 - DNA, 27 bp, Artificial Sequences
  Synthetic
cgggcgaacggatgatggaaggatcga

SEQ ID NO: 11617 - DNA, 27 bp, Artificial Sequences
  Synthetic
agcgggcgaacggatgatggaaggatc

SEQ ID NO: 11618 - DNA, 27 bp, Artificial Sequences
  Synthetic
gagcgggcgaacggatgatggaaggat

SEQ ID NO: 11619 - DNA, 26 bp, Artificial Sequences
  Synthetic
agcgggcgaacggatgatggaaggat

SEQ ID NO: 11620 - DNA, 27 bp, Artificial Sequences
  Synthetic
gcgggcgaacggatgatggaaggatcg

SEQ ID NO: 11621 - DNA, 27 bp, Artificial Sequences
  Synthetic
ttggtttcggagcgggttttggggttt

SEQ ID NO: 11622 - DNA, 27 bp, Artificial Sequences
  Synthetic
tttggtttcggagcgggttttggggtt

SEQ ID NO: 11623 - DNA, 27 bp, Artificial Sequences
  Synthetic
ttttggtttcggagcgggttttggggt

SEQ ID NO: 11624 - DNA, 27 bp, Artificial Sequences
  Synthetic
gttttggtttcggagcgggttttgggg

SEQ ID NO: 11625 - DNA, 28 bp, Artificial Sequences
  Synthetic
tgttttggtttcggagcgggttttgggg

SEQ ID NO: 11626 - DNA, 27 bp, Artificial Sequences
  Synthetic
cgggcgaacggatgatggaaggatcga

SEQ ID NO: 11627 - DNA, 27 bp, Artificial Sequences
  Synthetic
agcgggcgaacggatgatggaaggatc

SEQ ID NO: 11628 - DNA, 27 bp, Artificial Sequences
  Synthetic
gagcgggcgaacggatgatggaaggat

SEQ ID NO: 11629 - DNA, 27 bp, Artificial Sequences
  Synthetic
cgggcggggggagatgggagtatttta

SEQ ID NO: 11630 - DNA, 26 bp, Artificial Sequences
  Synthetic
cgggcggggggagatgggagtatttt

SEQ ID NO: 11631 - DNA, 27 bp, Artificial Sequences
  Synthetic
atggtggtcgcgttgggtcggtttttt

SEQ ID NO: 11632 - DNA, 27 bp, Artificial Sequences
  Synthetic
tggtggtcgcgttgggtcggtttttta

SEQ ID NO: 11633 - DNA, 27 bp, Artificial Sequences
  Synthetic
tatggtggtcgcgttgggtcggttttt

SEQ ID NO: 11634 - DNA, 27 bp, Artificial Sequences
  Synthetic
ttatggtggtcgcgttgggtcggtttt

SEQ ID NO: 11635 - DNA, 27 bp, Artificial Sequences
  Synthetic
tttatggtggtcgcgttgggtcggttt

SEQ ID NO: 11636 - DNA, 27 bp, Artificial Sequences
  Synthetic
cgggcggggggagatgggagtatttta

SEQ ID NO: 11637 - DNA, 27 bp, Artificial Sequences
  Synthetic
tcgggagggagaggattagttcgggga

SEQ ID NO: 11638 - DNA, 27 bp, Artificial Sequences
  Synthetic
cgggagggagaggattagttcggggag

SEQ ID NO: 11639 - DNA, 26 bp, Artificial Sequences
  Synthetic
cgggcggggggagatgggagtatttt

SEQ ID NO: 11640 - DNA, 27 bp, Artificial Sequences
  Synthetic
gatagaggtaaaggttcggtcgcgggc

SEQ ID NO: 11641 - DNA, 27 bp, Artificial Sequences
  Synthetic
tgcggtttggttcgttagaggcggttt

SEQ ID NO: 11642 - DNA, 27 bp, Artificial Sequences
  Synthetic
ttgcggtttggttcgttagaggcggtt

SEQ ID NO: 11643 - DNA, 27 bp, Artificial Sequences
  Synthetic
tttgcggtttggttcgttagaggcggt

SEQ ID NO: 11644 - DNA, 27 bp, Artificial Sequences
  Synthetic
gcggtttggttcgttagaggcggtttg

SEQ ID NO: 11645 - DNA, 28 bp, Artificial Sequences
  Synthetic
gcggtttggttcgttagaggcggtttgt

SEQ ID NO: 11646 - DNA, 27 bp, Artificial Sequences
  Synthetic
gcggagaaggaaggaggaagagcggag

SEQ ID NO: 11647 - DNA, 27 bp, Artificial Sequences
  Synthetic
agtttgcgttggttgttcggtaggcgg

SEQ ID NO: 11648 - DNA, 27 bp, Artificial Sequences
  Synthetic
cggaggttagggcgggttttaggtcgt

SEQ ID NO: 11649 - DNA, 27 bp, Artificial Sequences
  Synthetic
gtttgcgttggttgttcggtaggcgga

SEQ ID NO: 11650 - DNA, 27 bp, Artificial Sequences
  Synthetic
ttggcgttgggagggaaggggttaagg

SEQ ID NO: 11651 - DNA, 27 bp, Artificial Sequences
  Synthetic
gagagtgggtgttggggagacgaaggg

SEQ ID NO: 11652 - DNA, 27 bp, Artificial Sequences
  Synthetic
tgggtgttggggagacgaaggggtttt

SEQ ID NO: 11653 - DNA, 27 bp, Artificial Sequences
  Synthetic
gtgggtgttggggagacgaaggggttt

SEQ ID NO: 11654 - DNA, 27 bp, Artificial Sequences
  Synthetic
agagagtgggtgttggggagacgaagg

SEQ ID NO: 11655 - DNA, 27 bp, Artificial Sequences
  Synthetic
agtgggtgttggggagacgaaggggtt

SEQ ID NO: 11656 - DNA, 27 bp, Artificial Sequences
  Synthetic
ggaaaggttgtcgggggtaggggaagg

SEQ ID NO: 11657 - DNA, 27 bp, Artificial Sequences
  Synthetic
gggaaaggttgtcgggggtaggggaag

SEQ ID NO: 11658 - DNA, 27 bp, Artificial Sequences
  Synthetic
gttgtcgggggtaggggaaggtggttt

SEQ ID NO: 11659 - DNA, 27 bp, Artificial Sequences
  Synthetic
tgggggtaggtgggttcggtgataggt

SEQ ID NO: 11660 - DNA, 27 bp, Artificial Sequences
  Synthetic
ggggggatgagggtgggtaaatcggtg

SEQ ID NO: 11661 - DNA, 33 bp, Artificial Sequences
  Synthetic
tggggatattttttggtgagttttgttgttcgt

SEQ ID NO: 11662 - DNA, 34 bp, Artificial Sequences
  Synthetic
tggggatattttttggtgagttttgttgttcgtt

SEQ ID NO: 11663 - DNA, 34 bp, Artificial Sequences
  Synthetic
ttggggatattttttggtgagttttgttgttcgt

SEQ ID NO: 11664 - DNA, 35 bp, Artificial Sequences
  Synthetic
ttggggatattttttggtgagttttgttgttcgtt

SEQ ID NO: 11665 - DNA, 35 bp, Artificial Sequences
  Synthetic
tttggggatattttttggtgagttttgttgttcgt

SEQ ID NO: 11666 - DNA, 27 bp, Artificial Sequences
  Synthetic
ggaaaggttgtcgggggtaggggaagg

SEQ ID NO: 11667 - DNA, 27 bp, Artificial Sequences
  Synthetic
gggaaaggttgtcgggggtaggggaag

SEQ ID NO: 11668 - DNA, 27 bp, Artificial Sequences
  Synthetic
gttgtcgggggtaggggaaggtggttt

SEQ ID NO: 11669 - DNA, 27 bp, Artificial Sequences
  Synthetic
gtgtggttggtggcgggtagtagggtt

SEQ ID NO: 11670 - DNA, 27 bp, Artificial Sequences
  Synthetic
gggtaggggaaggtggtttagaggcgg

SEQ ID NO: 11671 - DNA, 27 bp, Artificial Sequences
  Synthetic
tggggatttgaggcgatggatgttgtt

SEQ ID NO: 11672 - DNA, 27 bp, Artificial Sequences
  Synthetic
ttggggatttgaggcgatggatgttgt

SEQ ID NO: 11673 - DNA, 28 bp, Artificial Sequences
  Synthetic
tggggatttgaggcgatggatgttgttg

SEQ ID NO: 11674 - DNA, 27 bp, Artificial Sequences
  Synthetic
ggggatttgaggcgatggatgttgttg

SEQ ID NO: 11675 - DNA, 29 bp, Artificial Sequences
  Synthetic
tggggatttgaggcgatggatgttgttga

SEQ ID NO: 11676 - DNA, 27 bp, Artificial Sequences
  Synthetic
agggatgcggggaagggaagacgtttc

SEQ ID NO: 11677 - DNA, 27 bp, Artificial Sequences
  Synthetic
gtagggatgcggggaagggaagacgtt

SEQ ID NO: 11678 - DNA, 27 bp, Artificial Sequences
  Synthetic
tcgttggaggcggaatggagggtaagg

SEQ ID NO: 11679 - DNA, 27 bp, Artificial Sequences
  Synthetic
agatttcgggtagggatgcggggaagg

SEQ ID NO: 11680 - DNA, 27 bp, Artificial Sequences
  Synthetic
gatttcgggtagggatgcggggaaggg

SEQ ID NO: 11681 - DNA, 27 bp, Artificial Sequences
  Synthetic
ggattcgttttgagggaggaggcggga

SEQ ID NO: 11682 - DNA, 27 bp, Artificial Sequences
  Synthetic
gtttcggtagttcgcgggtttggtcgg

SEQ ID NO: 11683 - DNA, 27 bp, Artificial Sequences
  Synthetic
ggtttcggtagttcgcgggtttggtcg

SEQ ID NO: 11684 - DNA, 27 bp, Artificial Sequences
  Synthetic
cgttttgagggaggaggcgggagttga

SEQ ID NO: 11685 - DNA, 27 bp, Artificial Sequences
  Synthetic
tcgttttgagggaggaggcgggagttg

SEQ ID NO: 11686 - DNA, 27 bp, Artificial Sequences
  Synthetic
tcgttggaggcggaatggagggtaagg

SEQ ID NO: 11687 - DNA, 27 bp, Artificial Sequences
  Synthetic
gcggaatggagggtaaggcgaaggagg

SEQ ID NO: 11688 - DNA, 27 bp, Artificial Sequences
  Synthetic
ggcggaatggagggtaaggcgaaggag

SEQ ID NO: 11689 - DNA, 27 bp, Artificial Sequences
  Synthetic
gaggcggaatggagggtaaggcgaagg

SEQ ID NO: 11690 - DNA, 27 bp, Artificial Sequences
  Synthetic
ggaggcggaatggagggtaaggcgaag

SEQ ID NO: 11691 - DNA, 28 bp, Artificial Sequences
  Synthetic
tggttagttcgtttcgtttcgttgcggt

SEQ ID NO: 11692 - DNA, 27 bp, Artificial Sequences
  Synthetic
ggttagttcgtttcgtttcgttgcggt

SEQ ID NO: 11693 - DNA, 27 bp, Artificial Sequences
  Synthetic
tggttagttcgtttcgtttcgttgcgg

SEQ ID NO: 11694 - DNA, 27 bp, Artificial Sequences
  Synthetic
cgtttgttttcgtttttagtcgcgcgt

SEQ ID NO: 11695 - DNA, 28 bp, Artificial Sequences
  Synthetic
tcgtttgttttcgtttttagtcgcgcgt

SEQ ID NO: 11696 - DNA, 27 bp, Artificial Sequences
  Synthetic
atttggcgggtaagggtcgtagcggag

SEQ ID NO: 11697 - DNA, 27 bp, Artificial Sequences
  Synthetic
gatttggggtcgcgcgttagggttagg

SEQ ID NO: 11698 - DNA, 27 bp, Artificial Sequences
  Synthetic
tatttggcgggtaagggtcgtagcgga

SEQ ID NO: 11699 - DNA, 27 bp, Artificial Sequences
  Synthetic
tcgaggtatttggcgggtaagggtcgt

SEQ ID NO: 11700 - DNA, 27 bp, Artificial Sequences
  Synthetic
gcggggttgtagagagcggtagtggta

SEQ ID NO: 11701 - DNA, 27 bp, Artificial Sequences
  Synthetic
cgtttggttttggcgcgcggttttagg

SEQ ID NO: 11702 - DNA, 27 bp, Artificial Sequences
  Synthetic
aagggatgttggaggggttgcgtcgta

SEQ ID NO: 11703 - DNA, 27 bp, Artificial Sequences
  Synthetic
taagggatgttggaggggttgcgtcgt

SEQ ID NO: 11704 - DNA, 27 bp, Artificial Sequences
  Synthetic
agggatgttggaggggttgcgtcgtat

SEQ ID NO: 11705 - DNA, 27 bp, Artificial Sequences
  Synthetic
gtttggttttggcgcgcggttttaggt

SEQ ID NO: 11706 - DNA, 27 bp, Artificial Sequences
  Synthetic
tttgttttcgagagtttgcgggcgggg

SEQ ID NO: 11707 - DNA, 27 bp, Artificial Sequences
  Synthetic
ttgcgggcggggattgatatttgtgcg

SEQ ID NO: 11708 - DNA, 27 bp, Artificial Sequences
  Synthetic
gttttcgagagtttgcgggcggggatt

SEQ ID NO: 11709 - DNA, 27 bp, Artificial Sequences
  Synthetic
gcgggcggggattgatatttgtgcgtt

SEQ ID NO: 11710 - DNA, 27 bp, Artificial Sequences
  Synthetic
ttttcgagagtttgcgggcggggattg

SEQ ID NO: 11711 - DNA, 27 bp, Artificial Sequences
  Synthetic
tcggtttgggtaggtggcgtagggaaa

SEQ ID NO: 11712 - DNA, 27 bp, Artificial Sequences
  Synthetic
ttcggtttgggtaggtggcgtagggaa

SEQ ID NO: 11713 - DNA, 27 bp, Artificial Sequences
  Synthetic
attcggtttgggtaggtggcgtaggga

SEQ ID NO: 11714 - DNA, 27 bp, Artificial Sequences
  Synthetic
cggtttgggtaggtggcgtagggaaat

SEQ ID NO: 11715 - DNA, 27 bp, Artificial Sequences
  Synthetic
aattcggtttgggtaggtggcgtaggg

SEQ ID NO: 11716 - DNA, 27 bp, Artificial Sequences
  Synthetic
aggaaggagcgaggtaggaaagcgtgg

SEQ ID NO: 11717 - DNA, 27 bp, Artificial Sequences
  Synthetic
ggagtttgtagtttagcgcgcggggtt

SEQ ID NO: 11718 - DNA, 27 bp, Artificial Sequences
  Synthetic
ttcggagtttgtagtttagcgcgcggg

SEQ ID NO: 11719 - DNA, 27 bp, Artificial Sequences
  Synthetic
ggaaggagcgaggtaggaaagcgtggc

SEQ ID NO: 11720 - DNA, 27 bp, Artificial Sequences
  Synthetic
tcggagtttgtagtttagcgcgcgggg

SEQ ID NO: 11721 - DNA, 27 bp, Artificial Sequences
  Synthetic
cgcgcgttaggttgtaagtttcggggt

SEQ ID NO: 11722 - DNA, 27 bp, Artificial Sequences
  Synthetic
tcgcgcgttaggttgtaagtttcgggg

SEQ ID NO: 11723 - DNA, 27 bp, Artificial Sequences
  Synthetic
cgggataggggtagttagggcggaagt

SEQ ID NO: 11724 - DNA, 28 bp, Artificial Sequences
  Synthetic
tcgcgcgttaggttgtaagtttcggggt

SEQ ID NO: 11725 - DNA, 28 bp, Artificial Sequences
  Synthetic
cgcgcgttaggttgtaagtttcggggtt

SEQ ID NO: 11726 - DNA, 32 bp, Artificial Sequences
  Synthetic
tgttttcgttttggttgtttttgtttcgaggg

SEQ ID NO: 11727 - DNA, 32 bp, Artificial Sequences
  Synthetic
gttttcgttttggttgtttttgtttcgaggga

SEQ ID NO: 11728 - DNA, 33 bp, Artificial Sequences
  Synthetic
tgttttcgttttggttgtttttgtttcgaggga

SEQ ID NO: 11729 - DNA, 33 bp, Artificial Sequences
  Synthetic
gcggagttttttcggttatttgtgttgttttcg

SEQ ID NO: 11730 - DNA, 34 bp, Artificial Sequences
  Synthetic
gcggagttttttcggttatttgtgttgttttcgt

SEQ ID NO: 11731 - DNA, 27 bp, Artificial Sequences
  Synthetic
agaggtacgggaagaggaaaagacggt

SEQ ID NO: 11732 - DNA, 27 bp, Artificial Sequences
  Synthetic
gaggtacgggaagaggaaaagacggtt

SEQ ID NO: 11733 - DNA, 28 bp, Artificial Sequences
  Synthetic
agaggtacgggaagaggaaaagacggtt

SEQ ID NO: 11734 - DNA, 28 bp, Artificial Sequences
  Synthetic
tagaggtacgggaagaggaaaagacggt

SEQ ID NO: 11735 - DNA, 29 bp, Artificial Sequences
  Synthetic
acgggaagaggaaaagacggttaattggg

SEQ ID NO: 11736 - DNA, 28 bp, Artificial Sequences
  Synthetic
gcggtgattttggttggagattgcgtcg

SEQ ID NO: 11737 - DNA, 29 bp, Artificial Sequences
  Synthetic
gcggtgattttggttggagattgcgtcgt

SEQ ID NO: 11738 - DNA, 28 bp, Artificial Sequences
  Synthetic
tggttggagattgcgtcgttgagagtcg

SEQ ID NO: 11739 - DNA, 27 bp, Artificial Sequences
  Synthetic
ggttggagattgcgtcgttgagagtcg

SEQ ID NO: 11740 - DNA, 27 bp, Artificial Sequences
  Synthetic
gcggtgattttggttggagattgcgtc

SEQ ID NO: 11741 - DNA, 27 bp, Artificial Sequences
  Synthetic
gcgggcggattatggtttagggcgtta

SEQ ID NO: 11742 - DNA, 26 bp, Artificial Sequences
  Synthetic
gcgggcggattatggtttagggcgtt

SEQ ID NO: 11743 - DNA, 28 bp, Artificial Sequences
  Synthetic
gcgggcggattatggtttagggcgttag

SEQ ID NO: 11744 - DNA, 29 bp, Artificial Sequences
  Synthetic
gcgggcggattatggtttagggcgttaga

SEQ ID NO: 11745 - DNA, 27 bp, Artificial Sequences
  Synthetic
cgggcggattatggtttagggcgttag

SEQ ID NO: 11746 - DNA, 28 bp, Artificial Sequences
  Synthetic
ggttggagattgcgtcgttgagagtcgg

SEQ ID NO: 11747 - DNA, 27 bp, Artificial Sequences
  Synthetic
ttggagattgcgtcgttgagagtcggt

SEQ ID NO: 11748 - DNA, 28 bp, Artificial Sequences
  Synthetic
gcggtgattttggttggagattgcgtcg

SEQ ID NO: 11749 - DNA, 29 bp, Artificial Sequences
  Synthetic
gcggtgattttggttggagattgcgtcgt

SEQ ID NO: 11750 - DNA, 28 bp, Artificial Sequences
  Synthetic
gttggagattgcgtcgttgagagtcggt

SEQ ID NO: 11751 - DNA, 27 bp, Artificial Sequences
  Synthetic
cggtagtcgtagttttttcgcgcgttt

SEQ ID NO: 11752 - DNA, 28 bp, Artificial Sequences
  Synthetic
cggtagtcgtagttttttcgcgcgtttt

SEQ ID NO: 11753 - DNA, 26 bp, Artificial Sequences
  Synthetic
cggtagtcgtagttttttcgcgcgtt

SEQ ID NO: 11754 - DNA, 29 bp, Artificial Sequences
  Synthetic
cggtagtcgtagttttttcgcgcgttttt

SEQ ID NO: 11755 - DNA, 25 bp, Artificial Sequences
  Synthetic
ggcgggagagttggcgtaaatttcg

SEQ ID NO: 11756 - DNA, 28 bp, Artificial Sequences
  Synthetic
ggttggagattgcgtcgttgagagtcgg

SEQ ID NO: 11757 - DNA, 27 bp, Artificial Sequences
  Synthetic
ttggagattgcgtcgttgagagtcggt

SEQ ID NO: 11758 - DNA, 28 bp, Artificial Sequences
  Synthetic
gttggagattgcgtcgttgagagtcggt

SEQ ID NO: 11759 - DNA, 28 bp, Artificial Sequences
  Synthetic
tggttggagattgcgtcgttgagagtcg

SEQ ID NO: 11760 - DNA, 29 bp, Artificial Sequences
  Synthetic
tggttggagattgcgtcgttgagagtcgg

SEQ ID NO: 11761 - DNA, 27 bp, Artificial Sequences
  Synthetic
tattagtgcgttggggagaggaggggg

SEQ ID NO: 11762 - DNA, 27 bp, Artificial Sequences
  Synthetic
attagtgcgttggggagaggagggggg

SEQ ID NO: 11763 - DNA, 27 bp, Artificial Sequences
  Synthetic
gcgtgtttgcgagtcgagggtttgttt

SEQ ID NO: 11764 - DNA, 28 bp, Artificial Sequences
  Synthetic
tattagtgcgttggggagaggagggggg

SEQ ID NO: 11765 - DNA, 26 bp, Artificial Sequences
  Synthetic
attagtgcgttggggagaggaggggg

SEQ ID NO: 11766 - DNA, 27 bp, Artificial Sequences
  Synthetic
agtgttgaggggaggggggagtcgtaa

SEQ ID NO: 11767 - DNA, 27 bp, Artificial Sequences
  Synthetic
gagtgttgaggggaggggggagtcgta

SEQ ID NO: 11768 - DNA, 27 bp, Artificial Sequences
  Synthetic
tatggagtgttgaggggaggggggagt

SEQ ID NO: 11769 - DNA, 27 bp, Artificial Sequences
  Synthetic
ggtatggagtgttgaggggagggggga

SEQ ID NO: 11770 - DNA, 27 bp, Artificial Sequences
  Synthetic
tcggtatggagtgttgaggggaggggg

SEQ ID NO: 11771 - DNA, 27 bp, Artificial Sequences
  Synthetic
tattagtgcgttggggagaggaggggg

SEQ ID NO: 11772 - DNA, 27 bp, Artificial Sequences
  Synthetic
attagtgcgttggggagaggagggggg

SEQ ID NO: 11773 - DNA, 27 bp, Artificial Sequences
  Synthetic
gcgtgtttgcgagtcgagggtttgttt

SEQ ID NO: 11774 - DNA, 28 bp, Artificial Sequences
  Synthetic
tattagtgcgttggggagaggagggggg

SEQ ID NO: 11775 - DNA, 26 bp, Artificial Sequences
  Synthetic
attagtgcgttggggagaggaggggg

SEQ ID NO: 11776 - DNA, 27 bp, Artificial Sequences
  Synthetic
agtgttgaggggaggggggagtcgtaa

SEQ ID NO: 11777 - DNA, 27 bp, Artificial Sequences
  Synthetic
gagtgttgaggggaggggggagtcgta

SEQ ID NO: 11778 - DNA, 27 bp, Artificial Sequences
  Synthetic
tatggagtgttgaggggaggggggagt

SEQ ID NO: 11779 - DNA, 27 bp, Artificial Sequences
  Synthetic
ggtatggagtgttgaggggagggggga

SEQ ID NO: 11780 - DNA, 27 bp, Artificial Sequences
  Synthetic
attggtgtttttggcgggtgtttggcg

SEQ ID NO: 11781 - DNA, 27 bp, Artificial Sequences
  Synthetic
gtaggggcgtcgggtcgttcgtttttt

SEQ ID NO: 11782 - DNA, 27 bp, Artificial Sequences
  Synthetic
ggtaggggcgtcgggtcgttcgttttt

SEQ ID NO: 11783 - DNA, 26 bp, Artificial Sequences
  Synthetic
gtaggggcgtcgggtcgttcgttttt

SEQ ID NO: 11784 - DNA, 26 bp, Artificial Sequences
  Synthetic
ggtaggggcgtcgggtcgttcgtttt

SEQ ID NO: 11785 - DNA, 28 bp, Artificial Sequences
  Synthetic
ggtaggggcgtcgggtcgttcgtttttt

SEQ ID NO: 11786 - DNA, 27 bp, Artificial Sequences
  Synthetic
attggtgtttttggcgggtgtttggcg

SEQ ID NO: 11787 - DNA, 27 bp, Artificial Sequences
  Synthetic
ttggtgtttttggcgggtgtttggcgg

SEQ ID NO: 11788 - DNA, 26 bp, Artificial Sequences
  Synthetic
ttggtgtttttggcgggtgtttggcg

SEQ ID NO: 11789 - DNA, 27 bp, Artificial Sequences
  Synthetic
agcgtattggtgtttttggcgggtgtt

SEQ ID NO: 11790 - DNA, 28 bp, Artificial Sequences
  Synthetic
attggtgtttttggcgggtgtttggcgg

SEQ ID NO: 11791 - DNA, 27 bp, Artificial Sequences
  Synthetic
gtaggggcgtcgggtcgttcgtttttt

SEQ ID NO: 11792 - DNA, 27 bp, Artificial Sequences
  Synthetic
ggtaggggcgtcgggtcgttcgttttt

SEQ ID NO: 11793 - DNA, 26 bp, Artificial Sequences
  Synthetic
gtaggggcgtcgggtcgttcgttttt

SEQ ID NO: 11794 - DNA, 26 bp, Artificial Sequences
  Synthetic
ggtaggggcgtcgggtcgttcgtttt

SEQ ID NO: 11795 - DNA, 28 bp, Artificial Sequences
  Synthetic
ggtaggggcgtcgggtcgttcgtttttt

SEQ ID NO: 11796 - DNA, 27 bp, Artificial Sequences
  Synthetic
cggttgattggttcgggagtttcggga

SEQ ID NO: 11797 - DNA, 27 bp, Artificial Sequences
  Synthetic
tcggttgattggttcgggagtttcggg

SEQ ID NO: 11798 - DNA, 28 bp, Artificial Sequences
  Synthetic
tcggttgattggttcgggagtttcggga

SEQ ID NO: 11799 - DNA, 27 bp, Artificial Sequences
  Synthetic
ttttgggagtgcgatgcgttttaggcg

SEQ ID NO: 11800 - DNA, 27 bp, Artificial Sequences
  Synthetic
tgtggttttgggagtgcgatgcgtttt

SEQ ID NO: 11801 - DNA, 27 bp, Artificial Sequences
  Synthetic
acgtttttagcggttaagtgggggcgc

SEQ ID NO: 11802 - DNA, 27 bp, Artificial Sequences
  Synthetic
tcgagtgggatatgtaggtcgcgggga

SEQ ID NO: 11803 - DNA, 27 bp, Artificial Sequences
  Synthetic
gtttttagcggttaagtgggggcgcgg

SEQ ID NO: 11804 - DNA, 27 bp, Artificial Sequences
  Synthetic
ttcgagtgggatatgtaggtcgcgggg

SEQ ID NO: 11805 - DNA, 27 bp, Artificial Sequences
  Synthetic
cgtttttagcggttaagtgggggcgcg

SEQ ID NO: 11806 - DNA, 27 bp, Artificial Sequences
  Synthetic
cggttgattggttcgggagtttcggga

SEQ ID NO: 11807 - DNA, 27 bp, Artificial Sequences
  Synthetic
tcggttgattggttcgggagtttcggg

SEQ ID NO: 11808 - DNA, 28 bp, Artificial Sequences
  Synthetic
tcggttgattggttcgggagtttcggga

SEQ ID NO: 11809 - DNA, 28 bp, Artificial Sequences
  Synthetic
cggttgattggttcgggagtttcgggag

SEQ ID NO: 11810 - DNA, 28 bp, Artificial Sequences
  Synthetic
ttcggttgattggttcgggagtttcggg

SEQ ID NO: 11811 - DNA, 29 bp, Artificial Sequences
  Synthetic
gcgagacgtttttagcggttaagtggggg

SEQ ID NO: 11812 - DNA, 28 bp, Artificial Sequences
  Synthetic
gcgagacgtttttagcggttaagtgggg

SEQ ID NO: 11813 - DNA, 28 bp, Artificial Sequences
  Synthetic
cgagacgtttttagcggttaagtggggg

SEQ ID NO: 11814 - DNA, 29 bp, Artificial Sequences
  Synthetic
cgagacgtttttagcggttaagtgggggt

SEQ ID NO: 11815 - DNA, 27 bp, Artificial Sequences
  Synthetic
gcgagacgtttttagcggttaagtggg

SEQ ID NO: 11816 - DNA, 27 bp, Artificial Sequences
  Synthetic
tcggggaggtttattagagtcgtcggt

SEQ ID NO: 11817 - DNA, 27 bp, Artificial Sequences
  Synthetic
ttttggggatttcgatcggggaggttt

SEQ ID NO: 11818 - DNA, 27 bp, Artificial Sequences
  Synthetic
attttggggatttcgatcggggaggtt

SEQ ID NO: 11819 - DNA, 27 bp, Artificial Sequences
  Synthetic
tttggggatttcgatcggggaggttta

SEQ ID NO: 11820 - DNA, 29 bp, Artificial Sequences
  Synthetic
cgatcggggaggtttattagagtcgtcgg

SEQ ID NO: 11821 - DNA, 27 bp, Artificial Sequences
  Synthetic
gagcggagataggcggtgtggttggat

SEQ ID NO: 11822 - DNA, 27 bp, Artificial Sequences
  Synthetic
tggttgtcggcggttttggtgggtttt

SEQ ID NO: 11823 - DNA, 27 bp, Artificial Sequences
  Synthetic
ttggttgtcggcggttttggtgggttt

SEQ ID NO: 11824 - DNA, 27 bp, Artificial Sequences
  Synthetic
tttggttgtcggcggttttggtgggtt

SEQ ID NO: 11825 - DNA, 27 bp, Artificial Sequences
  Synthetic
agcggagataggcggtgtggttggatt

SEQ ID NO: 11826 - DNA, 27 bp, Artificial Sequences
  Synthetic
cgcgggttttgggtcggttggtttagt

SEQ ID NO: 11827 - DNA, 27 bp, Artificial Sequences
  Synthetic
ggaatagtagcgcgggttttgggtcgg

SEQ ID NO: 11828 - DNA, 27 bp, Artificial Sequences
  Synthetic
gggaatagtagcgcgggttttgggtcg

SEQ ID NO: 11829 - DNA, 27 bp, Artificial Sequences
  Synthetic
gcgcgggttttgggtcggttggtttag

SEQ ID NO: 11830 - DNA, 27 bp, Artificial Sequences
  Synthetic
tagtagcgcgggttttgggtcggttgg

SEQ ID NO: 11831 - DNA, 27 bp, Artificial Sequences
  Synthetic
gagcggagataggcggtgtggttggat

SEQ ID NO: 11832 - DNA, 27 bp, Artificial Sequences
  Synthetic
agcggagataggcggtgtggttggatt

SEQ ID NO: 11833 - DNA, 27 bp, Artificial Sequences
  Synthetic
ggcgtaggaaggggggtgaggttgtag

SEQ ID NO: 11834 - DNA, 27 bp, Artificial Sequences
  Synthetic
ggaaggggggtgaggttgtagtgcgat

SEQ ID NO: 11835 - DNA, 27 bp, Artificial Sequences
  Synthetic
aggaaggggggtgaggttgtagtgcga

SEQ ID NO: 11836 - DNA, 27 bp, Artificial Sequences
  Synthetic
cgcgggttttgggtcggttggtttagt

SEQ ID NO: 11837 - DNA, 27 bp, Artificial Sequences
  Synthetic
ggaatagtagcgcgggttttgggtcgg

SEQ ID NO: 11838 - DNA, 27 bp, Artificial Sequences
  Synthetic
gggaatagtagcgcgggttttgggtcg

SEQ ID NO: 11839 - DNA, 27 bp, Artificial Sequences
  Synthetic
gcgcgggttttgggtcggttggtttag

SEQ ID NO: 11840 - DNA, 27 bp, Artificial Sequences
  Synthetic
tagtagcgcgggttttgggtcggttgg

SEQ ID NO: 11841 - DNA, 27 bp, Artificial Sequences
  Synthetic
tcgtcggttcggggtggttatattggt

SEQ ID NO: 11842 - DNA, 27 bp, Artificial Sequences
  Synthetic
tagagagtttttgagggtagcgcgggt

SEQ ID NO: 11843 - DNA, 28 bp, Artificial Sequences
  Synthetic
gtagagagtttttgagggtagcgcgggt

SEQ ID NO: 11844 - DNA, 27 bp, Artificial Sequences
  Synthetic
gtagagagtttttgagggtagcgcggg

SEQ ID NO: 11845 - DNA, 26 bp, Artificial Sequences
  Synthetic
agagagtttttgagggtagcgcgggt

SEQ ID NO: 11846 - DNA, 29 bp, Artificial Sequences
  Synthetic
tcgtttgttttcgttcgttgagtcgttgt

SEQ ID NO: 11847 - DNA, 30 bp, Artificial Sequences
  Synthetic
tcgtttgttttcgttcgttgagtcgttgtt

SEQ ID NO: 11848 - DNA, 30 bp, Artificial Sequences
  Synthetic
atcgtttgttttcgttcgttgagtcgttgt

SEQ ID NO: 11849 - DNA, 30 bp, Artificial Sequences
  Synthetic
cgtttgttttcgttcgttgagtcgttgttt

SEQ ID NO: 11850 - DNA, 31 bp, Artificial Sequences
  Synthetic
tcgtttgttttcgttcgttgagtcgttgttt

SEQ ID NO: 11851 - DNA, 28 bp, Artificial Sequences
  Synthetic
tggtcgggaatagtttataggggcgggt

SEQ ID NO: 11852 - DNA, 27 bp, Artificial Sequences
  Synthetic
tcgtcggttcggggtggttatattggt

SEQ ID NO: 11853 - DNA, 27 bp, Artificial Sequences
  Synthetic
ggtcgggaatagtttataggggcgggt

SEQ ID NO: 11854 - DNA, 27 bp, Artificial Sequences
  Synthetic
tggtcgggaatagtttataggggcggg

SEQ ID NO: 11855 - DNA, 28 bp, Artificial Sequences
  Synthetic
ttcgtcggttcggggtggttatattggt

SEQ ID NO: 11856 - DNA, 27 bp, Artificial Sequences
  Synthetic
agttcggcgcggggaagtaattcgatt

SEQ ID NO: 11857 - DNA, 27 bp, Artificial Sequences
  Synthetic
tgtttaggtttagttcggcgcggggaa

SEQ ID NO: 11858 - DNA, 27 bp, Artificial Sequences
  Synthetic
ttgtttaggtttagttcggcgcgggga

SEQ ID NO: 11859 - DNA, 27 bp, Artificial Sequences
  Synthetic
tttaggtttagttcggcgcggggaagt

SEQ ID NO: 11860 - DNA, 27 bp, Artificial Sequences
  Synthetic
tagttcggcgcggggaagtaattcgat

SEQ ID NO: 11861 - DNA, 27 bp, Artificial Sequences
  Synthetic
tttgcggttgagtggagaagggagggg

SEQ ID NO: 11862 - DNA, 27 bp, Artificial Sequences
  Synthetic
cggttgagtggagaagggagggggttg

SEQ ID NO: 11863 - DNA, 27 bp, Artificial Sequences
  Synthetic
ggttgagtggagaagggagggggttgc

SEQ ID NO: 11864 - DNA, 27 bp, Artificial Sequences
  Synthetic
gttgagtggagaagggagggggttgcg

SEQ ID NO: 11865 - DNA, 26 bp, Artificial Sequences
  Synthetic
ttgagtggagaagggagggggttgcg

SEQ ID NO: 11866 - DNA, 27 bp, Artificial Sequences
  Synthetic
agttcggcgcggggaagtaattcgatt

SEQ ID NO: 11867 - DNA, 27 bp, Artificial Sequences
  Synthetic
tgtttaggtttagttcggcgcggggaa

SEQ ID NO: 11868 - DNA, 27 bp, Artificial Sequences
  Synthetic
ttgtttaggtttagttcggcgcgggga

SEQ ID NO: 11869 - DNA, 27 bp, Artificial Sequences
  Synthetic
tttaggtttagttcggcgcggggaagt

SEQ ID NO: 11870 - DNA, 27 bp, Artificial Sequences
  Synthetic
gcgtcgcggagagttcgtttttatggg

SEQ ID NO: 11871 - DNA, 27 bp, Artificial Sequences
  Synthetic
tttgcggttgagtggagaagggagggg

SEQ ID NO: 11872 - DNA, 27 bp, Artificial Sequences
  Synthetic
cggttgagtggagaagggagggggttg

SEQ ID NO: 11873 - DNA, 27 bp, Artificial Sequences
  Synthetic
ggttgagtggagaagggagggggttgc

SEQ ID NO: 11874 - DNA, 27 bp, Artificial Sequences
  Synthetic
gttgagtggagaagggagggggttgcg

SEQ ID NO: 11875 - DNA, 26 bp, Artificial Sequences
  Synthetic
ttgagtggagaagggagggggttgcg

SEQ ID NO: 11876 - DNA, 27 bp, Artificial Sequences
  Synthetic
ttgaagggtgaggagcgcggggtttta

SEQ ID NO: 11877 - DNA, 27 bp, Artificial Sequences
  Synthetic
gaagggtgaggagcgcggggttttaga

SEQ ID NO: 11878 - DNA, 27 bp, Artificial Sequences
  Synthetic
aagggtgaggagcgcggggttttagag

SEQ ID NO: 11879 - DNA, 27 bp, Artificial Sequences
  Synthetic
agagggatttgaagggtgaggagcgcg

SEQ ID NO: 11880 - DNA, 27 bp, Artificial Sequences
  Synthetic
tgaagggtgaggagcgcggggttttag

SEQ ID NO: 11881 - DNA, 27 bp, Artificial Sequences
  Synthetic
ggagtcgcggggggattttcgttttgg

SEQ ID NO: 11882 - DNA, 27 bp, Artificial Sequences
  Synthetic
gggagtcgcggggggattttcgttttg

SEQ ID NO: 11883 - DNA, 27 bp, Artificial Sequences
  Synthetic
gtttcgtaggggagggagggagggagt

SEQ ID NO: 11884 - DNA, 27 bp, Artificial Sequences
  Synthetic
tttcgtaggggagggagggagggagtc

SEQ ID NO: 11885 - DNA, 27 bp, Artificial Sequences
  Synthetic
agggagtcgcggggggattttcgtttt

SEQ ID NO: 11886 - DNA, 27 bp, Artificial Sequences
  Synthetic
ttgaagggtgaggagcgcggggtttta

SEQ ID NO: 11887 - DNA, 27 bp, Artificial Sequences
  Synthetic
gaagggtgaggagcgcggggttttaga

SEQ ID NO: 11888 - DNA, 27 bp, Artificial Sequences
  Synthetic
aagggtgaggagcgcggggttttagag

SEQ ID NO: 11889 - DNA, 27 bp, Artificial Sequences
  Synthetic
agagggatttgaagggtgaggagcgcg

SEQ ID NO: 11890 - DNA, 27 bp, Artificial Sequences
  Synthetic
tgaagggtgaggagcgcggggttttag

SEQ ID NO: 11891 - DNA, 28 bp, Artificial Sequences
  Synthetic
gggttggggggaagagggagatttaggt

SEQ ID NO: 11892 - DNA, 28 bp, Artificial Sequences
  Synthetic
tggggggaagagggagatttaggttcgg

SEQ ID NO: 11893 - DNA, 27 bp, Artificial Sequences
  Synthetic
gggttggggggaagagggagatttagg

SEQ ID NO: 11894 - DNA, 27 bp, Artificial Sequences
  Synthetic
ggggggaagagggagatttaggttcgg

SEQ ID NO: 11895 - DNA, 29 bp, Artificial Sequences
  Synthetic
tggggggaagagggagatttaggttcgga

SEQ ID NO: 11896 - DNA, 27 bp, Artificial Sequences
  Synthetic
ttgaagggtgaggagcgcggggtttta

SEQ ID NO: 11897 - DNA, 27 bp, Artificial Sequences
  Synthetic
gaagggtgaggagcgcggggttttaga

SEQ ID NO: 11898 - DNA, 27 bp, Artificial Sequences
  Synthetic
aagggtgaggagcgcggggttttagag

SEQ ID NO: 11899 - DNA, 27 bp, Artificial Sequences
  Synthetic
agagggatttgaagggtgaggagcgcg

SEQ ID NO: 11900 - DNA, 27 bp, Artificial Sequences
  Synthetic
tgaagggtgaggagcgcggggttttag

SEQ ID NO: 11901 - DNA, 27 bp, Artificial Sequences
  Synthetic
ttttgtagtcggaggggttgagggggg

SEQ ID NO: 11902 - DNA, 27 bp, Artificial Sequences
  Synthetic
gggggttggggggaagagggagattta

SEQ ID NO: 11903 - DNA, 27 bp, Artificial Sequences
  Synthetic
ggggggttggggggaagagggagattt

SEQ ID NO: 11904 - DNA, 26 bp, Artificial Sequences
  Synthetic
gggggttggggggaagagggagattt

SEQ ID NO: 11905 - DNA, 28 bp, Artificial Sequences
  Synthetic
attttgtagtcggaggggttgagggggg

SEQ ID NO: 11906 - DNA, 26 bp, Artificial Sequences
  Synthetic
tttttcggtcgcgggtgggggtttgg

SEQ ID NO: 11907 - DNA, 24 bp, Artificial Sequences
  Synthetic
ttttcggtcgcgggtgggggtttg

SEQ ID NO: 11908 - DNA, 27 bp, Artificial Sequences
  Synthetic
tttttcggtcgcgggtgggggtttggg

SEQ ID NO: 11909 - DNA, 27 bp, Artificial Sequences
  Synthetic
tgttttagagacggacggtaagcggtt

SEQ ID NO: 11910 - DNA, 25 bp, Artificial Sequences
  Synthetic
ttttcggtcgcgggtgggggtttgg

SEQ ID NO: 11911 - DNA, 27 bp, Artificial Sequences
  Synthetic
cggcgagtgaggtagcggttaaagtgg

SEQ ID NO: 11912 - DNA, 28 bp, Artificial Sequences
  Synthetic
cggcgagtgaggtagcggttaaagtgga

SEQ ID NO: 11913 - DNA, 27 bp, Artificial Sequences
  Synthetic
ggcgagtgaggtagcggttaaagtgga

SEQ ID NO: 11914 - DNA, 29 bp, Artificial Sequences
  Synthetic
cggcgagtgaggtagcggttaaagtggaa

SEQ ID NO: 11915 - DNA, 28 bp, Artificial Sequences
  Synthetic
ggcgagtgaggtagcggttaaagtggaa

SEQ ID NO: 11916 - DNA, 27 bp, Artificial Sequences
  Synthetic
tgttttagagacggacggtaagcggtt

SEQ ID NO: 11917 - DNA, 27 bp, Artificial Sequences
  Synthetic
atgttttagagacggacggtaagcggt

SEQ ID NO: 11918 - DNA, 31 bp, Artificial Sequences
  Synthetic
ggggtggggtttatgttttagagacggacgg

SEQ ID NO: 11919 - DNA, 28 bp, Artificial Sequences
  Synthetic
tgttttagagacggacggtaagcggttt

SEQ ID NO: 11920 - DNA, 30 bp, Artificial Sequences
  Synthetic
gggtggggtttatgttttagagacggacgg

SEQ ID NO: 11921 - DNA, 27 bp, Artificial Sequences
  Synthetic
ggaaaggcgaaaaggaaaggcgtaggg

SEQ ID NO: 11922 - DNA, 28 bp, Artificial Sequences
  Synthetic
ggaaaggcgaaaaggaaaggcgtaggga

SEQ ID NO: 11923 - DNA, 27 bp, Artificial Sequences
  Synthetic
ataggaatcggttaggggcgcgttttg

SEQ ID NO: 11924 - DNA, 27 bp, Artificial Sequences
  Synthetic
gaaaggcgaaaaggaaaggcgtaggga

SEQ ID NO: 11925 - DNA, 27 bp, Artificial Sequences
  Synthetic
ggcgaaaaggaaaggcgtagggatagg

SEQ ID NO: 11926 - DNA, 27 bp, Artificial Sequences
  Synthetic
ttagaggtagcgggggaggttcgtaga

SEQ ID NO: 11927 - DNA, 27 bp, Artificial Sequences
  Synthetic
tttttagaggtagcgggggaggttcgt

SEQ ID NO: 11928 - DNA, 27 bp, Artificial Sequences
  Synthetic
aggttttttagaggtagcgggggaggt

SEQ ID NO: 11929 - DNA, 27 bp, Artificial Sequences
  Synthetic
tttagaggtagcgggggaggttcgtag

SEQ ID NO: 11930 - DNA, 28 bp, Artificial Sequences
  Synthetic
tttagaggtagcgggggaggttcgtaga

SEQ ID NO: 11931 - DNA, 27 bp, Artificial Sequences
  Synthetic
ttcgcgggaattttgggtcggtaggga

SEQ ID NO: 11932 - DNA, 27 bp, Artificial Sequences
  Synthetic
tcgcgggaattttgggtcggtagggat

SEQ ID NO: 11933 - DNA, 27 bp, Artificial Sequences
  Synthetic
gcgggaattttgggtcggtagggatgc

SEQ ID NO: 11934 - DNA, 27 bp, Artificial Sequences
  Synthetic
cgggaattttgggtcggtagggatgcg

SEQ ID NO: 11935 - DNA, 27 bp, Artificial Sequences
  Synthetic
cgcgggaattttgggtcggtagggatg

SEQ ID NO: 11936 - DNA, 27 bp, Artificial Sequences
  Synthetic
tcgggtcgggggtaggtgttggagtat

SEQ ID NO: 11937 - DNA, 27 bp, Artificial Sequences
  Synthetic
ttcgggtcgggggtaggtgttggagta

SEQ ID NO: 11938 - DNA, 27 bp, Artificial Sequences
  Synthetic
atttcgggtcgggggtaggtgttggag

SEQ ID NO: 11939 - DNA, 27 bp, Artificial Sequences
  Synthetic
cgggtcgggggtaggtgttggagtatt

SEQ ID NO: 11940 - DNA, 27 bp, Artificial Sequences
  Synthetic
tttcgggtcgggggtaggtgttggagt

SEQ ID NO: 11941 - DNA, 27 bp, Artificial Sequences
  Synthetic
ttcgcgggaattttgggtcggtaggga

SEQ ID NO: 11942 - DNA, 27 bp, Artificial Sequences
  Synthetic
tcgcgggaattttgggtcggtagggat

SEQ ID NO: 11943 - DNA, 27 bp, Artificial Sequences
  Synthetic
gagttgaggggagatggggtagcgtcg

SEQ ID NO: 11944 - DNA, 27 bp, Artificial Sequences
  Synthetic
cgagttgaggggagatggggtagcgtc

SEQ ID NO: 11945 - DNA, 27 bp, Artificial Sequences
  Synthetic
gtcgagttgaggggagatggggtagcg

SEQ ID NO: 11946 - DNA, 25 bp, Artificial Sequences
  Synthetic
ggagggttgcggcgtataggttggc

SEQ ID NO: 11947 - DNA, 27 bp, Artificial Sequences
  Synthetic
gcggggttgtcggcgttgttttatttt

SEQ ID NO: 11948 - DNA, 28 bp, Artificial Sequences
  Synthetic
gcggggttgtcggcgttgttttattttt

SEQ ID NO: 11949 - DNA, 26 bp, Artificial Sequences
  Synthetic
gcggggttgtcggcgttgttttattt

SEQ ID NO: 11950 - DNA, 29 bp, Artificial Sequences
  Synthetic
gcggggttgtcggcgttgttttatttttt

SEQ ID NO: 11951 - DNA, 27 bp, Artificial Sequences
  Synthetic
cgaggttagagggttcggcgagggttt

SEQ ID NO: 11952 - DNA, 27 bp, Artificial Sequences
  Synthetic
aggagagggcgaggttagagggttcgg

SEQ ID NO: 11953 - DNA, 27 bp, Artificial Sequences
  Synthetic
tagagggttcggcgagggttttgtggc

SEQ ID NO: 11954 - DNA, 27 bp, Artificial Sequences
  Synthetic
aaggagagggcgaggttagagggttcg

SEQ ID NO: 11955 - DNA, 28 bp, Artificial Sequences
  Synthetic
cgaggttagagggttcggcgagggtttt

SEQ ID NO: 11956 - DNA, 25 bp, Artificial Sequences
  Synthetic
ggagggttgcggcgtataggttggc

SEQ ID NO: 11957 - DNA, 24 bp, Artificial Sequences
  Synthetic
gagggttgcggcgtataggttggc

SEQ ID NO: 11958 - DNA, 24 bp, Artificial Sequences
  Synthetic
ggagggttgcggcgtataggttgg

SEQ ID NO: 11959 - DNA, 29 bp, Artificial Sequences
  Synthetic
agtttcgtaggattttttcggagggttgc

SEQ ID NO: 11960 - DNA, 23 bp, Artificial Sequences
  Synthetic
agggttgcggcgtataggttggc

SEQ ID NO: 11961 - DNA, 27 bp, Artificial Sequences
  Synthetic
cgaggttagagggttcggcgagggttt

SEQ ID NO: 11962 - DNA, 27 bp, Artificial Sequences
  Synthetic
aggagagggcgaggttagagggttcgg

SEQ ID NO: 11963 - DNA, 27 bp, Artificial Sequences
  Synthetic
tagagggttcggcgagggttttgtggc

SEQ ID NO: 11964 - DNA, 27 bp, Artificial Sequences
  Synthetic
aaggagagggcgaggttagagggttcg

SEQ ID NO: 11965 - DNA, 28 bp, Artificial Sequences
  Synthetic
cgaggttagagggttcggcgagggtttt

SEQ ID NO: 11966 - DNA, 27 bp, Artificial Sequences
  Synthetic
cggggtcgttgtagagtcggtttttcg

SEQ ID NO: 11967 - DNA, 29 bp, Artificial Sequences
  Synthetic
cgggggaggagaaaagtataggatcgcgg

SEQ ID NO: 11968 - DNA, 28 bp, Artificial Sequences
  Synthetic
cgggggaggagaaaagtataggatcgcg

SEQ ID NO: 11969 - DNA, 28 bp, Artificial Sequences
  Synthetic
gggggaggagaaaagtataggatcgcgg

SEQ ID NO: 11970 - DNA, 29 bp, Artificial Sequences
  Synthetic
tcgggggaggagaaaagtataggatcgcg

SEQ ID NO: 11971 - DNA, 27 bp, Artificial Sequences
  Synthetic
gcggcgcgggatttttaggttgtggtt

SEQ ID NO: 11972 - DNA, 27 bp, Artificial Sequences
  Synthetic
cggcgcgggatttttaggttgtggttt

SEQ ID NO: 11973 - DNA, 26 bp, Artificial Sequences
  Synthetic
gcggcgcgggatttttaggttgtggt

SEQ ID NO: 11974 - DNA, 28 bp, Artificial Sequences
  Synthetic
gcggcgcgggatttttaggttgtggttt

SEQ ID NO: 11975 - DNA, 28 bp, Artificial Sequences
  Synthetic
cggcgcgggatttttaggttgtggtttt

SEQ ID NO: 11976 - DNA, 27 bp, Artificial Sequences
  Synthetic
tagtcggaggtagaggcgtttcgaggc

SEQ ID NO: 11977 - DNA, 26 bp, Artificial Sequences
  Synthetic
agtcggaggtagaggcgtttcgaggc

SEQ ID NO: 11978 - DNA, 28 bp, Artificial Sequences
  Synthetic
atagtcggaggtagaggcgtttcgaggc

SEQ ID NO: 11979 - DNA, 27 bp, Artificial Sequences
  Synthetic
cggggtcgttgtagagtcggtttttcg

SEQ ID NO: 11980 - DNA, 27 bp, Artificial Sequences
  Synthetic
gttcgtttcggatttaggtcgcgaggt

SEQ ID NO: 11981 - DNA, 27 bp, Artificial Sequences
  Synthetic
gcgttttggttttggcgggcgagttac

SEQ ID NO: 11982 - DNA, 26 bp, Artificial Sequences
  Synthetic
gcgttttggttttggcgggcgagtta

SEQ ID NO: 11983 - DNA, 25 bp, Artificial Sequences
  Synthetic
gcgttttggttttggcgggcgagtt

SEQ ID NO: 11984 - DNA, 26 bp, Artificial Sequences
  Synthetic
cgttttggttttggcgggcgagttac

SEQ ID NO: 11985 - DNA, 24 bp, Artificial Sequences
  Synthetic
gcgttttggttttggcgggcgagt

SEQ ID NO: 11986 - DNA, 27 bp, Artificial Sequences
  Synthetic
cggaggaggcggttaaggtgtaggtcg

SEQ ID NO: 11987 - DNA, 27 bp, Artificial Sequences
  Synthetic
gggttcggaggaggcggttaaggtgta

SEQ ID NO: 11988 - DNA, 27 bp, Artificial Sequences
  Synthetic
ggaggcggttaaggtgtaggtcgaggt

SEQ ID NO: 11989 - DNA, 27 bp, Artificial Sequences
  Synthetic
tagtcggaggtagaggcgtttcgaggc

SEQ ID NO: 11990 - DNA, 27 bp, Artificial Sequences
  Synthetic
gcggttaaggtgtaggtcgaggttggc

SEQ ID NO: 11991 - DNA, 27 bp, Artificial Sequences
  Synthetic
gcgttttggttttggcgggcgagttac

SEQ ID NO: 11992 - DNA, 26 bp, Artificial Sequences
  Synthetic
gcgttttggttttggcgggcgagtta

SEQ ID NO: 11993 - DNA, 25 bp, Artificial Sequences
  Synthetic
gcgttttggttttggcgggcgagtt

SEQ ID NO: 11994 - DNA, 27 bp, Artificial Sequences
  Synthetic
agttttttcgcgcgttttggttttggc

SEQ ID NO: 11995 - DNA, 26 bp, Artificial Sequences
  Synthetic
cgttttggttttggcgggcgagttac

SEQ ID NO: 11996 - DNA, 27 bp, Artificial Sequences
  Synthetic
cggaggaggcggttaaggtgtaggtcg

SEQ ID NO: 11997 - DNA, 27 bp, Artificial Sequences
  Synthetic
gggttcggaggaggcggttaaggtgta

SEQ ID NO: 11998 - DNA, 27 bp, Artificial Sequences
  Synthetic
ggaggcggttaaggtgtaggtcgaggt

SEQ ID NO: 11999 - DNA, 27 bp, Artificial Sequences
  Synthetic
gttcgttaggattagagcgcgcggagg

SEQ ID NO: 12000 - DNA, 27 bp, Artificial Sequences
  Synthetic
gcggttaaggtgtaggtcgaggttggc

SEQ ID NO: 12001 - DNA, 28 bp, Artificial Sequences
  Synthetic
cgtggtattagtgggatttggggagcgg

SEQ ID NO: 12002 - DNA, 29 bp, Artificial Sequences
  Synthetic
cgtggtattagtgggatttggggagcggt

SEQ ID NO: 12003 - DNA, 29 bp, Artificial Sequences
  Synthetic
tcgtggtattagtgggatttggggagcgg

SEQ ID NO: 12004 - DNA, 27 bp, Artificial Sequences
  Synthetic
tggtattagtgggatttggggagcggt

SEQ ID NO: 12005 - DNA, 27 bp, Artificial Sequences
  Synthetic
cgtggtattagtgggatttggggagcg

SEQ ID NO: 12006 - DNA, 27 bp, Artificial Sequences
  Synthetic
gcgtggcgtttgttgttggttcggttg

SEQ ID NO: 12007 - DNA, 27 bp, Artificial Sequences
  Synthetic
taggggcgtggcgtttgttgttggttc

SEQ ID NO: 12008 - DNA, 27 bp, Artificial Sequences
  Synthetic
gtttttcgggttgtggaggttgcgggt

SEQ ID NO: 12009 - DNA, 27 bp, Artificial Sequences
  Synthetic
gataggggcgtggcgtttgttgttggt

SEQ ID NO: 12010 - DNA, 27 bp, Artificial Sequences
  Synthetic
ggataggggcgtggcgtttgttgttgg

SEQ ID NO: 12011 - DNA, 28 bp, Artificial Sequences
  Synthetic
ggggtagttagtgtagcgcgggtagtcg

SEQ ID NO: 12012 - DNA, 27 bp, Artificial Sequences
  Synthetic
gggtagttagtgtagcgcgggtagtcg

SEQ ID NO: 12013 - DNA, 28 bp, Artificial Sequences
  Synthetic
gggtagttagtgtagcgcgggtagtcga

SEQ ID NO: 12014 - DNA, 28 bp, Artificial Sequences
  Synthetic
cgcgggtagtcgagttagtagtaggcgt

SEQ ID NO: 12015 - DNA, 27 bp, Artificial Sequences
  Synthetic
ggggtagttagtgtagcgcgggtagtc

SEQ ID NO: 12016 - DNA, 27 bp, Artificial Sequences
  Synthetic
gcgtggcgtttgttgttggttcggttg

SEQ ID NO: 12017 - DNA, 27 bp, Artificial Sequences
  Synthetic
taggggcgtggcgtttgttgttggttc

SEQ ID NO: 12018 - DNA, 27 bp, Artificial Sequences
  Synthetic
gataggggcgtggcgtttgttgttggt

SEQ ID NO: 12019 - DNA, 27 bp, Artificial Sequences
  Synthetic
ggataggggcgtggcgtttgttgttgg

SEQ ID NO: 12020 - DNA, 27 bp, Artificial Sequences
  Synthetic
gggataggggcgtggcgtttgttgttg

SEQ ID NO: 12021 - DNA, 34 bp, Artificial Sequences
  Synthetic
agagtttgtgttttcgataggttgttgttagggt

SEQ ID NO: 12022 - DNA, 34 bp, Artificial Sequences
  Synthetic
gagtttgtgttttcgataggttgttgttagggtt

SEQ ID NO: 12023 - DNA, 35 bp, Artificial Sequences
  Synthetic
agagtttgtgttttcgataggttgttgttagggtt

SEQ ID NO: 12024 - DNA, 35 bp, Artificial Sequences
  Synthetic
tagagtttgtgttttcgataggttgttgttagggt

SEQ ID NO: 12025 - DNA, 35 bp, Artificial Sequences
  Synthetic
gagtttgtgttttcgataggttgttgttagggttt

SEQ ID NO: 12026 - DNA, 27 bp, Artificial Sequences
  Synthetic
attcggagttggtgggagggttagcgg

SEQ ID NO: 12027 - DNA, 27 bp, Artificial Sequences
  Synthetic
gggttcgggaaggggttcggagttagg

SEQ ID NO: 12028 - DNA, 27 bp, Artificial Sequences
  Synthetic
ggggttcgggaaggggttcggagttag

SEQ ID NO: 12029 - DNA, 27 bp, Artificial Sequences
  Synthetic
ggttggattcggagttggtgggagggt

SEQ ID NO: 12030 - DNA, 27 bp, Artificial Sequences
  Synthetic
tggttggattcggagttggtgggaggg

SEQ ID NO: 12031 - DNA, 27 bp, Artificial Sequences
  Synthetic
tagcgggtttagggagttgttgggcgt

SEQ ID NO: 12032 - DNA, 27 bp, Artificial Sequences
  Synthetic
cgggtttagggagttgttgggcgtcga

SEQ ID NO: 12033 - DNA, 27 bp, Artificial Sequences
  Synthetic
gtagcgggtttagggagttgttgggcg

SEQ ID NO: 12034 - DNA, 27 bp, Artificial Sequences
  Synthetic
ttcgatttttggtggggtcggggttgg

SEQ ID NO: 12035 - DNA, 27 bp, Artificial Sequences
  Synthetic
atttttggtggggtcggggttggggtt

SEQ ID NO: 12036 - DNA, 27 bp, Artificial Sequences
  Synthetic
ggggtttcggagggacggtttagaggg

SEQ ID NO: 12037 - DNA, 27 bp, Artificial Sequences
  Synthetic
gggggtttcggagggacggtttagagg

SEQ ID NO: 12038 - DNA, 27 bp, Artificial Sequences
  Synthetic
gagtcggggatagggttgggggtttcg

SEQ ID NO: 12039 - DNA, 27 bp, Artificial Sequences
  Synthetic
agttcgggttgttgagtagggggcgtc

SEQ ID NO: 12040 - DNA, 27 bp, Artificial Sequences
  Synthetic
ggtgggggcgtttttaggtttggggtc

SEQ ID NO: 12041 - DNA, 27 bp, Artificial Sequences
  Synthetic
ggggagggggcgttttatgtgatggga

SEQ ID NO: 12042 - DNA, 27 bp, Artificial Sequences
  Synthetic
agggggcgttttatgtgatgggagggg

SEQ ID NO: 12043 - DNA, 27 bp, Artificial Sequences
  Synthetic
agggcgcgggtagtcgtttgttatggt

SEQ ID NO: 12044 - DNA, 27 bp, Artificial Sequences
  Synthetic
gcggaggagtcgggtaagaagcggtac

SEQ ID NO: 12045 - DNA, 27 bp, Artificial Sequences
  Synthetic
ttttcgggttttatgagtcggggcgcg

SEQ ID NO: 12046 - DNA, 27 bp, Artificial Sequences
  Synthetic
ggcgcgcgggttgttgtagagttttga

SEQ ID NO: 12047 - DNA, 27 bp, Artificial Sequences
  Synthetic
cggcgcgcgggttgttgtagagttttg

SEQ ID NO: 12048 - DNA, 27 bp, Artificial Sequences
  Synthetic
cgcgcgggttgttgtagagttttgagc

SEQ ID NO: 12049 - DNA, 27 bp, Artificial Sequences
  Synthetic
gcgcgcgggttgttgtagagttttgag

SEQ ID NO: 12050 - DNA, 28 bp, Artificial Sequences
  Synthetic
ggcgcgcgggttgttgtagagttttgag

SEQ ID NO: 12051 - DNA, 27 bp, Artificial Sequences
  Synthetic
cgattggttgtgtcgcgtggtgaagta

SEQ ID NO: 12052 - DNA, 27 bp, Artificial Sequences
  Synthetic
aggtgttcggtatgtttgcgtcggttt

SEQ ID NO: 12053 - DNA, 28 bp, Artificial Sequences
  Synthetic
tgtaggtgttcggtatgtttgcgtcggt

SEQ ID NO: 12054 - DNA, 27 bp, Artificial Sequences
  Synthetic
gtaggtgttcggtatgtttgcgtcggt

SEQ ID NO: 12055 - DNA, 27 bp, Artificial Sequences
  Synthetic
tgtaggtgttcggtatgtttgcgtcgg

SEQ ID NO: 12056 - DNA, 27 bp, Artificial Sequences
  Synthetic
aggtcggttaggttgaggtgtcggatg

SEQ ID NO: 12057 - DNA, 27 bp, Artificial Sequences
  Synthetic
ggtcggttaggttgaggtgtcggatga

SEQ ID NO: 12058 - DNA, 29 bp, Artificial Sequences
  Synthetic
cggttaggtcggttaggttgaggtgtcgg

SEQ ID NO: 12059 - DNA, 28 bp, Artificial Sequences
  Synthetic
aggtcggttaggttgaggtgtcggatga

SEQ ID NO: 12060 - DNA, 28 bp, Artificial Sequences
  Synthetic
cggttaggtcggttaggttgaggtgtcg

SEQ ID NO: 12061 - DNA, 27 bp, Artificial Sequences
  Synthetic
tggagatcgtcgtgttggcggtgattt

SEQ ID NO: 12062 - DNA, 27 bp, Artificial Sequences
  Synthetic
ttggagatcgtcgtgttggcggtgatt

SEQ ID NO: 12063 - DNA, 27 bp, Artificial Sequences
  Synthetic
aattggagatcgtcgtgttggcggtga

SEQ ID NO: 12064 - DNA, 27 bp, Artificial Sequences
  Synthetic
attggagatcgtcgtgttggcggtgat

SEQ ID NO: 12065 - DNA, 27 bp, Artificial Sequences
  Synthetic
aaattggagatcgtcgtgttggcggtg

SEQ ID NO: 12066 - DNA, 34 bp, Artificial Sequences
  Synthetic
cggcgatttttagtttggttagtttttcgttgcg

SEQ ID NO: 12067 - DNA, 35 bp, Artificial Sequences
  Synthetic
cggcgatttttagtttggttagtttttcgttgcgt

SEQ ID NO: 12068 - DNA, 35 bp, Artificial Sequences
  Synthetic
acggcgatttttagtttggttagtttttcgttgcg

SEQ ID NO: 12069 - DNA, 33 bp, Artificial Sequences
  Synthetic
ggcgatttttagtttggttagtttttcgttgcg

SEQ ID NO: 12070 - DNA, 33 bp, Artificial Sequences
  Synthetic
cggcgatttttagtttggttagtttttcgttgc

SEQ ID NO: 12071 - DNA, 27 bp, Artificial Sequences
  Synthetic
tggtggtttttggttatcggcgttggt

SEQ ID NO: 12072 - DNA, 28 bp, Artificial Sequences
  Synthetic
atggtggtttttggttatcggcgttggt

SEQ ID NO: 12073 - DNA, 27 bp, Artificial Sequences
  Synthetic
atggtggtttttggttatcggcgttgg

SEQ ID NO: 12074 - DNA, 29 bp, Artificial Sequences
  Synthetic
cggcgttggtaatataagtcgggaggtcg

SEQ ID NO: 12075 - DNA, 27 bp, Artificial Sequences
  Synthetic
cggcgttggtaatataagtcgggaggt

SEQ ID NO: 12076 - DNA, 27 bp, Artificial Sequences
  Synthetic
cggtttgtgttgttagcgtcggtggtt

SEQ ID NO: 12077 - DNA, 26 bp, Artificial Sequences
  Synthetic
cggtttgtgttgttagcgtcggtggt

SEQ ID NO: 12078 - DNA, 28 bp, Artificial Sequences
  Synthetic
tgtgttgttagcgtcggtggttagaggt

SEQ ID NO: 12079 - DNA, 27 bp, Artificial Sequences
  Synthetic
gtgttgttagcgtcggtggttagaggt

SEQ ID NO: 12080 - DNA, 27 bp, Artificial Sequences
  Synthetic
tgtgttgttagcgtcggtggttagagg

SEQ ID NO: 12081 - DNA, 27 bp, Artificial Sequences
  Synthetic
tttttcgagacggggagggagcggttc

SEQ ID NO: 12082 - DNA, 27 bp, Artificial Sequences
  Synthetic
aagtttttcgagacggggagggagcgg

SEQ ID NO: 12083 - DNA, 27 bp, Artificial Sequences
  Synthetic
gtttttcgagacggggagggagcggtt

SEQ ID NO: 12084 - DNA, 26 bp, Artificial Sequences
  Synthetic
tttttcgagacggggagggagcggtt

SEQ ID NO: 12085 - DNA, 28 bp, Artificial Sequences
  Synthetic
taagtttttcgagacggggagggagcgg

SEQ ID NO: 12086 - DNA, 27 bp, Artificial Sequences
  Synthetic
cggtttgtgttgttagcgtcggtggtt

SEQ ID NO: 12087 - DNA, 26 bp, Artificial Sequences
  Synthetic
cggtttgtgttgttagcgtcggtggt

SEQ ID NO: 12088 - DNA, 28 bp, Artificial Sequences
  Synthetic
tgtgttgttagcgtcggtggttagaggt

SEQ ID NO: 12089 - DNA, 27 bp, Artificial Sequences
  Synthetic
gtgttgttagcgtcggtggttagaggt

SEQ ID NO: 12090 - DNA, 27 bp, Artificial Sequences
  Synthetic
tgtgttgttagcgtcggtggttagagg

SEQ ID NO: 12091 - DNA, 27 bp, Artificial Sequences
  Synthetic
tttttcgagacggggagggagcggttc

SEQ ID NO: 12092 - DNA, 27 bp, Artificial Sequences
  Synthetic
aagtttttcgagacggggagggagcgg

SEQ ID NO: 12093 - DNA, 27 bp, Artificial Sequences
  Synthetic
gtttttcgagacggggagggagcggtt

SEQ ID NO: 12094 - DNA, 26 bp, Artificial Sequences
  Synthetic
tttttcgagacggggagggagcggtt

SEQ ID NO: 12095 - DNA, 28 bp, Artificial Sequences
  Synthetic
taagtttttcgagacggggagggagcgg

SEQ ID NO: 12096 - DNA, 27 bp, Artificial Sequences
  Synthetic
cgcgttcgtagtttgtcgggttttgcg

SEQ ID NO: 12097 - DNA, 27 bp, Artificial Sequences
  Synthetic
gcgttcgtagtttgtcgggttttgcga

SEQ ID NO: 12098 - DNA, 28 bp, Artificial Sequences
  Synthetic
gcgttcgtagtttgtcgggttttgcgat

SEQ ID NO: 12099 - DNA, 27 bp, Artificial Sequences
  Synthetic
ttgggtttttcgttcgaagcgtagggt

SEQ ID NO: 12100 - DNA, 26 bp, Artificial Sequences
  Synthetic
gcgttcgtagtttgtcgggttttgcg

SEQ ID NO: 12101 - DNA, 27 bp, Artificial Sequences
  Synthetic
tgagagttgtttagtgggtaggcggga

SEQ ID NO: 12102 - DNA, 28 bp, Artificial Sequences
  Synthetic
tgagagttgtttagtgggtaggcgggac

SEQ ID NO: 12103 - DNA, 27 bp, Artificial Sequences
  Synthetic
gagagttgtttagtgggtaggcgggac

SEQ ID NO: 12104 - DNA, 27 bp, Artificial Sequences
  Synthetic
ttgagagttgtttagtgggtaggcggg

SEQ ID NO: 12105 - DNA, 28 bp, Artificial Sequences
  Synthetic
ttgagagttgtttagtgggtaggcggga

SEQ ID NO: 12106 - DNA, 27 bp, Artificial Sequences
  Synthetic
gaggtcgggaaggtgagtttcgagttt

SEQ ID NO: 12107 - DNA, 27 bp, Artificial Sequences
  Synthetic
aggtcgggaaggtgagtttcgagtttt

SEQ ID NO: 12108 - DNA, 28 bp, Artificial Sequences
  Synthetic
aggtcgggaaggtgagtttcgagttttc

SEQ ID NO: 12109 - DNA, 28 bp, Artificial Sequences
  Synthetic
gaggtcgggaaggtgagtttcgagtttt

SEQ ID NO: 12110 - DNA, 26 bp, Artificial Sequences
  Synthetic
gaggtcgggaaggtgagtttcgagtt

SEQ ID NO: 12111 - DNA, 27 bp, Artificial Sequences
  Synthetic
ttttcggtaatagggcgggagggagcg

SEQ ID NO: 12112 - DNA, 26 bp, Artificial Sequences
  Synthetic
tttcggtaatagggcgggagggagcg

SEQ ID NO: 12113 - DNA, 28 bp, Artificial Sequences
  Synthetic
tttttcggtaatagggcgggagggagcg

SEQ ID NO: 12114 - DNA, 27 bp, Artificial Sequences
  Synthetic
tttttcggtaatagggcgggagggagc

SEQ ID NO: 12115 - DNA, 28 bp, Artificial Sequences
  Synthetic
gtttttcggtaatagggcgggagggagc

SEQ ID NO: 12116 - DNA, 27 bp, Artificial Sequences
  Synthetic
cggtaggaggtattttcggggagcggt

SEQ ID NO: 12117 - DNA, 27 bp, Artificial Sequences
  Synthetic
tcggtaggaggtattttcggggagcgg

SEQ ID NO: 12118 - DNA, 28 bp, Artificial Sequences
  Synthetic
cggtaggaggtattttcggggagcggtt

SEQ ID NO: 12119 - DNA, 28 bp, Artificial Sequences
  Synthetic
tcggtaggaggtattttcggggagcggt

SEQ ID NO: 12120 - DNA, 28 bp, Artificial Sequences
  Synthetic
ttcggtaggaggtattttcggggagcgg

SEQ ID NO: 12121 - DNA, 27 bp, Artificial Sequences
  Synthetic
atcggggattgaggaaggaggagtgcg

SEQ ID NO: 12122 - DNA, 27 bp, Artificial Sequences
  Synthetic
cgtttttagggtagcgcggggagttcg

SEQ ID NO: 12123 - DNA, 27 bp, Artificial Sequences
  Synthetic
gggattgaggaaggaggagtgcgggat

SEQ ID NO: 12124 - DNA, 27 bp, Artificial Sequences
  Synthetic
gaggtcgttttggagatggcgtcggtt

SEQ ID NO: 12125 - DNA, 27 bp, Artificial Sequences
  Synthetic
ggggattgaggaaggaggagtgcggga

SEQ ID NO: 12126 - DNA, 27 bp, Artificial Sequences
  Synthetic
cggtaggaggtattttcggggagcggt

SEQ ID NO: 12127 - DNA, 27 bp, Artificial Sequences
  Synthetic
tcggtaggaggtattttcggggagcgg

SEQ ID NO: 12128 - DNA, 28 bp, Artificial Sequences
  Synthetic
cggtaggaggtattttcggggagcggtt

SEQ ID NO: 12129 - DNA, 28 bp, Artificial Sequences
  Synthetic
tcggtaggaggtattttcggggagcggt

SEQ ID NO: 12130 - DNA, 28 bp, Artificial Sequences
  Synthetic
ttcggtaggaggtattttcggggagcgg

SEQ ID NO: 12131 - DNA, 27 bp, Artificial Sequences
  Synthetic
ttcgtcgtttggagcgggaaagttgcg

SEQ ID NO: 12132 - DNA, 27 bp, Artificial Sequences
  Synthetic
gttttcgaggtttgggcgcgtaggagg

SEQ ID NO: 12133 - DNA, 27 bp, Artificial Sequences
  Synthetic
ttttcgaggtttgggcgcgtaggaggt

SEQ ID NO: 12134 - DNA, 27 bp, Artificial Sequences
  Synthetic
gttcggggttttcgtcgtttggagcgg

SEQ ID NO: 12135 - DNA, 27 bp, Artificial Sequences
  Synthetic
ggttcggggttttcgtcgtttggagcg

SEQ ID NO: 12136 - DNA, 27 bp, Artificial Sequences
  Synthetic
gttttaggcggcggggatttcgagtcg

SEQ ID NO: 12137 - DNA, 27 bp, Artificial Sequences
  Synthetic
cgttttaggcggcggggatttcgagtc

SEQ ID NO: 12138 - DNA, 27 bp, Artificial Sequences
  Synthetic
tcgttttaggcggcggggatttcgagt

SEQ ID NO: 12139 - DNA, 27 bp, Artificial Sequences
  Synthetic
ttcgttttaggcggcggggatttcgag

SEQ ID NO: 12140 - DNA, 27 bp, Artificial Sequences
  Synthetic
tttcgttttaggcggcggggatttcga

SEQ ID NO: 12141 - DNA, 27 bp, Artificial Sequences
  Synthetic
gttttcgaggtttgggcgcgtaggagg

SEQ ID NO: 12142 - DNA, 27 bp, Artificial Sequences
  Synthetic
ttttcgaggtttgggcgcgtaggaggt

SEQ ID NO: 12143 - DNA, 27 bp, Artificial Sequences
  Synthetic
tttcgaggtttgggcgcgtaggaggta

SEQ ID NO: 12144 - DNA, 27 bp, Artificial Sequences
  Synthetic
ttcgaggtttgggcgcgtaggaggtat

SEQ ID NO: 12145 - DNA, 28 bp, Artificial Sequences
  Synthetic
cgaggtttgggcgcgtaggaggtatagg

SEQ ID NO: 12146 - DNA, 27 bp, Artificial Sequences
  Synthetic
gttttaggcggcggggatttcgagtcg

SEQ ID NO: 12147 - DNA, 27 bp, Artificial Sequences
  Synthetic
cgttttaggcggcggggatttcgagtc

SEQ ID NO: 12148 - DNA, 27 bp, Artificial Sequences
  Synthetic
cggcggggatttcgagtcggagttttg

SEQ ID NO: 12149 - DNA, 27 bp, Artificial Sequences
  Synthetic
tcgttttaggcggcggggatttcgagt

SEQ ID NO: 12150 - DNA, 27 bp, Artificial Sequences
  Synthetic
ggcggggatttcgagtcggagttttgg

SEQ ID NO: 12151 - DNA, 27 bp, Artificial Sequences
  Synthetic
gtagagcggggcgttaagggttgttcg

SEQ ID NO: 12152 - DNA, 27 bp, Artificial Sequences
  Synthetic
cgagtttttatgtcggcgggcgtagag

SEQ ID NO: 12153 - DNA, 26 bp, Artificial Sequences
  Synthetic
tagagcggggcgttaagggttgttcg

SEQ ID NO: 12154 - DNA, 27 bp, Artificial Sequences
  Synthetic
gtttaggcggagggtcgaaacgttacg

SEQ ID NO: 12155 - DNA, 27 bp, Artificial Sequences
  Synthetic
cgttaagggttgttcgcggggtgtatt

SEQ ID NO: 12156 - DNA, 28 bp, Artificial Sequences
  Synthetic
gcgggtagtttttggcgtttcgttttgc

SEQ ID NO: 12157 - DNA, 28 bp, Artificial Sequences
  Synthetic
tggtggattagaggtgtatttcgcgggt

SEQ ID NO: 12158 - DNA, 27 bp, Artificial Sequences
  Synthetic
ggtggattagaggtgtatttcgcgggt

SEQ ID NO: 12159 - DNA, 27 bp, Artificial Sequences
  Synthetic
tggtggattagaggtgtatttcgcggg

SEQ ID NO: 12160 - DNA, 27 bp, Artificial Sequences
  Synthetic
cgggtagtttttggcgtttcgttttgc

SEQ ID NO: 12161 - DNA, 27 bp, Artificial Sequences
  Synthetic
cgagtttttatgtcggcgggcgtagag

SEQ ID NO: 12162 - DNA, 27 bp, Artificial Sequences
  Synthetic
gtttaggcggagggtcgaaacgttacg

SEQ ID NO: 12163 - DNA, 26 bp, Artificial Sequences
  Synthetic
cgagtttttatgtcggcgggcgtaga

SEQ ID NO: 12164 - DNA, 26 bp, Artificial Sequences
  Synthetic
tttaggcggagggtcgaaacgttacg

SEQ ID NO: 12165 - DNA, 26 bp, Artificial Sequences
  Synthetic
gagtttttatgtcggcgggcgtagag

SEQ ID NO: 12166 - DNA, 27 bp, Artificial Sequences
  Synthetic
tcggtatgaggattcgtgcgtggcgtt

SEQ ID NO: 12167 - DNA, 27 bp, Artificial Sequences
  Synthetic
cggtatgaggattcgtgcgtggcgttt

SEQ ID NO: 12168 - DNA, 27 bp, Artificial Sequences
  Synthetic
tgaggattcgtgcgtggcgtttcgatt

SEQ ID NO: 12169 - DNA, 27 bp, Artificial Sequences
  Synthetic
gtcggtatgaggattcgtgcgtggcgt

SEQ ID NO: 12170 - DNA, 27 bp, Artificial Sequences
  Synthetic
atgaggattcgtgcgtggcgtttcgat

SEQ ID NO: 12171 - DNA, 27 bp, Artificial Sequences
  Synthetic
tttgcgggtgggtggaggttgtaggtt

SEQ ID NO: 12172 - DNA, 27 bp, Artificial Sequences
  Synthetic
tgtttgcgggtgggtggaggttgtagg

SEQ ID NO: 12173 - DNA, 27 bp, Artificial Sequences
  Synthetic
gtttgcgggtgggtggaggttgtaggt

SEQ ID NO: 12174 - DNA, 27 bp, Artificial Sequences
  Synthetic
ttgcgggtgggtggaggttgtaggtta

SEQ ID NO: 12175 - DNA, 27 bp, Artificial Sequences
  Synthetic
tgcgggtgggtggaggttgtaggttat

SEQ ID NO: 12176 - DNA, 27 bp, Artificial Sequences
  Synthetic
gggagggagggagggagggagaaagag

SEQ ID NO: 12177 - DNA, 27 bp, Artificial Sequences
  Synthetic
gagggagggagggagggagggagaaag

SEQ ID NO: 12178 - DNA, 27 bp, Artificial Sequences
  Synthetic
tcgggttgcgttgttagggttgcgttt

SEQ ID NO: 12179 - DNA, 27 bp, Artificial Sequences
  Synthetic
ttcgggttgcgttgttagggttgcgtt

SEQ ID NO: 12180 - DNA, 27 bp, Artificial Sequences
  Synthetic
tttcgggttgcgttgttagggttgcgt

SEQ ID NO: 12181 - DNA, 27 bp, Artificial Sequences
  Synthetic
tttgcggtagttttttagggcgggcgg

SEQ ID NO: 12182 - DNA, 27 bp, Artificial Sequences
  Synthetic
cggtagttttttagggcgggcgggttg

SEQ ID NO: 12183 - DNA, 27 bp, Artificial Sequences
  Synthetic
ggtagttttttagggcgggcgggttgt

SEQ ID NO: 12184 - DNA, 27 bp, Artificial Sequences
  Synthetic
gtttgcggtagttttttagggcgggcg

SEQ ID NO: 12185 - DNA, 26 bp, Artificial Sequences
  Synthetic
ttgcggtagttttttagggcgggcgg

SEQ ID NO: 12186 - DNA, 35 bp, Artificial Sequences
  Synthetic
tggtttttaatagggttttagaaattgggcgagtg

SEQ ID NO: 12187 - DNA, 35 bp, Artificial Sequences
  Synthetic
ggtttttaatagggttttagaaattgggcgagtga

SEQ ID NO: 12188 - DNA, 36 bp, Artificial Sequences
  Synthetic
tggtttttaatagggttttagaaattgggcgagtga

SEQ ID NO: 12189 - DNA, 36 bp, Artificial Sequences
  Synthetic
ttggtttttaatagggttttagaaattgggcgagtg

SEQ ID NO: 12190 - DNA, 36 bp, Artificial Sequences
  Synthetic
ggtttttaatagggttttagaaattgggcgagtgaa

SEQ ID NO: 12191 - DNA, 34 bp, Artificial Sequences
  Synthetic
tgggaagtgagtatgtgtagtgtgtttaggaagt

SEQ ID NO: 12192 - DNA, 34 bp, Artificial Sequences
  Synthetic
tgtttgggaagtgagtatgtgtagtgtgtttagg

SEQ ID NO: 12193 - DNA, 34 bp, Artificial Sequences
  Synthetic
gtttgggaagtgagtatgtgtagtgtgtttagga

SEQ ID NO: 12194 - DNA, 35 bp, Artificial Sequences
  Synthetic
tgtttgggaagtgagtatgtgtagtgtgtttagga

SEQ ID NO: 12195 - DNA, 34 bp, Artificial Sequences
  Synthetic
gggaagtgagtatgtgtagtgtgtttaggaagtt

SEQ ID NO: 12196 - DNA, 27 bp, Artificial Sequences
  Synthetic
ttggttgaatgttttgggacggcgttc

SEQ ID NO: 12197 - DNA, 27 bp, Artificial Sequences
  Synthetic
attggttgaatgttttgggacggcgtt

SEQ ID NO: 12198 - DNA, 27 bp, Artificial Sequences
  Synthetic
aattggttgaatgttttgggacggcgt

SEQ ID NO: 12199 - DNA, 28 bp, Artificial Sequences
  Synthetic
attggttgaatgttttgggacggcgttc

SEQ ID NO: 12200 - DNA, 26 bp, Artificial Sequences
  Synthetic
tggttgaatgttttgggacggcgttc

SEQ ID NO: 12201 - DNA, 29 bp, Artificial Sequences
  Synthetic
gtggagggtgggttagaaggttatttggt

SEQ ID NO: 12202 - DNA, 30 bp, Artificial Sequences
  Synthetic
agtggagggtgggttagaaggttatttggt

SEQ ID NO: 12203 - DNA, 29 bp, Artificial Sequences
  Synthetic
agtggagggtgggttagaaggttatttgg

SEQ ID NO: 12204 - DNA, 31 bp, Artificial Sequences
  Synthetic
tggagggtgggttagaaggttatttggtagt

SEQ ID NO: 12205 - DNA, 31 bp, Artificial Sequences
  Synthetic
agtggagggtgggttagaaggttatttggta

SEQ ID NO: 12206 - DNA, 35 bp, Artificial Sequences
  Synthetic
cgttaaggaatgtatgtcggtagttgttgagatgt

SEQ ID NO: 12207 - DNA, 35 bp, Artificial Sequences
  Synthetic
tcgttaaggaatgtatgtcggtagttgttgagatg

SEQ ID NO: 12208 - DNA, 36 bp, Artificial Sequences
  Synthetic
tcgttaaggaatgtatgtcggtagttgttgagatgt

SEQ ID NO: 12209 - DNA, 36 bp, Artificial Sequences
  Synthetic
atcgttaaggaatgtatgtcggtagttgttgagatg

SEQ ID NO: 12210 - DNA, 36 bp, Artificial Sequences
  Synthetic
cgttaaggaatgtatgtcggtagttgttgagatgta

SEQ ID NO: 12211 - DNA, 27 bp, Artificial Sequences
  Synthetic
aggaggggtggaggagtaggtgttttt

SEQ ID NO: 12212 - DNA, 27 bp, Artificial Sequences
  Synthetic
taggaggggtggaggagtaggtgtttt

SEQ ID NO: 12213 - DNA, 27 bp, Artificial Sequences
  Synthetic
ggaggggtggaggagtaggtgtttttt

SEQ ID NO: 12214 - DNA, 28 bp, Artificial Sequences
  Synthetic
aggaggggtggaggagtaggtgtttttt

SEQ ID NO: 12215 - DNA, 27 bp, Artificial Sequences
  Synthetic
ataggaggggtggaggagtaggtgttt

SEQ ID NO: 12216 - DNA, 27 bp, Artificial Sequences
  Synthetic
gggtgatggagacgggaggaaagaggt

SEQ ID NO: 12217 - DNA, 27 bp, Artificial Sequences
  Synthetic
tgggtgatggagacgggaggaaagagg

SEQ ID NO: 12218 - DNA, 28 bp, Artificial Sequences
  Synthetic
tgggtgatggagacgggaggaaagaggt

SEQ ID NO: 12219 - DNA, 27 bp, Artificial Sequences
  Synthetic
tgtgggtgatggagacgggaggaaaga

SEQ ID NO: 12220 - DNA, 28 bp, Artificial Sequences
  Synthetic
gtgggtgatggagacgggaggaaagagg

SEQ ID NO: 12221 - DNA, 27 bp, Artificial Sequences
  Synthetic
ttgggcgtttcggggattttgttcgga

SEQ ID NO: 12222 - DNA, 27 bp, Artificial Sequences
  Synthetic
tgggcgtttcggggattttgttcggat

SEQ ID NO: 12223 - DNA, 27 bp, Artificial Sequences
  Synthetic
tttgggcgtttcggggattttgttcgg

SEQ ID NO: 12224 - DNA, 28 bp, Artificial Sequences
  Synthetic
tttgggcgtttcggggattttgttcgga

SEQ ID NO: 12225 - DNA, 28 bp, Artificial Sequences
  Synthetic
gcgtttttgggcgtttcggggattttgt

SEQ ID NO: 12226 - DNA, 27 bp, Artificial Sequences
  Synthetic
gcgggagttcgggtagggttttcggaa

SEQ ID NO: 12227 - DNA, 27 bp, Artificial Sequences
  Synthetic
ttgagggggttttttcgcgggagttcg

SEQ ID NO: 12228 - DNA, 27 bp, Artificial Sequences
  Synthetic
tgagggggttttttcgcgggagttcgg

SEQ ID NO: 12229 - DNA, 26 bp, Artificial Sequences
  Synthetic
gagggggttttttcgcgggagttcgg

SEQ ID NO: 12230 - DNA, 26 bp, Artificial Sequences
  Synthetic
gcgggagttcgggtagggttttcgga

SEQ ID NO: 12231 - DNA, 27 bp, Artificial Sequences
  Synthetic
ttgggcgtttcggggattttgttcgga

SEQ ID NO: 12232 - DNA, 27 bp, Artificial Sequences
  Synthetic
tgggcgtttcggggattttgttcggat

SEQ ID NO: 12233 - DNA, 27 bp, Artificial Sequences
  Synthetic
gcggttgcgtacggggatggtagtatt

SEQ ID NO: 12234 - DNA, 27 bp, Artificial Sequences
  Synthetic
tttgggcgtttcggggattttgttcgg

SEQ ID NO: 12235 - DNA, 28 bp, Artificial Sequences
  Synthetic
tttgggcgtttcggggattttgttcgga

SEQ ID NO: 12236 - DNA, 27 bp, Artificial Sequences
  Synthetic
gggtaggtggtttcggaggcgcgtata

SEQ ID NO: 12237 - DNA, 26 bp, Artificial Sequences
  Synthetic
gggtaggtggtttcggaggcgcgtat

SEQ ID NO: 12238 - DNA, 28 bp, Artificial Sequences
  Synthetic
ggtaggtggtttcggaggcgcgtatagt

SEQ ID NO: 12239 - DNA, 27 bp, Artificial Sequences
  Synthetic
aggtggtttcggaggcgcgtatagttt

SEQ ID NO: 12240 - DNA, 27 bp, Artificial Sequences
  Synthetic
ggggtaggtggtttcggaggcgcgtat

SEQ ID NO: 12241 - DNA, 27 bp, Artificial Sequences
  Synthetic
tggagcgttaggtttgggggttcgagg

SEQ ID NO: 12242 - DNA, 27 bp, Artificial Sequences
  Synthetic
ggagcgttaggtttgggggttcgaggg

SEQ ID NO: 12243 - DNA, 27 bp, Artificial Sequences
  Synthetic
tgttggagcgttaggtttgggggttcg

SEQ ID NO: 12244 - DNA, 27 bp, Artificial Sequences
  Synthetic
gagcgttaggtttgggggttcgagggc

SEQ ID NO: 12245 - DNA, 28 bp, Artificial Sequences
  Synthetic
tgttggagcgttaggtttgggggttcga

SEQ ID NO: 12246 - DNA, 27 bp, Artificial Sequences
  Synthetic
gggggttttggttagttcgggcgttcg

SEQ ID NO: 12247 - DNA, 27 bp, Artificial Sequences
  Synthetic
cgggggttttggttagttcgggcgttc

SEQ ID NO: 12248 - DNA, 27 bp, Artificial Sequences
  Synthetic
ggggttttggttagttcgggcgttcgt

SEQ ID NO: 12249 - DNA, 26 bp, Artificial Sequences
  Synthetic
cgggggttttggttagttcgggcgtt

SEQ ID NO: 12250 - DNA, 28 bp, Artificial Sequences
  Synthetic
ggggttttggttagttcgggcgttcgtt

SEQ ID NO: 12251 - DNA, 27 bp, Artificial Sequences
  Synthetic
gggcggaatgtaatagcgacggggagt

SEQ ID NO: 12252 - DNA, 27 bp, Artificial Sequences
  Synthetic
tggagcgttaggtttgggggttcgagg

SEQ ID NO: 12253 - DNA, 27 bp, Artificial Sequences
  Synthetic
agggcggaatgtaatagcgacggggag

SEQ ID NO: 12254 - DNA, 27 bp, Artificial Sequences
  Synthetic
ggagcgttaggtttgggggttcgaggg

SEQ ID NO: 12255 - DNA, 27 bp, Artificial Sequences
  Synthetic
tgttggagcgttaggtttgggggttcg

SEQ ID NO: 12256 - DNA, 27 bp, Artificial Sequences
  Synthetic
gggggttttggttagttcgggcgttcg

SEQ ID NO: 12257 - DNA, 27 bp, Artificial Sequences
  Synthetic
cgggggttttggttagttcgggcgttc

SEQ ID NO: 12258 - DNA, 27 bp, Artificial Sequences
  Synthetic
ggggttttggttagttcgggcgttcgt

SEQ ID NO: 12259 - DNA, 26 bp, Artificial Sequences
  Synthetic
cgggggttttggttagttcgggcgtt

SEQ ID NO: 12260 - DNA, 28 bp, Artificial Sequences
  Synthetic
ggggttttggttagttcgggcgttcgtt

SEQ ID NO: 12261 - DNA, 27 bp, Artificial Sequences
  Synthetic
gggcggaatgtaatagcgacggggagt

SEQ ID NO: 12262 - DNA, 27 bp, Artificial Sequences
  Synthetic
agggcggaatgtaatagcgacggggag

SEQ ID NO: 12263 - DNA, 27 bp, Artificial Sequences
  Synthetic
gaggaggggggtagttagcgagcgttc

SEQ ID NO: 12264 - DNA, 27 bp, Artificial Sequences
  Synthetic
gttcgaggaggggggtagttagcgagc

SEQ ID NO: 12265 - DNA, 27 bp, Artificial Sequences
  Synthetic
ttcgaggaggggggtagttagcgagcg

SEQ ID NO: 12266 - DNA, 27 bp, Artificial Sequences
  Synthetic
cgggggttttggttagttcgggcgttt

SEQ ID NO: 12267 - DNA, 26 bp, Artificial Sequences
  Synthetic
cgggggttttggttagttcgggcgtt

SEQ ID NO: 12268 - DNA, 27 bp, Artificial Sequences
  Synthetic
gcgggggttttggttagttcgggcgtt

SEQ ID NO: 12269 - DNA, 25 bp, Artificial Sequences
  Synthetic
cgggggttttggttagttcgggcgt

SEQ ID NO: 12270 - DNA, 25 bp, Artificial Sequences
  Synthetic
gcgggggttttggttagttcgggcg

SEQ ID NO: 12271 - DNA, 27 bp, Artificial Sequences
  Synthetic
gggcggaatgtaatagcgacggggagt

SEQ ID NO: 12272 - DNA, 27 bp, Artificial Sequences
  Synthetic
agggcggaatgtaatagcgacggggag

SEQ ID NO: 12273 - DNA, 27 bp, Artificial Sequences
  Synthetic
gaggaggggggtagttagcgagcgttc

SEQ ID NO: 12274 - DNA, 27 bp, Artificial Sequences
  Synthetic
gttcgaggaggggggtagttagcgagc

SEQ ID NO: 12275 - DNA, 27 bp, Artificial Sequences
  Synthetic
ttcgaggaggggggtagttagcgagcg

SEQ ID NO: 12276 - DNA, 27 bp, Artificial Sequences
  Synthetic
aggattttaggttgagcgttcggttgc

SEQ ID NO: 12277 - DNA, 28 bp, Artificial Sequences
  Synthetic
gaggattttaggttgagcgttcggttgc

SEQ ID NO: 12278 - DNA, 29 bp, Artificial Sequences
  Synthetic
agaggattttaggttgagcgttcggttgc

SEQ ID NO: 12279 - DNA, 29 bp, Artificial Sequences
  Synthetic
cgaagaggattttaggttgagcgttcggt

SEQ ID NO: 12280 - DNA, 28 bp, Artificial Sequences
  Synthetic
cgaagaggattttaggttgagcgttcgg

SEQ ID NO: 12281 - DNA, 30 bp, Artificial Sequences
  Synthetic
aggtaattttttagggattgggagcgaggt

SEQ ID NO: 12282 - DNA, 31 bp, Artificial Sequences
  Synthetic
aggtaattttttagggattgggagcgaggtt

SEQ ID NO: 12283 - DNA, 32 bp, Artificial Sequences
  Synthetic
aggtaattttttagggattgggagcgaggttt

SEQ ID NO: 12284 - DNA, 32 bp, Artificial Sequences
  Synthetic
taggtaattttttagggattgggagcgaggtt

SEQ ID NO: 12285 - DNA, 32 bp, Artificial Sequences
  Synthetic
ttaggtaattttttagggattgggagcgaggt

SEQ ID NO: 12286 - DNA, 27 bp, Artificial Sequences
  Synthetic
acggtttgaggggtggggttcggtatt

SEQ ID NO: 12287 - DNA, 27 bp, Artificial Sequences
  Synthetic
gtacggtttgaggggtggggttcggta

SEQ ID NO: 12288 - DNA, 27 bp, Artificial Sequences
  Synthetic
ggatagggtacggtttgaggggtgggg

SEQ ID NO: 12289 - DNA, 27 bp, Artificial Sequences
  Synthetic
tagggtacggtttgaggggtggggttc

SEQ ID NO: 12290 - DNA, 27 bp, Artificial Sequences
  Synthetic
cggtttgaggggtggggttcggtattg

SEQ ID NO: 12291 - DNA, 29 bp, Artificial Sequences
  Synthetic
cggtcgggtttgggtttagtttttgtggg

SEQ ID NO: 12292 - DNA, 30 bp, Artificial Sequences
  Synthetic
cggtcgggtttgggtttagtttttgtgggt

SEQ ID NO: 12293 - DNA, 30 bp, Artificial Sequences
  Synthetic
tcggtcgggtttgggtttagtttttgtggg

SEQ ID NO: 12294 - DNA, 28 bp, Artificial Sequences
  Synthetic
cggtcgggtttgggtttagtttttgtgg

SEQ ID NO: 12295 - DNA, 31 bp, Artificial Sequences
  Synthetic
tcggtcgggtttgggtttagtttttgtgggt

SEQ ID NO: 12296 - DNA, 30 bp, Artificial Sequences
  Synthetic
tgttcgttagttcggattggagtgtagggt

SEQ ID NO: 12297 - DNA, 29 bp, Artificial Sequences
  Synthetic
gttcgttagttcggattggagtgtagggt

SEQ ID NO: 12298 - DNA, 29 bp, Artificial Sequences
  Synthetic
tgttcgttagttcggattggagtgtaggg

SEQ ID NO: 12299 - DNA, 30 bp, Artificial Sequences
  Synthetic
gttcgttagttcggattggagtgtagggtt

SEQ ID NO: 12300 - DNA, 30 bp, Artificial Sequences
  Synthetic
ttgttcgttagttcggattggagtgtaggg

SEQ ID NO: 12301 - DNA, 27 bp, Artificial Sequences
  Synthetic
agttgtgtggaaggtgagagggtggta

SEQ ID NO: 12302 - DNA, 27 bp, Artificial Sequences
  Synthetic
tagttgtgtggaaggtgagagggtggt

SEQ ID NO: 12303 - DNA, 27 bp, Artificial Sequences
  Synthetic
tgtgttggggagaggtagttatggggt

SEQ ID NO: 12304 - DNA, 28 bp, Artificial Sequences
  Synthetic
gtagttgtgtggaaggtgagagggtggt

SEQ ID NO: 12305 - DNA, 27 bp, Artificial Sequences
  Synthetic
gtagttgtgtggaaggtgagagggtgg

SEQ ID NO: 12306 - DNA, 27 bp, Artificial Sequences
  Synthetic
ttgttttgtttggtgtgtgtggggtgt

SEQ ID NO: 12307 - DNA, 27 bp, Artificial Sequences
  Synthetic
agttgttttgtttggtgtgtgtggggt

SEQ ID NO: 12308 - DNA, 28 bp, Artificial Sequences
  Synthetic
gttgttttgtttggtgtgtgtggggtgt

SEQ ID NO: 12309 - DNA, 29 bp, Artificial Sequences
  Synthetic
agttgttttgtttggtgtgtgtggggtgt

SEQ ID NO: 12310 - DNA, 28 bp, Artificial Sequences
  Synthetic
agttgttttgtttggtgtgtgtggggtg

SEQ ID NO: 12311 - DNA, 27 bp, Artificial Sequences
  Synthetic
gttggagtcggtcggggattgcgtttg

SEQ ID NO: 12312 - DNA, 27 bp, Artificial Sequences
  Synthetic
aggaagttggagtcggtcggggattgc

SEQ ID NO: 12313 - DNA, 27 bp, Artificial Sequences
  Synthetic
agttggagtcggtcggggattgcgttt

SEQ ID NO: 12314 - DNA, 27 bp, Artificial Sequences
  Synthetic
aagttggagtcggtcggggattgcgtt

SEQ ID NO: 12315 - DNA, 27 bp, Artificial Sequences
  Synthetic
gaagttggagtcggtcggggattgcgt

SEQ ID NO: 12316 - DNA, 27 bp, Artificial Sequences
  Synthetic
gttggagtcggtcggggattgcgtttg

SEQ ID NO: 12317 - DNA, 27 bp, Artificial Sequences
  Synthetic
aggaagttggagtcggtcggggattgc

SEQ ID NO: 12318 - DNA, 27 bp, Artificial Sequences
  Synthetic
agttggagtcggtcggggattgcgttt

SEQ ID NO: 12319 - DNA, 27 bp, Artificial Sequences
  Synthetic
aagttggagtcggtcggggattgcgtt

SEQ ID NO: 12320 - DNA, 27 bp, Artificial Sequences
  Synthetic
gaagttggagtcggtcggggattgcgt

SEQ ID NO: 12321 - DNA, 27 bp, Artificial Sequences
  Synthetic
gttggagtcggtcggggattgcgtttg

SEQ ID NO: 12322 - DNA, 27 bp, Artificial Sequences
  Synthetic
gttttggtagtttgcggagggggagcg

SEQ ID NO: 12323 - DNA, 27 bp, Artificial Sequences
  Synthetic
cgttttggtagtttgcggagggggagc

SEQ ID NO: 12324 - DNA, 27 bp, Artificial Sequences
  Synthetic
agttggagtcggtcggggattgcgttt

SEQ ID NO: 12325 - DNA, 27 bp, Artificial Sequences
  Synthetic
aagttggagtcggtcggggattgcgtt

SEQ ID NO: 12326 - DNA, 27 bp, Artificial Sequences
  Synthetic
gttttggtagtttgcggagggggagcg

SEQ ID NO: 12327 - DNA, 27 bp, Artificial Sequences
  Synthetic
cgttttggtagtttgcggagggggagc

SEQ ID NO: 12328 - DNA, 27 bp, Artificial Sequences
  Synthetic
ggaaggagatagggcgcggtgagagaa

SEQ ID NO: 12329 - DNA, 27 bp, Artificial Sequences
  Synthetic
ttttggtagtttgcggagggggagcgg

SEQ ID NO: 12330 - DNA, 27 bp, Artificial Sequences
  Synthetic
agtcgttttggtagtttgcggaggggg

SEQ ID NO: 12331 - DNA, 28 bp, Artificial Sequences
  Synthetic
gggtcggtgagagatatagagatgcggg

SEQ ID NO: 12332 - DNA, 29 bp, Artificial Sequences
  Synthetic
agggtcggtgagagatatagagatgcggg

SEQ ID NO: 12333 - DNA, 29 bp, Artificial Sequences
  Synthetic
gggtcggtgagagatatagagatgcggga

SEQ ID NO: 12334 - DNA, 30 bp, Artificial Sequences
  Synthetic
agggtcggtgagagatatagagatgcggga

SEQ ID NO: 12335 - DNA, 28 bp, Artificial Sequences
  Synthetic
agggtcggtgagagatatagagatgcgg

SEQ ID NO: 12336 - DNA, 27 bp, Artificial Sequences
  Synthetic
cggtagaggggtagagagaaaggcgga

SEQ ID NO: 12337 - DNA, 27 bp, Artificial Sequences
  Synthetic
tcggtagaggggtagagagaaaggcgg

SEQ ID NO: 12338 - DNA, 28 bp, Artificial Sequences
  Synthetic
tcggtagaggggtagagagaaaggcgga

SEQ ID NO: 12339 - DNA, 28 bp, Artificial Sequences
  Synthetic
cggtagaggggtagagagaaaggcggaa

SEQ ID NO: 12340 - DNA, 28 bp, Artificial Sequences
  Synthetic
atcggtagaggggtagagagaaaggcgg

SEQ ID NO: 12341 - DNA, 27 bp, Artificial Sequences
  Synthetic
tgtttcgggttttcgggttttagtcgc

SEQ ID NO: 12342 - DNA, 28 bp, Artificial Sequences
  Synthetic
atgtttcgggttttcgggttttagtcgc

SEQ ID NO: 12343 - DNA, 29 bp, Artificial Sequences
  Synthetic
gatgtttcgggttttcgggttttagtcgc

SEQ ID NO: 12344 - DNA, 27 bp, Artificial Sequences
  Synthetic
gatatcggagggtcgcggaggagtcga

SEQ ID NO: 12345 - DNA, 27 bp, Artificial Sequences
  Synthetic
agatatcggagggtcgcggaggagtcg

SEQ ID NO: 12346 - DNA, 27 bp, Artificial Sequences
  Synthetic
cgtagagagaggaaagacggtcgcggt

SEQ ID NO: 12347 - DNA, 27 bp, Artificial Sequences
  Synthetic
gagatatcggagggtcgcggaggagtc

SEQ ID NO: 12348 - DNA, 26 bp, Artificial Sequences
  Synthetic
atatcggagggtcgcggaggagtcga

SEQ ID NO: 12349 - DNA, 27 bp, Artificial Sequences
  Synthetic
cgtagagagaggaaagacggtcgcggt

SEQ ID NO: 12350 - DNA, 27 bp, Artificial Sequences
  Synthetic
gcggtagcgagggagttaggagtgagt

SEQ ID NO: 12351 - DNA, 28 bp, Artificial Sequences
  Synthetic
cgtagagagaggaaagacggtcgcggtt

SEQ ID NO: 12352 - DNA, 28 bp, Artificial Sequences
  Synthetic
gcggtagcgagggagttaggagtgagtt

SEQ ID NO: 12353 - DNA, 27 bp, Artificial Sequences
  Synthetic
gtagagagaggaaagacggtcgcggtt

SEQ ID NO: 12354 - DNA, 29 bp, Artificial Sequences
  Synthetic
tcgcgttttgttttgttcgttggtttgtt

SEQ ID NO: 12355 - DNA, 29 bp, Artificial Sequences
  Synthetic
ttcgcgttttgttttgttcgttggtttgt

SEQ ID NO: 12356 - DNA, 32 bp, Artificial Sequences
  Synthetic
tgttttgttcgttggtttgtttttgttcggtt

SEQ ID NO: 12357 - DNA, 32 bp, Artificial Sequences
  Synthetic
ttgttttgttcgttggtttgtttttgttcggt

SEQ ID NO: 12358 - DNA, 33 bp, Artificial Sequences
  Synthetic
ttgttttgttcgttggtttgtttttgttcggtt

SEQ ID NO: 12359 - DNA, 27 bp, Artificial Sequences
  Synthetic
gcggaggttgataggttcggggagagg

SEQ ID NO: 12360 - DNA, 27 bp, Artificial Sequences
  Synthetic
ggttcggggagaggaatcgggtaggga

SEQ ID NO: 12361 - DNA, 27 bp, Artificial Sequences
  Synthetic
aggttcggggagaggaatcgggtaggg

SEQ ID NO: 12362 - DNA, 28 bp, Artificial Sequences
  Synthetic
taggttcggggagaggaatcgggtaggg

SEQ ID NO: 12363 - DNA, 27 bp, Artificial Sequences
  Synthetic
gttcggggagaggaatcgggtagggat

SEQ ID NO: 12364 - DNA, 27 bp, Artificial Sequences
  Synthetic
gggcgtagggatcgagtttagggcgtt

SEQ ID NO: 12365 - DNA, 27 bp, Artificial Sequences
  Synthetic
agggcgtagggatcgagtttagggcgt

SEQ ID NO: 12366 - DNA, 27 bp, Artificial Sequences
  Synthetic
tagggcgtagggatcgagtttagggcg

SEQ ID NO: 12367 - DNA, 26 bp, Artificial Sequences
  Synthetic
gggcgtagggatcgagtttagggcgt

SEQ ID NO: 12368 - DNA, 27 bp, Artificial Sequences
  Synthetic
agggcgttaaggtcgtttcgttcggtt

SEQ ID NO: 12369 - DNA, 27 bp, Artificial Sequences
  Synthetic
cggtgcgtagggttggggagtataggt

SEQ ID NO: 12370 - DNA, 28 bp, Artificial Sequences
  Synthetic
cggtgcgtagggttggggagtataggtt

SEQ ID NO: 12371 - DNA, 27 bp, Artificial Sequences
  Synthetic
ggtgcgtagggttggggagtataggtt

SEQ ID NO: 12372 - DNA, 29 bp, Artificial Sequences
  Synthetic
cggtgcgtagggttggggagtataggttt

SEQ ID NO: 12373 - DNA, 26 bp, Artificial Sequences
  Synthetic
cggtgcgtagggttggggagtatagg

SEQ ID NO: 12374 - DNA, 27 bp, Artificial Sequences
  Synthetic
tgcgggttttggggcgaggtttagttg

SEQ ID NO: 12375 - DNA, 27 bp, Artificial Sequences
  Synthetic
gcgggttttggggcgaggtttagttgg

SEQ ID NO: 12376 - DNA, 27 bp, Artificial Sequences
  Synthetic
ggcgaggcgttgtttggggatagatcg

SEQ ID NO: 12377 - DNA, 27 bp, Artificial Sequences
  Synthetic
tggggcgaggtttagttggtttggggg

SEQ ID NO: 12378 - DNA, 27 bp, Artificial Sequences
  Synthetic
ggggcgaggtttagttggtttgggggt

SEQ ID NO: 12379 - DNA, 27 bp, Artificial Sequences
  Synthetic
tgtttggggtgggtgttggagggtagg

SEQ ID NO: 12380 - DNA, 27 bp, Artificial Sequences
  Synthetic
ggtgtttggggtgggtgttggagggta

SEQ ID NO: 12381 - DNA, 27 bp, Artificial Sequences
  Synthetic
ttggggtgggtgttggagggtaggaga

SEQ ID NO: 12382 - DNA, 27 bp, Artificial Sequences
  Synthetic
gtttggggtgggtgttggagggtagga

SEQ ID NO: 12383 - DNA, 27 bp, Artificial Sequences
  Synthetic
tacggtgtttggggtgggtgttggagg

SEQ ID NO: 12384 - DNA, 27 bp, Artificial Sequences
  Synthetic
ggcgaggcgttgtttggggatagatcg

SEQ ID NO: 12385 - DNA, 28 bp, Artificial Sequences
  Synthetic
aggcgaggcgttgtttggggatagatcg

SEQ ID NO: 12386 - DNA, 27 bp, Artificial Sequences
  Synthetic
aggcgaggcgttgtttggggatagatc

SEQ ID NO: 12387 - DNA, 26 bp, Artificial Sequences
  Synthetic
aggcgaggcgttgtttggggatagat

SEQ ID NO: 12388 - DNA, 26 bp, Artificial Sequences
  Synthetic
gcgaggcgttgtttggggatagatcg

SEQ ID NO: 12389 - DNA, 27 bp, Artificial Sequences
  Synthetic
tgtttggggtgggtgttggagggtagg

SEQ ID NO: 12390 - DNA, 27 bp, Artificial Sequences
  Synthetic
ggtgtttggggtgggtgttggagggta

SEQ ID NO: 12391 - DNA, 27 bp, Artificial Sequences
  Synthetic
ttggggtgggtgttggagggtaggaga

SEQ ID NO: 12392 - DNA, 27 bp, Artificial Sequences
  Synthetic
gtttggggtgggtgttggagggtagga

SEQ ID NO: 12393 - DNA, 27 bp, Artificial Sequences
  Synthetic
tacggtgtttggggtgggtgttggagg

SEQ ID NO: 12394 - DNA, 27 bp, Artificial Sequences
  Synthetic
tcggtcgttcgtatttgggcgcgtaga

SEQ ID NO: 12395 - DNA, 27 bp, Artificial Sequences
  Synthetic
gtcggtcgttcgtatttgggcgcgtag

SEQ ID NO: 12396 - DNA, 27 bp, Artificial Sequences
  Synthetic
cggtcgttcgtatttgggcgcgtagag

SEQ ID NO: 12397 - DNA, 27 bp, Artificial Sequences
  Synthetic
gtcgttcgtattgttcgggtcggcgtt

SEQ ID NO: 12398 - DNA, 27 bp, Artificial Sequences
  Synthetic
ggtcgttcgtatttgggcgcgtagagg

SEQ ID NO: 12399 - DNA, 27 bp, Artificial Sequences
  Synthetic
gtgataatggcggggtgacgggggtta

SEQ ID NO: 12400 - DNA, 27 bp, Artificial Sequences
  Synthetic
tgataatggcggggtgacgggggttaa

SEQ ID NO: 12401 - DNA, 27 bp, Artificial Sequences
  Synthetic
aatggcggggtgacgggggttaattcg

SEQ ID NO: 12402 - DNA, 27 bp, Artificial Sequences
  Synthetic
tgagggcggttattgtgcgttgtgtga

SEQ ID NO: 12403 - DNA, 27 bp, Artificial Sequences
  Synthetic
gcgtttttgagggcggttattgtgcgt

SEQ ID NO: 12404 - DNA, 27 bp, Artificial Sequences
  Synthetic
gatcgagtggaggtagttgggggaggc

SEQ ID NO: 12405 - DNA, 27 bp, Artificial Sequences
  Synthetic
cgatcgagtggaggtagttgggggagg

SEQ ID NO: 12406 - DNA, 27 bp, Artificial Sequences
  Synthetic
agtggaggtagttgggggaggcgagtc

SEQ ID NO: 12407 - DNA, 27 bp, Artificial Sequences
  Synthetic
gagtggaggtagttgggggaggcgagt

SEQ ID NO: 12408 - DNA, 27 bp, Artificial Sequences
  Synthetic
atcgagtggaggtagttgggggaggcg

SEQ ID NO: 12409 - DNA, 27 bp, Artificial Sequences
  Synthetic
ttatcggtcggggaggcggtcgggtta

SEQ ID NO: 12410 - DNA, 27 bp, Artificial Sequences
  Synthetic
tatcggtcggggaggcggtcgggttac

SEQ ID NO: 12411 - DNA, 26 bp, Artificial Sequences
  Synthetic
tatcggtcggggaggcggtcgggtta

SEQ ID NO: 12412 - DNA, 27 bp, Artificial Sequences
  Synthetic
gttatcggtcggggaggcggtcgggtt

SEQ ID NO: 12413 - DNA, 28 bp, Artificial Sequences
  Synthetic
ttatcggtcggggaggcggtcgggttac

SEQ ID NO: 12414 - DNA, 27 bp, Artificial Sequences
  Synthetic
gatcgagtggaggtagttgggggaggc

SEQ ID NO: 12415 - DNA, 27 bp, Artificial Sequences
  Synthetic
cgatcgagtggaggtagttgggggagg

SEQ ID NO: 12416 - DNA, 27 bp, Artificial Sequences
  Synthetic
agtggaggtagttgggggaggcgagtc

SEQ ID NO: 12417 - DNA, 27 bp, Artificial Sequences
  Synthetic
gagtggaggtagttgggggaggcgagt

SEQ ID NO: 12418 - DNA, 27 bp, Artificial Sequences
  Synthetic
atcgagtggaggtagttgggggaggcg

SEQ ID NO: 12419 - DNA, 27 bp, Artificial Sequences
  Synthetic
ttatcggtcggggaggcggtcgggtta

SEQ ID NO: 12420 - DNA, 27 bp, Artificial Sequences
  Synthetic
tatcggtcggggaggcggtcgggttac

SEQ ID NO: 12421 - DNA, 26 bp, Artificial Sequences
  Synthetic
tatcggtcggggaggcggtcgggtta

SEQ ID NO: 12422 - DNA, 27 bp, Artificial Sequences
  Synthetic
gttatcggtcggggaggcggtcgggtt

SEQ ID NO: 12423 - DNA, 28 bp, Artificial Sequences
  Synthetic
ttatcggtcggggaggcggtcgggttac

SEQ ID NO: 12424 - DNA, 27 bp, Artificial Sequences
  Synthetic
gatcgagtggaggtagttgggggaggc

SEQ ID NO: 12425 - DNA, 27 bp, Artificial Sequences
  Synthetic
cgatcgagtggaggtagttgggggagg

SEQ ID NO: 12426 - DNA, 27 bp, Artificial Sequences
  Synthetic
agtggaggtagttgggggaggcgagtc

SEQ ID NO: 12427 - DNA, 27 bp, Artificial Sequences
  Synthetic
gagtggaggtagttgggggaggcgagt

SEQ ID NO: 12428 - DNA, 27 bp, Artificial Sequences
  Synthetic
atcgagtggaggtagttgggggaggcg

SEQ ID NO: 12429 - DNA, 27 bp, Artificial Sequences
  Synthetic
cggttagcggggtttcgttgcgttttt

SEQ ID NO: 12430 - DNA, 28 bp, Artificial Sequences
  Synthetic
cggttagcggggtttcgttgcgtttttt

SEQ ID NO: 12431 - DNA, 26 bp, Artificial Sequences
  Synthetic
cggttagcggggtttcgttgcgtttt

SEQ ID NO: 12432 - DNA, 27 bp, Artificial Sequences
  Synthetic
ttatcggtcggggaggcggtcgggtta

SEQ ID NO: 12433 - DNA, 27 bp, Artificial Sequences
  Synthetic
ggttagcggggtttcgttgcgtttttt

SEQ ID NO: 12434 - DNA, 27 bp, Artificial Sequences
  Synthetic
gggtcgcgcgtttttaattttcggtcg

SEQ ID NO: 12435 - DNA, 28 bp, Artificial Sequences
  Synthetic
gggtcgcgcgtttttaattttcggtcgt

SEQ ID NO: 12436 - DNA, 27 bp, Artificial Sequences
  Synthetic
ggtcgcgcgtttttaattttcggtcgt

SEQ ID NO: 12437 - DNA, 29 bp, Artificial Sequences
  Synthetic
gggtcgcgcgtttttaattttcggtcgtc

SEQ ID NO: 12438 - DNA, 28 bp, Artificial Sequences
  Synthetic
ggtcgcgcgtttttaattttcggtcgtc

SEQ ID NO: 12439 - DNA, 27 bp, Artificial Sequences
  Synthetic
cggttagcggggtttcgttgcgttttt

SEQ ID NO: 12440 - DNA, 28 bp, Artificial Sequences
  Synthetic
cggttagcggggtttcgttgcgtttttt

SEQ ID NO: 12441 - DNA, 26 bp, Artificial Sequences
  Synthetic
cggttagcggggtttcgttgcgtttt

SEQ ID NO: 12442 - DNA, 27 bp, Artificial Sequences
  Synthetic
ggttagcggggtttcgttgcgtttttt

SEQ ID NO: 12443 - DNA, 25 bp, Artificial Sequences
  Synthetic
gtcggtcggggattgtggcggttag

SEQ ID NO: 12444 - DNA, 27 bp, Artificial Sequences
  Synthetic
gttttcggtcggcggggttatcggttc

SEQ ID NO: 12445 - DNA, 27 bp, Artificial Sequences
  Synthetic
tcggcggggttatcggttcggtttagt

SEQ ID NO: 12446 - DNA, 27 bp, Artificial Sequences
  Synthetic
tagttttcggtcggcggggttatcggt

SEQ ID NO: 12447 - DNA, 27 bp, Artificial Sequences
  Synthetic
agttttcggtcggcggggttatcggtt

SEQ ID NO: 12448 - DNA, 27 bp, Artificial Sequences
  Synthetic
ggtcggcggggttatcggttcggttta

SEQ ID NO: 12449 - DNA, 27 bp, Artificial Sequences
  Synthetic
agttggggagaggggttcggagttgtt

SEQ ID NO: 12450 - DNA, 27 bp, Artificial Sequences
  Synthetic
tagttggggagaggggttcggagttgt

SEQ ID NO: 12451 - DNA, 27 bp, Artificial Sequences
  Synthetic
gttggggagaggggttcggagttgttt

SEQ ID NO: 12452 - DNA, 28 bp, Artificial Sequences
  Synthetic
agttggggagaggggttcggagttgttt

SEQ ID NO: 12453 - DNA, 26 bp, Artificial Sequences
  Synthetic
agttggggagaggggttcggagttgt

SEQ ID NO: 12454 - DNA, 28 bp, Artificial Sequences
  Synthetic
gcgtttagtgcgttttgggttttgggcg

SEQ ID NO: 12455 - DNA, 27 bp, Artificial Sequences
  Synthetic
gcgtttagtgcgttttgggttttgggc

SEQ ID NO: 12456 - DNA, 27 bp, Artificial Sequences
  Synthetic
agtgcgttttgggttttgggcgtagag

SEQ ID NO: 12457 - DNA, 28 bp, Artificial Sequences
  Synthetic
cgtttagtgcgttttgggttttgggcgt

SEQ ID NO: 12458 - DNA, 27 bp, Artificial Sequences
  Synthetic
cgtttagtgcgttttgggttttgggcg

SEQ ID NO: 12459 - DNA, 27 bp, Artificial Sequences
  Synthetic
tggcgcgttattatcggtcgttgggag

SEQ ID NO: 12460 - DNA, 28 bp, Artificial Sequences
  Synthetic
ggttggcgcgttattatcggtcgttggg

SEQ ID NO: 12461 - DNA, 27 bp, Artificial Sequences
  Synthetic
ttggcgcgttattatcggtcgttggga

SEQ ID NO: 12462 - DNA, 27 bp, Artificial Sequences
  Synthetic
gttggcgcgttattatcggtcgttggg

SEQ ID NO: 12463 - DNA, 27 bp, Artificial Sequences
  Synthetic
ggttggcgcgttattatcggtcgttgg

SEQ ID NO: 12464 - DNA, 27 bp, Artificial Sequences
  Synthetic
tagcggtcggtgatggcgcgttagtta

SEQ ID NO: 12465 - DNA, 27 bp, Artificial Sequences
  Synthetic
gtttttagcggtcggtgatggcgcgtt

SEQ ID NO: 12466 - DNA, 27 bp, Artificial Sequences
  Synthetic
ttttagcggtcggtgatggcgcgttag

SEQ ID NO: 12467 - DNA, 27 bp, Artificial Sequences
  Synthetic
ttagcggtcggtgatggcgcgttagtt

SEQ ID NO: 12468 - DNA, 27 bp, Artificial Sequences
  Synthetic
tttagcggtcggtgatggcgcgttagt

SEQ ID NO: 12469 - DNA, 27 bp, Artificial Sequences
  Synthetic
tgttttgcggtcggggtttggttggtt

SEQ ID NO: 12470 - DNA, 27 bp, Artificial Sequences
  Synthetic
ttgttttgcggtcggggtttggttggt

SEQ ID NO: 12471 - DNA, 27 bp, Artificial Sequences
  Synthetic
ttttgcggtcggggtttggttggttgg

SEQ ID NO: 12472 - DNA, 27 bp, Artificial Sequences
  Synthetic
cggggtttggttggttggcgcgttatt

SEQ ID NO: 12473 - DNA, 27 bp, Artificial Sequences
  Synthetic
gttttgcggtcggggtttggttggttg

SEQ ID NO: 12474 - DNA, 27 bp, Artificial Sequences
  Synthetic
tagcggtcggtgatggcgcgttagtta

SEQ ID NO: 12475 - DNA, 27 bp, Artificial Sequences
  Synthetic
gtttttagcggtcggtgatggcgcgtt

SEQ ID NO: 12476 - DNA, 27 bp, Artificial Sequences
  Synthetic
ttttagcggtcggtgatggcgcgttag

SEQ ID NO: 12477 - DNA, 27 bp, Artificial Sequences
  Synthetic
ttagcggtcggtgatggcgcgttagtt

SEQ ID NO: 12478 - DNA, 27 bp, Artificial Sequences
  Synthetic
tttagcggtcggtgatggcgcgttagt

SEQ ID NO: 12479 - DNA, 29 bp, Artificial Sequences
  Synthetic
aagggttaggttagcggtcgatttaggtc

SEQ ID NO: 12480 - DNA, 32 bp, Artificial Sequences
  Synthetic
aataagggttaggttagcggtcgatttaggtc

SEQ ID NO: 12481 - DNA, 35 bp, Artificial Sequences
  Synthetic
tttaataagggttaggttagcggtcgatttaggtc

SEQ ID NO: 12482 - DNA, 36 bp, Artificial Sequences
  Synthetic
ttttaataagggttaggttagcggtcgatttaggtc

SEQ ID NO: 12483 - DNA, 27 bp, Artificial Sequences
  Synthetic
gtaggaggaggtaggaggaggcgggag

SEQ ID NO: 12484 - DNA, 27 bp, Artificial Sequences
  Synthetic
gaggtaggaggaggtaggaggaggcgg

SEQ ID NO: 12485 - DNA, 27 bp, Artificial Sequences
  Synthetic
ggaggtaggaggaggtaggaggaggcg

SEQ ID NO: 12486 - DNA, 27 bp, Artificial Sequences
  Synthetic
gcggaggaggtaggaggaggtaggagg

SEQ ID NO: 12487 - DNA, 27 bp, Artificial Sequences
  Synthetic
cgcggaggaggtaggaggaggtaggag

SEQ ID NO: 12488 - DNA, 34 bp, Artificial Sequences
  Synthetic
tcggtcgtttggggttagttaataatggtttaga

SEQ ID NO: 12489 - DNA, 35 bp, Artificial Sequences
  Synthetic
ttcggtcgtttggggttagttaataatggtttaga

SEQ ID NO: 12490 - DNA, 35 bp, Artificial Sequences
  Synthetic
tcggtcgtttggggttagttaataatggtttagat

SEQ ID NO: 12491 - DNA, 36 bp, Artificial Sequences
  Synthetic
ttcggtcgtttggggttagttaataatggtttagat

SEQ ID NO: 12492 - DNA, 36 bp, Artificial Sequences
  Synthetic
attcggtcgtttggggttagttaataatggtttaga

SEQ ID NO: 12493 - DNA, 28 bp, Artificial Sequences
  Synthetic
tggttgtgggtggatggatgaagaaggt

SEQ ID NO: 12494 - DNA, 27 bp, Artificial Sequences
  Synthetic
ggttgtgggtggatggatgaagaaggt

SEQ ID NO: 12495 - DNA, 27 bp, Artificial Sequences
  Synthetic
tggttgtgggtggatggatgaagaagg

SEQ ID NO: 12496 - DNA, 29 bp, Artificial Sequences
  Synthetic
tggttgtgggtggatggatgaagaaggtt

SEQ ID NO: 12497 - DNA, 29 bp, Artificial Sequences
  Synthetic
ttggttgtgggtggatggatgaagaaggt

SEQ ID NO: 12498 - DNA, 27 bp, Artificial Sequences
  Synthetic
ttgatggagtagttcgcgtcgtggtgc

SEQ ID NO: 12499 - DNA, 28 bp, Artificial Sequences
  Synthetic
tttgatggagtagttcgcgtcgtggtgc

SEQ ID NO: 12500 - DNA, 26 bp, Artificial Sequences
  Synthetic
tgatggagtagttcgcgtcgtggtgc

SEQ ID NO: 12501 - DNA, 28 bp, Artificial Sequences
  Synthetic
ggaaacgcggttggaggttagtggatgt

SEQ ID NO: 12502 - DNA, 27 bp, Artificial Sequences
  Synthetic
ggaaacgcggttggaggttagtggatg

SEQ ID NO: 12503 - DNA, 28 bp, Artificial Sequences
  Synthetic
tggttgtgggtggatggatgaagaaggt

SEQ ID NO: 12504 - DNA, 27 bp, Artificial Sequences
  Synthetic
ggttgtgggtggatggatgaagaaggt

SEQ ID NO: 12505 - DNA, 27 bp, Artificial Sequences
  Synthetic
tggttgtgggtggatggatgaagaagg

SEQ ID NO: 12506 - DNA, 29 bp, Artificial Sequences
  Synthetic
tggttgtgggtggatggatgaagaaggtt

SEQ ID NO: 12507 - DNA, 29 bp, Artificial Sequences
  Synthetic
ttggttgtgggtggatggatgaagaaggt

SEQ ID NO: 12508 - DNA, 27 bp, Artificial Sequences
  Synthetic
cgggtttattttgggggcgtttagtgt

SEQ ID NO: 12509 - DNA, 28 bp, Artificial Sequences
  Synthetic
tcgggtttattttgggggcgtttagtgt

SEQ ID NO: 12510 - DNA, 27 bp, Artificial Sequences
  Synthetic
tcgggtttattttgggggcgtttagtg

SEQ ID NO: 12511 - DNA, 28 bp, Artificial Sequences
  Synthetic
cgggtttattttgggggcgtttagtgtt

SEQ ID NO: 12512 - DNA, 29 bp, Artificial Sequences
  Synthetic
tcgggtttattttgggggcgtttagtgtt

SEQ ID NO: 12513 - DNA, 29 bp, Artificial Sequences
  Synthetic
tttatttggagtttaagttttggcgcgcg

SEQ ID NO: 12514 - DNA, 30 bp, Artificial Sequences
  Synthetic
ttttatttggagtttaagttttggcgcgcg

SEQ ID NO: 12515 - DNA, 30 bp, Artificial Sequences
  Synthetic
cggttgtagtattgggcgtttttagagtgg

SEQ ID NO: 12516 - DNA, 31 bp, Artificial Sequences
  Synthetic
cggttgtagtattgggcgtttttagagtgga

SEQ ID NO: 12517 - DNA, 31 bp, Artificial Sequences
  Synthetic
tcggttgtagtattgggcgtttttagagtgg

SEQ ID NO: 12518 - DNA, 27 bp, Artificial Sequences
  Synthetic
gcggtcgttggtaggtagtcggatcgg

SEQ ID NO: 12519 - DNA, 27 bp, Artificial Sequences
  Synthetic
cggtcgttggtaggtagtcggatcggg

SEQ ID NO: 12520 - DNA, 27 bp, Artificial Sequences
  Synthetic
agcggtcgttggtaggtagtcggatcg

SEQ ID NO: 12521 - DNA, 27 bp, Artificial Sequences
  Synthetic
ttgagcggtcgttggtaggtagtcgga

SEQ ID NO: 12522 - DNA, 27 bp, Artificial Sequences
  Synthetic
ggtcgttggtaggtagtcggatcggga

SEQ ID NO: 12523 - DNA, 27 bp, Artificial Sequences
  Synthetic
gcggcgagttagggtatttcggatcgg

SEQ ID NO: 12524 - DNA, 28 bp, Artificial Sequences
  Synthetic
agcggcgagttagggtatttcggatcgg

SEQ ID NO: 12525 - DNA, 28 bp, Artificial Sequences
  Synthetic
gcggcgagttagggtatttcggatcggt

SEQ ID NO: 12526 - DNA, 27 bp, Artificial Sequences
  Synthetic
agcggcgagttagggtatttcggatcg

SEQ ID NO: 12527 - DNA, 27 bp, Artificial Sequences
  Synthetic
taagttatcggcgcggtttaggagggg

SEQ ID NO: 12528 - DNA, 27 bp, Artificial Sequences
  Synthetic
aggcggaatgtaggtcggtgtgtgagg

SEQ ID NO: 12529 - DNA, 27 bp, Artificial Sequences
  Synthetic
ggaggcggaatgtaggtcggtgtgtga

SEQ ID NO: 12530 - DNA, 27 bp, Artificial Sequences
  Synthetic
ggcggaatgtaggtcggtgtgtgaggt

SEQ ID NO: 12531 - DNA, 27 bp, Artificial Sequences
  Synthetic
gcggtcgttggtaggtagtcggatcgg

SEQ ID NO: 12532 - DNA, 27 bp, Artificial Sequences
  Synthetic
cggtcgttggtaggtagtcggatcggg

SEQ ID NO: 12533 - DNA, 27 bp, Artificial Sequences
  Synthetic
gcggcgagttagggtatttcggatcgg

SEQ ID NO: 12534 - DNA, 28 bp, Artificial Sequences
  Synthetic
agcggcgagttagggtatttcggatcgg

SEQ ID NO: 12535 - DNA, 28 bp, Artificial Sequences
  Synthetic
gcggcgagttagggtatttcggatcggt

SEQ ID NO: 12536 - DNA, 27 bp, Artificial Sequences
  Synthetic
agcggcgagttagggtatttcggatcg

SEQ ID NO: 12537 - DNA, 27 bp, Artificial Sequences
  Synthetic
taagttatcggcgcggtttaggagggg

SEQ ID NO: 12538 - DNA, 27 bp, Artificial Sequences
  Synthetic
aggcggaatgtaggtcggtgtgtgagg

SEQ ID NO: 12539 - DNA, 27 bp, Artificial Sequences
  Synthetic
ggaggcggaatgtaggtcggtgtgtga

SEQ ID NO: 12540 - DNA, 27 bp, Artificial Sequences
  Synthetic
ggcggaatgtaggtcggtgtgtgaggt

SEQ ID NO: 12541 - DNA, 27 bp, Artificial Sequences
  Synthetic
gatgggggttggggaggcggaatgtag

SEQ ID NO: 12542 - DNA, 27 bp, Artificial Sequences
  Synthetic
ttcgtggtaaggatgggggttggggag

SEQ ID NO: 12543 - DNA, 27 bp, Artificial Sequences
  Synthetic
ataagagggttggtcggggagggggat

SEQ ID NO: 12544 - DNA, 27 bp, Artificial Sequences
  Synthetic
tcgcgggagagggaaatttcggcgtta

SEQ ID NO: 12545 - DNA, 27 bp, Artificial Sequences
  Synthetic
cggattgcgttcggttttggcgtttgg

SEQ ID NO: 12546 - DNA, 27 bp, Artificial Sequences
  Synthetic
ggttggtcggggagggggatgttgaaa

SEQ ID NO: 12547 - DNA, 27 bp, Artificial Sequences
  Synthetic
ggacgcgggggaggatttgaggttagt

SEQ ID NO: 12548 - DNA, 27 bp, Artificial Sequences
  Synthetic
ttcggggattgtaggtggagacgtcgt

SEQ ID NO: 12549 - DNA, 28 bp, Artificial Sequences
  Synthetic
gttcggggattgtaggtggagacgtcgt

SEQ ID NO: 12550 - DNA, 27 bp, Artificial Sequences
  Synthetic
gttcggggattgtaggtggagacgtcg

SEQ ID NO: 12551 - DNA, 27 bp, Artificial Sequences
  Synthetic
gagggaaatcgcgggggagaggaaatt

SEQ ID NO: 12552 - DNA, 28 bp, Artificial Sequences
  Synthetic
cggggattgtaggtggagacgtcgtagg

SEQ ID NO: 12553 - DNA, 27 bp, Artificial Sequences
  Synthetic
gggttgggtagggttcggcggtttttg

SEQ ID NO: 12554 - DNA, 27 bp, Artificial Sequences
  Synthetic
agggttgggtagggttcggcggttttt

SEQ ID NO: 12555 - DNA, 27 bp, Artificial Sequences
  Synthetic
aggggtaggagggttgggtagggttcg

SEQ ID NO: 12556 - DNA, 27 bp, Artificial Sequences
  Synthetic
ggttgggtagggttcggcggtttttgt

SEQ ID NO: 12557 - DNA, 27 bp, Artificial Sequences
  Synthetic
gagggttgggtagggttcggcggtttt

SEQ ID NO: 12558 - DNA, 27 bp, Artificial Sequences
  Synthetic
tgcggggtttttgtttttgggtgagga

SEQ ID NO: 12559 - DNA, 28 bp, Artificial Sequences
  Synthetic
tgcggggtttttgtttttgggtgaggag

SEQ ID NO: 12560 - DNA, 27 bp, Artificial Sequences
  Synthetic
gcggggtttttgtttttgggtgaggag

SEQ ID NO: 12561 - DNA, 27 bp, Artificial Sequences
  Synthetic
ttgcggggtttttgtttttgggtgagg

SEQ ID NO: 12562 - DNA, 29 bp, Artificial Sequences
  Synthetic
tgcggggtttttgtttttgggtgaggaga

SEQ ID NO: 12563 - DNA, 29 bp, Artificial Sequences
  Synthetic
acgtcgtttgggtagcgtttggtaataga

SEQ ID NO: 12564 - DNA, 30 bp, Artificial Sequences
  Synthetic
acgtcgtttgggtagcgtttggtaatagat

SEQ ID NO: 12565 - DNA, 30 bp, Artificial Sequences
  Synthetic
cgtcgtttgggtagcgtttggtaatagatg

SEQ ID NO: 12566 - DNA, 31 bp, Artificial Sequences
  Synthetic
acgtcgtttgggtagcgtttggtaatagatg

SEQ ID NO: 12567 - DNA, 31 bp, Artificial Sequences
  Synthetic
cgtcgtttgggtagcgtttggtaatagatga

SEQ ID NO: 12568 - DNA, 27 bp, Artificial Sequences
  Synthetic
tagggttaggggtttaggggagggcgg

SEQ ID NO: 12569 - DNA, 27 bp, Artificial Sequences
  Synthetic
gggtggttggagaggtgggtagggagg

SEQ ID NO: 12570 - DNA, 27 bp, Artificial Sequences
  Synthetic
ggggtggttggagaggtgggtagggag

SEQ ID NO: 12571 - DNA, 26 bp, Artificial Sequences
  Synthetic
gtggttggagaggtgggtagggaggc

SEQ ID NO: 12572 - DNA, 27 bp, Artificial Sequences
  Synthetic
atagggttaggggtttaggggagggcg

SEQ ID NO: 12573 - DNA, 27 bp, Artificial Sequences
  Synthetic
gggggagggaggttcggggttttttgt

SEQ ID NO: 12574 - DNA, 27 bp, Artificial Sequences
  Synthetic
tttagtacgggggagggaggttcgggg

SEQ ID NO: 12575 - DNA, 27 bp, Artificial Sequences
  Synthetic
ttttagtacgggggagggaggttcggg

SEQ ID NO: 12576 - DNA, 27 bp, Artificial Sequences
  Synthetic
tacgggggagggaggttcggggttttt

SEQ ID NO: 12577 - DNA, 27 bp, Artificial Sequences
  Synthetic
cgggggagggaggttcggggttttttg

SEQ ID NO: 12578 - DNA, 27 bp, Artificial Sequences
  Synthetic
gggagggtttgtagggggtttcgggtt

SEQ ID NO: 12579 - DNA, 27 bp, Artificial Sequences
  Synthetic
tggtttgttggggtcgttgtgggggta

SEQ ID NO: 12580 - DNA, 27 bp, Artificial Sequences
  Synthetic
gttggtttgttggggtcgttgtggggg

SEQ ID NO: 12581 - DNA, 27 bp, Artificial Sequences
  Synthetic
ggttggtttgttggggtcgttgtgggg

SEQ ID NO: 12582 - DNA, 27 bp, Artificial Sequences
  Synthetic
tttagcgtggggagggtttgtaggggg

SEQ ID NO: 12583 - DNA, 27 bp, Artificial Sequences
  Synthetic
ggaggagggagggtgagatagaggcgt

SEQ ID NO: 12584 - DNA, 27 bp, Artificial Sequences
  Synthetic
cgagggaaggaggaggaggaggaggag

SEQ ID NO: 12585 - DNA, 27 bp, Artificial Sequences
  Synthetic
aggaggagggagggtgagatagaggcg

SEQ ID NO: 12586 - DNA, 27 bp, Artificial Sequences
  Synthetic
gaaggaggaggaggaggaggagggagg

SEQ ID NO: 12587 - DNA, 27 bp, Artificial Sequences
  Synthetic
ggaaggaggaggaggaggaggagggag

SEQ ID NO: 12588 - DNA, 27 bp, Artificial Sequences
  Synthetic
tttagttgtgagtggggaggaggcggg

SEQ ID NO: 12589 - DNA, 27 bp, Artificial Sequences
  Synthetic
ttggtagtgtcggttgggttggtgggg

SEQ ID NO: 12590 - DNA, 27 bp, Artificial Sequences
  Synthetic
ggtagtgtcggttgggttggtggggag

SEQ ID NO: 12591 - DNA, 27 bp, Artificial Sequences
  Synthetic
agggttggtagtgtcggttgggttggt

SEQ ID NO: 12592 - DNA, 27 bp, Artificial Sequences
  Synthetic
aggcggggaggtttcggggtagtttag

SEQ ID NO: 12593 - DNA, 26 bp, Artificial Sequences
  Synthetic
cggtttcgggatttggggtttaggcg

SEQ ID NO: 12594 - DNA, 25 bp, Artificial Sequences
  Synthetic
ggtttcgggatttggggtttaggcg

SEQ ID NO: 12595 - DNA, 25 bp, Artificial Sequences
  Synthetic
cggtttcgggatttggggtttaggc

SEQ ID NO: 12596 - DNA, 30 bp, Artificial Sequences
  Synthetic
ggatagtatagttaggaggagagtggcggt

SEQ ID NO: 12597 - DNA, 31 bp, Artificial Sequences
  Synthetic
aggatagtatagttaggaggagagtggcggt

SEQ ID NO: 12598 - DNA, 36 bp, Artificial Sequences
  Synthetic
gggtttttggttttcgtgggtttttattattttggt

SEQ ID NO: 12599 - DNA, 36 bp, Artificial Sequences
  Synthetic
tgggtttttggttttcgtgggtttttattattttgg

SEQ ID NO: 12600 - DNA, 36 bp, Artificial Sequences
  Synthetic
ttttaaggtttcgtttgagttttaggtttcggagtt

SEQ ID NO: 12601 - DNA, 36 bp, Artificial Sequences
  Synthetic
tttttaaggtttcgtttgagttttaggtttcggagt

SEQ ID NO: 12602 - DNA, 27 bp, Artificial Sequences
  Synthetic
tggggtttaggcgaggttttgaggagt

SEQ ID NO: 12603 - DNA, 28 bp, Artificial Sequences
  Synthetic
tggggtttaggcgaggttttgaggagtt

SEQ ID NO: 12604 - DNA, 28 bp, Artificial Sequences
  Synthetic
ttggggtttaggcgaggttttgaggagt

SEQ ID NO: 12605 - DNA, 27 bp, Artificial Sequences
  Synthetic
ggggtttaggcgaggttttgaggagtt

SEQ ID NO: 12606 - DNA, 27 bp, Artificial Sequences
  Synthetic
ttggggtttaggcgaggttttgaggag

SEQ ID NO: 12607 - DNA, 29 bp, Artificial Sequences
  Synthetic
gcggaaatgcggtttttattttgtcggtt

SEQ ID NO: 12608 - DNA, 30 bp, Artificial Sequences
  Synthetic
gcggaaatgcggtttttattttgtcggttt

SEQ ID NO: 12609 - DNA, 31 bp, Artificial Sequences
  Synthetic
gcggaaatgcggtttttattttgtcggtttt

SEQ ID NO: 12610 - DNA, 32 bp, Artificial Sequences
  Synthetic
gcggaaatgcggtttttattttgtcggttttt

SEQ ID NO: 12611 - DNA, 34 bp, Artificial Sequences
  Synthetic
gcggaaatgcggtttttattttgtcggtttttcg

SEQ ID NO: 12612 - DNA, 27 bp, Artificial Sequences
  Synthetic
cggtttggggatgatttgaggtcgcgt

SEQ ID NO: 12613 - DNA, 27 bp, Artificial Sequences
  Synthetic
tcggtttggggatgatttgaggtcgcg

SEQ ID NO: 12614 - DNA, 28 bp, Artificial Sequences
  Synthetic
tcggtttggggatgatttgaggtcgcgt

SEQ ID NO: 12615 - DNA, 28 bp, Artificial Sequences
  Synthetic
cggtttggggatgatttgaggtcgcgtt

SEQ ID NO: 12616 - DNA, 28 bp, Artificial Sequences
  Synthetic
ttcggtttggggatgatttgaggtcgcg

SEQ ID NO: 12617 - DNA, 27 bp, Artificial Sequences
  Synthetic
gggcgcgttttgtcggttattaggggt

SEQ ID NO: 12618 - DNA, 27 bp, Artificial Sequences
  Synthetic
tgggcgcgttttgtcggttattagggg

SEQ ID NO: 12619 - DNA, 28 bp, Artificial Sequences
  Synthetic
tgggcgcgttttgtcggttattaggggt

SEQ ID NO: 12620 - DNA, 28 bp, Artificial Sequences
  Synthetic
ttgggcgcgttttgtcggttattagggg

SEQ ID NO: 12621 - DNA, 27 bp, Artificial Sequences
  Synthetic
gggttgggcgcgttttgtcggttatta

SEQ ID NO: 12622 - DNA, 27 bp, Artificial Sequences
  Synthetic
tgcgttgtttttggtggtcggtagggc

SEQ ID NO: 12623 - DNA, 27 bp, Artificial Sequences
  Synthetic
gtttttggtggtcggtagggcgcgttt

SEQ ID NO: 12624 - DNA, 27 bp, Artificial Sequences
  Synthetic
gttgtttttggtggtcggtagggcgcg

SEQ ID NO: 12625 - DNA, 27 bp, Artificial Sequences
  Synthetic
cgttgtttttggtggtcggtagggcgc

SEQ ID NO: 12626 - DNA, 27 bp, Artificial Sequences
  Synthetic
gcgttgtttttggtggtcggtagggcg

SEQ ID NO: 12627 - DNA, 27 bp, Artificial Sequences
  Synthetic
gggcgcgttttgtcggttattaggggt

SEQ ID NO: 12628 - DNA, 27 bp, Artificial Sequences
  Synthetic
tgggcgcgttttgtcggttattagggg

SEQ ID NO: 12629 - DNA, 28 bp, Artificial Sequences
  Synthetic
tgggcgcgttttgtcggttattaggggt

SEQ ID NO: 12630 - DNA, 28 bp, Artificial Sequences
  Synthetic
ttgggcgcgttttgtcggttattagggg

SEQ ID NO: 12631 - DNA, 27 bp, Artificial Sequences
  Synthetic
gggttgggcgcgttttgtcggttatta

SEQ ID NO: 12632 - DNA, 27 bp, Artificial Sequences
  Synthetic
ggatggagaaacggtggagagacgggg

SEQ ID NO: 12633 - DNA, 27 bp, Artificial Sequences
  Synthetic
gggatggagaaacggtggagagacggg

SEQ ID NO: 12634 - DNA, 27 bp, Artificial Sequences
  Synthetic
ggggatggagaaacggtggagagacgg

SEQ ID NO: 12635 - DNA, 27 bp, Artificial Sequences
  Synthetic
gggggatggagaaacggtggagagacg

SEQ ID NO: 12636 - DNA, 27 bp, Artificial Sequences
  Synthetic
tttcggggggatggagaaacggtggag

SEQ ID NO: 12637 - DNA, 29 bp, Artificial Sequences
  Synthetic
cggggcgtattagttttttaggcgtcggg

SEQ ID NO: 12638 - DNA, 27 bp, Artificial Sequences
  Synthetic
tcgttaattgcgggggatttcgttcgt

SEQ ID NO: 12639 - DNA, 27 bp, Artificial Sequences
  Synthetic
attaggagatttcggtgcggcgagttc

SEQ ID NO: 12640 - DNA, 28 bp, Artificial Sequences
  Synthetic
cggggcgtattagttttttaggcgtcgg

SEQ ID NO: 12641 - DNA, 28 bp, Artificial Sequences
  Synthetic
ggggcgtattagttttttaggcgtcggg

SEQ ID NO: 12642 - DNA, 27 bp, Artificial Sequences
  Synthetic
tgtagcgggcggtttgtagggtgagtt

SEQ ID NO: 12643 - DNA, 27 bp, Artificial Sequences
  Synthetic
ttgtagcgggcggtttgtagggtgagt

SEQ ID NO: 12644 - DNA, 27 bp, Artificial Sequences
  Synthetic
agcgggcggtttgtagggtgagttacg

SEQ ID NO: 12645 - DNA, 27 bp, Artificial Sequences
  Synthetic
gttgtagcgggcggtttgtagggtgag

SEQ ID NO: 12646 - DNA, 27 bp, Artificial Sequences
  Synthetic
cgttgtagcgggcggtttgtagggtga

SEQ ID NO: 12647 - DNA, 27 bp, Artificial Sequences
  Synthetic
gtagttcgtggttgcgcgggaaagtcg

SEQ ID NO: 12648 - DNA, 27 bp, Artificial Sequences
  Synthetic
gtggcggtagtgtagttcgtggttgcg

SEQ ID NO: 12649 - DNA, 27 bp, Artificial Sequences
  Synthetic
cgtggcggtagtgtagttcgtggttgc

SEQ ID NO: 12650 - DNA, 27 bp, Artificial Sequences
  Synthetic
gcgtggcggtagtgtagttcgtggttg

SEQ ID NO: 12651 - DNA, 27 bp, Artificial Sequences
  Synthetic
gtgtagttcgtggttgcgcgggaaagt

SEQ ID NO: 12652 - DNA, 27 bp, Artificial Sequences
  Synthetic
tgtagcgggcggtttgtagggtgagtt

SEQ ID NO: 12653 - DNA, 27 bp, Artificial Sequences
  Synthetic
ttgtagcgggcggtttgtagggtgagt

SEQ ID NO: 12654 - DNA, 27 bp, Artificial Sequences
  Synthetic
agcgggcggtttgtagggtgagttacg

SEQ ID NO: 12655 - DNA, 27 bp, Artificial Sequences
  Synthetic
gttgtagcgggcggtttgtagggtgag

SEQ ID NO: 12656 - DNA, 27 bp, Artificial Sequences
  Synthetic
tgttcgtgggttatttcggcgcgtagg

SEQ ID NO: 12657 - DNA, 27 bp, Artificial Sequences
  Synthetic
gttggagtttttgtcggcgtggcggta

SEQ ID NO: 12658 - DNA, 27 bp, Artificial Sequences
  Synthetic
gtagttcgtggttgcgcgggaaagtcg

SEQ ID NO: 12659 - DNA, 27 bp, Artificial Sequences
  Synthetic
ggagtttttgtcggcgtggcggtagtg

SEQ ID NO: 12660 - DNA, 27 bp, Artificial Sequences
  Synthetic
ggcgtaggaaggggaggtttcgggaag

SEQ ID NO: 12661 - DNA, 27 bp, Artificial Sequences
  Synthetic
gcgtaggaaggggaggtttcgggaagt

SEQ ID NO: 12662 - DNA, 27 bp, Artificial Sequences
  Synthetic
aggtttcggttcgtagtttcgcgcgtt

SEQ ID NO: 12663 - DNA, 27 bp, Artificial Sequences
  Synthetic
taggtttcggttcgtagtttcgcgcgt

SEQ ID NO: 12664 - DNA, 27 bp, Artificial Sequences
  Synthetic
ggtttcggttcgtagtttcgcgcgttt

SEQ ID NO: 12665 - DNA, 28 bp, Artificial Sequences
  Synthetic
aggtttcggttcgtagtttcgcgcgttt

SEQ ID NO: 12666 - DNA, 26 bp, Artificial Sequences
  Synthetic
aggtttcggttcgtagtttcgcgcgt

SEQ ID NO: 12667 - DNA, 27 bp, Artificial Sequences
  Synthetic
ggcgtaggaaggggaggtttcgggaag

SEQ ID NO: 12668 - DNA, 27 bp, Artificial Sequences
  Synthetic
gcgtaggaaggggaggtttcgggaagt

SEQ ID NO: 12669 - DNA, 27 bp, Artificial Sequences
  Synthetic
ggtggtggcgtaggaaggggaggtttc

SEQ ID NO: 12670 - DNA, 27 bp, Artificial Sequences
  Synthetic
gtggtggcgtaggaaggggaggtttcg

SEQ ID NO: 12671 - DNA, 27 bp, Artificial Sequences
  Synthetic
gcgggtcggggtttggtttcggttttc

SEQ ID NO: 12672 - DNA, 27 bp, Artificial Sequences
  Synthetic
gggtgcgtagggagaatgggttgtggt

SEQ ID NO: 12673 - DNA, 27 bp, Artificial Sequences
  Synthetic
gaggtgtgggggtgcgtagggagaatg

SEQ ID NO: 12674 - DNA, 27 bp, Artificial Sequences
  Synthetic
ttagagaggtttggcgaggtgtggggg

SEQ ID NO: 12675 - DNA, 27 bp, Artificial Sequences
  Synthetic
tgcgtagggagaatgggttgtggtcgt

SEQ ID NO: 12676 - DNA, 27 bp, Artificial Sequences
  Synthetic
ggggtgcgtagggagaatgggttgtgg

SEQ ID NO: 12677 - DNA, 27 bp, Artificial Sequences
  Synthetic
tcgtcggttttttaaggagaacgcggt

SEQ ID NO: 12678 - DNA, 27 bp, Artificial Sequences
  Synthetic
cgtcggttttttaaggagaacgcggtg

SEQ ID NO: 12679 - DNA, 28 bp, Artificial Sequences
  Synthetic
cgtcggttttttaaggagaacgcggtga

SEQ ID NO: 12680 - DNA, 28 bp, Artificial Sequences
  Synthetic
tcgtcggttttttaaggagaacgcggtg

SEQ ID NO: 12681 - DNA, 29 bp, Artificial Sequences
  Synthetic
tcgtcggttttttaaggagaacgcggtga

SEQ ID NO: 12682 - DNA, 27 bp, Artificial Sequences
  Synthetic
tggtgcgtgttggttttgtggagatgg

SEQ ID NO: 12683 - DNA, 28 bp, Artificial Sequences
  Synthetic
tggtgcgtgttggttttgtggagatgga

SEQ ID NO: 12684 - DNA, 27 bp, Artificial Sequences
  Synthetic
ggtgcgtgttggttttgtggagatgga

SEQ ID NO: 12685 - DNA, 28 bp, Artificial Sequences
  Synthetic
atggtgcgtgttggttttgtggagatgg

SEQ ID NO: 12686 - DNA, 29 bp, Artificial Sequences
  Synthetic
tggtgcgtgttggttttgtggagatggat

SEQ ID NO: 12687 - DNA, 27 bp, Artificial Sequences
  Synthetic
tcgtcggttttttaaggagaacgcggt

SEQ ID NO: 12688 - DNA, 27 bp, Artificial Sequences
  Synthetic
cgtcggttttttaaggagaacgcggtg

SEQ ID NO: 12689 - DNA, 28 bp, Artificial Sequences
  Synthetic
cgtcggttttttaaggagaacgcggtga

SEQ ID NO: 12690 - DNA, 28 bp, Artificial Sequences
  Synthetic
tcgtcggttttttaaggagaacgcggtg

SEQ ID NO: 12691 - DNA, 29 bp, Artificial Sequences
  Synthetic
tcgtcggttttttaaggagaacgcggtga

SEQ ID NO: 12692 - DNA, 27 bp, Artificial Sequences
  Synthetic
cgaaggtggtggggattgtcgtgagga

SEQ ID NO: 12693 - DNA, 27 bp, Artificial Sequences
  Synthetic
ttggcgaaggtggtggggattgtcgtg

SEQ ID NO: 12694 - DNA, 27 bp, Artificial Sequences
  Synthetic
gttggcgaaggtggtggggattgtcgt

SEQ ID NO: 12695 - DNA, 27 bp, Artificial Sequences
  Synthetic
gcgaaggtggtggggattgtcgtgagg

SEQ ID NO: 12696 - DNA, 27 bp, Artificial Sequences
  Synthetic
ggcgaaggtggtggggattgtcgtgag

SEQ ID NO: 12697 - DNA, 27 bp, Artificial Sequences
  Synthetic
gcgggtggagcgtagttttttgggaga

SEQ ID NO: 12698 - DNA, 28 bp, Artificial Sequences
  Synthetic
gcgggtggagcgtagttttttgggagag

SEQ ID NO: 12699 - DNA, 28 bp, Artificial Sequences
  Synthetic
cgggtggagcgtagttttttgggagagt

SEQ ID NO: 12700 - DNA, 27 bp, Artificial Sequences
  Synthetic
cgggtggagcgtagttttttgggagag

SEQ ID NO: 12701 - DNA, 29 bp, Artificial Sequences
  Synthetic
gcgggtggagcgtagttttttgggagagt

SEQ ID NO: 12702 - DNA, 27 bp, Artificial Sequences
  Synthetic
gcgcggtagtggtttcgagttttgggt

SEQ ID NO: 12703 - DNA, 27 bp, Artificial Sequences
  Synthetic
cgcgcggtagtggtttcgagttttggg

SEQ ID NO: 12704 - DNA, 27 bp, Artificial Sequences
  Synthetic
gcgcgcggtagtggtttcgagttttgg

SEQ ID NO: 12705 - DNA, 27 bp, Artificial Sequences
  Synthetic
ggcgcgcggtagtggtttcgagttttg

SEQ ID NO: 12706 - DNA, 28 bp, Artificial Sequences
  Synthetic
gcgcggtagtggtttcgagttttgggtt

SEQ ID NO: 12707 - DNA, 28 bp, Artificial Sequences
  Synthetic
cgtggtaggggcgtttaggggtttaggt

SEQ ID NO: 12708 - DNA, 27 bp, Artificial Sequences
  Synthetic
cgtggtaggggcgtttaggggtttagg

SEQ ID NO: 12709 - DNA, 27 bp, Artificial Sequences
  Synthetic
tgaagaggtttagtgttgggacggggg

SEQ ID NO: 12710 - DNA, 27 bp, Artificial Sequences
  Synthetic
gtggtaggggcgtttaggggtttaggt

SEQ ID NO: 12711 - DNA, 28 bp, Artificial Sequences
  Synthetic
tgaagaggtttagtgttgggacggggga

SEQ ID NO: 12712 - DNA, 27 bp, Artificial Sequences
  Synthetic
tgggttagggtgtagggttcgcggttt

SEQ ID NO: 12713 - DNA, 27 bp, Artificial Sequences
  Synthetic
ttgggttagggtgtagggttcgcggtt

SEQ ID NO: 12714 - DNA, 27 bp, Artificial Sequences
  Synthetic
tttgggttagggtgtagggttcgcggt

SEQ ID NO: 12715 - DNA, 27 bp, Artificial Sequences
  Synthetic
tcgggggaagggtagtaattcggcgtt

SEQ ID NO: 12716 - DNA, 27 bp, Artificial Sequences
  Synthetic
ttcgggggaagggtagtaattcggcgt

SEQ ID NO: 12717 - DNA, 27 bp, Artificial Sequences
  Synthetic
gaggaggaggtagtgcgaggcgttgag

SEQ ID NO: 12718 - DNA, 27 bp, Artificial Sequences
  Synthetic
agaggaggaggtagtgcgaggcgttga

SEQ ID NO: 12719 - DNA, 27 bp, Artificial Sequences
  Synthetic
gttgaggggggcgtcgagttgttgttt

SEQ ID NO: 12720 - DNA, 27 bp, Artificial Sequences
  Synthetic
tagaggaggaggtagtgcgaggcgttg

SEQ ID NO: 12721 - DNA, 27 bp, Artificial Sequences
  Synthetic
tgaggggggcgtcgagttgttgttttt

SEQ ID NO: 12722 - DNA, 27 bp, Artificial Sequences
  Synthetic
tgggttagggtgtagggttcgcggttt

SEQ ID NO: 12723 - DNA, 27 bp, Artificial Sequences
  Synthetic
ttgggttagggtgtagggttcgcggtt

SEQ ID NO: 12724 - DNA, 27 bp, Artificial Sequences
  Synthetic
tttgggttagggtgtagggttcgcggt

SEQ ID NO: 12725 - DNA, 27 bp, Artificial Sequences
  Synthetic
tcgggggaagggtagtaattcggcgtt

SEQ ID NO: 12726 - DNA, 27 bp, Artificial Sequences
  Synthetic
ttcgggggaagggtagtaattcggcgt

SEQ ID NO: 12727 - DNA, 27 bp, Artificial Sequences
  Synthetic
taggagtggggttggggggacggttta

SEQ ID NO: 12728 - DNA, 27 bp, Artificial Sequences
  Synthetic
tgtagtaggagtggggttggggggacg

SEQ ID NO: 12729 - DNA, 27 bp, Artificial Sequences
  Synthetic
tgttgtagtaggagtggggttgggggg

SEQ ID NO: 12730 - DNA, 27 bp, Artificial Sequences
  Synthetic
gtagtaggagtggggttggggggacgg

SEQ ID NO: 12731 - DNA, 28 bp, Artificial Sequences
  Synthetic
tgttgtagtaggagtggggttgggggga

SEQ ID NO: 12732 - DNA, 26 bp, Artificial Sequences
  Synthetic
cgtggtttgggtttcgcgggttttcg

SEQ ID NO: 12733 - DNA, 25 bp, Artificial Sequences
  Synthetic
gcgggttttcgggggcgattggatc

SEQ ID NO: 12734 - DNA, 24 bp, Artificial Sequences
  Synthetic
gcgggttttcgggggcgattggat

SEQ ID NO: 12735 - DNA, 24 bp, Artificial Sequences
  Synthetic
ggtttgagcgacgggttggagcgg

SEQ ID NO: 12736 - DNA, 24 bp, Artificial Sequences
  Synthetic
gggtttgagcgacgggttggagcg

SEQ ID NO: 12737 - DNA, 27 bp, Artificial Sequences
  Synthetic
taggagtggggttggggggacggttta

SEQ ID NO: 12738 - DNA, 27 bp, Artificial Sequences
  Synthetic
tgtagtaggagtggggttggggggacg

SEQ ID NO: 12739 - DNA, 27 bp, Artificial Sequences
  Synthetic
tgttgtagtaggagtggggttgggggg

SEQ ID NO: 12740 - DNA, 27 bp, Artificial Sequences
  Synthetic
gtagtaggagtggggttggggggacgg

SEQ ID NO: 12741 - DNA, 28 bp, Artificial Sequences
  Synthetic
tgttgtagtaggagtggggttgggggga

SEQ ID NO: 12742 - DNA, 27 bp, Artificial Sequences
  Synthetic
cgtggtttgggtttcgcgggttttcgg

SEQ ID NO: 12743 - DNA, 26 bp, Artificial Sequences
  Synthetic
cgtggtttgggtttcgcgggttttcg

SEQ ID NO: 12744 - DNA, 26 bp, Artificial Sequences
  Synthetic
gtggtttgggtttcgcgggttttcgg

SEQ ID NO: 12745 - DNA, 25 bp, Artificial Sequences
  Synthetic
gcgggttttcgggggcgattggatc

SEQ ID NO: 12746 - DNA, 24 bp, Artificial Sequences
  Synthetic
gcgggttttcgggggcgattggat

SEQ ID NO: 12747 - DNA, 20 bp, Artificial Sequences
  Synthetic
gagcgcgtcgggtcgttagc

SEQ ID NO: 12748 - DNA, 36 bp, Artificial Sequences
  Synthetic
tcgattatatacgttgtgagatttagaggtcgagga

SEQ ID NO: 12749 - DNA, 36 bp, Artificial Sequences
  Synthetic
gtcgattatatacgttgtgagatttagaggtcgagg

SEQ ID NO: 12750 - DNA, 36 bp, Artificial Sequences
  Synthetic
ggtcgattatatacgttgtgagatttagaggtcgag

SEQ ID NO: 12751 - DNA, 28 bp, Artificial Sequences
  Synthetic
tggaggttattaagggcgtagggttggt

SEQ ID NO: 12752 - DNA, 27 bp, Artificial Sequences
  Synthetic
ggaggttattaagggcgtagggttggt

SEQ ID NO: 12753 - DNA, 27 bp, Artificial Sequences
  Synthetic
tggaggttattaagggcgtagggttgg

SEQ ID NO: 12754 - DNA, 29 bp, Artificial Sequences
  Synthetic
tggtggttgatggaggttattaagggcgt

SEQ ID NO: 12755 - DNA, 28 bp, Artificial Sequences
  Synthetic
ggtggttgatggaggttattaagggcgt

SEQ ID NO: 12756 - DNA, 21 bp, Artificial Sequences
  Synthetic
tttagagtcgggggcggggtc

SEQ ID NO: 12757 - DNA, 36 bp, Artificial Sequences
  Synthetic
ggggtcgattatatacgttgtgagatttagaggtcg

SEQ ID NO: 12758 - DNA, 35 bp, Artificial Sequences
  Synthetic
gggtcgattatatacgttgtgagatttagaggtcg

SEQ ID NO: 12759 - DNA, 35 bp, Artificial Sequences
  Synthetic
ggggtcgattatatacgttgtgagatttagaggtc

SEQ ID NO: 12760 - DNA, 36 bp, Artificial Sequences
  Synthetic
gggtcgattatatacgttgtgagatttagaggtcga

SEQ ID NO: 12761 - DNA, 27 bp, Artificial Sequences
  Synthetic
gcgtgtaggtggagtagtagcgaggga

SEQ ID NO: 12762 - DNA, 27 bp, Artificial Sequences
  Synthetic
tgtaggtggagtagtagcgagggaggc

SEQ ID NO: 12763 - DNA, 28 bp, Artificial Sequences
  Synthetic
gcgtgtaggtggagtagtagcgagggag

SEQ ID NO: 12764 - DNA, 28 bp, Artificial Sequences
  Synthetic
gtgtaggtggagtagtagcgagggaggc

SEQ ID NO: 12765 - DNA, 28 bp, Artificial Sequences
  Synthetic
cgtgtaggtggagtagtagcgagggagg

SEQ ID NO: 12766 - DNA, 27 bp, Artificial Sequences
  Synthetic
aggcgaaggtagaggttagtacgggtt

SEQ ID NO: 12767 - DNA, 27 bp, Artificial Sequences
  Synthetic
taggcgaaggtagaggttagtacgggt

SEQ ID NO: 12768 - DNA, 26 bp, Artificial Sequences
  Synthetic
aggcgaaggtagaggttagtacgggt

SEQ ID NO: 12769 - DNA, 28 bp, Artificial Sequences
  Synthetic
aggcgaaggtagaggttagtacgggtta

SEQ ID NO: 12770 - DNA, 28 bp, Artificial Sequences
  Synthetic
taggcgaaggtagaggttagtacgggtt

SEQ ID NO: 12771 - DNA, 27 bp, Artificial Sequences
  Synthetic
cgggggcgttggggtcgttaaggttat

SEQ ID NO: 12772 - DNA, 28 bp, Artificial Sequences
  Synthetic
cgggggcgttggggtcgttaaggttata

SEQ ID NO: 12773 - DNA, 27 bp, Artificial Sequences
  Synthetic
gcgtgtaggtggagtagtagcgaggga

SEQ ID NO: 12774 - DNA, 26 bp, Artificial Sequences
  Synthetic
cgggggcgttggggtcgttaaggtta

SEQ ID NO: 12775 - DNA, 27 bp, Artificial Sequences
  Synthetic
tgtaggtggagtagtagcgagggaggc

SEQ ID NO: 12776 - DNA, 27 bp, Artificial Sequences
  Synthetic
aggcgaaggtagaggttagtacgggtt

SEQ ID NO: 12777 - DNA, 27 bp, Artificial Sequences
  Synthetic
taggcgaaggtagaggttagtacgggt

SEQ ID NO: 12778 - DNA, 26 bp, Artificial Sequences
  Synthetic
aggcgaaggtagaggttagtacgggt

SEQ ID NO: 12779 - DNA, 28 bp, Artificial Sequences
  Synthetic
aggcgaaggtagaggttagtacgggtta

SEQ ID NO: 12780 - DNA, 28 bp, Artificial Sequences
  Synthetic
taggcgaaggtagaggttagtacgggtt

SEQ ID NO: 12781 - DNA, 27 bp, Artificial Sequences
  Synthetic
tagtcgcgcggggttggagggttttat

SEQ ID NO: 12782 - DNA, 27 bp, Artificial Sequences
  Synthetic
ggggagtttacgttgggttcgaggggt

SEQ ID NO: 12783 - DNA, 27 bp, Artificial Sequences
  Synthetic
aggggagtttacgttgggttcgagggg

SEQ ID NO: 12784 - DNA, 27 bp, Artificial Sequences
  Synthetic
gtagtcgcgcggggttggagggtttta

SEQ ID NO: 12785 - DNA, 27 bp, Artificial Sequences
  Synthetic
ttttgagtagtcgcgcggggttggagg

SEQ ID NO: 12786 - DNA, 27 bp, Artificial Sequences
  Synthetic
gcgcggttgtttaaggtgggagtcgtg

SEQ ID NO: 12787 - DNA, 27 bp, Artificial Sequences
  Synthetic
gttgggggtcgtaggtgttggcggtat

SEQ ID NO: 12788 - DNA, 27 bp, Artificial Sequences
  Synthetic
cgcggttgtttaaggtgggagtcgtgg

SEQ ID NO: 12789 - DNA, 27 bp, Artificial Sequences
  Synthetic
tttttgggggttatcgcgtggggttcg

SEQ ID NO: 12790 - DNA, 27 bp, Artificial Sequences
  Synthetic
ggggtattcgtaggagttcgggcgagt

SEQ ID NO: 12791 - DNA, 27 bp, Artificial Sequences
  Synthetic
tagtcgcgcggggttggagggttttat

SEQ ID NO: 12792 - DNA, 27 bp, Artificial Sequences
  Synthetic
agtttttagggagtggggagtcgggcg

SEQ ID NO: 12793 - DNA, 27 bp, Artificial Sequences
  Synthetic
agtggggagtcgggcgggaaatagttc

SEQ ID NO: 12794 - DNA, 27 bp, Artificial Sequences
  Synthetic
gagtggggagtcgggcgggaaatagtt

SEQ ID NO: 12795 - DNA, 27 bp, Artificial Sequences
  Synthetic
gtagtcgcgcggggttggagggtttta

SEQ ID NO: 12796 - DNA, 27 bp, Artificial Sequences
  Synthetic
gttgggggtcgtaggtgttggcggtat

SEQ ID NO: 12797 - DNA, 27 bp, Artificial Sequences
  Synthetic
cggtagagggtgtaggttttggggcga

SEQ ID NO: 12798 - DNA, 27 bp, Artificial Sequences
  Synthetic
tcggtagagggtgtaggttttggggcg

SEQ ID NO: 12799 - DNA, 27 bp, Artificial Sequences
  Synthetic
ggcgaaggttttgtgttgcggggtttg

SEQ ID NO: 12800 - DNA, 27 bp, Artificial Sequences
  Synthetic
tttttgggggttatcgcgtggggttcg

SEQ ID NO: 12801 - DNA, 27 bp, Artificial Sequences
  Synthetic
gtagtcgggcgtggaagtgggatgagt

SEQ ID NO: 12802 - DNA, 27 bp, Artificial Sequences
  Synthetic
tgtagtcgggcgtggaagtgggatgag

SEQ ID NO: 12803 - DNA, 27 bp, Artificial Sequences
  Synthetic
ttgtagtcgggcgtggaagtgggatga

SEQ ID NO: 12804 - DNA, 27 bp, Artificial Sequences
  Synthetic
agtcgggcgtggaagtgggatgagtaa

SEQ ID NO: 12805 - DNA, 27 bp, Artificial Sequences
  Synthetic
cgagggttttttgtagtcgggcgtgga

SEQ ID NO: 12806 - DNA, 27 bp, Artificial Sequences
  Synthetic
gttatcgaatgggtgtgttggcggggg

SEQ ID NO: 12807 - DNA, 27 bp, Artificial Sequences
  Synthetic
cgaatgggtgtgttggcggggggataa

SEQ ID NO: 12808 - DNA, 27 bp, Artificial Sequences
  Synthetic
ttatcgaatgggtgtgttggcgggggg

SEQ ID NO: 12809 - DNA, 27 bp, Artificial Sequences
  Synthetic
tgttatcgaatgggtgtgttggcgggg

SEQ ID NO: 12810 - DNA, 27 bp, Artificial Sequences
  Synthetic
gaatgggtgtgttggcggggggataaa

SEQ ID NO: 12811 - DNA, 26 bp, Artificial Sequences
  Synthetic
gaagggtgaggttgtcggcgcgtttg

SEQ ID NO: 12812 - DNA, 27 bp, Artificial Sequences
  Synthetic
gaagggtgaggttgtcggcgcgtttgg

SEQ ID NO: 12813 - DNA, 25 bp, Artificial Sequences
  Synthetic
gaagggtgaggttgtcggcgcgttt

SEQ ID NO: 12814 - DNA, 27 bp, Artificial Sequences
  Synthetic
cgaagggtgaggttgtcggcgcgtttg

SEQ ID NO: 12815 - DNA, 26 bp, Artificial Sequences
  Synthetic
gtagcggcgaagggtgaggttgtcgg

SEQ ID NO: 12816 - DNA, 27 bp, Artificial Sequences
  Synthetic
gtcgttgtattcgggggagcggacgtt

SEQ ID NO: 12817 - DNA, 27 bp, Artificial Sequences
  Synthetic
tcgttgtattcgggggagcggacgtta

SEQ ID NO: 12818 - DNA, 27 bp, Artificial Sequences
  Synthetic
gtcgtcgttgtattcgggggagcggac

SEQ ID NO: 12819 - DNA, 27 bp, Artificial Sequences
  Synthetic
cgttgtattcgggggagcggacgttag

SEQ ID NO: 12820 - DNA, 28 bp, Artificial Sequences
  Synthetic
cgttgtattcgggggagcggacgttagt

SEQ ID NO: 12821 - DNA, 27 bp, Artificial Sequences
  Synthetic
tgattttgtaggtggtagcgcggggtt

SEQ ID NO: 12822 - DNA, 26 bp, Artificial Sequences
  Synthetic
gaagggtgaggttgtcggcgcgtttg

SEQ ID NO: 12823 - DNA, 28 bp, Artificial Sequences
  Synthetic
cgatgattttgtaggtggtagcgcgggg

SEQ ID NO: 12824 - DNA, 27 bp, Artificial Sequences
  Synthetic
atgattttgtaggtggtagcgcggggt

SEQ ID NO: 12825 - DNA, 27 bp, Artificial Sequences
  Synthetic
gaagggtgaggttgtcggcgcgtttgg

SEQ ID NO: 12826 - DNA, 27 bp, Artificial Sequences
  Synthetic
gggttcggttagggtgaggcggtttga

SEQ ID NO: 12827 - DNA, 27 bp, Artificial Sequences
  Synthetic
cgggttcggttagggtgaggcggtttg

SEQ ID NO: 12828 - DNA, 27 bp, Artificial Sequences
  Synthetic
ggttcggttagggtgaggcggtttgat

SEQ ID NO: 12829 - DNA, 27 bp, Artificial Sequences
  Synthetic
ttcggttagggtgaggcggtttgatcg

SEQ ID NO: 12830 - DNA, 28 bp, Artificial Sequences
  Synthetic
gggttcggttagggtgaggcggtttgat

SEQ ID NO: 12831 - DNA, 27 bp, Artificial Sequences
  Synthetic
cgtggtgttcgtatttggcgttcgtat

SEQ ID NO: 12832 - DNA, 28 bp, Artificial Sequences
  Synthetic
cgtggtgttcgtatttggcgttcgtatt

SEQ ID NO: 12833 - DNA, 26 bp, Artificial Sequences
  Synthetic
cgtggtgttcgtatttggcgttcgta

SEQ ID NO: 12834 - DNA, 29 bp, Artificial Sequences
  Synthetic
cgtggtgttcgtatttggcgttcgtattt

SEQ ID NO: 12835 - DNA, 25 bp, Artificial Sequences
  Synthetic
cgtggtgttcgtatttggcgttcgt

SEQ ID NO: 12836 - DNA, 27 bp, Artificial Sequences
  Synthetic
gggttcggttagggtgaggcggtttga

SEQ ID NO: 12837 - DNA, 27 bp, Artificial Sequences
  Synthetic
cgggttcggttagggtgaggcggtttg

SEQ ID NO: 12838 - DNA, 27 bp, Artificial Sequences
  Synthetic
ggttcggttagggtgaggcggtttgat

SEQ ID NO: 12839 - DNA, 27 bp, Artificial Sequences
  Synthetic
ttcggttagggtgaggcggtttgatcg

SEQ ID NO: 12840 - DNA, 28 bp, Artificial Sequences
  Synthetic
gggttcggttagggtgaggcggtttgat

SEQ ID NO: 12841 - DNA, 27 bp, Artificial Sequences
  Synthetic
cgtggtgttcgtatttggcgttcgtat

SEQ ID NO: 12842 - DNA, 27 bp, Artificial Sequences
  Synthetic
cgcgttcgtgggttttttgtttttcga

SEQ ID NO: 12843 - DNA, 28 bp, Artificial Sequences
  Synthetic
cgtggtgttcgtatttggcgttcgtatt

SEQ ID NO: 12844 - DNA, 28 bp, Artificial Sequences
  Synthetic
cgcgttcgtgggttttttgtttttcgat

SEQ ID NO: 12845 - DNA, 26 bp, Artificial Sequences
  Synthetic
cgtggtgttcgtatttggcgttcgta

SEQ ID NO: 12846 - DNA, 27 bp, Artificial Sequences
  Synthetic
cggggtgcgggcgttaaatgcgaatat

SEQ ID NO: 12847 - DNA, 27 bp, Artificial Sequences
  Synthetic
gggttcggttagggtgaggcggtttga

SEQ ID NO: 12848 - DNA, 26 bp, Artificial Sequences
  Synthetic
cggggtgcgggcgttaaatgcgaata

SEQ ID NO: 12849 - DNA, 28 bp, Artificial Sequences
  Synthetic
cggggtgcgggcgttaaatgcgaatatt

SEQ ID NO: 12850 - DNA, 27 bp, Artificial Sequences
  Synthetic
cgggttcggttagggtgaggcggtttg

SEQ ID NO: 12851 - DNA, 26 bp, Artificial Sequences
  Synthetic
gtggtcgaagtggagttggcggaaga

SEQ ID NO: 12852 - DNA, 27 bp, Artificial Sequences
  Synthetic
cgcgttcgtgggttttttgtttttcga

SEQ ID NO: 12853 - DNA, 25 bp, Artificial Sequences
  Synthetic
tggtcgaagtggagttggcggaaga

SEQ ID NO: 12854 - DNA, 25 bp, Artificial Sequences
  Synthetic
gtggtcgaagtggagttggcggaag

SEQ ID NO: 12855 - DNA, 28 bp, Artificial Sequences
  Synthetic
cgcgttcgtgggttttttgtttttcgat

SEQ ID NO: 12856 - DNA, 22 bp, Artificial Sequences
  Synthetic
gtcggggtaaggacgtaggggc

SEQ ID NO: 12857 - DNA, 36 bp, Artificial Sequences
  Synthetic
gcgttttttatgttggaaggatttttagtttggagc

SEQ ID NO: 12858 - DNA, 36 bp, Artificial Sequences
  Synthetic
cgttttttatgttggaaggatttttagtttggagcg

SEQ ID NO: 12859 - DNA, 36 bp, Artificial Sequences
  Synthetic
ttttatgttggaaggatttttagtttggagcggaaa

SEQ ID NO: 12860 - DNA, 36 bp, Artificial Sequences
  Synthetic
tttttatgttggaaggatttttagtttggagcggaa

SEQ ID NO: 12861 - DNA, 27 bp, Artificial Sequences
  Synthetic
gcggttagtcgggttagaaacgtgggc

SEQ ID NO: 12862 - DNA, 27 bp, Artificial Sequences
  Synthetic
tgcggttagtcgggttagaaacgtggg

SEQ ID NO: 12863 - DNA, 28 bp, Artificial Sequences
  Synthetic
tgcggttagtcgggttagaaacgtgggc

SEQ ID NO: 12864 - DNA, 28 bp, Artificial Sequences
  Synthetic
ttgcggttagtcgggttagaaacgtggg

SEQ ID NO: 12865 - DNA, 29 bp, Artificial Sequences
  Synthetic
ttgcggttagtcgggttagaaacgtgggc

SEQ ID NO: 12866 - DNA, 22 bp, Artificial Sequences
  Synthetic
gtcggggtaaggacgtaggggc

SEQ ID NO: 12867 - DNA, 34 bp, Artificial Sequences
  Synthetic
acgtttttggttcggttagtcgtaattttttgga

SEQ ID NO: 12868 - DNA, 35 bp, Artificial Sequences
  Synthetic
acgtttttggttcggttagtcgtaattttttggat

SEQ ID NO: 12869 - DNA, 35 bp, Artificial Sequences
  Synthetic
tggttcggttagtcgtaattttttggatgtaaacg

SEQ ID NO: 12870 - DNA, 35 bp, Artificial Sequences
  Synthetic
cgtttttggttcggttagtcgtaattttttggatg

SEQ ID NO: 12871 - DNA, 27 bp, Artificial Sequences
  Synthetic
aggagcggggagttgttgaaagtcggg

SEQ ID NO: 12872 - DNA, 27 bp, Artificial Sequences
  Synthetic
ggagcggggagttgttgaaagtcgggt

SEQ ID NO: 12873 - DNA, 27 bp, Artificial Sequences
  Synthetic
gaggagcggggagttgttgaaagtcgg

SEQ ID NO: 12874 - DNA, 27 bp, Artificial Sequences
  Synthetic
gagcggggagttgttgaaagtcgggtt

SEQ ID NO: 12875 - DNA, 26 bp, Artificial Sequences
  Synthetic
ggagcggggagttgttgaaagtcggg

SEQ ID NO: 12876 - DNA, 27 bp, Artificial Sequences
  Synthetic
cgttgcggcgtgtggggaaagatgatt

SEQ ID NO: 12877 - DNA, 26 bp, Artificial Sequences
  Synthetic
cgttgcggcgtgtggggaaagatgat

SEQ ID NO: 12878 - DNA, 28 bp, Artificial Sequences
  Synthetic
cgttgcggcgtgtggggaaagatgatta

SEQ ID NO: 12879 - DNA, 27 bp, Artificial Sequences
  Synthetic
gcgttgcggcgtgtggggaaagatgat

SEQ ID NO: 12880 - DNA, 25 bp, Artificial Sequences
  Synthetic
cgttgcggcgtgtggggaaagatga

SEQ ID NO: 12881 - DNA, 27 bp, Artificial Sequences
  Synthetic
aggagcggggagttgttgaaagtcggg

SEQ ID NO: 12882 - DNA, 27 bp, Artificial Sequences
  Synthetic
tggggggttgtagtttcgggcgtagtt

SEQ ID NO: 12883 - DNA, 27 bp, Artificial Sequences
  Synthetic
ttggggggttgtagtttcgggcgtagt

SEQ ID NO: 12884 - DNA, 27 bp, Artificial Sequences
  Synthetic
ggagcggggagttgttgaaagtcgggt

SEQ ID NO: 12885 - DNA, 27 bp, Artificial Sequences
  Synthetic
gaggagcggggagttgttgaaagtcgg

SEQ ID NO: 12886 - DNA, 27 bp, Artificial Sequences
  Synthetic
cgttgcggcgtgtggggaaagatgatt

SEQ ID NO: 12887 - DNA, 26 bp, Artificial Sequences
  Synthetic
cgttgcggcgtgtggggaaagatgat

SEQ ID NO: 12888 - DNA, 28 bp, Artificial Sequences
  Synthetic
cgttgcggcgtgtggggaaagatgatta

SEQ ID NO: 12889 - DNA, 27 bp, Artificial Sequences
  Synthetic
gcgttgcggcgtgtggggaaagatgat

SEQ ID NO: 12890 - DNA, 25 bp, Artificial Sequences
  Synthetic
cgttgcggcgtgtggggaaagatga

SEQ ID NO: 12891 - DNA, 27 bp, Artificial Sequences
  Synthetic
cgtgcgcggaggtagttttttgggtgt

SEQ ID NO: 12892 - DNA, 27 bp, Artificial Sequences
  Synthetic
agaggggagtgggagtaggaggtgtcg

SEQ ID NO: 12893 - DNA, 27 bp, Artificial Sequences
  Synthetic
cggagaggggagtgggagtaggaggtg

SEQ ID NO: 12894 - DNA, 27 bp, Artificial Sequences
  Synthetic
agtgggagtaggaggtgtcggtttggc

SEQ ID NO: 12895 - DNA, 27 bp, Artificial Sequences
  Synthetic
tggggggttgtagtttcgggcgtagtt

SEQ ID NO: 12896 - DNA, 27 bp, Artificial Sequences
  Synthetic
tcgtagtggagttgcgttcggggttgt

SEQ ID NO: 12897 - DNA, 27 bp, Artificial Sequences
  Synthetic
tgtgggtcgtagtggagttgcgttcgg

SEQ ID NO: 12898 - DNA, 27 bp, Artificial Sequences
  Synthetic
ggtcgtagtggagttgcgttcggggtt

SEQ ID NO: 12899 - DNA, 27 bp, Artificial Sequences
  Synthetic
gtcgtagtggagttgcgttcggggttg

SEQ ID NO: 12900 - DNA, 27 bp, Artificial Sequences
  Synthetic
gtgggtcgtagtggagttgcgttcggg

SEQ ID NO: 12901 - DNA, 27 bp, Artificial Sequences
  Synthetic
ggagtaggaggtgtcggtttggcgtgt

SEQ ID NO: 12902 - DNA, 27 bp, Artificial Sequences
  Synthetic
ttgtttacggttgggcggagaggggag

SEQ ID NO: 12903 - DNA, 27 bp, Artificial Sequences
  Synthetic
agaggggagtgggagtaggaggtgtcg

SEQ ID NO: 12904 - DNA, 27 bp, Artificial Sequences
  Synthetic
cggagaggggagtgggagtaggaggtg

SEQ ID NO: 12905 - DNA, 27 bp, Artificial Sequences
  Synthetic
gttgtttacggttgggcggagagggga

SEQ ID NO: 12906 - DNA, 27 bp, Artificial Sequences
  Synthetic
tgcgttgcgggtagttgttcgtaggga

SEQ ID NO: 12907 - DNA, 27 bp, Artificial Sequences
  Synthetic
gcgttgcgttgcgggtagttgttcgta

SEQ ID NO: 12908 - DNA, 27 bp, Artificial Sequences
  Synthetic
gcgttgcgggtagttgttcgtagggag

SEQ ID NO: 12909 - DNA, 27 bp, Artificial Sequences
  Synthetic
ttgcgttgcgggtagttgttcgtaggg

SEQ ID NO: 12910 - DNA, 28 bp, Artificial Sequences
  Synthetic
cgttgcgttgcgggtagttgttcgtagg

SEQ ID NO: 12911 - DNA, 27 bp, Artificial Sequences
  Synthetic
tggatggaggtgagcgcgaaggaagtc

SEQ ID NO: 12912 - DNA, 27 bp, Artificial Sequences
  Synthetic
gtggatggaggtgagcgcgaaggaagt

SEQ ID NO: 12913 - DNA, 27 bp, Artificial Sequences
  Synthetic
tttaggtggtggatggaggtgagcgcg

SEQ ID NO: 12914 - DNA, 27 bp, Artificial Sequences
  Synthetic
ggtggatggaggtgagcgcgaaggaag

SEQ ID NO: 12915 - DNA, 27 bp, Artificial Sequences
  Synthetic
taggtggtggatggaggtgagcgcgaa

SEQ ID NO: 12916 - DNA, 27 bp, Artificial Sequences
  Synthetic
tgtcgcggttggagtacggtttttgtt

SEQ ID NO: 12917 - DNA, 27 bp, Artificial Sequences
  Synthetic
ttgtcgcggttggagtacggtttttgt

SEQ ID NO: 12918 - DNA, 28 bp, Artificial Sequences
  Synthetic
ttgtcgcggttggagtacggtttttgtt

SEQ ID NO: 12919 - DNA, 28 bp, Artificial Sequences
  Synthetic
tttgtcgcggttggagtacggtttttgt

SEQ ID NO: 12920 - DNA, 27 bp, Artificial Sequences
  Synthetic
tttgtcgcggttggagtacggtttttg

SEQ ID NO: 12921 - DNA, 27 bp, Artificial Sequences
  Synthetic
tgacgggtttttcgagggggttttagt

SEQ ID NO: 12922 - DNA, 28 bp, Artificial Sequences
  Synthetic
acgggtttttcgagggggttttagttgt

SEQ ID NO: 12923 - DNA, 28 bp, Artificial Sequences
  Synthetic
tgacgggtttttcgagggggttttagtt

SEQ ID NO: 12924 - DNA, 28 bp, Artificial Sequences
  Synthetic
atgacgggtttttcgagggggttttagt

SEQ ID NO: 12925 - DNA, 29 bp, Artificial Sequences
  Synthetic
gacgggtttttcgagggggttttagttgt

SEQ ID NO: 12926 - DNA, 27 bp, Artificial Sequences
  Synthetic
tgtcgcggttggagtacggtttttgtt

SEQ ID NO: 12927 - DNA, 27 bp, Artificial Sequences
  Synthetic
ttgtcgcggttggagtacggtttttgt

SEQ ID NO: 12928 - DNA, 28 bp, Artificial Sequences
  Synthetic
ttgtcgcggttggagtacggtttttgtt

SEQ ID NO: 12929 - DNA, 26 bp, Artificial Sequences
  Synthetic
tgtcgcggttggagtacggtttttgt

SEQ ID NO: 12930 - DNA, 29 bp, Artificial Sequences
  Synthetic
cgcggttggagtacggtttttgttagtcg

SEQ ID NO: 12931 - DNA, 27 bp, Artificial Sequences
  Synthetic
tgacgggtttttcgagggggttttagt

SEQ ID NO: 12932 - DNA, 27 bp, Artificial Sequences
  Synthetic
tcgacgcggtttttgattttggagtga

SEQ ID NO: 12933 - DNA, 28 bp, Artificial Sequences
  Synthetic
acgggtttttcgagggggttttagttgt

SEQ ID NO: 12934 - DNA, 28 bp, Artificial Sequences
  Synthetic
tgacgggtttttcgagggggttttagtt

SEQ ID NO: 12935 - DNA, 28 bp, Artificial Sequences
  Synthetic
atgacgggtttttcgagggggttttagt

SEQ ID NO: 12936 - DNA, 27 bp, Artificial Sequences
  Synthetic
cgcgtcggttttgtttggggtatgggt

SEQ ID NO: 12937 - DNA, 27 bp, Artificial Sequences
  Synthetic
tcgcgtcggttttgtttggggtatggg

SEQ ID NO: 12938 - DNA, 27 bp, Artificial Sequences
  Synthetic
agaggtcgcgtcggttttgtttggggt

SEQ ID NO: 12939 - DNA, 27 bp, Artificial Sequences
  Synthetic
gaggtcgcgtcggttttgtttggggta

SEQ ID NO: 12940 - DNA, 27 bp, Artificial Sequences
  Synthetic
tagaggtcgcgtcggttttgtttgggg

SEQ ID NO: 12941 - DNA, 27 bp, Artificial Sequences
  Synthetic
tagggggtggggaagaggaagagcgaa

SEQ ID NO: 12942 - DNA, 27 bp, Artificial Sequences
  Synthetic
ttagggggtggggaagaggaagagcga

SEQ ID NO: 12943 - DNA, 27 bp, Artificial Sequences
  Synthetic
gttaggtatgggcgtgcgggttttggg

SEQ ID NO: 12944 - DNA, 27 bp, Artificial Sequences
  Synthetic
ttaggtatgggcgtgcgggttttggga

SEQ ID NO: 12945 - DNA, 27 bp, Artificial Sequences
  Synthetic
gttagggggtggggaagaggaagagcg

SEQ ID NO: 12946 - DNA, 27 bp, Artificial Sequences
  Synthetic
attttcgcgcggatggtttaggagggg

SEQ ID NO: 12947 - DNA, 27 bp, Artificial Sequences
  Synthetic
ttttcgcgcggatggtttaggaggggc

SEQ ID NO: 12948 - DNA, 28 bp, Artificial Sequences
  Synthetic
gattttcgcgcggatggtttaggagggg

SEQ ID NO: 12949 - DNA, 26 bp, Artificial Sequences
  Synthetic
ttttcgcgcggatggtttaggagggg

SEQ ID NO: 12950 - DNA, 27 bp, Artificial Sequences
  Synthetic
aggggagtattagagggtcgcgaggtt

SEQ ID NO: 12951 - DNA, 27 bp, Artificial Sequences
  Synthetic
cggtggggatcgcgtcggtataggata

SEQ ID NO: 12952 - DNA, 28 bp, Artificial Sequences
  Synthetic
cgtcggtataggataacgcggtggaggg

SEQ ID NO: 12953 - DNA, 26 bp, Artificial Sequences
  Synthetic
cggtggggatcgcgtcggtataggat

SEQ ID NO: 12954 - DNA, 27 bp, Artificial Sequences
  Synthetic
gcggtggggatcgcgtcggtataggat

SEQ ID NO: 12955 - DNA, 27 bp, Artificial Sequences
  Synthetic
tcggtataggataacgcggtggaggga

SEQ ID NO: 12956 - DNA, 27 bp, Artificial Sequences
  Synthetic
gagttaaggtgggcgggggtaggtgtt

SEQ ID NO: 12957 - DNA, 27 bp, Artificial Sequences
  Synthetic
ttgagttaaggtgggcgggggtaggtg

SEQ ID NO: 12958 - DNA, 27 bp, Artificial Sequences
  Synthetic
agttaaggtgggcgggggtaggtgttt

SEQ ID NO: 12959 - DNA, 27 bp, Artificial Sequences
  Synthetic
tgagttaaggtgggcgggggtaggtgt

SEQ ID NO: 12960 - DNA, 27 bp, Artificial Sequences
  Synthetic
attttcgcgcggatggtttaggagggg

SEQ ID NO: 12961 - DNA, 27 bp, Artificial Sequences
  Synthetic
ggattcggtgggaggaaggagtgcgaa

SEQ ID NO: 12962 - DNA, 27 bp, Artificial Sequences
  Synthetic
gggaatcgtgaagtcgggtttgcggat

SEQ ID NO: 12963 - DNA, 27 bp, Artificial Sequences
  Synthetic
cgggaatcgtgaagtcgggtttgcgga

SEQ ID NO: 12964 - DNA, 27 bp, Artificial Sequences
  Synthetic
cggtggggatcgcgtcggtataggata

SEQ ID NO: 12965 - DNA, 26 bp, Artificial Sequences
  Synthetic
cgggaatcgtgaagtcgggtttgcgg

SEQ ID NO: 12966 - DNA, 27 bp, Artificial Sequences
  Synthetic
gagttaaggtgggcgggggtaggtgtt

SEQ ID NO: 12967 - DNA, 27 bp, Artificial Sequences
  Synthetic
ttgagttaaggtgggcgggggtaggtg

SEQ ID NO: 12968 - DNA, 27 bp, Artificial Sequences
  Synthetic
agttaaggtgggcgggggtaggtgttt

SEQ ID NO: 12969 - DNA, 27 bp, Artificial Sequences
  Synthetic
tgagttaaggtgggcgggggtaggtgt

SEQ ID NO: 12970 - DNA, 27 bp, Artificial Sequences
  Synthetic
attttcgcgcggatggtttaggagggg

SEQ ID NO: 12971 - DNA, 27 bp, Artificial Sequences
  Synthetic
ggattcggtgggaggaaggagtgcgaa

SEQ ID NO: 12972 - DNA, 27 bp, Artificial Sequences
  Synthetic
gggaatcgtgaagtcgggtttgcggat

SEQ ID NO: 12973 - DNA, 27 bp, Artificial Sequences
  Synthetic
cgggaatcgtgaagtcgggtttgcgga

SEQ ID NO: 12974 - DNA, 26 bp, Artificial Sequences
  Synthetic
cgggaatcgtgaagtcgggtttgcgg

SEQ ID NO: 12975 - DNA, 26 bp, Artificial Sequences
  Synthetic
ggattcggtgggaggaaggagtgcga

SEQ ID NO: 12976 - DNA, 27 bp, Artificial Sequences
  Synthetic
tatgtcggcgcggtttttatcgttcga

SEQ ID NO: 12977 - DNA, 26 bp, Artificial Sequences
  Synthetic
atgtcggcgcggtttttatcgttcga

SEQ ID NO: 12978 - DNA, 27 bp, Artificial Sequences
  Synthetic
ttatgtcggcgcggtttttatcgttcg

SEQ ID NO: 12979 - DNA, 28 bp, Artificial Sequences
  Synthetic
ttatgtcggcgcggtttttatcgttcga

SEQ ID NO: 12980 - DNA, 27 bp, Artificial Sequences
  Synthetic
tcggcgcggtttttatcgttcgattta

SEQ ID NO: 12981 - DNA, 27 bp, Artificial Sequences
  Synthetic
tgtggttttgcgggagtgagttgaggg

SEQ ID NO: 12982 - DNA, 28 bp, Artificial Sequences
  Synthetic
tgtggttttgcgggagtgagttgaggga

SEQ ID NO: 12983 - DNA, 27 bp, Artificial Sequences
  Synthetic
gtggttttgcgggagtgagttgaggga

SEQ ID NO: 12984 - DNA, 28 bp, Artificial Sequences
  Synthetic
tggttttgcgggagtgagttgagggagt

SEQ ID NO: 12985 - DNA, 27 bp, Artificial Sequences
  Synthetic
ggttttgcgggagtgagttgagggagt

SEQ ID NO: 12986 - DNA, 27 bp, Artificial Sequences
  Synthetic
ttttcgggttttcgggtatgtgaggga

SEQ ID NO: 12987 - DNA, 27 bp, Artificial Sequences
  Synthetic
tcgggttttcgggtatgtgagggattt

SEQ ID NO: 12988 - DNA, 27 bp, Artificial Sequences
  Synthetic
ttcgggttttcgggtatgtgagggatt

SEQ ID NO: 12989 - DNA, 27 bp, Artificial Sequences
  Synthetic
tttcgggttttcgggtatgtgagggat

SEQ ID NO: 12990 - DNA, 27 bp, Artificial Sequences
  Synthetic
cgggttttcgggtatgtgagggatttg

SEQ ID NO: 12991 - DNA, 27 bp, Artificial Sequences
  Synthetic
gtcgatcgatgtggggaaggggaaggg

SEQ ID NO: 12992 - DNA, 27 bp, Artificial Sequences
  Synthetic
ggtcgatcgatgtggggaaggggaagg

SEQ ID NO: 12993 - DNA, 27 bp, Artificial Sequences
  Synthetic
cggtcgatcgatgtggggaaggggaag

SEQ ID NO: 12994 - DNA, 27 bp, Artificial Sequences
  Synthetic
atcgatgtggggaaggggaaggggttc

SEQ ID NO: 12995 - DNA, 27 bp, Artificial Sequences
  Synthetic
gatcgatgtggggaaggggaaggggtt

SEQ ID NO: 12996 - DNA, 26 bp, Artificial Sequences
  Synthetic
cggtcggtcgagggagtttagagtcg

SEQ ID NO: 12997 - DNA, 25 bp, Artificial Sequences
  Synthetic
ggtcggtcgagggagtttagagtcg

SEQ ID NO: 12998 - DNA, 25 bp, Artificial Sequences
  Synthetic
cggtcggtcgagggagtttagagtc

SEQ ID NO: 12999 - DNA, 26 bp, Artificial Sequences
  Synthetic
gtgggaagtcgacgatgtttgaggcg

SEQ ID NO: 13000 - DNA, 25 bp, Artificial Sequences
  Synthetic
tgggaagtcgacgatgtttgaggcg

SEQ ID NO: 13001 - DNA, 25 bp, Artificial Sequences
  Synthetic
gtgggaagtcgacgatgtttgaggc

SEQ ID NO: 13002 - DNA, 29 bp, Artificial Sequences
  Synthetic
cgatgtttgaggcgttttgttttcggttt

SEQ ID NO: 13003 - DNA, 30 bp, Artificial Sequences
  Synthetic
tcgtaggaaaggattaggagaggtcgttgt

SEQ ID NO: 13004 - DNA, 27 bp, Artificial Sequences
  Synthetic
tcgggagggtgtttcgggtcggatttg

SEQ ID NO: 13005 - DNA, 27 bp, Artificial Sequences
  Synthetic
gtcgggagggtgtttcgggtcggattt

SEQ ID NO: 13006 - DNA, 27 bp, Artificial Sequences
  Synthetic
gggcgtggagaggaggtttgtcggttt

SEQ ID NO: 13007 - DNA, 27 bp, Artificial Sequences
  Synthetic
gggtcggatttgcggcgttgggttttt

SEQ ID NO: 13008 - DNA, 27 bp, Artificial Sequences
  Synthetic
ggcgtggagaggaggtttgtcggtttt

SEQ ID NO: 13009 - DNA, 27 bp, Artificial Sequences
  Synthetic
gcgggtgagaggggtcggtagttgttt

SEQ ID NO: 13010 - DNA, 27 bp, Artificial Sequences
  Synthetic
gcgtttgggagcggttgtgtaggtgat

SEQ ID NO: 13011 - DNA, 27 bp, Artificial Sequences
  Synthetic
tcgtgcgggaattttgggtggggattt

SEQ ID NO: 13012 - DNA, 27 bp, Artificial Sequences
  Synthetic
atcgtgcgggaattttgggtggggatt

SEQ ID NO: 13013 - DNA, 26 bp, Artificial Sequences
  Synthetic
gcgggtgagaggggtcggtagttgtt

SEQ ID NO: 13014 - DNA, 32 bp, Artificial Sequences
  Synthetic
ggggggacgagtttttaggaagtagttgtggg

SEQ ID NO: 13015 - DNA, 29 bp, Artificial Sequences
  Synthetic
agagtttttagtagggagggtcgagtcga

SEQ ID NO: 13016 - DNA, 29 bp, Artificial Sequences
  Synthetic
aggtgagagtttttagtagggagggtcga

SEQ ID NO: 13017 - DNA, 31 bp, Artificial Sequences
  Synthetic
gggggacgagtttttaggaagtagttgtggg

SEQ ID NO: 13018 - DNA, 31 bp, Artificial Sequences
  Synthetic
ggggggacgagtttttaggaagtagttgtgg

SEQ ID NO: 13019 - DNA, 27 bp, Artificial Sequences
  Synthetic
tcgagaggtaggtgggggttaaggtgt

SEQ ID NO: 13020 - DNA, 28 bp, Artificial Sequences
  Synthetic
ttcgagaggtaggtgggggttaaggtgt

SEQ ID NO: 13021 - DNA, 27 bp, Artificial Sequences
  Synthetic
ttcgagaggtaggtgggggttaaggtg

SEQ ID NO: 13022 - DNA, 27 bp, Artificial Sequences
  Synthetic
cgagaggtaggtgggggttaaggtgta

SEQ ID NO: 13023 - DNA, 27 bp, Artificial Sequences
  Synthetic
tttcgagaggtaggtgggggttaaggt

SEQ ID NO: 13024 - DNA, 32 bp, Artificial Sequences
  Synthetic
tggtaggaaggggttttatagacgtttttggt

SEQ ID NO: 13025 - DNA, 33 bp, Artificial Sequences
  Synthetic
tggtaggaaggggttttatagacgtttttggtg

SEQ ID NO: 13026 - DNA, 33 bp, Artificial Sequences
  Synthetic
ggtaggaaggggttttatagacgtttttggtga

SEQ ID NO: 13027 - DNA, 33 bp, Artificial Sequences
  Synthetic
aggaaggggttttatagacgtttttggtgatgt

SEQ ID NO: 13028 - DNA, 34 bp, Artificial Sequences
  Synthetic
tggtaggaaggggttttatagacgtttttggtga

SEQ ID NO: 13029 - DNA, 27 bp, Artificial Sequences
  Synthetic
agggaggaggggatgagttggtttgta

SEQ ID NO: 13030 - DNA, 27 bp, Artificial Sequences
  Synthetic
tagggaggaggggatgagttggtttgt

SEQ ID NO: 13031 - DNA, 28 bp, Artificial Sequences
  Synthetic
gggaggaggggatgagttggtttgtagt

SEQ ID NO: 13032 - DNA, 27 bp, Artificial Sequences
  Synthetic
gggaggaggggatgagttggtttgtag

SEQ ID NO: 13033 - DNA, 29 bp, Artificial Sequences
  Synthetic
agggaggaggggatgagttggtttgtagt

SEQ ID NO: 13034 - DNA, 27 bp, Artificial Sequences
  Synthetic
gcgtttcgtgtgatttcgtgtcgttgt

SEQ ID NO: 13035 - DNA, 28 bp, Artificial Sequences
  Synthetic
gcgtttcgtgtgatttcgtgtcgttgtt

SEQ ID NO: 13036 - DNA, 29 bp, Artificial Sequences
  Synthetic
gcgtttcgtgtgatttcgtgtcgttgttt

SEQ ID NO: 13037 - DNA, 26 bp, Artificial Sequences
  Synthetic
gcgtttcgtgtgatttcgtgtcgttg

SEQ ID NO: 13038 - DNA, 28 bp, Artificial Sequences
  Synthetic
tcgcgtttttgttgttttgggagaaagc

SEQ ID NO: 13039 - DNA, 34 bp, Artificial Sequences
  Synthetic
gagaaacggatattttttggttgttacgagggtc

SEQ ID NO: 13040 - DNA, 27 bp, Artificial Sequences
  Synthetic
gcgtttcgtgtgatttcgtgtcgttgt

SEQ ID NO: 13041 - DNA, 28 bp, Artificial Sequences
  Synthetic
gcgtttcgtgtgatttcgtgtcgttgtt

SEQ ID NO: 13042 - DNA, 29 bp, Artificial Sequences
  Synthetic
cgcgttcgggaggggattatatttttgcg

SEQ ID NO: 13043 - DNA, 30 bp, Artificial Sequences
  Synthetic
cgcgttcgggaggggattatatttttgcgt

SEQ ID NO: 13044 - DNA, 29 bp, Artificial Sequences
  Synthetic
gcgttcgggaggggattatatttttgcgt

SEQ ID NO: 13045 - DNA, 27 bp, Artificial Sequences
  Synthetic
cgatgggataggttgtgttgcgtttcg

SEQ ID NO: 13046 - DNA, 27 bp, Artificial Sequences
  Synthetic
tgggataggttgtgttgcgtttcgaga

SEQ ID NO: 13047 - DNA, 28 bp, Artificial Sequences
  Synthetic
cgatgggataggttgtgttgcgtttcga

SEQ ID NO: 13048 - DNA, 28 bp, Artificial Sequences
  Synthetic
tcgatgggataggttgtgttgcgtttcg

SEQ ID NO: 13049 - DNA, 29 bp, Artificial Sequences
  Synthetic
tcgatgggataggttgtgttgcgtttcga

SEQ ID NO: 13050 - DNA, 27 bp, Artificial Sequences
  Synthetic
tgcgttgttggcggaagtgatttgttt

SEQ ID NO: 13051 - DNA, 29 bp, Artificial Sequences
  Synthetic
cgcgttcgggaggggattatatttttgcg

SEQ ID NO: 13052 - DNA, 30 bp, Artificial Sequences; identical to SEQ ID NO: 13043
  Synthetic

SEQ ID NO: 13053 - DNA, 28 bp, Artificial Sequences
  Synthetic
tgcgttgttggcggaagtgatttgtttt

SEQ ID NO: 13054 - DNA, 27 bp, Artificial Sequences
  Synthetic
gcgttgttggcggaagtgatttgtttt

SEQ ID NO: 13055 - DNA, 32 bp, Artificial Sequences
  Synthetic
aggtttttggtttgtttgtttttcgttacggg

SEQ ID NO: 13056 - DNA, 32 bp, Artificial Sequences
  Synthetic
ggtttttggtttgtttgtttttcgttacggga

SEQ ID NO: 13057 - DNA, 33 bp, Artificial Sequences
  Synthetic
aggtttttggtttgtttgtttttcgttacggga

SEQ ID NO: 13058 - DNA, 33 bp, Artificial Sequences
  Synthetic
ggtttttggtttgtttgtttttcgttacgggag

SEQ ID NO: 13059 - DNA, 33 bp, Artificial Sequences
  Synthetic
gaggtttttggtttgtttgtttttcgttacggg

SEQ ID NO: 13060 - DNA, 27 bp, Artificial Sequences
  Synthetic
agttcgggttagggcgtagatgatgga

SEQ ID NO: 13061 - DNA, 27 bp, Artificial Sequences
  Synthetic
gttcgggttagggcgtagatgatggat

SEQ ID NO: 13062 - DNA, 28 bp, Artificial Sequences
  Synthetic
agttcgggttagggcgtagatgatggat

SEQ ID NO: 13063 - DNA, 28 bp, Artificial Sequences
  Synthetic
tagttcgggttagggcgtagatgatgga

SEQ ID NO: 13064 - DNA, 28 bp, Artificial Sequences
  Synthetic
gttcgggttagggcgtagatgatggatt

SEQ ID NO: 13065 - DNA, 27 bp, Artificial Sequences
  Synthetic
aggttttgttcgagggtttggagcgcg

SEQ ID NO: 13066 - DNA, 27 bp, Artificial Sequences
  Synthetic
ggttttgttcgagggtttggagcgcgc

SEQ ID NO: 13067 - DNA, 28 bp, Artificial Sequences
  Synthetic
gaggttttgttcgagggtttggagcgcg

SEQ ID NO: 13068 - DNA, 27 bp, Artificial Sequences
  Synthetic
gaggttttgttcgagggtttggagcgc

SEQ ID NO: 13069 - DNA, 26 bp, Artificial Sequences
  Synthetic
gttttgttcgagggtttggagcgcgc

SEQ ID NO: 13070 - DNA, 27 bp, Artificial Sequences
  Synthetic
ggagagtttcggtgttttcgcgagggc

SEQ ID NO: 13071 - DNA, 27 bp, Artificial Sequences
  Synthetic
gcggagagtttcggtgttttcgcgagg

SEQ ID NO: 13072 - DNA, 27 bp, Artificial Sequences
  Synthetic
ttggttgttagagcgagtgaggggcgt

SEQ ID NO: 13073 - DNA, 27 bp, Artificial Sequences
  Synthetic
cggagagtttcggtgttttcgcgaggg

SEQ ID NO: 13074 - DNA, 27 bp, Artificial Sequences
  Synthetic
tggttgttagagcgagtgaggggcgta

SEQ ID NO: 13075 - DNA, 28 bp, Artificial Sequences
  Synthetic
cgcgcggagttatgaggggtaaagaggt

SEQ ID NO: 13076 - DNA, 27 bp, Artificial Sequences
  Synthetic
cgcgcggagttatgaggggtaaagagg

SEQ ID NO: 13077 - DNA, 28 bp, Artificial Sequences
  Synthetic
tcgcgcggagttatgaggggtaaagagg

SEQ ID NO: 13078 - DNA, 27 bp, Artificial Sequences
  Synthetic
gcgcggagttatgaggggtaaagaggt

SEQ ID NO: 13079 - DNA, 27 bp, Artificial Sequences
  Synthetic
tcgcgcggagttatgaggggtaaagag

SEQ ID NO: 13080 - DNA, 27 bp, Artificial Sequences
  Synthetic
ggagagtttcggtgttttcgcgagggc

SEQ ID NO: 13081 - DNA, 27 bp, Artificial Sequences
  Synthetic
gcggagagtttcggtgttttcgcgagg

SEQ ID NO: 13082 - DNA, 27 bp, Artificial Sequences
  Synthetic
ttggttgttagagcgagtgaggggcgt

SEQ ID NO: 13083 - DNA, 27 bp, Artificial Sequences
  Synthetic
cggagagtttcggtgttttcgcgaggg

SEQ ID NO: 13084 - DNA, 27 bp, Artificial Sequences
  Synthetic
tggttgttagagcgagtgaggggcgta

SEQ ID NO: 13085 - DNA, 26 bp, Artificial Sequences
  Synthetic
ggcgggcggagaaggttcggtttttt

SEQ ID NO: 13086 - DNA, 28 bp, Artificial Sequences
  Synthetic
cgcgcggagttatgaggggtaaagaggt

SEQ ID NO: 13087 - DNA, 27 bp, Artificial Sequences
  Synthetic
cgcgcggagttatgaggggtaaagagg

SEQ ID NO: 13088 - DNA, 28 bp, Artificial Sequences
  Synthetic
tcgcgcggagttatgaggggtaaagagg

SEQ ID NO: 13089 - DNA, 27 bp, Artificial Sequences
  Synthetic
gggcgggcggagaaggttcggtttttt

SEQ ID NO: 13090 - DNA, 27 bp, Artificial Sequences
  Synthetic
ggagagtttcggtgttttcgcgagggc

SEQ ID NO: 13091 - DNA, 27 bp, Artificial Sequences
  Synthetic
gcggagagtttcggtgttttcgcgagg

SEQ ID NO: 13092 - DNA, 27 bp, Artificial Sequences
  Synthetic
cggagagtttcggtgttttcgcgaggg

SEQ ID NO: 13093 - DNA, 27 bp, Artificial Sequences
  Synthetic
tgttagagcgagtgaggggcgtagagg

SEQ ID NO: 13094 - DNA, 28 bp, Artificial Sequences
  Synthetic
ttgttagagcgagtgaggggcgtagagg

SEQ ID NO: 13095 - DNA, 26 bp, Artificial Sequences
  Synthetic
ggcgggcggagaaggttcggtttttt

SEQ ID NO: 13096 - DNA, 28 bp, Artificial Sequences
  Synthetic
cgcgcggagttatgaggggtaaagaggt

SEQ ID NO: 13097 - DNA, 27 bp, Artificial Sequences
  Synthetic
cgcgcggagttatgaggggtaaagagg

SEQ ID NO: 13098 - DNA, 26 bp, Artificial Sequences
  Synthetic
gggcgggggtgttggggatatcgtag

SEQ ID NO: 13099 - DNA, 28 bp, Artificial Sequences
  Synthetic
tcgcgcggagttatgaggggtaaagagg

SEQ ID NO: 13100 - DNA, 27 bp, Artificial Sequences
  Synthetic
ggagagtttcggtgttttcgcgagggc

SEQ ID NO: 13101 - DNA, 27 bp, Artificial Sequences
  Synthetic
gcggagagtttcggtgttttcgcgagg

SEQ ID NO: 13102 - DNA, 27 bp, Artificial Sequences
  Synthetic
cggagagtttcggtgttttcgcgaggg

SEQ ID NO: 13103 - DNA, 27 bp, Artificial Sequences
  Synthetic
tgttttttatggtttcgcgcgggagga

SEQ ID NO: 13104 - DNA, 26 bp, Artificial Sequences
  Synthetic
gcggagagtttcggtgttttcgcgag

SEQ ID NO: 13105 - DNA, 26 bp, Artificial Sequences
  Synthetic
ggcgggcggagaaggttcggtttttt

SEQ ID NO: 13106 - DNA, 28 bp, Artificial Sequences
  Synthetic
cgcgcggagttatgaggggtaaagaggt

SEQ ID NO: 13107 - DNA, 27 bp, Artificial Sequences
  Synthetic
cgcgcggagttatgaggggtaaagagg

SEQ ID NO: 13108 - DNA, 26 bp, Artificial Sequences
  Synthetic
gggcgggggtgttggggatatcgtag

SEQ ID NO: 13109 - DNA, 28 bp, Artificial Sequences
  Synthetic
tcgcgcggagttatgaggggtaaagagg

SEQ ID NO: 13110 - DNA, 26 bp, Artificial Sequences
  Synthetic
ggggttcggggattttgggggtcgag

SEQ ID NO: 13111 - DNA, 25 bp, Artificial Sequences
  Synthetic
gttcggggattttgggggtcgagcg

SEQ ID NO: 13112 - DNA, 26 bp, Artificial Sequences
  Synthetic
gggttcggggattttgggggtcgagc

SEQ ID NO: 13113 - DNA, 25 bp, Artificial Sequences
  Synthetic
ggttcggggattttgggggtcgagc

SEQ ID NO: 13114 - DNA, 26 bp, Artificial Sequences
  Synthetic
ggttcggggattttgggggtcgagcg

SEQ ID NO: 13115 - DNA, 27 bp, Artificial Sequences
  Synthetic
cggcggtgttttcgttcgggttggttt

SEQ ID NO: 13116 - DNA, 27 bp, Artificial Sequences
  Synthetic
gcggtgttttcgttcgggttggtttcg

SEQ ID NO: 13117 - DNA, 27 bp, Artificial Sequences
  Synthetic
ggcggtgttttcgttcgggttggtttc

SEQ ID NO: 13118 - DNA, 28 bp, Artificial Sequences
  Synthetic
gcggtgttttcgttcgggttggtttcgt

SEQ ID NO: 13119 - DNA, 26 bp, Artificial Sequences
  Synthetic
cggcggtgttttcgttcgggttggtt

SEQ ID NO: 13120 - DNA, 27 bp, Artificial Sequences
  Synthetic
ggggattttgggggtcgagcgaggtta

SEQ ID NO: 13121 - DNA, 27 bp, Artificial Sequences
  Synthetic
gttcggggattttgggggtcgagcgag

SEQ ID NO: 13122 - DNA, 28 bp, Artificial Sequences
  Synthetic
gggattttgggggtcgagcgaggttagt

SEQ ID NO: 13123 - DNA, 27 bp, Artificial Sequences
  Synthetic
gggattttgggggtcgagcgaggttag

SEQ ID NO: 13124 - DNA, 28 bp, Artificial Sequences
  Synthetic
ggggattttgggggtcgagcgaggttag

SEQ ID NO: 13125 - DNA, 28 bp, Artificial Sequences
  Synthetic
gcgttttgagtttcggtttggtcgtagc

SEQ ID NO: 13126 - DNA, 29 bp, Artificial Sequences
  Synthetic
agcgttttgagtttcggtttggtcgtagc

SEQ ID NO: 13127 - DNA, 28 bp, Artificial Sequences
  Synthetic
agcgttttgagtttcggtttggtcgtag

SEQ ID NO: 13128 - DNA, 26 bp, Artificial Sequences
  Synthetic
agcgttttgagtttcggtttggtcgt

SEQ ID NO: 13129 - DNA, 34 bp, Artificial Sequences
  Synthetic
cgtgtttttattagggttgatatcggttcgtcgg

SEQ ID NO: 13130 - DNA, 27 bp, Artificial Sequences
  Synthetic
ggggattttgggggtcgagcgaggtta

SEQ ID NO: 13131 - DNA, 27 bp, Artificial Sequences
  Synthetic
tcggcgataggggggaatttcgttggg

SEQ ID NO: 13132 - DNA, 27 bp, Artificial Sequences
  Synthetic
gtcggcgataggggggaatttcgttgg

SEQ ID NO: 13133 - DNA, 27 bp, Artificial Sequences
  Synthetic
gttcggggattttgggggtcgagcgag

SEQ ID NO: 13134 - DNA, 28 bp, Artificial Sequences
  Synthetic
gggattttgggggtcgagcgaggttagt

SEQ ID NO: 13135 - DNA, 28 bp, Artificial Sequences
  Synthetic
gcgttttgagtttcggtttggtcgtagt

SEQ ID NO: 13136 - DNA, 29 bp, Artificial Sequences
  Synthetic
agcgttttgagtttcggtttggtcgtagt

SEQ ID NO: 13137 - DNA, 28 bp, Artificial Sequences
  Synthetic
agcgttttgagtttcggtttggtcgtag

SEQ ID NO: 13138 - DNA, 26 bp, Artificial Sequences
  Synthetic
agcgttttgagtttcggtttggtcgt

SEQ ID NO: 13139 - DNA, 34 bp, Artificial Sequences; identical to SEQ ID NO: 13129
  Synthetic

SEQ ID NO: 13140 - DNA, 27 bp, Artificial Sequences
  Synthetic
ggggattttgggggtcgagcgaggtta

SEQ ID NO: 13141 - DNA, 27 bp, Artificial Sequences
  Synthetic
taggtcggggtttagggcgttgggttg

SEQ ID NO: 13142 - DNA, 27 bp, Artificial Sequences
  Synthetic
gttaggtcggggtttagggcgttgggt

SEQ ID NO: 13143 - DNA, 27 bp, Artificial Sequences
  Synthetic
gggtttagggcgttgggttgtgcgttt

SEQ ID NO: 13144 - DNA, 27 bp, Artificial Sequences
  Synthetic
tcggcgataggggggaatttcgttggg

SEQ ID NO: 13145 - DNA, 27 bp, Artificial Sequences
  Synthetic
tgggaaaggtgggttggggagaaaggg

SEQ ID NO: 13146 - DNA, 27 bp, Artificial Sequences
  Synthetic
aaggtgggttggggagaaagggcgtag

SEQ ID NO: 13147 - DNA, 27 bp, Artificial Sequences
  Synthetic
ggtgggttggggagaaagggcgtagag

SEQ ID NO: 13148 - DNA, 27 bp, Artificial Sequences
  Synthetic
aaaggtgggttggggagaaagggcgta

SEQ ID NO: 13149 - DNA, 27 bp, Artificial Sequences
  Synthetic
gaaaggtgggttggggagaaagggcgt

SEQ ID NO: 13150 - DNA, 25 bp, Artificial Sequences
  Synthetic
gtggagtggggacggcggggtatag

SEQ ID NO: 13151 - DNA, 25 bp, Artificial Sequences
  Synthetic
gagtggggacggcggggtataggac

SEQ ID NO: 13152 - DNA, 27 bp, Artificial Sequences
  Synthetic
tggagtggggacggcggggtataggac

SEQ ID NO: 13153 - DNA, 27 bp, Artificial Sequences
  Synthetic
gtggagtggggacggcggggtatagga

SEQ ID NO: 13154 - DNA, 26 bp, Artificial Sequences
  Synthetic
ggagtggggacggcggggtataggac

SEQ ID NO: 13155 - DNA, 22 bp, Artificial Sequences
  Synthetic
cggggtcgttttttgcggggtc

SEQ ID NO: 13156 - DNA, 21 bp, Artificial Sequences
  Synthetic
cggggtcgttttttgcggggt

SEQ ID NO: 13157 - DNA, 34 bp, Artificial Sequences
  Synthetic
ggcgttcgtagtattaagttgttggtttttgagt

SEQ ID NO: 13158 - DNA, 34 bp, Artificial Sequences
  Synthetic
tggcgttcgtagtattaagttgttggtttttgag

SEQ ID NO: 13159 - DNA, 35 bp, Artificial Sequences
  Synthetic
tggcgttcgtagtattaagttgttggtttttgagt

SEQ ID NO: 13160 - DNA, 31 bp, Artificial Sequences
  Synthetic
tgtcgggttaaacgtcgttatattgttgggt

SEQ ID NO: 13161 - DNA, 31 bp, Artificial Sequences
  Synthetic
gtgtcgggttaaacgtcgttatattgttggg

SEQ ID NO: 13162 - DNA, 32 bp, Artificial Sequences
  Synthetic
gtgtcgggttaaacgtcgttatattgttgggt

SEQ ID NO: 13163 - DNA, 32 bp, Artificial Sequences
  Synthetic
tgtgtcgggttaaacgtcgttatattgttggg

SEQ ID NO: 13164 - DNA, 33 bp, Artificial Sequences
  Synthetic
tgtgtcgggttaaacgtcgttatattgttgggt

SEQ ID NO: 13165 - DNA, 27 bp, Artificial Sequences
  Synthetic
gtgggttttgtttggtaagtgcgcggt

SEQ ID NO: 13166 - DNA, 28 bp, Artificial Sequences
  Synthetic
agtgggttttgtttggtaagtgcgcggt

SEQ ID NO: 13167 - DNA, 27 bp, Artificial Sequences
  Synthetic
agtgggttttgtttggtaagtgcgcgg

SEQ ID NO: 13168 - DNA, 27 bp, Artificial Sequences
  Synthetic
tgggttttgtttggtaagtgcgcggtt

SEQ ID NO: 13169 - DNA, 28 bp, Artificial Sequences
  Synthetic
gtgggttttgtttggtaagtgcgcggtt

SEQ ID NO: 13170 - DNA, 27 bp, Artificial Sequences
  Synthetic
gttgttggttggaagcggtcgggaagc

SEQ ID NO: 13171 - DNA, 27 bp, Artificial Sequences
  Synthetic
tgttgttggttggaagcggtcgggaag

SEQ ID NO: 13172 - DNA, 27 bp, Artificial Sequences
  Synthetic
ttgttgttggttggaagcggtcgggaa

SEQ ID NO: 13173 - DNA, 27 bp, Artificial Sequences
  Synthetic
tttgttgttggttggaagcggtcggga

SEQ ID NO: 13174 - DNA, 26 bp, Artificial Sequences
  Synthetic
ttgttggttggaagcggtcgggaagc

SEQ ID NO: 13175 - DNA, 33 bp, Artificial Sequences
  Synthetic
tggagtcgtgtggtattgtttatgttatagcga

SEQ ID NO: 13176 - DNA, 34 bp, Artificial Sequences
  Synthetic
ggagtcgtgtggtattgtttatgttatagcgagt

SEQ ID NO: 13177 - DNA, 34 bp, Artificial Sequences
  Synthetic
tggagtcgtgtggtattgtttatgttatagcgag

SEQ ID NO: 13178 - DNA, 35 bp, Artificial Sequences
  Synthetic
tggagtcgtgtggtattgtttatgttatagcgagt

SEQ ID NO: 13179 - DNA, 34 bp, Artificial Sequences
  Synthetic
ttggagtcgtgtggtattgtttatgttatagcga

SEQ ID NO: 13180 - DNA, 27 bp, Artificial Sequences
  Synthetic
gtgtggtcgagcggtttaaggcgttgg

SEQ ID NO: 13181 - DNA, 27 bp, Artificial Sequences
  Synthetic
tgtggtcgagcggtttaaggcgttgga

SEQ ID NO: 13182 - DNA, 27 bp, Artificial Sequences
  Synthetic
agtgtggtcgagcggtttaaggcgttg

SEQ ID NO: 13183 - DNA, 27 bp, Artificial Sequences
  Synthetic
cgtgtgtggtagtgtggtcgagcggtt

SEQ ID NO: 13184 - DNA, 27 bp, Artificial Sequences
  Synthetic
aacgtgtgtggtagtgtggtcgagcgg

SEQ ID NO: 13185 - DNA, 35 bp, Artificial Sequences
  Synthetic
acgtattattggtagtggtgggattcgaatttacg

SEQ ID NO: 13186 - DNA, 35 bp, Artificial Sequences
  Synthetic
tgttgtgttaaaacgtattattggtagtggtggga

SEQ ID NO: 13187 - DNA, 35 bp, Artificial Sequences
  Synthetic
tgttaaaacgtattattggtagtggtgggattcga

SEQ ID NO: 13188 - DNA, 35 bp, Artificial Sequences
  Synthetic
gtgttaaaacgtattattggtagtggtgggattcg

SEQ ID NO: 13189 - DNA, 36 bp, Artificial Sequences
  Synthetic
tgtgttaaaacgtattattggtagtggtgggattcg

SEQ ID NO: 13190 - DNA, 29 bp, Artificial Sequences
  Synthetic
cggttaggtagggaggttttttcgttcgc

SEQ ID NO: 13191 - DNA, 30 bp, Artificial Sequences
  Synthetic
tcggttaggtagggaggttttttcgttcgc

SEQ ID NO: 13192 - DNA, 28 bp, Artificial Sequences
  Synthetic
ggttaggtagggaggttttttcgttcgc

SEQ ID NO: 13193 - DNA, 29 bp, Artificial Sequences
  Synthetic
tcggttaggtagggaggttttttcgttcg

SEQ ID NO: 13194 - DNA, 31 bp, Artificial Sequences
  Synthetic
ttcggttaggtagggaggttttttcgttcgc

SEQ ID NO: 13195 - DNA, 34 bp, Artificial Sequences
  Synthetic
gttagtataacggataaagtaggagatcgcgagc

SEQ ID NO: 13196 - DNA, 35 bp, Artificial Sequences
  Synthetic
agttagtataacggataaagtaggagatcgcgagc

SEQ ID NO: 13197 - DNA, 35 bp, Artificial Sequences
  Synthetic
gcgggaatttaaatggtgtagtgtaaaaattgggg

SEQ ID NO: 13198 - DNA, 36 bp, Artificial Sequences
  Synthetic
gcgggaatttaaatggtgtagtgtaaaaattggggt

SEQ ID NO: 13199 - DNA, 36 bp, Artificial Sequences
  Synthetic
tgcgggaatttaaatggtgtagtgtaaaaattgggg

SEQ ID NO: 13200 - DNA, 30 bp, Artificial Sequences
  Synthetic
cgcggtcggtattgttttaggagttgtagt

SEQ ID NO: 13201 - DNA, 31 bp, Artificial Sequences
  Synthetic
cgcggtcggtattgttttaggagttgtagtt

SEQ ID NO: 13202 - DNA, 32 bp, Artificial Sequences
  Synthetic
cgcggtcggtattgttttaggagttgtagttt

SEQ ID NO: 13203 - DNA, 33 bp, Artificial Sequences
  Synthetic
cgcggtcggtattgttttaggagttgtagtttt

SEQ ID NO: 13204 - DNA, 34 bp, Artificial Sequences
  Synthetic
cgcggtcggtattgttttaggagttgtagttttg

SEQ ID NO: 13205 - DNA, 34 bp, Artificial Sequences
  Synthetic
agggtttaggtaggatatttcgcgagtatagagt

SEQ ID NO: 13206 - DNA, 35 bp, Artificial Sequences
  Synthetic
agggtttaggtaggatatttcgcgagtatagagtt

SEQ ID NO: 13207 - DNA, 35 bp, Artificial Sequences
  Synthetic
gggtttaggtaggatatttcgcgagtatagagttg

SEQ ID NO: 13208 - DNA, 36 bp, Artificial Sequences
  Synthetic
gggtttaggtaggatatttcgcgagtatagagttgt

SEQ ID NO: 13209 - DNA, 36 bp, Artificial Sequences
  Synthetic
agggtttaggtaggatatttcgcgagtatagagttg

SEQ ID NO: 13210 - DNA, 27 bp, Artificial Sequences
  Synthetic
cgggaaggagggagttaggatttcggt

SEQ ID NO: 13211 - DNA, 28 bp, Artificial Sequences
  Synthetic
tcgggaaggagggagttaggatttcggt

SEQ ID NO: 13212 - DNA, 27 bp, Artificial Sequences
  Synthetic
tcgggaaggagggagttaggatttcgg

SEQ ID NO: 13213 - DNA, 28 bp, Artificial Sequences
  Synthetic
cgggaaggagggagttaggatttcggtt

SEQ ID NO: 13214 - DNA, 29 bp, Artificial Sequences
  Synthetic
tcgggaaggagggagttaggatttcggtt

SEQ ID NO: 13215 - DNA, 28 bp, Artificial Sequences
  Synthetic
cggtagtcgttgggaaatagagggaggg

SEQ ID NO: 13216 - DNA, 27 bp, Artificial Sequences
  Synthetic
agtcgttgggaaatagagggagggagt

SEQ ID NO: 13217 - DNA, 29 bp, Artificial Sequences
  Synthetic
cggtagtcgttgggaaatagagggaggga

SEQ ID NO: 13218 - DNA, 27 bp, Artificial Sequences
  Synthetic
cggtagtcgttgggaaatagagggagg

SEQ ID NO: 13219 - DNA, 30 bp, Artificial Sequences
  Synthetic
cggtagtcgttgggaaatagagggagggag

SEQ ID NO: 13220 - DNA, 27 bp, Artificial Sequences
  Synthetic
tagttgcgtcgtgggttcggttagcga

SEQ ID NO: 13221 - DNA, 27 bp, Artificial Sequences
  Synthetic
tcgtgggttcggttagcgagagttggg

SEQ ID NO: 13222 - DNA, 27 bp, Artificial Sequences
  Synthetic
gtgggttcggttagcgagagttggggt

SEQ ID NO: 13223 - DNA, 27 bp, Artificial Sequences
  Synthetic
gtagttgcgtcgtgggttcggttagcg

SEQ ID NO: 13224 - DNA, 27 bp, Artificial Sequences
  Synthetic
cgtagttgcgtcgtgggttcggttagc

SEQ ID NO: 13225 - DNA, 28 bp, Artificial Sequences
  Synthetic
gggatttagaggggtagggcggattggt

SEQ ID NO: 13226 - DNA, 27 bp, Artificial Sequences
  Synthetic
gggatttagaggggtagggcggattgg

SEQ ID NO: 13227 - DNA, 27 bp, Artificial Sequences
  Synthetic
ggatttagaggggtagggcggattggt

SEQ ID NO: 13228 - DNA, 27 bp, Artificial Sequences
  Synthetic
gaggggtagggcggattggttagaagt

SEQ ID NO: 13229 - DNA, 28 bp, Artificial Sequences
  Synthetic
agaggggtagggcggattggttagaagt

SEQ ID NO: 13230 - DNA, 27 bp, Artificial Sequences
  Synthetic
cgggtttgcggtaagggtaggcgtttg

SEQ ID NO: 13231 - DNA, 27 bp, Artificial Sequences
  Synthetic
tattagggtgggaggggacgttcgggt

SEQ ID NO: 13232 - DNA, 27 bp, Artificial Sequences
  Synthetic
gggtttgcggtaagggtaggcgtttgg

SEQ ID NO: 13233 - DNA, 27 bp, Artificial Sequences
  Synthetic
tcgggtttgcggtaagggtaggcgttt

SEQ ID NO: 13234 - DNA, 27 bp, Artificial Sequences
  Synthetic
ttcgggtttgcggtaagggtaggcgtt

SEQ ID NO: 13235 - DNA, 27 bp, Artificial Sequences
  Synthetic
ttcgtcgggatttagaggggtagggcg

SEQ ID NO: 13236 - DNA, 27 bp, Artificial Sequences
  Synthetic
cgtcgggatttagaggggtagggcgga

SEQ ID NO: 13237 - DNA, 27 bp, Artificial Sequences
  Synthetic
tcgtcgggatttagaggggtagggcgg

SEQ ID NO: 13238 - DNA, 27 bp, Artificial Sequences
  Synthetic
gtcgggatttagaggggtagggcggat

SEQ ID NO: 13239 - DNA, 26 bp, Artificial Sequences
  Synthetic
cgtcgggatttagaggggtagggcgg

SEQ ID NO: 13240 - DNA, 27 bp, Artificial Sequences
  Synthetic
cgggtttgcggtaagggtaggcgtttg

SEQ ID NO: 13241 - DNA, 27 bp, Artificial Sequences
  Synthetic
gggtttgcggtaagggtaggcgtttgg

SEQ ID NO: 13242 - DNA, 27 bp, Artificial Sequences
  Synthetic
cggcgggtcggttgcgttttaggttta

SEQ ID NO: 13243 - DNA, 27 bp, Artificial Sequences
  Synthetic
ttcgggtttgcggtaagggtaggcgtt

SEQ ID NO: 13244 - DNA, 27 bp, Artificial Sequences
  Synthetic
gggacgttaggttgggcggtttgtgtt

SEQ ID NO: 13245 - DNA, 27 bp, Artificial Sequences
  Synthetic
gcggtcgcgtcgttttagttttcggtt

SEQ ID NO: 13246 - DNA, 26 bp, Artificial Sequences
  Synthetic
gcggtcgcgtcgttttagttttcggt

SEQ ID NO: 13247 - DNA, 27 bp, Artificial Sequences
  Synthetic
tgcgcgttaaggtttgggtttcgtagt

SEQ ID NO: 13248 - DNA, 28 bp, Artificial Sequences
  Synthetic
gcggtcgcgtcgttttagttttcggtta

SEQ ID NO: 13249 - DNA, 27 bp, Artificial Sequences
  Synthetic
ttttgcgcgttaaggtttgggtttcgt

SEQ ID NO: 13250 - DNA, 27 bp, Artificial Sequences
  Synthetic
tcgggtgatcggaaataggtaggcgga

SEQ ID NO: 13251 - DNA, 27 bp, Artificial Sequences
  Synthetic
cgggtgatcggaaataggtaggcggag

SEQ ID NO: 13252 - DNA, 28 bp, Artificial Sequences
  Synthetic
cgggtgatcggaaataggtaggcggaga

SEQ ID NO: 13253 - DNA, 28 bp, Artificial Sequences
  Synthetic
tcgggtgatcggaaataggtaggcggag

SEQ ID NO: 13254 - DNA, 29 bp, Artificial Sequences
  Synthetic
tcgggtgatcggaaataggtaggcggaga

SEQ ID NO: 13255 - DNA, 27 bp, Artificial Sequences
  Synthetic
agaatggtagcgggttgggtcgggttc

SEQ ID NO: 13256 - DNA, 27 bp, Artificial Sequences
  Synthetic
tagaatggtagcgggttgggtcgggtt

SEQ ID NO: 13257 - DNA, 27 bp, Artificial Sequences
  Synthetic
ttagaatggtagcgggttgggtcgggt

SEQ ID NO: 13258 - DNA, 27 bp, Artificial Sequences
  Synthetic
tgcgagagtaggggaggggtttgttgt

SEQ ID NO: 13259 - DNA, 28 bp, Artificial Sequences
  Synthetic
gttagaatggtagcgggttgggtcgggt

SEQ ID NO: 13260 - DNA, 27 bp, Artificial Sequences
  Synthetic
tcgtagggtttcggtcgtgtcgttgtc

SEQ ID NO: 13261 - DNA, 27 bp, Artificial Sequences
  Synthetic
ttcgtagggtttcggtcgtgtcgttgt

SEQ ID NO: 13262 - DNA, 28 bp, Artificial Sequences
  Synthetic
ttcgtagggtttcggtcgtgtcgttgtc

SEQ ID NO: 13263 - DNA, 28 bp, Artificial Sequences
  Synthetic
tttcgtagggtttcggtcgtgtcgttgt

SEQ ID NO: 13264 - DNA, 27 bp, Artificial Sequences
  Synthetic
tttcgtagggtttcggtcgtgtcgttg

SEQ ID NO: 13265 - DNA, 27 bp, Artificial Sequences
  Synthetic
agaatggtagcgggttgggtcgggttc

SEQ ID NO: 13266 - DNA, 27 bp, Artificial Sequences
  Synthetic
tagaatggtagcgggttgggtcgggtt

SEQ ID NO: 13267 - DNA, 27 bp, Artificial Sequences
  Synthetic
ttagaatggtagcgggttgggtcgggt

SEQ ID NO: 13268 - DNA, 28 bp, Artificial Sequences
  Synthetic
gttagaatggtagcgggttgggtcgggt

SEQ ID NO: 13269 - DNA, 26 bp, Artificial Sequences
  Synthetic
agaatggtagcgggttgggtcgggtt

SEQ ID NO: 13270 - DNA, 28 bp, Artificial Sequences
  Synthetic
tgatgagaaggtggagaggttgtcgggt

SEQ ID NO: 13271 - DNA, 27 bp, Artificial Sequences
  Synthetic
gatgagaaggtggagaggttgtcgggt

SEQ ID NO: 13272 - DNA, 27 bp, Artificial Sequences
  Synthetic
tgatgagaaggtggagaggttgtcggg

SEQ ID NO: 13273 - DNA, 27 bp, Artificial Sequences
  Synthetic
atgagaaggtggagaggttgtcgggtt

SEQ ID NO: 13274 - DNA, 27 bp, Artificial Sequences
  Synthetic
tgagaaggtggagaggttgtcgggtta

SEQ ID NO: 13275 - DNA, 27 bp, Artificial Sequences
  Synthetic
cgggaggggatggcggttaaaaggagt

SEQ ID NO: 13276 - DNA, 27 bp, Artificial Sequences
  Synthetic
gttgcgggaggggatggcggttaaaag

SEQ ID NO: 13277 - DNA, 27 bp, Artificial Sequences
  Synthetic
tgcggtttggatttggagggattgcgg

SEQ ID NO: 13278 - DNA, 27 bp, Artificial Sequences
  Synthetic
tggtgggagaggaggataggaggcgtt

SEQ ID NO: 13279 - DNA, 27 bp, Artificial Sequences
  Synthetic
ttggtgggagaggaggataggaggcgt

SEQ ID NO: 13280 - DNA, 27 bp, Artificial Sequences
  Synthetic
ttgtaggggttagcggtttagggcgga

SEQ ID NO: 13281 - DNA, 27 bp, Artificial Sequences
  Synthetic
tgtaggggttagcggtttagggcggat

SEQ ID NO: 13282 - DNA, 27 bp, Artificial Sequences
  Synthetic
tttgtaggggttagcggtttagggcgg

SEQ ID NO: 13283 - DNA, 28 bp, Artificial Sequences
  Synthetic
tttgtaggggttagcggtttagggcgga

SEQ ID NO: 13284 - DNA, 27 bp, Artificial Sequences
  Synthetic
aggggttagcggtttagggcggatttt

SEQ ID NO: 13285 - DNA, 23 bp, Artificial Sequences
  Synthetic
gcgtttagggcgagggagggttt

SEQ ID NO: 13286 - DNA, 30 bp, Artificial Sequences
  Synthetic
tcgttttgtagggtaagcggttagttgagt

SEQ ID NO: 13287 - DNA, 31 bp, Artificial Sequences
  Synthetic
ttcgttttgtagggtaagcggttagttgagt

SEQ ID NO: 13288 - DNA, 22 bp, Artificial Sequences
  Synthetic
gcgtttagggcgagggagggtt

SEQ ID NO: 13289 - DNA, 32 bp, Artificial Sequences
  Synthetic
tcgttttgtagggtaagcggttagttgagttt

SEQ ID NO: 13290 - DNA, 27 bp, Artificial Sequences
  Synthetic
gcgggcgtttggtgggtatttcggttt

SEQ ID NO: 13291 - DNA, 27 bp, Artificial Sequences
  Synthetic
ggtacggggttggttgtagtggtcggc

SEQ ID NO: 13292 - DNA, 27 bp, Artificial Sequences
  Synthetic
gtacggggttggttgtagtggtcggcg

SEQ ID NO: 13293 - DNA, 26 bp, Artificial Sequences
  Synthetic
gcgggcgtttggtgggtatttcggtt

SEQ ID NO: 13294 - DNA, 28 bp, Artificial Sequences
  Synthetic
gcgggcgtttggtgggtatttcggtttt

SEQ ID NO: 13295 - DNA, 28 bp, Artificial Sequences
  Synthetic
ggcgttcgttgggataaattttcgggcg

SEQ ID NO: 13296 - DNA, 28 bp, Artificial Sequences
  Synthetic
cggcgttcgttgggataaattttcgggc

SEQ ID NO: 13297 - DNA, 29 bp, Artificial Sequences
  Synthetic
ggcgttcgttgggataaattttcgggcga

SEQ ID NO: 13298 - DNA, 27 bp, Artificial Sequences
  Synthetic
gcgttcgttgggataaattttcgggcg

SEQ ID NO: 13299 - DNA, 28 bp, Artificial Sequences
  Synthetic
gcgttcgttgggataaattttcgggcga

SEQ ID NO: 13300 - DNA, 27 bp, Artificial Sequences
  Synthetic
tttcggggcgcggcgtaggatataaga

SEQ ID NO: 13301 - DNA, 27 bp, Artificial Sequences
  Synthetic
ggtttcggggcgcggcgtaggatataa

SEQ ID NO: 13302 - DNA, 27 bp, Artificial Sequences
  Synthetic
tcggggcgcggcgtaggatataagatt

SEQ ID NO: 13303 - DNA, 27 bp, Artificial Sequences
  Synthetic
ttcggggcgcggcgtaggatataagat

SEQ ID NO: 13304 - DNA, 27 bp, Artificial Sequences
  Synthetic
gttgtgtagttggaagggcgcgcgata

SEQ ID NO: 13305 - DNA, 27 bp, Artificial Sequences
  Synthetic
tcgaggtgagtgcgttttgtcggggat

SEQ ID NO: 13306 - DNA, 27 bp, Artificial Sequences
  Synthetic
atcgaggtgagtgcgttttgtcgggga

SEQ ID NO: 13307 - DNA, 27 bp, Artificial Sequences
  Synthetic
gatcgaggtgagtgcgttttgtcgggg

SEQ ID NO: 13308 - DNA, 27 bp, Artificial Sequences
  Synthetic
ggatcgaggtgagtgcgttttgtcggg

SEQ ID NO: 13309 - DNA, 27 bp, Artificial Sequences
  Synthetic
gggatcgaggtgagtgcgttttgtcgg

SEQ ID NO: 13310 - DNA, 27 bp, Artificial Sequences
  Synthetic
tttcggggcgcggcgtaggatataaga

SEQ ID NO: 13311 - DNA, 27 bp, Artificial Sequences
  Synthetic
ggtttcggggcgcggcgtaggatataa

SEQ ID NO: 13312 - DNA, 27 bp, Artificial Sequences
  Synthetic
tcggggcgcggcgtaggatataagatt

SEQ ID NO: 13313 - DNA, 27 bp, Artificial Sequences
  Synthetic
ttcggggcgcggcgtaggatataagat

SEQ ID NO: 13314 - DNA, 27 bp, Artificial Sequences
  Synthetic
gtttcggggcgcggcgtaggatataag

SEQ ID NO: 13315 - DNA, 27 bp, Artificial Sequences
  Synthetic
ttgcgggtaggtttagggttcggaggg

SEQ ID NO: 13316 - DNA, 27 bp, Artificial Sequences
  Synthetic
cgggtaggtttagggttcggagggggt

SEQ ID NO: 13317 - DNA, 27 bp, Artificial Sequences
  Synthetic
gggtaggtttagggttcggagggggtt

SEQ ID NO: 13318 - DNA, 26 bp, Artificial Sequences
  Synthetic
gcgggtaggtttagggttcggagggg

SEQ ID NO: 13319 - DNA, 27 bp, Artificial Sequences
  Synthetic
tgcgggtaggtttagggttcggagggg

SEQ ID NO: 13320 - DNA, 27 bp, Artificial Sequences
  Synthetic
ggttttgggtttgttcgtaggagcgcg

SEQ ID NO: 13321 - DNA, 28 bp, Artificial Sequences
  Synthetic
gggttttgggtttgttcgtaggagcgcg

SEQ ID NO: 13322 - DNA, 28 bp, Artificial Sequences
  Synthetic
cgggttttgggtttgttcgtaggagcgc

SEQ ID NO: 13323 - DNA, 27 bp, Artificial Sequences
  Synthetic
gggttttgggtttgttcgtaggagcgc

SEQ ID NO: 13324 - DNA, 27 bp, Artificial Sequences
  Synthetic
cgggttttgggtttgttcgtaggagcg

SEQ ID NO: 13325 - DNA, 27 bp, Artificial Sequences
  Synthetic
gcggtaggcggtcgaggaggtttgtat

SEQ ID NO: 13326 - DNA, 27 bp, Artificial Sequences
  Synthetic
ttgcgggtaggtttagggttcggaggg

SEQ ID NO: 13327 - DNA, 27 bp, Artificial Sequences
  Synthetic
tttggtaggcgttttggttcgggtcgg

SEQ ID NO: 13328 - DNA, 27 bp, Artificial Sequences
  Synthetic
cgaggtggggcgtttagtatcgtgcgt

SEQ ID NO: 13329 - DNA, 27 bp, Artificial Sequences
  Synthetic
gcggggttttagagaatgaggtcggcg

SEQ ID NO: 13330 - DNA, 27 bp, Artificial Sequences
  Synthetic
gtacggtcggtagtggggtgttcgtcg

SEQ ID NO: 13331 - DNA, 26 bp, Artificial Sequences
  Synthetic
tacggtcggtagtggggtgttcgtcg

SEQ ID NO: 13332 - DNA, 27 bp, Artificial Sequences
  Synthetic
acggtcggtagtggggtgttcgtcgtc

SEQ ID NO: 13333 - DNA, 26 bp, Artificial Sequences
  Synthetic
cggtcggtagtggggtgttcgtcgtc

SEQ ID NO: 13334 - DNA, 25 bp, Artificial Sequences
  Synthetic
cggtcggtagtggggtgttcgtcgt

SEQ ID NO: 13335 - DNA, 27 bp, Artificial Sequences
  Synthetic
gttgggagtagttttgcgtgcggggtt

SEQ ID NO: 13336 - DNA, 27 bp, Artificial Sequences
  Synthetic
aagttgggagtagttttgcgtgcgggg

SEQ ID NO: 13337 - DNA, 27 bp, Artificial Sequences
  Synthetic
tttggtaggcgttttggttcgggtcgg

SEQ ID NO: 13338 - DNA, 27 bp, Artificial Sequences
  Synthetic
agttgggagtagttttgcgtgcggggt

SEQ ID NO: 13339 - DNA, 27 bp, Artificial Sequences
  Synthetic
gcggggttttagagaatgaggtcggcg

SEQ ID NO: 13340 - DNA, 27 bp, Artificial Sequences
  Synthetic
gtttgtttgatcgcgcggaggaggagg

SEQ ID NO: 13341 - DNA, 27 bp, Artificial Sequences
  Synthetic
tttgtttgatcgcgcggaggaggaggg

SEQ ID NO: 13342 - DNA, 27 bp, Artificial Sequences
  Synthetic
agtttgtttgatcgcgcggaggaggag

SEQ ID NO: 13343 - DNA, 28 bp, Artificial Sequences
  Synthetic
agtttgtttgatcgcgcggaggaggagg

SEQ ID NO: 13344 - DNA, 27 bp, Artificial Sequences
  Synthetic
tagtttgtttgatcgcgcggaggagga

SEQ ID NO: 13345 - DNA, 27 bp, Artificial Sequences
  Synthetic
ttaggtaggttggtacggcgggggaga

SEQ ID NO: 13346 - DNA, 27 bp, Artificial Sequences
  Synthetic
atgcggtcgtttggtagttttgcgcgt

SEQ ID NO: 13347 - DNA, 27 bp, Artificial Sequences
  Synthetic
gttaggtaggttggtacggcgggggag

SEQ ID NO: 13348 - DNA, 27 bp, Artificial Sequences
  Synthetic
tgcggtcgtttggtagttttgcgcgtt

SEQ ID NO: 13349 - DNA, 27 bp, Artificial Sequences
  Synthetic
ttcgcgcggttaggtaggttggtacgg

SEQ ID NO: 13350 - DNA, 27 bp, Artificial Sequences
  Synthetic
gtttgtttgatcgcgcggaggaggagg

SEQ ID NO: 13351 - DNA, 27 bp, Artificial Sequences
  Synthetic
ttcggattgtagttttcgcggcggtgg

SEQ ID NO: 13352 - DNA, 27 bp, Artificial Sequences
  Synthetic
tttgtttgatcgcgcggaggaggaggg

SEQ ID NO: 13353 - DNA, 27 bp, Artificial Sequences
  Synthetic
agtttgtttgatcgcgcggaggaggag

SEQ ID NO: 13354 - DNA, 28 bp, Artificial Sequences
  Synthetic
tttcggattgtagttttcgcggcggtgg

SEQ ID NO: 13355 - DNA, 27 bp, Artificial Sequences
  Synthetic
cggttaggggtggatcgggcggtattt

SEQ ID NO: 13356 - DNA, 27 bp, Artificial Sequences
  Synthetic
atgcggtcgtttggtagttttgcgcgt

SEQ ID NO: 13357 - DNA, 27 bp, Artificial Sequences
  Synthetic
tgcggtcgtttggtagttttgcgcgtt

SEQ ID NO: 13358 - DNA, 27 bp, Artificial Sequences
  Synthetic
gatgcggtcgtttggtagttttgcgcg

SEQ ID NO: 13359 - DNA, 27 bp, Artificial Sequences
  Synthetic
gcggtcgtttggtagttttgcgcgttt

SEQ ID NO: 13360 - DNA, 27 bp, Artificial Sequences
  Synthetic
cgtggtcgtttggtgggatatggtcga

SEQ ID NO: 13361 - DNA, 28 bp, Artificial Sequences
  Synthetic
cgtggtcgtttggtgggatatggtcgat

SEQ ID NO: 13362 - DNA, 28 bp, Artificial Sequences
  Synthetic
gcgtaggattgttaggcggtcgtatcgt

SEQ ID NO: 13363 - DNA, 28 bp, Artificial Sequences
  Synthetic
ggtcgtttggtgggatatggtcgatcgt

SEQ ID NO: 13364 - DNA, 28 bp, Artificial Sequences
  Synthetic
tggtcgtttggtgggatatggtcgatcg

SEQ ID NO: 13365 - DNA, 27 bp, Artificial Sequences
  Synthetic
cggttaggggtggatcgggcggtattt

SEQ ID NO: 13366 - DNA, 27 bp, Artificial Sequences
  Synthetic
tcggttaggggtggatcgggcggtatt

SEQ ID NO: 13367 - DNA, 27 bp, Artificial Sequences
  Synthetic
ttcggttaggggtggatcgggcggtat

SEQ ID NO: 13368 - DNA, 26 bp, Artificial Sequences
  Synthetic
cggttaggggtggatcgggcggtatt

SEQ ID NO: 13369 - DNA, 28 bp, Artificial Sequences
  Synthetic
gggttcgggttagtagaggggattgcgg

SEQ ID NO: 13370 - DNA, 27 bp, Artificial Sequences
  Synthetic
cgtggtcgtttggtgggatatggtcga

SEQ ID NO: 13371 - DNA, 28 bp, Artificial Sequences
  Synthetic
cgtggtcgtttggtgggatatggtcgat

SEQ ID NO: 13372 - DNA, 28 bp, Artificial Sequences
  Synthetic
ggtcgtttggtgggatatggtcgatcgt

SEQ ID NO: 13373 - DNA, 28 bp, Artificial Sequences
  Synthetic
tggtcgtttggtgggatatggtcgatcg

SEQ ID NO: 13374 - DNA, 29 bp, Artificial Sequences
  Synthetic
tggtcgtttggtgggatatggtcgatcgt

SEQ ID NO: 13375 - DNA, 28 bp, Artificial Sequences
  Synthetic
gggttcgggttagtagaggggattgcgg

SEQ ID NO: 13376 - DNA, 27 bp, Artificial Sequences
  Synthetic
ttcgcgtagtttgagtcgtcggggttt

SEQ ID NO: 13377 - DNA, 27 bp, Artificial Sequences
  Synthetic
tttcgcgtagtttgagtcgtcggggtt

SEQ ID NO: 13378 - DNA, 27 bp, Artificial Sequences
  Synthetic
ttttcgcgtagtttgagtcgtcggggt

SEQ ID NO: 13379 - DNA, 28 bp, Artificial Sequences
  Synthetic
ggttcgggttagtagaggggattgcggt

SEQ ID NO: 13380 - DNA, 27 bp, Artificial Sequences
  Synthetic
tttcgacggtttaggttgcgcggggat

SEQ ID NO: 13381 - DNA, 27 bp, Artificial Sequences
  Synthetic
gtttaggttgcgcggggatggggtagg

SEQ ID NO: 13382 - DNA, 27 bp, Artificial Sequences
  Synthetic
ggtttaggttgcgcggggatggggtag

SEQ ID NO: 13383 - DNA, 27 bp, Artificial Sequences
  Synthetic
ttcgacggtttaggttgcgcggggatg

SEQ ID NO: 13384 - DNA, 27 bp, Artificial Sequences
  Synthetic
gtttcgacggtttaggttgcgcgggga

SEQ ID NO: 13385 - DNA, 28 bp, Artificial Sequences
  Synthetic
gggttcgggttagtagaggggattgcgg

SEQ ID NO: 13386 - DNA, 28 bp, Artificial Sequences
  Synthetic
ggttcgggttagtagaggggattgcggt

SEQ ID NO: 13387 - DNA, 28 bp, Artificial Sequences
  Synthetic
tgggttcgggttagtagaggggattgcg

SEQ ID NO: 13388 - DNA, 27 bp, Artificial Sequences
  Synthetic
ggttcgggttagtagaggggattgcgg

SEQ ID NO: 13389 - DNA, 27 bp, Artificial Sequences
  Synthetic
gggttcgggttagtagaggggattgcg

SEQ ID NO: 13390 - DNA, 27 bp, Artificial Sequences
  Synthetic
gcgtttcgggggtttggtcgtgttgtt

SEQ ID NO: 13391 - DNA, 26 bp, Artificial Sequences
  Synthetic
gcgtttcgggggtttggtcgtgttgt

SEQ ID NO: 13392 - DNA, 28 bp, Artificial Sequences
  Synthetic
gcgtttcgggggtttggtcgtgttgttt

SEQ ID NO: 13393 - DNA, 27 bp, Artificial Sequences
  Synthetic
cgtttcgggggtttggtcgtgttgttt

SEQ ID NO: 13394 - DNA, 28 bp, Artificial Sequences
  Synthetic
cgtttcgggggtttggtcgtgttgtttg

SEQ ID NO: 13395 - DNA, 27 bp, Artificial Sequences
  Synthetic
cgcggcgttggtagaagtaggggtgtt

SEQ ID NO: 13396 - DNA, 27 bp, Artificial Sequences
  Synthetic
gcggcgttggtagaagtaggggtgttc

SEQ ID NO: 13397 - DNA, 27 bp, Artificial Sequences
  Synthetic
aggggtgttcgatcgagaggtagcgtt

SEQ ID NO: 13398 - DNA, 27 bp, Artificial Sequences
  Synthetic
cggcgttggtagaagtaggggtgttcg

SEQ ID NO: 13399 - DNA, 27 bp, Artificial Sequences
  Synthetic
aggtaagcggttcgttcgtgtcggatg

SEQ ID NO: 13400 - DNA, 26 bp, Artificial Sequences
  Synthetic
gcgtttcgggggtttggtcgtgttgt

SEQ ID NO: 13401 - DNA, 28 bp, Artificial Sequences
  Synthetic
gcgtttcgggggtttggtcgtgttgttt

SEQ ID NO: 13402 - DNA, 27 bp, Artificial Sequences
  Synthetic
cgtttcgggggtttggtcgtgttgttt

SEQ ID NO: 13403 - DNA, 29 bp, Artificial Sequences
  Synthetic
cgtttcgggggtttggtcgtgttgtttgt

SEQ ID NO: 13404 - DNA, 27 bp, Artificial Sequences
  Synthetic
ttcgggggtttggtcgtgttgtttgtt

SEQ ID NO: 13405 - DNA, 27 bp, Artificial Sequences
  Synthetic
ggcggtgtatgcggatgaggttgagaa

SEQ ID NO: 13406 - DNA, 28 bp, Artificial Sequences
  Synthetic
ggcggtgtatgcggatgaggttgagaat

SEQ ID NO: 13407 - DNA, 26 bp, Artificial Sequences
  Synthetic
ggcggtgtatgcggatgaggttgaga

SEQ ID NO: 13408 - DNA, 27 bp, Artificial Sequences
  Synthetic
agggaaggttcgtagcggttttttcgg

SEQ ID NO: 13409 - DNA, 29 bp, Artificial Sequences
  Synthetic
ggcggtgtatgcggatgaggttgagaatg

SEQ ID NO: 13410 - DNA, 27 bp, Artificial Sequences
  Synthetic
agggaaggttcgtagcggttttttcgg

SEQ ID NO: 13411 - DNA, 28 bp, Artificial Sequences
  Synthetic
tagggaaggttcgtagcggttttttcgg

SEQ ID NO: 13412 - DNA, 27 bp, Artificial Sequences
  Synthetic
cggggtcgtttcggttattgtttaggg

SEQ ID NO: 13413 - DNA, 28 bp, Artificial Sequences
  Synthetic
cggggtcgtttcggttattgtttaggga

SEQ ID NO: 13414 - DNA, 26 bp, Artificial Sequences
  Synthetic
gggaaggttcgtagcggttttttcgg

SEQ ID NO: 13415 - DNA, 27 bp, Artificial Sequences
  Synthetic
ggggttcgtaggagaggggaaagggtg

SEQ ID NO: 13416 - DNA, 27 bp, Artificial Sequences
  Synthetic
aggggaaagggtgtttatggcggagga

SEQ ID NO: 13417 - DNA, 27 bp, Artificial Sequences
  Synthetic
tttttgggtagtggtcggggcggtttc

SEQ ID NO: 13418 - DNA, 27 bp, Artificial Sequences
  Synthetic
cggggttcgtaggagaggggaaagggt

SEQ ID NO: 13419 - DNA, 27 bp, Artificial Sequences
  Synthetic
ttttttgggtagtggtcggggcggttt

SEQ ID NO: 13420 - DNA, 27 bp, Artificial Sequences
  Synthetic
agtcgggttgtggaaacgtagggagtg

SEQ ID NO: 13421 - DNA, 27 bp, Artificial Sequences
  Synthetic
gtcgggttgtggaaacgtagggagtga

SEQ ID NO: 13422 - DNA, 28 bp, Artificial Sequences
  Synthetic
agtcgggttgtggaaacgtagggagtga

SEQ ID NO: 13423 - DNA, 27 bp, Artificial Sequences
  Synthetic
gagtcgggttgtggaaacgtagggagt

SEQ ID NO: 13424 - DNA, 28 bp, Artificial Sequences
  Synthetic
agagtcgggttgtggaaacgtagggagt

SEQ ID NO: 13425 - DNA, 27 bp, Artificial Sequences
  Synthetic
ggggttcgtaggagaggggaaagggtg

SEQ ID NO: 13426 - DNA, 27 bp, Artificial Sequences
  Synthetic
aggggaaagggtgtttatggcggagga

SEQ ID NO: 13427 - DNA, 27 bp, Artificial Sequences
  Synthetic
aagggtgtttatggcggaggagacgga

SEQ ID NO: 13428 - DNA, 27 bp, Artificial Sequences
  Synthetic
cggggttcgtaggagaggggaaagggt

SEQ ID NO: 13429 - DNA, 27 bp, Artificial Sequences
  Synthetic
agggtgtttatggcggaggagacggat

SEQ ID NO: 13430 - DNA, 27 bp, Artificial Sequences
  Synthetic
tttgtagggcggtggaaagggtggagg

SEQ ID NO: 13431 - DNA, 27 bp, Artificial Sequences
  Synthetic
gtggaaagggtggaggcgttaggggag

SEQ ID NO: 13432 - DNA, 27 bp, Artificial Sequences
  Synthetic
ggaaagggtggaggcgttaggggagag

SEQ ID NO: 13433 - DNA, 27 bp, Artificial Sequences
  Synthetic
agtttgtagggcggtggaaagggtgga

SEQ ID NO: 13434 - DNA, 27 bp, Artificial Sequences
  Synthetic
tggaaagggtggaggcgttaggggaga

SEQ ID NO: 13435 - DNA, 31 bp, Artificial Sequences
  Synthetic
tgatgttttagtagttaggtagggttcggcg

SEQ ID NO: 13436 - DNA, 32 bp, Artificial Sequences
  Synthetic
ttgatgttttagtagttaggtagggttcggcg

SEQ ID NO: 13437 - DNA, 33 bp, Artificial Sequences
  Synthetic
gttgatgttttagtagttaggtagggttcggcg

SEQ ID NO: 13438 - DNA, 34 bp, Artificial Sequences
  Synthetic
tgttgatgttttagtagttaggtagggttcggcg

SEQ ID NO: 13439 - DNA, 33 bp, Artificial Sequences
  Synthetic
tgttggcggttttgttttttattttagtggggt

SEQ ID NO: 13440 - DNA, 27 bp, Artificial Sequences
  Synthetic
agtgtgtacgggtagcgagcgggtttt

SEQ ID NO: 13441 - DNA, 27 bp, Artificial Sequences
  Synthetic
aagtgtgtacgggtagcgagcgggttt

SEQ ID NO: 13442 - DNA, 27 bp, Artificial Sequences
  Synthetic
gaagtgtgtacgggtagcgagcgggtt

SEQ ID NO: 13443 - DNA, 27 bp, Artificial Sequences
  Synthetic
tgtggggaagtgtgtacgggtagcgag

SEQ ID NO: 13444 - DNA, 27 bp, Artificial Sequences
  Synthetic
gtggggaagtgtgtacgggtagcgagc

SEQ ID NO: 13445 - DNA, 31 bp, Artificial Sequences
  Synthetic
agttaggtgagtggtagatttcgggtttacg

SEQ ID NO: 13446 - DNA, 32 bp, Artificial Sequences
  Synthetic
aagttaggtgagtggtagatttcgggtttacg

SEQ ID NO: 13447 - DNA, 33 bp, Artificial Sequences
  Synthetic
aaagttaggtgagtggtagatttcgggtttacg

SEQ ID NO: 13448 - DNA, 34 bp, Artificial Sequences
  Synthetic
aaaagttaggtgagtggtagatttcgggtttacg

SEQ ID NO: 13449 - DNA, 35 bp, Artificial Sequences
  Synthetic
taaaagttaggtgagtggtagatttcgggtttacg

SEQ ID NO: 13450 - DNA, 34 bp, Artificial Sequences
  Synthetic
tgttcgtgggttcggaatttgttatttatttggt

SEQ ID NO: 13451 - DNA, 35 bp, Artificial Sequences
  Synthetic
tgttcgtgggttcggaatttgttatttatttggtt

SEQ ID NO: 13452 - DNA, 35 bp, Artificial Sequences
  Synthetic
atgttcgtgggttcggaatttgttatttatttggt

SEQ ID NO: 13453 - DNA, 36 bp, Artificial Sequences
  Synthetic
tgttcgtgggttcggaatttgttatttatttggttt

SEQ ID NO: 13454 - DNA, 36 bp, Artificial Sequences
  Synthetic
atgttcgtgggttcggaatttgttatttatttggtt

SEQ ID NO: 13455 - DNA, 28 bp, Artificial Sequences
  Synthetic
ttcggttttagttttttcgggcgtaggg

SEQ ID NO: 13456 - DNA, 29 bp, Artificial Sequences
  Synthetic
tttcggttttagttttttcgggcgtaggg

SEQ ID NO: 13457 - DNA, 30 bp, Artificial Sequences
  Synthetic
gtttcggttttagttttttcgggcgtaggg

SEQ ID NO: 13458 - DNA, 31 bp, Artificial Sequences
  Synthetic
agtttcggttttagttttttcgggcgtaggg

SEQ ID NO: 13459 - DNA, 30 bp, Artificial Sequences
  Synthetic
agtttcggttttagttttttcgggcgtagg

SEQ ID NO: 13460 - DNA, 27 bp, Artificial Sequences
  Synthetic
aggttcggtggcgaggtttgtacgttc

SEQ ID NO: 13461 - DNA, 27 bp, Artificial Sequences
  Synthetic
gaggttcggtggcgaggtttgtacgtt

SEQ ID NO: 13462 - DNA, 28 bp, Artificial Sequences
  Synthetic
gaggttcggtggcgaggtttgtacgttc

SEQ ID NO: 13463 - DNA, 27 bp, Artificial Sequences
  Synthetic
gcgggagtgggtcgttagttagagtcg

SEQ ID NO: 13464 - DNA, 28 bp, Artificial Sequences
  Synthetic
gcgggagtgggtcgttagttagagtcga

SEQ ID NO: 13465 - DNA, 27 bp, Artificial Sequences
  Synthetic
aggtttgattgtagggttcgggcgggg

SEQ ID NO: 13466 - DNA, 27 bp, Artificial Sequences
  Synthetic
ggtttgattgtagggttcgggcggggt

SEQ ID NO: 13467 - DNA, 27 bp, Artificial Sequences
  Synthetic
gaggtttgattgtagggttcgggcggg

SEQ ID NO: 13468 - DNA, 27 bp, Artificial Sequences
  Synthetic
ggaggtttgattgtagggttcgggcgg

SEQ ID NO: 13469 - DNA, 27 bp, Artificial Sequences
  Synthetic
gtttgattgtagggttcgggcggggtt

SEQ ID NO: 13470 - DNA, 27 bp, Artificial Sequences
  Synthetic
gggcgtagtttttaggtttcgggggcg

SEQ ID NO: 13471 - DNA, 27 bp, Artificial Sequences
  Synthetic
cgggcgtagtttttaggtttcgggggc

SEQ ID NO: 13472 - DNA, 27 bp, Artificial Sequences
  Synthetic
taggtttcgggggcgtcggttttaggg

SEQ ID NO: 13473 - DNA, 27 bp, Artificial Sequences
  Synthetic
ggcgtagtttttaggtttcgggggcgt

SEQ ID NO: 13474 - DNA, 26 bp, Artificial Sequences
  Synthetic
cgtcggttttagggcgttgtgggtcg

SEQ ID NO: 13475 - DNA, 27 bp, Artificial Sequences
  Synthetic
ggtttatagcgttttgggatcggcgtt

SEQ ID NO: 13476 - DNA, 28 bp, Artificial Sequences
  Synthetic
ggtttatagcgttttgggatcggcgttt

SEQ ID NO: 13477 - DNA, 26 bp, Artificial Sequences
  Synthetic
ggtttatagcgttttgggatcggcgt

SEQ ID NO: 13478 - DNA, 29 bp, Artificial Sequences
  Synthetic
ggtttatagcgttttgggatcggcgtttt

SEQ ID NO: 13479 - DNA, 30 bp, Artificial Sequences
  Synthetic
ggtttatagcgttttgggatcggcgttttc

SEQ ID NO: 13480 - DNA, 27 bp, Artificial Sequences
  Synthetic
ttggcgggttaggtaggggcgagattg

SEQ ID NO: 13481 - DNA, 27 bp, Artificial Sequences
  Synthetic
gtttggcgggttaggtaggggcgagat

SEQ ID NO: 13482 - DNA, 27 bp, Artificial Sequences
  Synthetic
gcgggttaggtaggggcgagattgagg

SEQ ID NO: 13483 - DNA, 27 bp, Artificial Sequences
  Synthetic
ggcgggttaggtaggggcgagattgag

SEQ ID NO: 13484 - DNA, 27 bp, Artificial Sequences
  Synthetic
tttggcgggttaggtaggggcgagatt

SEQ ID NO: 13485 - DNA, 29 bp, Artificial Sequences
  Synthetic
gggagttcggcgtttgttttagttggggg

SEQ ID NO: 13486 - DNA, 29 bp, Artificial Sequences
  Synthetic
ggggagttcggcgtttgttttagttgggg

SEQ ID NO: 13487 - DNA, 28 bp, Artificial Sequences
  Synthetic
tgggggttttcggggtagagatgtgagt

SEQ ID NO: 13488 - DNA, 27 bp, Artificial Sequences
  Synthetic
gggggttttcggggtagagatgtgagt

SEQ ID NO: 13489 - DNA, 27 bp, Artificial Sequences
  Synthetic
tgggggttttcggggtagagatgtgag

SEQ ID NO: 13490 - DNA, 27 bp, Artificial Sequences
  Synthetic
taagacgttgggaggttggggcggaat

SEQ ID NO: 13491 - DNA, 27 bp, Artificial Sequences
  Synthetic
gtaagacgttgggaggttggggcggaa

SEQ ID NO: 13492 - DNA, 27 bp, Artificial Sequences
  Synthetic
aagacgttgggaggttggggcggaatt

SEQ ID NO: 13493 - DNA, 27 bp, Artificial Sequences
  Synthetic
acgttgggaggttggggcggaattgtt

SEQ ID NO: 13494 - DNA, 27 bp, Artificial Sequences
  Synthetic
cgttgggaggttggggcggaattgtta

SEQ ID NO: 13495 - DNA, 28 bp, Artificial Sequences
  Synthetic
tgggggttttcggggtagagatgtgagt

SEQ ID NO: 13496 - DNA, 27 bp, Artificial Sequences
  Synthetic
gggggttttcggggtagagatgtgagt

SEQ ID NO: 13497 - DNA, 27 bp, Artificial Sequences
  Synthetic
tgggggttttcggggtagagatgtgag

SEQ ID NO: 13498 - DNA, 27 bp, Artificial Sequences
  Synthetic
agttgggggttttcggggtagagatgt

SEQ ID NO: 13499 - DNA, 27 bp, Artificial Sequences
  Synthetic
ttgggggttttcggggtagagatgtga

SEQ ID NO: 13500 - DNA, 27 bp, Artificial Sequences
  Synthetic
taagacgttgggaggttggggcggaat

SEQ ID NO: 13501 - DNA, 27 bp, Artificial Sequences
  Synthetic
gtaagacgttgggaggttggggcggaa

SEQ ID NO: 13502 - DNA, 27 bp, Artificial Sequences
  Synthetic
aagacgttgggaggttggggcggaatt

SEQ ID NO: 13503 - DNA, 27 bp, Artificial Sequences
  Synthetic
acgttgggaggttggggcggaattgtt

SEQ ID NO: 13504 - DNA, 27 bp, Artificial Sequences
  Synthetic
cgttgggaggttggggcggaattgtta

SEQ ID NO: 13505 - DNA, 27 bp, Artificial Sequences
  Synthetic
ttttgcgtttgtggcggcggtagtacg

SEQ ID NO: 13506 - DNA, 27 bp, Artificial Sequences
  Synthetic
gttttgcgtttgtggcggcggtagtac

SEQ ID NO: 13507 - DNA, 26 bp, Artificial Sequences
  Synthetic
tttgcgtttgtggcggcggtagtacg

SEQ ID NO: 13508 - DNA, 28 bp, Artificial Sequences
  Synthetic
gttttgcgtttgtggcggcggtagtacg

SEQ ID NO: 13509 - DNA, 25 bp, Artificial Sequences
  Synthetic
ttgcgtttgtggcggcggtagtacg

SEQ ID NO: 13510 - DNA, 34 bp, Artificial Sequences
  Synthetic
tttgtgggtgattttttaggttcgtattgtcgtt

SEQ ID NO: 13511 - DNA, 34 bp, Artificial Sequences
  Synthetic
ttttgtgggtgattttttaggttcgtattgtcgt

SEQ ID NO: 13512 - DNA, 35 bp, Artificial Sequences
  Synthetic
ttttgtgggtgattttttaggttcgtattgtcgtt

SEQ ID NO: 13513 - DNA, 35 bp, Artificial Sequences
  Synthetic
tttttgtgggtgattttttaggttcgtattgtcgt

SEQ ID NO: 13514 - DNA, 36 bp, Artificial Sequences
  Synthetic
tttttgtgggtgattttttaggttcgtattgtcgtt

SEQ ID NO: 13515 - DNA, 33 bp, Artificial Sequences
  Synthetic
tgatggaaaggaaataaaattacgcggattggc

SEQ ID NO: 13516 - DNA, 34 bp, Artificial Sequences
  Synthetic
atgatggaaaggaaataaaattacgcggattggc

SEQ ID NO: 13517 - DNA, 35 bp, Artificial Sequences
  Synthetic
tatgatggaaaggaaataaaattacgcggattggc

SEQ ID NO: 13518 - DNA, 36 bp, Artificial Sequences
  Synthetic
gtatgatggaaaggaaataaaattacgcggattggc

SEQ ID NO: 13519 - DNA, 36 bp, Artificial Sequences
  Synthetic
tgtatgatggaaaggaaataaaattacgcggattgg

SEQ ID NO: 13520 - DNA, 27 bp, Artificial Sequences
  Synthetic
gcgattggtttgcggttgggaagacga

SEQ ID NO: 13521 - DNA, 27 bp, Artificial Sequences
  Synthetic
tgcggttgggaagacgacgaagaggag

SEQ ID NO: 13522 - DNA, 27 bp, Artificial Sequences
  Synthetic
ttgcggttgggaagacgacgaagagga

SEQ ID NO: 13523 - DNA, 27 bp, Artificial Sequences
  Synthetic
gcggttgggaagacgacgaagaggagg

SEQ ID NO: 13524 - DNA, 27 bp, Artificial Sequences
  Synthetic
tggtttgcggttgggaagacgacgaag

SEQ ID NO: 13525 - DNA, 31 bp, Artificial Sequences
  Synthetic
tcgcgggtggtagagttatttgatttttcga

SEQ ID NO: 13526 - DNA, 32 bp, Artificial Sequences
  Synthetic
cgcgggtggtagagttatttgatttttcgagg

SEQ ID NO: 13527 - DNA, 33 bp, Artificial Sequences
  Synthetic
cgcgggtggtagagttatttgatttttcgaggt

SEQ ID NO: 13528 - DNA, 33 bp, Artificial Sequences
  Synthetic
tcgcgggtggtagagttatttgatttttcgagg

SEQ ID NO: 13529 - DNA, 31 bp, Artificial Sequences
  Synthetic
cgcgggtggtagagttatttgatttttcgag

SEQ ID NO: 13530 - DNA, 29 bp, Artificial Sequences
  Synthetic
tcggtggaattttgataggggatttgggt

SEQ ID NO: 13531 - DNA, 30 bp, Artificial Sequences
  Synthetic
tcggtggaattttgataggggatttgggtt

SEQ ID NO: 13532 - DNA, 30 bp, Artificial Sequences
  Synthetic
ttcggtggaattttgataggggatttgggt

SEQ ID NO: 13533 - DNA, 31 bp, Artificial Sequences
  Synthetic
tcggtggaattttgataggggatttgggttt

SEQ ID NO: 13534 - DNA, 31 bp, Artificial Sequences
  Synthetic
ttcggtggaattttgataggggatttgggtt

SEQ ID NO: 13535 - DNA, 33 bp, Artificial Sequences
  Synthetic
gcgttgttgcgtttaagtgatttttgaaatcga

SEQ ID NO: 13536 - DNA, 34 bp, Artificial Sequences
  Synthetic
gcgttgttgcgtttaagtgatttttgaaatcgat

SEQ ID NO: 13537 - DNA, 35 bp, Artificial Sequences
  Synthetic
gcgttgttgcgtttaagtgatttttgaaatcgatg

SEQ ID NO: 13538 - DNA, 36 bp, Artificial Sequences
  Synthetic
gcgttgttgcgtttaagtgatttttgaaatcgatgt

SEQ ID NO: 13539 - DNA, 35 bp, Artificial Sequences
  Synthetic
cgttgttgcgtttaagtgatttttgaaatcgatgt

SEQ ID NO: 13540 - DNA, 29 bp, Artificial Sequences
  Synthetic
tcggtggaattttgataggggatttgggt

SEQ ID NO: 13541 - DNA, 30 bp, Artificial Sequences; identical to SEQ ID NO: 13531
  Synthetic

SEQ ID NO: 13542 - DNA, 30 bp, Artificial Sequences; identical to SEQ ID NO: 13532
  Synthetic

SEQ ID NO: 13543 - DNA, 31 bp, Artificial Sequences; identical to SEQ ID NO: 13533
  Synthetic

SEQ ID NO: 13544 - DNA, 31 bp, Artificial Sequences; identical to SEQ ID NO: 13534
  Synthetic

SEQ ID NO: 13545 - DNA, 27 bp, Artificial Sequences
  Synthetic
aggggttcgtcgaggtttagtttgtgt

SEQ ID NO: 13546 - DNA, 28 bp, Artificial Sequences
  Synthetic
gaggggttcgtcgaggtttagtttgtgt

SEQ ID NO: 13547 - DNA, 28 bp, Artificial Sequences
  Synthetic
aggggttcgtcgaggtttagtttgtgtt

SEQ ID NO: 13548 - DNA, 29 bp, Artificial Sequences
  Synthetic
gaggggttcgtcgaggtttagtttgtgtt

SEQ ID NO: 13549 - DNA, 29 bp, Artificial Sequences
  Synthetic
aggggttcgtcgaggtttagtttgtgtta

SEQ ID NO: 13550 - DNA, 30 bp, Artificial Sequences
  Synthetic
cgcgaagattttttgggagtttgtagagcg

SEQ ID NO: 13551 - DNA, 29 bp, Artificial Sequences
  Synthetic
tttttgggagtttgtagagcgattcgtcg

SEQ ID NO: 13552 - DNA, 30 bp, Artificial Sequences
  Synthetic
acgcgaagattttttgggagtttgtagagc

SEQ ID NO: 13553 - DNA, 30 bp, Artificial Sequences
  Synthetic
gcgaagattttttgggagtttgtagagcga

SEQ ID NO: 13554 - DNA, 30 bp, Artificial Sequences
  Synthetic
ttttttgggagtttgtagagcgattcgtcg

SEQ ID NO: 13555 - DNA, 27 bp, Artificial Sequences
  Synthetic
aggggttcgtcgaggtttagtttgtgt

SEQ ID NO: 13556 - DNA, 28 bp, Artificial Sequences
  Synthetic
gaggggttcgtcgaggtttagtttgtgt

SEQ ID NO: 13557 - DNA, 28 bp, Artificial Sequences
  Synthetic
aggggttcgtcgaggtttagtttgtgtt

SEQ ID NO: 13558 - DNA, 29 bp, Artificial Sequences
  Synthetic
gaggggttcgtcgaggtttagtttgtgtt

SEQ ID NO: 13559 - DNA, 29 bp, Artificial Sequences
  Synthetic
aggggttcgtcgaggtttagtttgtgtta

SEQ ID NO: 13560 - DNA, 27 bp, Artificial Sequences
  Synthetic
tgttttggagtttgggaagggggtgcg

SEQ ID NO: 13561 - DNA, 27 bp, Artificial Sequences
  Synthetic
gttttggagtttgggaagggggtgcgc

SEQ ID NO: 13562 - DNA, 26 bp, Artificial Sequences
  Synthetic
ttttggagtttgggaagggggtgcgc

SEQ ID NO: 13563 - DNA, 28 bp, Artificial Sequences
  Synthetic
ttgttttggagtttgggaagggggtgcg

SEQ ID NO: 13564 - DNA, 27 bp, Artificial Sequences
  Synthetic
ttttggagtttgggaagggggtgcgcg

SEQ ID NO: 13565 - DNA, 27 bp, Artificial Sequences
  Synthetic
tttggcggggagaggtagggttcgttc

SEQ ID NO: 13566 - DNA, 27 bp, Artificial Sequences
  Synthetic
ttttggcggggagaggtagggttcgtt

SEQ ID NO: 13567 - DNA, 27 bp, Artificial Sequences
  Synthetic
tttttggcggggagaggtagggttcgt

SEQ ID NO: 13568 - DNA, 28 bp, Artificial Sequences
  Synthetic
ttttggcggggagaggtagggttcgttc

SEQ ID NO: 13569 - DNA, 26 bp, Artificial Sequences
  Synthetic
ttggcggggagaggtagggttcgttc

SEQ ID NO: 13570 - DNA, 27 bp, Artificial Sequences
  Synthetic
gtttttggttcggtcgcggttttgggc

SEQ ID NO: 13571 - DNA, 27 bp, Artificial Sequences
  Synthetic
tttgttcgttttaggtgcgcgcggagg

SEQ ID NO: 13572 - DNA, 27 bp, Artificial Sequences
  Synthetic
cggtttttggttcggtcgcggttttgg

SEQ ID NO: 13573 - DNA, 27 bp, Artificial Sequences
  Synthetic
ggtttttggttcggtcgcggttttggg

SEQ ID NO: 13574 - DNA, 27 bp, Artificial Sequences
  Synthetic
ggatttcggtttttggttcggtcgcgg

SEQ ID NO: 13575 - DNA, 27 bp, Artificial Sequences
  Synthetic
cggtttggttggaggagggggaaggaa

SEQ ID NO: 13576 - DNA, 27 bp, Artificial Sequences
  Synthetic
tggaggagggggaaggaagggaagtgt

SEQ ID NO: 13577 - DNA, 27 bp, Artificial Sequences
  Synthetic
tggaaggtcggtttggttggaggaggg

SEQ ID NO: 13578 - DNA, 27 bp, Artificial Sequences
  Synthetic
aagtgtaagagagtggtggcggtgggg

SEQ ID NO: 13579 - DNA, 27 bp, Artificial Sequences
  Synthetic
aggagggggaaggaagggaagtgtggt

SEQ ID NO: 13580 - DNA, 27 bp, Artificial Sequences
  Synthetic
tgaagttttggggatggggtgggaagt

SEQ ID NO: 13581 - DNA, 28 bp, Artificial Sequences
  Synthetic
ttgaagttttggggatggggtgggaagt

SEQ ID NO: 13582 - DNA, 27 bp, Artificial Sequences
  Synthetic
ttgaagttttggggatggggtgggaag

SEQ ID NO: 13583 - DNA, 29 bp, Artificial Sequences
  Synthetic
acgatttgaagttttggggatggggtggg

SEQ ID NO: 13584 - DNA, 28 bp, Artificial Sequences
  Synthetic
cgatttgaagttttggggatggggtggg

SEQ ID NO: 13585 - DNA, 34 bp, Artificial Sequences
  Synthetic
agggtatattttgtggagaaatttgggtgttcgt

SEQ ID NO: 13586 - DNA, 34 bp, Artificial Sequences
  Synthetic
gggtatattttgtggagaaatttgggtgttcgtg

SEQ ID NO: 13587 - DNA, 35 bp, Artificial Sequences
  Synthetic
agggtatattttgtggagaaatttgggtgttcgtg

SEQ ID NO: 13588 - DNA, 35 bp, Artificial Sequences
  Synthetic
gggtatattttgtggagaaatttgggtgttcgtga

SEQ ID NO: 13589 - DNA, 34 bp, Artificial Sequences
  Synthetic
aagggtatattttgtggagaaatttgggtgttcg

SEQ ID NO: 13590 - DNA, 31 bp, Artificial Sequences
  Synthetic
cgttttgaatatgttttttggtggcgtgtgt

SEQ ID NO: 13591 - DNA, 31 bp, Artificial Sequences
  Synthetic
acgttttgaatatgttttttggtggcgtgtg

SEQ ID NO: 13592 - DNA, 32 bp, Artificial Sequences
  Synthetic
acgttttgaatatgttttttggtggcgtgtgt

SEQ ID NO: 13593 - DNA, 32 bp, Artificial Sequences
  Synthetic
aacgttttgaatatgttttttggtggcgtgtg

SEQ ID NO: 13594 - DNA, 33 bp, Artificial Sequences
  Synthetic
aacgttttgaatatgttttttggtggcgtgtgt

SEQ ID NO: 13595 - DNA, 27 bp, Artificial Sequences
  Synthetic
ttcgggtgttggggaagggttttcgtt

SEQ ID NO: 13596 - DNA, 27 bp, Artificial Sequences
  Synthetic
attcgggtgttggggaagggttttcgt

SEQ ID NO: 13597 - DNA, 27 bp, Artificial Sequences
  Synthetic
tcgggtgttggggaagggttttcgtta

SEQ ID NO: 13598 - DNA, 27 bp, Artificial Sequences
  Synthetic
aggtttattcgggtgttggggaagggt

SEQ ID NO: 13599 - DNA, 28 bp, Artificial Sequences
  Synthetic
attcgggtgttggggaagggttttcgtt

SEQ ID NO: 13600 - DNA, 27 bp, Artificial Sequences
  Synthetic
ggaggcgtacgggttgtggtttttggg

SEQ ID NO: 13601 - DNA, 27 bp, Artificial Sequences
  Synthetic
gggaggcgtacgggttgtggtttttgg

SEQ ID NO: 13602 - DNA, 27 bp, Artificial Sequences
  Synthetic
taggaggttgtgagggtgggagtcggt

SEQ ID NO: 13603 - DNA, 27 bp, Artificial Sequences
  Synthetic
cgggaggcgtacgggttgtggtttttg

SEQ ID NO: 13604 - DNA, 27 bp, Artificial Sequences
  Synthetic
agggtgggagtcggtcggcgaattttt

SEQ ID NO: 13605 - DNA, 29 bp, Artificial Sequences
  Synthetic
acgtttgaggcggggtttttgtttatcgt

SEQ ID NO: 13606 - DNA, 28 bp, Artificial Sequences
  Synthetic
cgtttgaggcggggtttttgtttatcgt

SEQ ID NO: 13607 - DNA, 28 bp, Artificial Sequences
  Synthetic
acgtttgaggcggggtttttgtttatcg

SEQ ID NO: 13608 - DNA, 29 bp, Artificial Sequences
  Synthetic
cgtttgaggcggggtttttgtttatcgtg

SEQ ID NO: 13609 - DNA, 30 bp, Artificial Sequences
  Synthetic
cgtttgaggcggggtttttgtttatcgtgt

SEQ ID NO: 13610 - DNA, 27 bp, Artificial Sequences
  Synthetic
taggaggttgtgagggtgggagtcggt

SEQ ID NO: 13611 - DNA, 27 bp, Artificial Sequences
  Synthetic
gatgcggtgttgtagtttcgggcgagg

SEQ ID NO: 13612 - DNA, 27 bp, Artificial Sequences
  Synthetic
ggatgcggtgttgtagtttcgggcgag

SEQ ID NO: 13613 - DNA, 27 bp, Artificial Sequences
  Synthetic
agggtgggagtcggtcggcgaattttt

SEQ ID NO: 13614 - DNA, 27 bp, Artificial Sequences
  Synthetic
cggtgttgtagtttcgggcgaggggaa

SEQ ID NO: 13615 - DNA, 29 bp, Artificial Sequences
  Synthetic
ttgcgtggaagatttttgggatttgtgga

SEQ ID NO: 13616 - DNA, 29 bp, Artificial Sequences
  Synthetic
tgcgtggaagatttttgggatttgtggat

SEQ ID NO: 13617 - DNA, 30 bp, Artificial Sequences
  Synthetic
ggttgagaagttgcgtggaagatttttggg

SEQ ID NO: 13618 - DNA, 29 bp, Artificial Sequences
  Synthetic
gttgcgtggaagatttttgggatttgtgg

SEQ ID NO: 13619 - DNA, 30 bp, Artificial Sequences
  Synthetic
agttgcgtggaagatttttgggatttgtgg

SEQ ID NO: 13620 - DNA, 27 bp, Artificial Sequences
  Synthetic
ggggttagttcggttgtttgggcgagt

SEQ ID NO: 13621 - DNA, 28 bp, Artificial Sequences
  Synthetic
aggggttagttcggttgtttgggcgagt

SEQ ID NO: 13622 - DNA, 27 bp, Artificial Sequences
  Synthetic
aggggttagttcggttgtttgggcgag

SEQ ID NO: 13623 - DNA, 28 bp, Artificial Sequences
  Synthetic
gcgtaggggttagttcggttgtttgggc

SEQ ID NO: 13624 - DNA, 28 bp, Artificial Sequences
  Synthetic
cgtaggggttagttcggttgtttgggcg

SEQ ID NO: 13625 - DNA, 33 bp, Artificial Sequences
  Synthetic
acgtaggtgggtaattggtttaaaaatcgtcga

SEQ ID NO: 13626 - DNA, 33 bp, Artificial Sequences
  Synthetic
tcggattgatttttacgtaggtgggtaattggt

SEQ ID NO: 13627 - DNA, 34 bp, Artificial Sequences
  Synthetic
acgtaggtgggtaattggtttaaaaatcgtcgat

SEQ ID NO: 13628 - DNA, 34 bp, Artificial Sequences
  Synthetic
tcggattgatttttacgtaggtgggtaattggtt

SEQ ID NO: 13629 - DNA, 34 bp, Artificial Sequences
  Synthetic
tacgtaggtgggtaattggtttaaaaatcgtcga

SEQ ID NO: 13630 - DNA, 28 bp, Artificial Sequences
  Synthetic
ggagtcgttagggattgggtaagggcgt

SEQ ID NO: 13631 - DNA, 28 bp, Artificial Sequences
  Synthetic
tggagtcgttagggattgggtaagggcg

SEQ ID NO: 13632 - DNA, 27 bp, Artificial Sequences
  Synthetic
ggagtcgttagggattgggtaagggcg

SEQ ID NO: 13633 - DNA, 27 bp, Artificial Sequences
  Synthetic
gggattgggtaagggcgttagaggtgt

SEQ ID NO: 13634 - DNA, 27 bp, Artificial Sequences
  Synthetic
gagtcgttagggattgggtaagggcgt

SEQ ID NO: 13635 - DNA, 30 bp, Artificial Sequences
  Synthetic
tcggtatttagaggttttcgcgttttgagc

SEQ ID NO: 13636 - DNA, 32 bp, Artificial Sequences
  Synthetic
ggtcggtatttagaggttttcgcgttttgagc

SEQ ID NO: 13637 - DNA, 30 bp, Artificial Sequences
  Synthetic
aggtcggtatttagaggttttcgcgttttg

SEQ ID NO: 13638 - DNA, 30 bp, Artificial Sequences
  Synthetic
ggtcggtatttagaggttttcgcgttttga

SEQ ID NO: 13639 - DNA, 30 bp, Artificial Sequences
  Synthetic
gggatcgagcggttgtagttaagaataggt

SEQ ID NO: 13640 - DNA, 28 bp, Artificial Sequences
  Synthetic
ggagtcgttagggattgggtaagggcgt

SEQ ID NO: 13641 - DNA, 28 bp, Artificial Sequences
  Synthetic
tggagtcgttagggattgggtaagggcg

SEQ ID NO: 13642 - DNA, 27 bp, Artificial Sequences
  Synthetic
ggagtcgttagggattgggtaagggcg

SEQ ID NO: 13643 - DNA, 27 bp, Artificial Sequences
  Synthetic
gggattgggtaagggcgttagaggtgt

SEQ ID NO: 13644 - DNA, 27 bp, Artificial Sequences
  Synthetic
gagtcgttagggattgggtaagggcgt

SEQ ID NO: 13645 - DNA, 27 bp, Artificial Sequences
  Synthetic
aggagttgggagcgcggtttgttttgg

SEQ ID NO: 13646 - DNA, 27 bp, Artificial Sequences
  Synthetic
agttgggagcgcggtttgttttgggtt

SEQ ID NO: 13647 - DNA, 27 bp, Artificial Sequences
  Synthetic
ggggaggaggcgggtggaggtattttt

SEQ ID NO: 13648 - DNA, 27 bp, Artificial Sequences
  Synthetic
gagttgggagcgcggtttgttttgggt

SEQ ID NO: 13649 - DNA, 27 bp, Artificial Sequences
  Synthetic
gaggcgggtggaggtatttttggcgtt

SEQ ID NO: 13650 - DNA, 27 bp, Artificial Sequences
  Synthetic
tggggagttagcgggtggggaagtaga

SEQ ID NO: 13651 - DNA, 27 bp, Artificial Sequences
  Synthetic
gtggggagttagcgggtggggaagtag

SEQ ID NO: 13652 - DNA, 27 bp, Artificial Sequences
  Synthetic
gcgggtggggaagtagagtcggtaagg

SEQ ID NO: 13653 - DNA, 27 bp, Artificial Sequences
  Synthetic
ggggagttagcgggtggggaagtagag

SEQ ID NO: 13654 - DNA, 27 bp, Artificial Sequences
  Synthetic
cgggtggggaagtagagtcggtaaggg

SEQ ID NO: 13655 - DNA, 27 bp, Artificial Sequences
  Synthetic
aggagttgggagcgcggtttgttttgg

SEQ ID NO: 13656 - DNA, 27 bp, Artificial Sequences
  Synthetic
agttgggagcgcggtttgttttgggtt

SEQ ID NO: 13657 - DNA, 27 bp, Artificial Sequences
  Synthetic
gagttgggagcgcggtttgttttgggt

SEQ ID NO: 13658 - DNA, 27 bp, Artificial Sequences
  Synthetic
ggagttgggagcgcggtttgttttggg

SEQ ID NO: 13659 - DNA, 26 bp, Artificial Sequences
  Synthetic
agttgggagcgcggtttgttttgggt

SEQ ID NO: 13660 - DNA, 31 bp, Artificial Sequences
  Synthetic
tcgggattagttgttgtagttgttcgtaggc

SEQ ID NO: 13661 - DNA, 31 bp, Artificial Sequences
  Synthetic
tggtttggtgatcgggattagttgttgtagt

SEQ ID NO: 13662 - DNA, 32 bp, Artificial Sequences
  Synthetic
cgttttagtgaagttttggtttggtgatcggg

SEQ ID NO: 13663 - DNA, 32 bp, Artificial Sequences
  Synthetic
ggtgatcgggattagttgttgtagttgttcgt

SEQ ID NO: 13664 - DNA, 32 bp, Artificial Sequences
  Synthetic
tggtgatcgggattagttgttgtagttgttcg

SEQ ID NO: 13665 - DNA, 27 bp, Artificial Sequences
  Synthetic
cgtggcggcggtagttgtttacgttgt

SEQ ID NO: 13666 - DNA, 27 bp, Artificial Sequences
  Synthetic
tcggaggggggtttaggttttacgcgt

SEQ ID NO: 13667 - DNA, 27 bp, Artificial Sequences
  Synthetic
tggtttggaggtcgcgcggtttaagtt

SEQ ID NO: 13668 - DNA, 27 bp, Artificial Sequences
  Synthetic
atggtttggaggtcgcgcggtttaagt

SEQ ID NO: 13669 - DNA, 28 bp, Artificial Sequences
  Synthetic
cgcgagggagttgagtgaggtttttgcg

SEQ ID NO: 13670 - DNA, 27 bp, Artificial Sequences
  Synthetic
agtataggttggggggagggttggggt

SEQ ID NO: 13671 - DNA, 27 bp, Artificial Sequences
  Synthetic
ggttggggtcgcggttggaaggttttt

SEQ ID NO: 13672 - DNA, 27 bp, Artificial Sequences
  Synthetic
tttgttttaggggtttgggtcgcgcgg

SEQ ID NO: 13673 - DNA, 27 bp, Artificial Sequences
  Synthetic
gttttaggggtttgggtcgcgcggttt

SEQ ID NO: 13674 - DNA, 27 bp, Artificial Sequences
  Synthetic
tttaggggtttgggtcgcgcggttttt

SEQ ID NO: 13675 - DNA, 27 bp, Artificial Sequences
  Synthetic
tcggaggggggtttaggttttacgcgt

SEQ ID NO: 13676 - DNA, 27 bp, Artificial Sequences
  Synthetic
cggaggggggtttaggttttacgcgtt

SEQ ID NO: 13677 - DNA, 28 bp, Artificial Sequences
  Synthetic
tcggaggggggtttaggttttacgcgtt

SEQ ID NO: 13678 - DNA, 28 bp, Artificial Sequences
  Synthetic
ttcggaggggggtttaggttttacgcgt

SEQ ID NO: 13679 - DNA, 27 bp, Artificial Sequences
  Synthetic
ttcggaggggggtttaggttttacgcg

SEQ ID NO: 13680 - DNA, 27 bp, Artificial Sequences
  Synthetic
tcggtttggagttgatggagggaaagt

SEQ ID NO: 13681 - DNA, 28 bp, Artificial Sequences
  Synthetic
ttcggtttggagttgatggagggaaagt

SEQ ID NO: 13682 - DNA, 28 bp, Artificial Sequences
  Synthetic
tgaattcggtttggagttgatggaggga

SEQ ID NO: 13683 - DNA, 29 bp, Artificial Sequences
  Synthetic
attcggtttggagttgatggagggaaagt

SEQ ID NO: 13684 - DNA, 29 bp, Artificial Sequences
  Synthetic
tgaattcggtttggagttgatggagggaa

SEQ ID NO: 13685 - DNA, 27 bp, Artificial Sequences
  Synthetic
ttgttgggggagatgtgggcgtaggag

SEQ ID NO: 13686 - DNA, 27 bp, Artificial Sequences
  Synthetic
ttgtgtttgttgggggagatgtgggcg

SEQ ID NO: 13687 - DNA, 27 bp, Artificial Sequences
  Synthetic
tttgttgggggagatgtgggcgtagga

SEQ ID NO: 13688 - DNA, 27 bp, Artificial Sequences
  Synthetic
tgtgtttgttgggggagatgtgggcgt

SEQ ID NO: 13689 - DNA, 27 bp, Artificial Sequences
  Synthetic
gtttgttgggggagatgtgggcgtagg

SEQ ID NO: 13690 - DNA, 33 bp, Artificial Sequences
  Synthetic
cgttcggtttgatgtggggataaaaattttgga

SEQ ID NO: 13691 - DNA, 33 bp, Artificial Sequences
  Synthetic
tcgttcggtttgatgtggggataaaaattttgg

SEQ ID NO: 13692 - DNA, 34 bp, Artificial Sequences
  Synthetic
tcgttcggtttgatgtggggataaaaattttgga

SEQ ID NO: 13693 - DNA, 34 bp, Artificial Sequences
  Synthetic
cgttcggtttgatgtggggataaaaattttggat

SEQ ID NO: 13694 - DNA, 34 bp, Artificial Sequences
  Synthetic
atcgttcggtttgatgtggggataaaaattttgg

SEQ ID NO: 13695 - DNA, 27 bp, Artificial Sequences
  Synthetic
tttggtcgcgggttgttgggttggttt

SEQ ID NO: 13696 - DNA, 27 bp, Artificial Sequences
  Synthetic
ttttggtcgcgggttgttgggttggtt

SEQ ID NO: 13697 - DNA, 27 bp, Artificial Sequences
  Synthetic
tttttggtcgcgggttgttgggttggt

SEQ ID NO: 13698 - DNA, 27 bp, Artificial Sequences
  Synthetic
tcgtttttggtcgcgggttgttgggtt

SEQ ID NO: 13699 - DNA, 27 bp, Artificial Sequences
  Synthetic
ttcgtttttggtcgcgggttgttgggt

SEQ ID NO: 13700 - DNA, 27 bp, Artificial Sequences
  Synthetic
cggagtcgtcggaggtggagttcgttt

SEQ ID NO: 13701 - DNA, 27 bp, Artificial Sequences
  Synthetic
ggggaaatcggttaggaggggttgggg

SEQ ID NO: 13702 - DNA, 27 bp, Artificial Sequences
  Synthetic
gggaagtcgggatttaggagggcggag

SEQ ID NO: 13703 - DNA, 27 bp, Artificial Sequences
  Synthetic
gaggggaagtcgggatttaggagggcg

SEQ ID NO: 13704 - DNA, 27 bp, Artificial Sequences
  Synthetic
gcggaggggaagtcgggatttaggagg

SEQ ID NO: 13705 - DNA, 27 bp, Artificial Sequences
  Synthetic
tggaatggggttttagaggtgggggcg

SEQ ID NO: 13706 - DNA, 27 bp, Artificial Sequences
  Synthetic
ttcggttgagttcgggggtttcggaga

SEQ ID NO: 13707 - DNA, 27 bp, Artificial Sequences
  Synthetic
tggggggttgatttaggtggggtggtt

SEQ ID NO: 13708 - DNA, 27 bp, Artificial Sequences
  Synthetic
ttggggggttgatttaggtggggtggt

SEQ ID NO: 13709 - DNA, 27 bp, Artificial Sequences
  Synthetic
ggtagggttggggtagtatgtcggcgt

SEQ ID NO: 13710 - DNA, 27 bp, Artificial Sequences
  Synthetic
agtggatggcgaattagagcgaggcgt

SEQ ID NO: 13711 - DNA, 27 bp, Artificial Sequences
  Synthetic
ttcgtgtcggggtagcgtcgtttggta

SEQ ID NO: 13712 - DNA, 27 bp, Artificial Sequences
  Synthetic
tcgtgtcggggtagcgtcgtttggtat

SEQ ID NO: 13713 - DNA, 27 bp, Artificial Sequences
  Synthetic
tttcgtgtcggggtagcgtcgtttggt

SEQ ID NO: 13714 - DNA, 27 bp, Artificial Sequences
  Synthetic
ggttttcgtgtcggggtagcgtcgttt

SEQ ID NO: 13715 - DNA, 26 bp, Artificial Sequences
  Synthetic
gacggagggagtgggtcgggtttttt

SEQ ID NO: 13716 - DNA, 27 bp, Artificial Sequences
  Synthetic
ttcggttataagggggtagtttcgcgc

SEQ ID NO: 13717 - DNA, 25 bp, Artificial Sequences
  Synthetic
gacggagggagtgggtcgggttttt

SEQ ID NO: 13718 - DNA, 25 bp, Artificial Sequences
  Synthetic
acggagggagtgggtcgggtttttt

SEQ ID NO: 13719 - DNA, 28 bp, Artificial Sequences
  Synthetic
attcggttataagggggtagtttcgcgc

SEQ ID NO: 13720 - DNA, 27 bp, Artificial Sequences
  Synthetic
agggttgtaggtagagaggttgcgcgc

SEQ ID NO: 13721 - DNA, 27 bp, Artificial Sequences
  Synthetic
cggttgaggatttcggttcggcggaga

SEQ ID NO: 13722 - DNA, 27 bp, Artificial Sequences
  Synthetic
gagaggttgcgcgcggggttgtttttt

SEQ ID NO: 13723 - DNA, 27 bp, Artificial Sequences
  Synthetic
taggcgttggaagtttcggttcggagc

SEQ ID NO: 13724 - DNA, 27 bp, Artificial Sequences
  Synthetic
tagagaggttgcgcgcggggttgtttt

SEQ ID NO: 13725 - DNA, 27 bp, Artificial Sequences
  Synthetic
agttttgagtttcggggaaggcgaggt

SEQ ID NO: 13726 - DNA, 27 bp, Artificial Sequences
  Synthetic
ggtcgtttcgggtcggagtttttagcg

SEQ ID NO: 13727 - DNA, 28 bp, Artificial Sequences
  Synthetic
aggtcgtttcgggtcggagtttttagcg

SEQ ID NO: 13728 - DNA, 27 bp, Artificial Sequences
  Synthetic
gttttgagtttcggggaaggcgaggtc

SEQ ID NO: 13729 - DNA, 28 bp, Artificial Sequences
  Synthetic
agttttgagtttcggggaaggcgaggtc

SEQ ID NO: 13730 - DNA, 27 bp, Artificial Sequences
  Synthetic
cgtttgcgggttggggttgggtattcg

SEQ ID NO: 13731 - DNA, 27 bp, Artificial Sequences
  Synthetic
tgcgggttggggttgggtattcgtagt

SEQ ID NO: 13732 - DNA, 27 bp, Artificial Sequences
  Synthetic
gtttgcgggttggggttgggtattcgt

SEQ ID NO: 13733 - DNA, 27 bp, Artificial Sequences
  Synthetic
taggcgttggaagtttcggttcggagc

SEQ ID NO: 13734 - DNA, 28 bp, Artificial Sequences
  Synthetic
gcgagtaggcgttggaagtttcggttcg

SEQ ID NO: 13735 - DNA, 27 bp, Artificial Sequences
  Synthetic
ttgggtttttaggggtggaggacggcg

SEQ ID NO: 13736 - DNA, 27 bp, Artificial Sequences
  Synthetic
ggtgtggggttgggtttttaggggtgg

SEQ ID NO: 13737 - DNA, 27 bp, Artificial Sequences
  Synthetic
gttgggtttttaggggtggaggacggc

SEQ ID NO: 13738 - DNA, 27 bp, Artificial Sequences
  Synthetic
tggggttgggtttttaggggtggagga

SEQ ID NO: 13739 - DNA, 27 bp, Artificial Sequences
  Synthetic
gtggggttgggtttttaggggtggagg

SEQ ID NO: 13740 - DNA, 27 bp, Artificial Sequences
  Synthetic
attggtaaagcgggaggggatcgggtg

SEQ ID NO: 13741 - DNA, 27 bp, Artificial Sequences
  Synthetic
gggtagggattggtaaagcgggagggg

SEQ ID NO: 13742 - DNA, 27 bp, Artificial Sequences
  Synthetic
ggggtagggattggtaaagcgggaggg

SEQ ID NO: 13743 - DNA, 27 bp, Artificial Sequences
  Synthetic
gattggtaaagcgggaggggatcgggt

SEQ ID NO: 13744 - DNA, 27 bp, Artificial Sequences
  Synthetic
tggggttttgaggagttgcgtggggta

SEQ ID NO: 13745 - DNA, 27 bp, Artificial Sequences
  Synthetic
ttgggtttttaggggtggaggacggcg

SEQ ID NO: 13746 - DNA, 27 bp, Artificial Sequences
  Synthetic
ggtgtggggttgggtttttaggggtgg

SEQ ID NO: 13747 - DNA, 27 bp, Artificial Sequences
  Synthetic
gttgggtttttaggggtggaggacggc

SEQ ID NO: 13748 - DNA, 27 bp, Artificial Sequences
  Synthetic
tggggttgggtttttaggggtggagga

SEQ ID NO: 13749 - DNA, 27 bp, Artificial Sequences
  Synthetic
gtggggttgggtttttaggggtggagg

SEQ ID NO: 13750 - DNA, 27 bp, Artificial Sequences
  Synthetic
attggtaaagcgggaggggatcgggtg

SEQ ID NO: 13751 - DNA, 27 bp, Artificial Sequences
  Synthetic
gggtagggattggtaaagcgggagggg

SEQ ID NO: 13752 - DNA, 27 bp, Artificial Sequences
  Synthetic
ggggtagggattggtaaagcgggaggg

SEQ ID NO: 13753 - DNA, 27 bp, Artificial Sequences
  Synthetic
gattggtaaagcgggaggggatcgggt

SEQ ID NO: 13754 - DNA, 27 bp, Artificial Sequences
  Synthetic
tggggttttgaggagttgcgtggggta

SEQ ID NO: 13755 - DNA, 27 bp, Artificial Sequences
  Synthetic
ggacgggcgttgtttttagttggcgga

SEQ ID NO: 13756 - DNA, 27 bp, Artificial Sequences
  Synthetic
cggcgggagttcgttttgtttggtggt

SEQ ID NO: 13757 - DNA, 27 bp, Artificial Sequences
  Synthetic
cgggcgttgtttttagttggcggacga

SEQ ID NO: 13758 - DNA, 27 bp, Artificial Sequences
  Synthetic
tgggaagttaggtagggagggggacgg

SEQ ID NO: 13759 - DNA, 27 bp, Artificial Sequences
  Synthetic
ggaagttaggtagggagggggacgggt

SEQ ID NO: 13760 - DNA, 27 bp, Artificial Sequences
  Synthetic
gggtttgtggttacggcggggttttgt

SEQ ID NO: 13761 - DNA, 27 bp, Artificial Sequences
  Synthetic
gaggggaggcgtttcgggagggtttta

SEQ ID NO: 13762 - DNA, 27 bp, Artificial Sequences
  Synthetic
agtggaagtcgcgtttgggttcgttgc

SEQ ID NO: 13763 - DNA, 27 bp, Artificial Sequences
  Synthetic
tggcgggcgttaagttgtttgcgagtt

SEQ ID NO: 13764 - DNA, 27 bp, Artificial Sequences
  Synthetic
tagaggcggggttagacgtgcgtttgg

SEQ ID NO: 13765 - DNA, 27 bp, Artificial Sequences
  Synthetic
tgatgaggttggggtaggtgaggtgtt

SEQ ID NO: 13766 - DNA, 27 bp, Artificial Sequences
  Synthetic
ttgatgaggttggggtaggtgaggtgt

SEQ ID NO: 13767 - DNA, 28 bp, Artificial Sequences
  Synthetic
tgatgaggttggggtaggtgaggtgttt

SEQ ID NO: 13768 - DNA, 28 bp, Artificial Sequences
  Synthetic
ttgatgaggttggggtaggtgaggtgtt

SEQ ID NO: 13769 - DNA, 27 bp, Artificial Sequences
  Synthetic
gatgaggttggggtaggtgaggtgttt

SEQ ID NO: 13770 - DNA, 30 bp, Artificial Sequences
  Synthetic
cggggtcgtagtagttttagttttttggcg

SEQ ID NO: 13771 - DNA, 31 bp, Artificial Sequences
  Synthetic
cggggtcgtagtagttttagttttttggcgt

SEQ ID NO: 13772 - DNA, 32 bp, Artificial Sequences
  Synthetic
cggggtcgtagtagttttagttttttggcgtt

SEQ ID NO: 13773 - DNA, 31 bp, Artificial Sequences
  Synthetic
ggggtcgtagtagttttagttttttggcgtt

SEQ ID NO: 13774 - DNA, 33 bp, Artificial Sequences
  Synthetic
cggggtcgtagtagttttagttttttggcgttt

SEQ ID NO: 13775 - DNA, 26 bp, Artificial Sequences
  Synthetic
gtcggttaggagttggggcgggagtc

SEQ ID NO: 13776 - DNA, 28 bp, Artificial Sequences
  Synthetic
cggggcgagggaaggtatttgttttggg

SEQ ID NO: 13777 - DNA, 26 bp, Artificial Sequences
  Synthetic
acgcgttgggtcggttaggagttggg

SEQ ID NO: 13778 - DNA, 27 bp, Artificial Sequences
  Synthetic
ggtcggttaggagttggggcgggagtc

SEQ ID NO: 13779 - DNA, 27 bp, Artificial Sequences
  Synthetic
cggggcgagggaaggtatttgttttgg

SEQ ID NO: 13780 - DNA, 27 bp, Artificial Sequences
  Synthetic
gggcgcgggattttagtaggtgagggt

SEQ ID NO: 13781 - DNA, 27 bp, Artificial Sequences
  Synthetic
cgggcgcgggattttagtaggtgaggg

SEQ ID NO: 13782 - DNA, 27 bp, Artificial Sequences
  Synthetic
gcgggcgcgggattttagtaggtgagg

SEQ ID NO: 13783 - DNA, 28 bp, Artificial Sequences
  Synthetic
gggcgcgggattttagtaggtgagggtt

SEQ ID NO: 13784 - DNA, 27 bp, Artificial Sequences
  Synthetic
ggcgcgggattttagtaggtgagggtt

SEQ ID NO: 13785 - DNA, 27 bp, Artificial Sequences
  Synthetic
ggttacgcgtggggatagaggaggtcg

SEQ ID NO: 13786 - DNA, 27 bp, Artificial Sequences
  Synthetic
gttacgcgtggggatagaggaggtcga

SEQ ID NO: 13787 - DNA, 27 bp, Artificial Sequences
  Synthetic
aggttacgcgtggggatagaggaggtc

SEQ ID NO: 13788 - DNA, 26 bp, Artificial Sequences
  Synthetic
gtcggttaggagttggggcgggagtc

SEQ ID NO: 13789 - DNA, 27 bp, Artificial Sequences
  Synthetic
ttacgcgtggggatagaggaggtcgaa

SEQ ID NO: 13790 - DNA, 27 bp, Artificial Sequences
  Synthetic
tatgttttcggggcgcggcgtagtagt

SEQ ID NO: 13791 - DNA, 27 bp, Artificial Sequences
  Synthetic
tgtatgttttcggggcgcggcgtagta

SEQ ID NO: 13792 - DNA, 27 bp, Artificial Sequences
  Synthetic
gtatgttttcggggcgcggcgtagtag

SEQ ID NO: 13793 - DNA, 27 bp, Artificial Sequences
  Synthetic
gttgtatgttttcggggcgcggcgtag

SEQ ID NO: 13794 - DNA, 27 bp, Artificial Sequences
  Synthetic
ggtgtcgcggtgggtatttgttcggtt

SEQ ID NO: 13795 - DNA, 25 bp, Artificial Sequences
  Synthetic
gggaggagttggacgcgcggttttc

SEQ ID NO: 13796 - DNA, 28 bp, Artificial Sequences
  Synthetic
cggcgtagttttgggtttgtatcgtggg

SEQ ID NO: 13797 - DNA, 29 bp, Artificial Sequences
  Synthetic
cggcgtagttttgggtttgtatcgtggga

SEQ ID NO: 13798 - DNA, 29 bp, Artificial Sequences
  Synthetic
tcggcgtagttttgggtttgtatcgtggg

SEQ ID NO: 13799 - DNA, 27 bp, Artificial Sequences
  Synthetic
aatttaggttcgggaggagttggacgc

SEQ ID NO: 13800 - DNA, 27 bp, Artificial Sequences
  Synthetic
tatgttttcggggcgcggcgtagtagt

SEQ ID NO: 13801 - DNA, 27 bp, Artificial Sequences
  Synthetic
tgtatgttttcggggcgcggcgtagta

SEQ ID NO: 13802 - DNA, 27 bp, Artificial Sequences
  Synthetic
gtatgttttcggggcgcggcgtagtag

SEQ ID NO: 13803 - DNA, 27 bp, Artificial Sequences
  Synthetic
ggtgtcgcggtgggtatttgttcggtt

SEQ ID NO: 13804 - DNA, 27 bp, Artificial Sequences
  Synthetic
ttggtgtcgcggtgggtatttgttcgg

SEQ ID NO: 13805 - DNA, 25 bp, Artificial Sequences
  Synthetic
gggaggagttggacgcgcggttttc

SEQ ID NO: 13806 - DNA, 27 bp, Artificial Sequences
  Synthetic
aatttaggttcgggaggagttggacgc

SEQ ID NO: 13807 - DNA, 24 bp, Artificial Sequences
  Synthetic
gggaggagttggacgcgcggtttt

SEQ ID NO: 13808 - DNA, 27 bp, Artificial Sequences
  Synthetic
tgcgttgtttgagaagttggggttacg

SEQ ID NO: 13809 - DNA, 28 bp, Artificial Sequences
  Synthetic
tgcgttgtttgagaagttggggttacga

SEQ ID NO: 13810 - DNA, 28 bp, Artificial Sequences
  Synthetic
tgggggttgtgtagcgtttagtgtttga

SEQ ID NO: 13811 - DNA, 28 bp, Artificial Sequences
  Synthetic
ttgggggttgtgtagcgtttagtgtttg

SEQ ID NO: 13812 - DNA, 28 bp, Artificial Sequences
  Synthetic
ttcggtatttgagttggggaagagggtt

SEQ ID NO: 13813 - DNA, 28 bp, Artificial Sequences
  Synthetic
tttcggtatttgagttggggaagagggt

SEQ ID NO: 13814 - DNA, 29 bp, Artificial Sequences
  Synthetic
ttgggggttgtgtagcgtttagtgtttga

SEQ ID NO: 13815 - DNA, 27 bp, Artificial Sequences
  Synthetic
ttgtcgttgtggagggtgagaagacgt

SEQ ID NO: 13816 - DNA, 27 bp, Artificial Sequences
  Synthetic
tgtcgttgtggagggtgagaagacgta

SEQ ID NO: 13817 - DNA, 28 bp, Artificial Sequences
  Synthetic
tttgtcgttgtggagggtgagaagacgt

SEQ ID NO: 13818 - DNA, 27 bp, Artificial Sequences
  Synthetic
tttgtcgttgtggagggtgagaagacg

SEQ ID NO: 13819 - DNA, 26 bp, Artificial Sequences
  Synthetic
tgtcgttgtggagggtgagaagacgt

SEQ ID NO: 13820 - DNA, 28 bp, Artificial Sequences
  Synthetic
tgggggttgtgtagcgtttagtgtttga

SEQ ID NO: 13821 - DNA, 28 bp, Artificial Sequences
  Synthetic
ttgggggttgtgtagcgtttagtgtttg

SEQ ID NO: 13822 - DNA, 29 bp, Artificial Sequences
  Synthetic
ttgggggttgtgtagcgtttagtgtttga

SEQ ID NO: 13823 - DNA, 29 bp, Artificial Sequences
  Synthetic
tgggggttgtgtagcgtttagtgtttgat

SEQ ID NO: 13824 - DNA, 29 bp, Artificial Sequences
  Synthetic
tttgggggttgtgtagcgtttagtgtttg

SEQ ID NO: 13825 - DNA, 31 bp, Artificial Sequences
  Synthetic
ggggggaagagggtaaaatatgatgaaaggt

SEQ ID NO: 13826 - DNA, 32 bp, Artificial Sequences
  Synthetic
ggggggaagagggtaaaatatgatgaaaggtt

SEQ ID NO: 13827 - DNA, 35 bp, Artificial Sequences
  Synthetic
agggaaagggttagagatttgatagcgaaaaatgt

SEQ ID NO: 13828 - DNA, 35 bp, Artificial Sequences
  Synthetic
ggggggaagagggtaaaatatgatgaaaggttaat

SEQ ID NO: 13829 - DNA, 36 bp, Artificial Sequences
  Synthetic
agggaaagggttagagatttgatagcgaaaaatgtt

SEQ ID NO: 13830 - DNA, 27 bp, Artificial Sequences
  Synthetic
agtgttggggttgttggttcggggtta

SEQ ID NO: 13831 - DNA, 27 bp, Artificial Sequences
  Synthetic
tagtgttggggttgttggttcggggtt

SEQ ID NO: 13832 - DNA, 27 bp, Artificial Sequences
  Synthetic
atagtgttggggttgttggttcggggt

SEQ ID NO: 13833 - DNA, 26 bp, Artificial Sequences
  Synthetic
agtgttggggttgttggttcggggtt

SEQ ID NO: 13834 - DNA, 27 bp, Artificial Sequences
  Synthetic
gtgttggggttgttggttcggggttat

SEQ ID NO: 13835 - DNA, 32 bp, Artificial Sequences
  Synthetic
gggatttaggaattggaaatttaggggtgggg

SEQ ID NO: 13836 - DNA, 33 bp, Artificial Sequences
  Synthetic
gggatttaggaattggaaatttaggggtggggt

SEQ ID NO: 13837 - DNA, 33 bp, Artificial Sequences
  Synthetic
agggatttaggaattggaaatttaggggtgggg

SEQ ID NO: 13838 - DNA, 34 bp, Artificial Sequences
  Synthetic
agggatttaggaattggaaatttaggggtggggt

SEQ ID NO: 13839 - DNA, 32 bp, Artificial Sequences
  Synthetic
ggatttaggaattggaaatttaggggtggggt

SEQ ID NO: 13840 - DNA, 27 bp, Artificial Sequences
  Synthetic
agtgttggggttgttggttcggggtta

SEQ ID NO: 13841 - DNA, 27 bp, Artificial Sequences
  Synthetic
tagtgttggggttgttggttcggggtt

SEQ ID NO: 13842 - DNA, 27 bp, Artificial Sequences
  Synthetic
atagtgttggggttgttggttcggggt

SEQ ID NO: 13843 - DNA, 26 bp, Artificial Sequences
  Synthetic
agtgttggggttgttggttcggggtt

SEQ ID NO: 13844 - DNA, 27 bp, Artificial Sequences
  Synthetic
gtgttggggttgttggttcggggttat

SEQ ID NO: 13845 - DNA, 27 bp, Artificial Sequences
  Synthetic
gtggagaggaagagggatgtgttgcgt

SEQ ID NO: 13846 - DNA, 28 bp, Artificial Sequences
  Synthetic
agtggagaggaagagggatgtgttgcgt

SEQ ID NO: 13847 - DNA, 27 bp, Artificial Sequences
  Synthetic
agtggagaggaagagggatgtgttgcg

SEQ ID NO: 13848 - DNA, 27 bp, Artificial Sequences
  Synthetic
tggagaggaagagggatgtgttgcgtt

SEQ ID NO: 13849 - DNA, 28 bp, Artificial Sequences
  Synthetic
ggagaggaagagggatgtgttgcgttgt

SEQ ID NO: 13850 - DNA, 27 bp, Artificial Sequences
  Synthetic
tgtggacgtgtatgtgtgttgggcgtt

SEQ ID NO: 13851 - DNA, 27 bp, Artificial Sequences
  Synthetic
ttgtggacgtgtatgtgtgttgggcgt

SEQ ID NO: 13852 - DNA, 28 bp, Artificial Sequences
  Synthetic
tgtggacgtgtatgtgtgttgggcgttt

SEQ ID NO: 13853 - DNA, 28 bp, Artificial Sequences
  Synthetic
ttgtggacgtgtatgtgtgttgggcgtt

SEQ ID NO: 13854 - DNA, 28 bp, Artificial Sequences
  Synthetic
tttgtggacgtgtatgtgtgttgggcgt

SEQ ID NO: 13855 - DNA, 27 bp, Artificial Sequences
  Synthetic
gtggagaggaagagggatgtgttgcgt

SEQ ID NO: 13856 - DNA, 28 bp, Artificial Sequences
  Synthetic
agtggagaggaagagggatgtgttgcgt

SEQ ID NO: 13857 - DNA, 27 bp, Artificial Sequences
  Synthetic
agtggagaggaagagggatgtgttgcg

SEQ ID NO: 13858 - DNA, 27 bp, Artificial Sequences
  Synthetic
tggagaggaagagggatgtgttgcgtt

SEQ ID NO: 13859 - DNA, 28 bp, Artificial Sequences
  Synthetic
ggagaggaagagggatgtgttgcgttgt

SEQ ID NO: 13860 - DNA, 36 bp, Artificial Sequences
  Synthetic
gggtttgcgatgattttttatagtagagtggatgga

SEQ ID NO: 13861 - DNA, 29 bp, Artificial Sequences
  Synthetic
tgaggagacggtgattagggttttttggt

SEQ ID NO: 13862 - DNA, 30 bp, Artificial Sequences
  Synthetic
tgaggagacggtgattagggttttttggtt

SEQ ID NO: 13863 - DNA, 30 bp, Artificial Sequences
  Synthetic
ttgaggagacggtgattagggttttttggt

SEQ ID NO: 13864 - DNA, 31 bp, Artificial Sequences
  Synthetic
tgaggagacggtgattagggttttttggttt

SEQ ID NO: 13865 - DNA, 31 bp, Artificial Sequences
  Synthetic
ttgaggagacggtgattagggttttttggtt

SEQ ID NO: 13866 - DNA, 27 bp, Artificial Sequences
  Synthetic
gggttggttgttacggtcggttcggga

SEQ ID NO: 13867 - DNA, 27 bp, Artificial Sequences
  Synthetic
acggggttggttgttacggtcggttcg

SEQ ID NO: 13868 - DNA, 28 bp, Artificial Sequences
  Synthetic
ggatacggggttggttgttacggtcggt

SEQ ID NO: 13869 - DNA, 27 bp, Artificial Sequences
  Synthetic
ggatacggggttggttgttacggtcgg

SEQ ID NO: 13870 - DNA, 27 bp, Artificial Sequences
  Synthetic
ggttggttgttacggtcggttcgggat

SEQ ID NO: 13871 - DNA, 32 bp, Artificial Sequences
  Synthetic
ggagtttcggagggttttatatggtttagcgt

SEQ ID NO: 13872 - DNA, 32 bp, Artificial Sequences
  Synthetic
aggagtttcggagggttttatatggtttagcg

SEQ ID NO: 13873 - DNA, 33 bp, Artificial Sequences
  Synthetic
aggagtttcggagggttttatatggtttagcgt

SEQ ID NO: 13874 - DNA, 33 bp, Artificial Sequences
  Synthetic
aaggagtttcggagggttttatatggtttagcg

SEQ ID NO: 13875 - DNA, 34 bp, Artificial Sequences
  Synthetic
aaggagtttcggagggttttatatggtttagcgt

SEQ ID NO: 13876 - DNA, 27 bp, Artificial Sequences
  Synthetic
cgggggttttttggtttgcgttgggtt

SEQ ID NO: 13877 - DNA, 28 bp, Artificial Sequences
  Synthetic
tcgggggttttttggtttgcgttgggtt

SEQ ID NO: 13878 - DNA, 28 bp, Artificial Sequences
  Synthetic
gcgttgggttatgtggggtttttcgggg

SEQ ID NO: 13879 - DNA, 28 bp, Artificial Sequences
  Synthetic
tgcgttgggttatgtggggtttttcggg

SEQ ID NO: 13880 - DNA, 27 bp, Artificial Sequences
  Synthetic
gcgttgggttatgtggggtttttcggg

SEQ ID NO: 13881 - DNA, 27 bp, Artificial Sequences
  Synthetic
ttgggtaggtagacggggttggggttg

SEQ ID NO: 13882 - DNA, 27 bp, Artificial Sequences
  Synthetic
tgggtaggtagacggggttggggttgg

SEQ ID NO: 13883 - DNA, 27 bp, Artificial Sequences
  Synthetic
gggtaggtagacggggttggggttggt

SEQ ID NO: 13884 - DNA, 27 bp, Artificial Sequences
  Synthetic
tttgggtaggtagacggggttggggtt

SEQ ID NO: 13885 - DNA, 27 bp, Artificial Sequences
  Synthetic
atttgggtaggtagacggggttggggt

SEQ ID NO: 13886 - DNA, 27 bp, Artificial Sequences
  Synthetic
agtgtagtcggcgaagatgttacgggt

SEQ ID NO: 13887 - DNA, 28 bp, Artificial Sequences
  Synthetic
aagtgtagtcggcgaagatgttacgggt

SEQ ID NO: 13888 - DNA, 27 bp, Artificial Sequences
  Synthetic
aagtgtagtcggcgaagatgttacggg

SEQ ID NO: 13889 - DNA, 27 bp, Artificial Sequences
  Synthetic
gtgtagtcggcgaagatgttacgggta

SEQ ID NO: 13890 - DNA, 28 bp, Artificial Sequences
  Synthetic
agtgtagtcggcgaagatgttacgggta

SEQ ID NO: 13891 - DNA, 27 bp, Artificial Sequences
  Synthetic
tttcggggagttgtcgggtaggggaaa

SEQ ID NO: 13892 - DNA, 27 bp, Artificial Sequences
  Synthetic
ttttcggggagttgtcgggtaggggaa

SEQ ID NO: 13893 - DNA, 27 bp, Artificial Sequences
  Synthetic
tttttcggggagttgtcgggtagggga

SEQ ID NO: 13894 - DNA, 27 bp, Artificial Sequences
  Synthetic
tcggggagttgtcgggtaggggaaatt

SEQ ID NO: 13895 - DNA, 27 bp, Artificial Sequences
  Synthetic
ttcggggagttgtcgggtaggggaaat

SEQ ID NO: 13896 - DNA, 27 bp, Artificial Sequences
  Synthetic
tgttcggtagtttttcggggagtcggg

SEQ ID NO: 13897 - DNA, 28 bp, Artificial Sequences
  Synthetic
tgttcggtagtttttcggggagtcggga

SEQ ID NO: 13898 - DNA, 27 bp, Artificial Sequences
  Synthetic
gttcggtagtttttcggggagtcggga

SEQ ID NO: 13899 - DNA, 27 bp, Artificial Sequences
  Synthetic
ttcggtagtttttcggggagtcgggaa

SEQ ID NO: 13900 - DNA, 27 bp, Artificial Sequences
  Synthetic
tcggtagtttttcggggagtcgggaat

SEQ ID NO: 13901 - DNA, 27 bp, Artificial Sequences
  Synthetic
tcggttgggggtgggggatattcgttg

SEQ ID NO: 13902 - DNA, 27 bp, Artificial Sequences
  Synthetic
cgttgttcgcggggtggattcggattt

SEQ ID NO: 13903 - DNA, 27 bp, Artificial Sequences
  Synthetic
cggttgggggtgggggatattcgttgt

SEQ ID NO: 13904 - DNA, 27 bp, Artificial Sequences
  Synthetic
cgggcggtttatttttgtcggacgggg

SEQ ID NO: 13905 - DNA, 27 bp, Artificial Sequences
  Synthetic
ggtgatcggttgggggtgggggatatt

SEQ ID NO: 13906 - DNA, 27 bp, Artificial Sequences
  Synthetic
ttttttgggttgggagcgcgcggtgta

SEQ ID NO: 13907 - DNA, 27 bp, Artificial Sequences
  Synthetic
tttttgggttgggagcgcgcggtgtag

SEQ ID NO: 13908 - DNA, 27 bp, Artificial Sequences
  Synthetic
tttgggttgggagcgcgcggtgtagta

SEQ ID NO: 13909 - DNA, 27 bp, Artificial Sequences
  Synthetic
cgcgttttagagtttcggggttgacgt

SEQ ID NO: 13910 - DNA, 27 bp, Artificial Sequences
  Synthetic
ttgggttgggagcgcgcggtgtagtag

SEQ ID NO: 13911 - DNA, 27 bp, Artificial Sequences
  Synthetic
cggggtaggagtaggggaagtttgcga

SEQ ID NO: 13912 - DNA, 27 bp, Artificial Sequences
  Synthetic
tcggggtaggagtaggggaagtttgcg

SEQ ID NO: 13913 - DNA, 27 bp, Artificial Sequences
  Synthetic
gcgcgggttgttcgaggttaggggatt

SEQ ID NO: 13914 - DNA, 27 bp, Artificial Sequences
  Synthetic
cgcgggttgttcgaggttaggggattt

SEQ ID NO: 13915 - DNA, 28 bp, Artificial Sequences
  Synthetic
tcggggtaggagtaggggaagtttgcga

SEQ ID NO: 13916 - DNA, 27 bp, Artificial Sequences
  Synthetic
tttgggtcgttttggtattcgcggtcg

SEQ ID NO: 13917 - DNA, 28 bp, Artificial Sequences
  Synthetic
gtttgggtcgttttggtattcgcggtcg

SEQ ID NO: 13918 - DNA, 26 bp, Artificial Sequences
  Synthetic
ggtaggtgggcgcgggggttgtattg

SEQ ID NO: 13919 - DNA, 25 bp, Artificial Sequences
  Synthetic
gtaggtgggcgcgggggttgtattg

SEQ ID NO: 13920 - DNA, 27 bp, Artificial Sequences
  Synthetic
tagggtaggtgggcgcgggggttgtat

SEQ ID NO: 13921 - DNA, 27 bp, Artificial Sequences
  Synthetic
tcggggagttggagattttcggcgtgt

SEQ ID NO: 13922 - DNA, 27 bp, Artificial Sequences
  Synthetic
ttggagattttcggcgtgtcgttgcgg

SEQ ID NO: 13923 - DNA, 27 bp, Artificial Sequences
  Synthetic
agggtcggggagttggagattttcggc

SEQ ID NO: 13924 - DNA, 27 bp, Artificial Sequences
  Synthetic
ggggagttggagattttcggcgtgtcg

SEQ ID NO: 13925 - DNA, 27 bp, Artificial Sequences
  Synthetic
cggggagttggagattttcggcgtgtc

SEQ ID NO: 13926 - DNA, 27 bp, Artificial Sequences
  Synthetic
attagggtcggcgcgttagggtaggtg

SEQ ID NO: 13927 - DNA, 26 bp, Artificial Sequences
  Synthetic
ttagggtcggcgcgttagggtaggtg

SEQ ID NO: 13928 - DNA, 27 bp, Artificial Sequences
  Synthetic
tattagggtcggcgcgttagggtaggt

SEQ ID NO: 13929 - DNA, 27 bp, Artificial Sequences
  Synthetic
ttagggtcggcgcgttagggtaggtgg

SEQ ID NO: 13930 - DNA, 27 bp, Artificial Sequences
  Synthetic
ggtttattagggtcggcgcgttagggt

SEQ ID NO: 13931 - DNA, 27 bp, Artificial Sequences
  Synthetic
tcggggagttggagattttcggcgtgt

SEQ ID NO: 13932 - DNA, 27 bp, Artificial Sequences
  Synthetic
gcgggtgttagggcgatttaggttgcg

SEQ ID NO: 13933 - DNA, 27 bp, Artificial Sequences
  Synthetic
ttggagattttcggcgtgtcgttgcgg

SEQ ID NO: 13934 - DNA, 27 bp, Artificial Sequences
  Synthetic
agggtcggggagttggagattttcggc

SEQ ID NO: 13935 - DNA, 27 bp, Artificial Sequences
  Synthetic
cgggtgttagggcgatttaggttgcgg

SEQ ID NO: 13936 - DNA, 27 bp, Artificial Sequences
  Synthetic
attagggtcggcgcgttagggtaggtg

SEQ ID NO: 13937 - DNA, 26 bp, Artificial Sequences
  Synthetic
ttagggtcggcgcgttagggtaggtg

SEQ ID NO: 13938 - DNA, 27 bp, Artificial Sequences
  Synthetic
tattagggtcggcgcgttagggtaggt

SEQ ID NO: 13939 - DNA, 27 bp, Artificial Sequences
  Synthetic
ttagggtcggcgcgttagggtaggtgg

SEQ ID NO: 13940 - DNA, 27 bp, Artificial Sequences
  Synthetic
ggtttattagggtcggcgcgttagggt

SEQ ID NO: 13941 - DNA, 27 bp, Artificial Sequences
  Synthetic
tcggggagttggagattttcggcgtgt

SEQ ID NO: 13942 - DNA, 27 bp, Artificial Sequences
  Synthetic
gcgggtgttagggcgatttaggttgcg

SEQ ID NO: 13943 - DNA, 27 bp, Artificial Sequences
  Synthetic
ttggagattttcggcgtgtcgttgcgg

SEQ ID NO: 13944 - DNA, 27 bp, Artificial Sequences
  Synthetic
agggtcggggagttggagattttcggc

SEQ ID NO: 13945 - DNA, 27 bp, Artificial Sequences
  Synthetic
cgggtgttagggcgatttaggttgcgg

SEQ ID NO: 13946 - DNA, 27 bp, Artificial Sequences
  Synthetic
tatgcgggaaattcgggcggcgttttt

SEQ ID NO: 13947 - DNA, 27 bp, Artificial Sequences
  Synthetic
attagggtcggcgcgttagggtaggtg

SEQ ID NO: 13948 - DNA, 27 bp, Artificial Sequences
  Synthetic
gtatgcgggaaattcgggcggcgtttt

SEQ ID NO: 13949 - DNA, 27 bp, Artificial Sequences
  Synthetic
atgcgggaaattcgggcggcgtttttc

SEQ ID NO: 13950 - DNA, 26 bp, Artificial Sequences
  Synthetic
tatgcgggaaattcgggcggcgtttt

SEQ ID NO: 13951 - DNA, 27 bp, Artificial Sequences
  Synthetic
agtttttgtgggggttcggagggtcgt

SEQ ID NO: 13952 - DNA, 27 bp, Artificial Sequences
  Synthetic
tgttttggcgcgtcggttttggtgagt

SEQ ID NO: 13953 - DNA, 27 bp, Artificial Sequences
  Synthetic
gtttttgtgggggttcggagggtcgtg

SEQ ID NO: 13954 - DNA, 27 bp, Artificial Sequences
  Synthetic
ggtgagtttttgtgggggttcggaggg

SEQ ID NO: 13955 - DNA, 27 bp, Artificial Sequences
  Synthetic
ttgggggtttttggttcggggttgagg

SEQ ID NO: 13956 - DNA, 27 bp, Artificial Sequences
  Synthetic
ggttcgggttagagttaggcggcgagt

SEQ ID NO: 13957 - DNA, 27 bp, Artificial Sequences
  Synthetic
gggttcgggttagagttaggcggcgag

SEQ ID NO: 13958 - DNA, 26 bp, Artificial Sequences
  Synthetic
gggttcgggttagagttaggcggcga

SEQ ID NO: 13959 - DNA, 27 bp, Artificial Sequences
  Synthetic
ggggttcgggttagagttaggcggcga

SEQ ID NO: 13960 - DNA, 28 bp, Artificial Sequences
  Synthetic
ggttcgggttagagttaggcggcgagta

SEQ ID NO: 13961 - DNA, 27 bp, Artificial Sequences
  Synthetic
ttgggggtttttggttcggggttgagg

SEQ ID NO: 13962 - DNA, 27 bp, Artificial Sequences
  Synthetic
tgggggtttttggttcggggttgaggg

SEQ ID NO: 13963 - DNA, 27 bp, Artificial Sequences
  Synthetic
tcgggtttttcgtatgtagcgtcgcgt

SEQ ID NO: 13964 - DNA, 26 bp, Artificial Sequences
  Synthetic
gggtttttggttcggggttgaggggc

SEQ ID NO: 13965 - DNA, 26 bp, Artificial Sequences
  Synthetic
ggggtttttggttcggggttgagggg

SEQ ID NO: 13966 - DNA, 27 bp, Artificial Sequences
  Synthetic
agaagggtagggtgttatgcggtggtc

SEQ ID NO: 13967 - DNA, 27 bp, Artificial Sequences
  Synthetic
aagaagggtagggtgttatgcggtggt

SEQ ID NO: 13968 - DNA, 28 bp, Artificial Sequences
  Synthetic
aagaagggtagggtgttatgcggtggtc

SEQ ID NO: 13969 - DNA, 26 bp, Artificial Sequences
  Synthetic
agaagggtagggtgttatgcggtggt

SEQ ID NO: 13970 - DNA, 28 bp, Artificial Sequences
  Synthetic
taagaagggtagggtgttatgcggtggt

SEQ ID NO: 13971 - DNA, 27 bp, Artificial Sequences
  Synthetic
ttgggggtttttggttcggggttgagg

SEQ ID NO: 13972 - DNA, 27 bp, Artificial Sequences
  Synthetic
tgggggtttttggttcggggttgaggg

SEQ ID NO: 13973 - DNA, 27 bp, Artificial Sequences
  Synthetic
tcgggtttttcgtatgtagcgtcgcgt

SEQ ID NO: 13974 - DNA, 26 bp, Artificial Sequences
  Synthetic
gggtttttggttcggggttgaggggc

SEQ ID NO: 13975 - DNA, 26 bp, Artificial Sequences
  Synthetic
ggggtttttggttcggggttgagggg

SEQ ID NO: 13976 - DNA, 27 bp, Artificial Sequences
  Synthetic
agaagggtagggtgttatgcggtggtc

SEQ ID NO: 13977 - DNA, 27 bp, Artificial Sequences
  Synthetic
aagaagggtagggtgttatgcggtggt

SEQ ID NO: 13978 - DNA, 28 bp, Artificial Sequences
  Synthetic
aagaagggtagggtgttatgcggtggtc

SEQ ID NO: 13979 - DNA, 26 bp, Artificial Sequences
  Synthetic
agaagggtagggtgttatgcggtggt

SEQ ID NO: 13980 - DNA, 28 bp, Artificial Sequences
  Synthetic
taagaagggtagggtgttatgcggtggt

SEQ ID NO: 13981 - DNA, 27 bp, Artificial Sequences
  Synthetic
gagttggggtcggtagggcgatttttt

SEQ ID NO: 13982 - DNA, 26 bp, Artificial Sequences
  Synthetic
gagttggggtcggtagggcgattttt

SEQ ID NO: 13983 - DNA, 26 bp, Artificial Sequences
  Synthetic
agttggggtcggtagggcgatttttt

SEQ ID NO: 13984 - DNA, 29 bp, Artificial Sequences
  Synthetic
cgtttataggtttggttgcgagttggggt

SEQ ID NO: 13985 - DNA, 29 bp, Artificial Sequences
  Synthetic
acgtttataggtttggttgcgagttgggg

SEQ ID NO: 13986 - DNA, 28 bp, Artificial Sequences
  Synthetic
cggtgttatttgggtcgttggtgtgtcg

SEQ ID NO: 13987 - DNA, 29 bp, Artificial Sequences
  Synthetic
cggtgttatttgggtcgttggtgtgtcgt

SEQ ID NO: 13988 - DNA, 29 bp, Artificial Sequences
  Synthetic
tcggtgttatttgggtcgttggtgtgtcg

SEQ ID NO: 13989 - DNA, 27 bp, Artificial Sequences
  Synthetic
tcggtgttatttgggtcgttggtgtgt

SEQ ID NO: 13990 - DNA, 30 bp, Artificial Sequences
  Synthetic
tcggtgttatttgggtcgttggtgtgtcgt

SEQ ID NO: 13991 - DNA, 28 bp, Artificial Sequences
  Synthetic
gcggtttagatgatatcggaaggaggcg

SEQ ID NO: 13992 - DNA, 29 bp, Artificial Sequences
  Synthetic
agcggtttagatgatatcggaaggaggcg

SEQ ID NO: 13993 - DNA, 28 bp, Artificial Sequences
  Synthetic
agcggtttagatgatatcggaaggaggc

SEQ ID NO: 13994 - DNA, 30 bp, Artificial Sequences
  Synthetic
tagcggtttagatgatatcggaaggaggcg

SEQ ID NO: 13995 - DNA, 26 bp, Artificial Sequences
  Synthetic
gtggagtgacggggaggcggcggttg

SEQ ID NO: 13996 - DNA, 34 bp, Artificial Sequences
  Synthetic
tcggattttatttgggttttttcgggttatcgtt

SEQ ID NO: 13997 - DNA, 34 bp, Artificial Sequences
  Synthetic
ttcggattttatttgggttttttcgggttatcgt

SEQ ID NO: 13998 - DNA, 35 bp, Artificial Sequences
  Synthetic
ttcggattttatttgggttttttcgggttatcgtt

SEQ ID NO: 13999 - DNA, 35 bp, Artificial Sequences
  Synthetic
tttcggattttatttgggttttttcgggttatcgt

SEQ ID NO: 14000 - DNA, 36 bp, Artificial Sequences
  Synthetic
tttcggattttatttgggttttttcgggttatcgtt

SEQ ID NO: 14001 - DNA, 29 bp, Artificial Sequences
  Synthetic
gcggtttagatgatatcggaaggaggcgt

SEQ ID NO: 14002 - DNA, 28 bp, Artificial Sequences
  Synthetic
gcggtttagatgatatcggaaggaggcg

SEQ ID NO: 14003 - DNA, 29 bp, Artificial Sequences
  Synthetic
agcggtttagatgatatcggaaggaggcg

SEQ ID NO: 14004 - DNA, 30 bp, Artificial Sequences
  Synthetic
agcggtttagatgatatcggaaggaggcgt

SEQ ID NO: 14005 - DNA, 28 bp, Artificial Sequences
  Synthetic
agcggtttagatgatatcggaaggaggc

SEQ ID NO: 14006 - DNA, 34 bp, Artificial Sequences; identical to SEQ ID NO: 13996
  Synthetic

SEQ ID NO: 14007 - DNA, 34 bp, Artificial Sequences; identical to SEQ ID NO: 13997
  Synthetic

SEQ ID NO: 14008 - DNA, 35 bp, Artificial Sequences; identical to SEQ ID NO: 13998
  Synthetic

SEQ ID NO: 14009 - DNA, 35 bp, Artificial Sequences; identical to SEQ ID NO: 13999
  Synthetic

SEQ ID NO: 14010 - DNA, 36 bp, Artificial Sequences; identical to SEQ ID NO: 14000
  Synthetic

SEQ ID NO: 14011 - DNA, 27 bp, Artificial Sequences
  Synthetic
aggaagaatggcggtggttcgagggag

SEQ ID NO: 14012 - DNA, 27 bp, Artificial Sequences
  Synthetic
gaggaagaatggcggtggttcgaggga

SEQ ID NO: 14013 - DNA, 27 bp, Artificial Sequences
  Synthetic
ggaagaatggcggtggttcgagggagt

SEQ ID NO: 14014 - DNA, 27 bp, Artificial Sequences
  Synthetic
gggcggaggatgtcgtttaaggggagg

SEQ ID NO: 14015 - DNA, 27 bp, Artificial Sequences
  Synthetic
ggggcggaggatgtcgtttaaggggag

SEQ ID NO: 14016 - DNA, 27 bp, Artificial Sequences
  Synthetic
gttgatggggttcggtaggagggtcgg

SEQ ID NO: 14017 - DNA, 27 bp, Artificial Sequences
  Synthetic
ggttggtttgcggagttggcgagttga

SEQ ID NO: 14018 - DNA, 27 bp, Artificial Sequences
  Synthetic
gcgtaggagagggtcgggtttttggga

SEQ ID NO: 14019 - DNA, 27 bp, Artificial Sequences
  Synthetic
gcgagttgatggggttcggtaggaggg

SEQ ID NO: 14020 - DNA, 27 bp, Artificial Sequences
  Synthetic
ggcgagttgatggggttcggtaggagg

SEQ ID NO: 14021 - DNA, 27 bp, Artificial Sequences
  Synthetic
gtggtggagtcgggttttcggggtttt

SEQ ID NO: 14022 - DNA, 27 bp, Artificial Sequences
  Synthetic
ggtggtggagtcgggttttcggggttt

SEQ ID NO: 14023 - DNA, 28 bp, Artificial Sequences
  Synthetic
tggagtcgggttttcggggttttagggt

SEQ ID NO: 14024 - DNA, 27 bp, Artificial Sequences
  Synthetic
ggagtcgggttttcggggttttagggt

SEQ ID NO: 14025 - DNA, 27 bp, Artificial Sequences
  Synthetic
tggagtcgggttttcggggttttaggg

SEQ ID NO: 14026 - DNA, 27 bp, Artificial Sequences
  Synthetic
gttgatggggttcggtaggagggtcgg

SEQ ID NO: 14027 - DNA, 27 bp, Artificial Sequences
  Synthetic
ggttggtttgcggagttggcgagttga

SEQ ID NO: 14028 - DNA, 27 bp, Artificial Sequences
  Synthetic
gcgagttgatggggttcggtaggaggg

SEQ ID NO: 14029 - DNA, 27 bp, Artificial Sequences
  Synthetic
ggcgagttgatggggttcggtaggagg

SEQ ID NO: 14030 - DNA, 27 bp, Artificial Sequences
  Synthetic
tggtttgcggagttggcgagttgatgg

SEQ ID NO: 14031 - DNA, 26 bp, Artificial Sequences
  Synthetic
ggggtcggggttgggagaaagtgtcg

SEQ ID NO: 14032 - DNA, 26 bp, Artificial Sequences
  Synthetic
cggggtcggggttgggagaaagtgtc

SEQ ID NO: 14033 - DNA, 26 bp, Artificial Sequences
  Synthetic
gtcggggttgggagaaagtgtcgcgt

SEQ ID NO: 14034 - DNA, 26 bp, Artificial Sequences
  Synthetic
gggtcggggttgggagaaagtgtcgc

SEQ ID NO: 14035 - DNA, 25 bp, Artificial Sequences
  Synthetic
gtcggggttgggagaaagtgtcgcg

SEQ ID NO: 14036 - DNA, 22 bp, Artificial Sequences
  Synthetic
ggagggggttcgtttcggcgcg

SEQ ID NO: 14037 - DNA, 22 bp, Artificial Sequences
  Synthetic
cggagggggttcgtttcggcgc

SEQ ID NO: 14038 - DNA, 22 bp, Artificial Sequences
  Synthetic
gagggggttcgtttcggcgcgc

SEQ ID NO: 14039 - DNA, 23 bp, Artificial Sequences
  Synthetic
cggagggggttcgtttcggcgcg

SEQ ID NO: 14040 - DNA, 23 bp, Artificial Sequences
  Synthetic
ggagggggttcgtttcggcgcgc

SEQ ID NO: 14041 - DNA, 28 bp, Artificial Sequences
  Synthetic
tgtaaattatgggggtacggggggttcg

SEQ ID NO: 14042 - DNA, 27 bp, Artificial Sequences
  Synthetic
gtaaattatgggggtacggggggttcg

SEQ ID NO: 14043 - DNA, 27 bp, Artificial Sequences
  Synthetic
tgtaaattatgggggtacggggggttc

SEQ ID NO: 14044 - DNA, 29 bp, Artificial Sequences
  Synthetic
ttgtaaattatgggggtacggggggttcg

SEQ ID NO: 14045 - DNA, 28 bp, Artificial Sequences
  Synthetic
ttgtaaattatgggggtacggggggttc

SEQ ID NO: 14046 - DNA, 27 bp, Artificial Sequences
  Synthetic
gggagagttgtggtcgcgcgtttgttt

SEQ ID NO: 14047 - DNA, 27 bp, Artificial Sequences
  Synthetic
agagttgtggtcgcgcgtttgtttcgt

SEQ ID NO: 14048 - DNA, 27 bp, Artificial Sequences
  Synthetic
taggtgttgggtgcgtcggttcggtta

SEQ ID NO: 14049 - DNA, 27 bp, Artificial Sequences
  Synthetic
aggtgttgggtgcgtcggttcggttat

SEQ ID NO: 14050 - DNA, 27 bp, Artificial Sequences
  Synthetic
gtcgttaggtgttgggtgcgtcggttc

SEQ ID NO: 14051 - DNA, 27 bp, Artificial Sequences
  Synthetic
agtatttggcggcggggggtgtttttg

SEQ ID NO: 14052 - DNA, 27 bp, Artificial Sequences
  Synthetic
gcggtaggttagtgatcgagtcggcgt

SEQ ID NO: 14053 - DNA, 27 bp, Artificial Sequences
  Synthetic
gcgtatttagtatttggcggcgggggg

SEQ ID NO: 14054 - DNA, 27 bp, Artificial Sequences
  Synthetic
agcggtaggttagtgatcgagtcggcg

SEQ ID NO: 14055 - DNA, 27 bp, Artificial Sequences
  Synthetic
gcggagtaggcgcgcggttatagtttt

SEQ ID NO: 14056 - DNA, 27 bp, Artificial Sequences
  Synthetic
taggtgttgggtgcgtcggttcggtta

SEQ ID NO: 14057 - DNA, 27 bp, Artificial Sequences
  Synthetic
aggtgttgggtgcgtcggttcggttat

SEQ ID NO: 14058 - DNA, 27 bp, Artificial Sequences
  Synthetic
gtcgttaggtgttgggtgcgtcggttc

SEQ ID NO: 14059 - DNA, 27 bp, Artificial Sequences
  Synthetic
ttaggtgttgggtgcgtcggttcggtt

SEQ ID NO: 14060 - DNA, 27 bp, Artificial Sequences
  Synthetic
ggtgttgggtgcgtcggttcggttatt

SEQ ID NO: 14061 - DNA, 27 bp, Artificial Sequences
  Synthetic
cgagtttttgcgggcggaagagggaag

SEQ ID NO: 14062 - DNA, 27 bp, Artificial Sequences
  Synthetic
gagtttttgcgggcggaagagggaagc

SEQ ID NO: 14063 - DNA, 27 bp, Artificial Sequences
  Synthetic
ttcgtcgagtttttgcgggcggaagag

SEQ ID NO: 14064 - DNA, 27 bp, Artificial Sequences
  Synthetic
ggcggggcggggggttttttattgttt

SEQ ID NO: 14065 - DNA, 27 bp, Artificial Sequences
  Synthetic
tcgagtttttgcgggcggaagagggaa

SEQ ID NO: 14066 - DNA, 27 bp, Artificial Sequences
  Synthetic
tcggcgaagtgtttgggagagggagtg

SEQ ID NO: 14067 - DNA, 27 bp, Artificial Sequences
  Synthetic
tgggagagggagtgcgttaggaggagg

SEQ ID NO: 14068 - DNA, 27 bp, Artificial Sequences
  Synthetic
gggagagggagtgcgttaggaggaggt

SEQ ID NO: 14069 - DNA, 27 bp, Artificial Sequences
  Synthetic
ttcggcgaagtgtttgggagagggagt

SEQ ID NO: 14070 - DNA, 27 bp, Artificial Sequences
  Synthetic
gggagtgcgttaggaggaggttttgcg

SEQ ID NO: 14071 - DNA, 27 bp, Artificial Sequences
  Synthetic
cgagtttttgcgggcggaagagggaag

SEQ ID NO: 14072 - DNA, 27 bp, Artificial Sequences
  Synthetic
gagtttttgcgggcggaagagggaagc

SEQ ID NO: 14073 - DNA, 27 bp, Artificial Sequences
  Synthetic
ttcgtcgagtttttgcgggcggaagag

SEQ ID NO: 14074 - DNA, 27 bp, Artificial Sequences
  Synthetic
tcgagtttttgcgggcggaagagggaa

SEQ ID NO: 14075 - DNA, 27 bp, Artificial Sequences
  Synthetic
tttcgtcgagtttttgcgggcggaaga

SEQ ID NO: 14076 - DNA, 27 bp, Artificial Sequences
  Synthetic
tcggcgaagtgtttgggagagggagtg

SEQ ID NO: 14077 - DNA, 27 bp, Artificial Sequences
  Synthetic
tgggagagggagtgcgttaggaggagg

SEQ ID NO: 14078 - DNA, 27 bp, Artificial Sequences
  Synthetic
gggagagggagtgcgttaggaggaggt

SEQ ID NO: 14079 - DNA, 27 bp, Artificial Sequences
  Synthetic
ttcggcgaagtgtttgggagagggagt

SEQ ID NO: 14080 - DNA, 27 bp, Artificial Sequences
  Synthetic
ggagtgcgttaggaggaggttttgcgg

SEQ ID NO: 14081 - DNA, 27 bp, Artificial Sequences
  Synthetic
gatttcggggaggtttcggcgggtttg

SEQ ID NO: 14082 - DNA, 27 bp, Artificial Sequences
  Synthetic
gtttgatttcggggaggtttcggcggg

SEQ ID NO: 14083 - DNA, 27 bp, Artificial Sequences
  Synthetic
gggggtggggaaggtttggaagtcgta

SEQ ID NO: 14084 - DNA, 27 bp, Artificial Sequences
  Synthetic
ttgggggtggggaaggtttggaagtcg

SEQ ID NO: 14085 - DNA, 27 bp, Artificial Sequences
  Synthetic
tgtttgatttcggggaggtttcggcgg

SEQ ID NO: 14086 - DNA, 27 bp, Artificial Sequences
  Synthetic
ggagtgcgttaggaggaggttttgcgg

SEQ ID NO: 14087 - DNA, 27 bp, Artificial Sequences
  Synthetic
gggagtgcgttaggaggaggttttgcg

SEQ ID NO: 14088 - DNA, 27 bp, Artificial Sequences
  Synthetic
gagtgcgttaggaggaggttttgcggt

SEQ ID NO: 14089 - DNA, 27 bp, Artificial Sequences
  Synthetic
agtgcgttaggaggaggttttgcggtt

SEQ ID NO: 14090 - DNA, 28 bp, Artificial Sequences
  Synthetic
ggagtgcgttaggaggaggttttgcggt

SEQ ID NO: 14091 - DNA, 27 bp, Artificial Sequences
  Synthetic
gatttcggggaggtttcggcgggtttg

SEQ ID NO: 14092 - DNA, 27 bp, Artificial Sequences
  Synthetic
gtttgatttcggggaggtttcggcggg

SEQ ID NO: 14093 - DNA, 27 bp, Artificial Sequences
  Synthetic
gggggtggggaaggtttggaagtcgta

SEQ ID NO: 14094 - DNA, 27 bp, Artificial Sequences
  Synthetic
ttgggggtggggaaggtttggaagtcg

SEQ ID NO: 14095 - DNA, 27 bp, Artificial Sequences
  Synthetic
tgtttgatttcggggaggtttcggcgg

SEQ ID NO: 14096 - DNA, 27 bp, Artificial Sequences
  Synthetic
tttagttgttttcggtgggtcgggggc

SEQ ID NO: 14097 - DNA, 27 bp, Artificial Sequences
  Synthetic
ttagttgttttcggtgggtcgggggcg

SEQ ID NO: 14098 - DNA, 28 bp, Artificial Sequences
  Synthetic
ttttagttgttttcggtgggtcgggggc

SEQ ID NO: 14099 - DNA, 26 bp, Artificial Sequences
  Synthetic
ttagttgttttcggtgggtcgggggc

SEQ ID NO: 14100 - DNA, 26 bp, Artificial Sequences
  Synthetic
tagttgttttcggtgggtcgggggcg

SEQ ID NO: 14101 - DNA, 29 bp, Artificial Sequences
  Synthetic
gggttaaggtttgataatcggcgtttcgg

SEQ ID NO: 14102 - DNA, 30 bp, Artificial Sequences
  Synthetic
gggttaaggtttgataatcggcgtttcggt

SEQ ID NO: 14103 - DNA, 30 bp, Artificial Sequences
  Synthetic
agggttaaggtttgataatcggcgtttcgg

SEQ ID NO: 14104 - DNA, 31 bp, Artificial Sequences
  Synthetic
agggttaaggtttgataatcggcgtttcggt

SEQ ID NO: 14105 - DNA, 29 bp, Artificial Sequences
  Synthetic
ggttaaggtttgataatcggcgtttcggt

SEQ ID NO: 14106 - DNA, 27 bp, Artificial Sequences
  Synthetic
gcgtgttttgttaggtcggttgggggg

SEQ ID NO: 14107 - DNA, 27 bp, Artificial Sequences
  Synthetic
tggggggattaagtaggggttcggggt

SEQ ID NO: 14108 - DNA, 27 bp, Artificial Sequences
  Synthetic
gtcgggggcgtggcgagattttgtttt

SEQ ID NO: 14109 - DNA, 27 bp, Artificial Sequences
  Synthetic
cggggtcgggatagttgtttgaggggg

SEQ ID NO: 14110 - DNA, 27 bp, Artificial Sequences
  Synthetic
atattggtgagtagtggggcgggtggg

SEQ ID NO: 14111 - DNA, 27 bp, Artificial Sequences
  Synthetic
aggtagcggttagggtatgagggggcg

SEQ ID NO: 14112 - DNA, 26 bp, Artificial Sequences
  Synthetic
ggtagcggttagggtatgagggggcg

SEQ ID NO: 14113 - DNA, 27 bp, Artificial Sequences
  Synthetic
gtagcggttagggtatgagggggcgta

SEQ ID NO: 14114 - DNA, 27 bp, Artificial Sequences
  Synthetic
ggtagcggttagggtatgagggggcgt

SEQ ID NO: 14115 - DNA, 28 bp, Artificial Sequences
  Synthetic
taggtagcggttagggtatgagggggcg

SEQ ID NO: 14116 - DNA, 27 bp, Artificial Sequences
  Synthetic
gcgtgttttgttaggtcggttgggggg

SEQ ID NO: 14117 - DNA, 27 bp, Artificial Sequences
  Synthetic
tagggcgggaattcggtaagggcgttt

SEQ ID NO: 14118 - DNA, 27 bp, Artificial Sequences
  Synthetic
ttagggcgggaattcggtaagggcgtt

SEQ ID NO: 14119 - DNA, 27 bp, Artificial Sequences
  Synthetic
gggcgggaattcggtaagggcgttttt

SEQ ID NO: 14120 - DNA, 27 bp, Artificial Sequences
  Synthetic
tggggggattaagtaggggttcggggt

SEQ ID NO: 14121 - DNA, 27 bp, Artificial Sequences
  Synthetic
atttggttatcggggaggggcgtggtt

SEQ ID NO: 14122 - DNA, 27 bp, Artificial Sequences
  Synthetic
agggtggggtgggagaggagggtaaat

SEQ ID NO: 14123 - DNA, 27 bp, Artificial Sequences
  Synthetic
aggatttggttatcggggaggggcgtg

SEQ ID NO: 14124 - DNA, 27 bp, Artificial Sequences
  Synthetic
ttggttatcggggaggggcgtggtttt

SEQ ID NO: 14125 - DNA, 27 bp, Artificial Sequences
  Synthetic
tttggttatcggggaggggcgtggttt

SEQ ID NO: 14126 - DNA, 30 bp, Artificial Sequences
  Synthetic
acgtgtttttagatttggtgagcgtggaaa

SEQ ID NO: 14127 - DNA, 31 bp, Artificial Sequences
  Synthetic
acgtgtttttagatttggtgagcgtggaaat

SEQ ID NO: 14128 - DNA, 32 bp, Artificial Sequences
  Synthetic
acgtgtttttagatttggtgagcgtggaaatt

SEQ ID NO: 14129 - DNA, 32 bp, Artificial Sequences
  Synthetic
ttacgtgtttttagatttggtgagcgtggaaa

SEQ ID NO: 14130 - DNA, 33 bp, Artificial Sequences
  Synthetic
acgtgtttttagatttggtgagcgtggaaattt

SEQ ID NO: 14131 - DNA, 27 bp, Artificial Sequences
  Synthetic
tcggggattgttgggatttcgttcggt

SEQ ID NO: 14132 - DNA, 27 bp, Artificial Sequences
  Synthetic
cggggattgttgggatttcgttcggtt

SEQ ID NO: 14133 - DNA, 28 bp, Artificial Sequences
  Synthetic
tcggggattgttgggatttcgttcggtt

SEQ ID NO: 14134 - DNA, 28 bp, Artificial Sequences
  Synthetic
ttcggggattgttgggatttcgttcggt

SEQ ID NO: 14135 - DNA, 27 bp, Artificial Sequences
  Synthetic
gggtttcggggattgttgggatttcgt

SEQ ID NO: 14136 - DNA, 23 bp, Artificial Sequences
  Synthetic
ggattcggtgaggcggggaaggc

SEQ ID NO: 14137 - DNA, 24 bp, Artificial Sequences
  Synthetic
gggattcggtgaggcggggaaggc

SEQ ID NO: 14138 - DNA, 23 bp, Artificial Sequences
  Synthetic
gggattcggtgaggcggggaagg

SEQ ID NO: 14139 - DNA, 22 bp, Artificial Sequences
  Synthetic
ggaaggcggcgggaagggatcg

SEQ ID NO: 14140 - DNA, 22 bp, Artificial Sequences
  Synthetic
gggaaggcggcgggaagggatc

SEQ ID NO: 14141 - DNA, 26 bp, Artificial Sequences
  Synthetic
cggcgagttagggaaggtcggggttc

SEQ ID NO: 14142 - DNA, 25 bp, Artificial Sequences
  Synthetic
cggcgagttagggaaggtcggggtt

SEQ ID NO: 14143 - DNA, 27 bp, Artificial Sequences
  Synthetic
gcggcgagttagggaaggtcggggttc

SEQ ID NO: 14144 - DNA, 24 bp, Artificial Sequences
  Synthetic
cggcgagttagggaaggtcggggt

SEQ ID NO: 14145 - DNA, 26 bp, Artificial Sequences
  Synthetic
gcggcgagttagggaaggtcggggtt

SEQ ID NO: 14146 - DNA, 27 bp, Artificial Sequences
  Synthetic
ggtagggtttggaggggagaggcgttt

SEQ ID NO: 14147 - DNA, 27 bp, Artificial Sequences
  Synthetic
tttggtagggtttggaggggagaggcg

SEQ ID NO: 14148 - DNA, 27 bp, Artificial Sequences
  Synthetic
cgggtttggtagggtttggaggggaga

SEQ ID NO: 14149 - DNA, 27 bp, Artificial Sequences
  Synthetic
tcgggtttggtagggtttggaggggag

SEQ ID NO: 14150 - DNA, 27 bp, Artificial Sequences
  Synthetic
ggaaggcggcgggaagggatcgtattt

SEQ ID NO: 14151 - DNA, 26 bp, Artificial Sequences
  Synthetic
cggcgagttagggaaggtcggggttc

SEQ ID NO: 14152 - DNA, 25 bp, Artificial Sequences
  Synthetic
cggcgagttagggaaggtcggggtt

SEQ ID NO: 14153 - DNA, 27 bp, Artificial Sequences
  Synthetic
gcggcgagttagggaaggtcggggttc

SEQ ID NO: 14154 - DNA, 24 bp, Artificial Sequences
  Synthetic
cggcgagttagggaaggtcggggt

SEQ ID NO: 14155 - DNA, 26 bp, Artificial Sequences
  Synthetic
gcggcgagttagggaaggtcggggtt

SEQ ID NO: 14156 - DNA, 27 bp, Artificial Sequences
  Synthetic
taggtgacgggttggttggacggtagc

SEQ ID NO: 14157 - DNA, 27 bp, Artificial Sequences
  Synthetic
tgacgggttggttggacggtagcgtta

SEQ ID NO: 14158 - DNA, 27 bp, Artificial Sequences
  Synthetic
ggtagggtttggaggggagaggcgttt

SEQ ID NO: 14159 - DNA, 27 bp, Artificial Sequences
  Synthetic
tttggtagggtttggaggggagaggcg

SEQ ID NO: 14160 - DNA, 27 bp, Artificial Sequences
  Synthetic
cgggtttggtagggtttggaggggaga

SEQ ID NO: 14161 - DNA, 26 bp, Artificial Sequences
  Synthetic
ggttcgttttgttcggtggcggggtc

SEQ ID NO: 14162 - DNA, 27 bp, Artificial Sequences
  Synthetic
gggttcgttttgttcggtggcggggtc

SEQ ID NO: 14163 - DNA, 25 bp, Artificial Sequences
  Synthetic
ggttcgttttgttcggtggcggggt

SEQ ID NO: 14164 - DNA, 27 bp, Artificial Sequences
  Synthetic
cgggcgtcgtttatatgagtagggggt

SEQ ID NO: 14165 - DNA, 25 bp, Artificial Sequences
  Synthetic
gggttcgttttgttcggtggcgggg

SEQ ID NO: 14166 - DNA, 27 bp, Artificial Sequences
  Synthetic
ggagagcggagggagtgttttggaggg

SEQ ID NO: 14167 - DNA, 27 bp, Artificial Sequences
  Synthetic
gggagagcggagggagtgttttggagg

SEQ ID NO: 14168 - DNA, 27 bp, Artificial Sequences
  Synthetic
gagagcggagggagtgttttggagggt

SEQ ID NO: 14169 - DNA, 27 bp, Artificial Sequences
  Synthetic
cgagggagagcggagggagtgttttgg

SEQ ID NO: 14170 - DNA, 27 bp, Artificial Sequences
  Synthetic
gatgattcggtttgtggaggggggcga

SEQ ID NO: 14171 - DNA, 28 bp, Artificial Sequences
  Synthetic
aggagggttttgggagtaatcgtaggga

SEQ ID NO: 14172 - DNA, 28 bp, Artificial Sequences
  Synthetic
cgggtgttttagtaggagggttttggga

SEQ ID NO: 14173 - DNA, 28 bp, Artificial Sequences
  Synthetic
tcgggtgttttagtaggagggttttggg

SEQ ID NO: 14174 - DNA, 28 bp, Artificial Sequences
  Synthetic
ggagggttttgggagtaatcgtagggac

SEQ ID NO: 14175 - DNA, 29 bp, Artificial Sequences
  Synthetic
tcgggtgttttagtaggagggttttggga

SEQ ID NO: 14176 - DNA, 27 bp, Artificial Sequences
  Synthetic
gtggaggttcgggtcgtttttgcggtt

SEQ ID NO: 14177 - DNA, 27 bp, Artificial Sequences
  Synthetic
ggtcgtggaggttcgggtcgtttttgc

SEQ ID NO: 14178 - DNA, 27 bp, Artificial Sequences
  Synthetic
ggagagcggagggagtgttttggaggg

SEQ ID NO: 14179 - DNA, 27 bp, Artificial Sequences
  Synthetic
gggagagcggagggagtgttttggagg

SEQ ID NO: 14180 - DNA, 27 bp, Artificial Sequences
  Synthetic
gggtcgtggaggttcgggtcgtttttg

SEQ ID NO: 14181 - DNA, 27 bp, Artificial Sequences
  Synthetic
gattggagcgtgattgtgggaagggcg

SEQ ID NO: 14182 - DNA, 27 bp, Artificial Sequences
  Synthetic
attggagcgtgattgtgggaagggcga

SEQ ID NO: 14183 - DNA, 27 bp, Artificial Sequences
  Synthetic
ggagcgtgattgtgggaagggcgaaat

SEQ ID NO: 14184 - DNA, 27 bp, Artificial Sequences
  Synthetic
tggagcgtgattgtgggaagggcgaaa

SEQ ID NO: 14185 - DNA, 27 bp, Artificial Sequences
  Synthetic
ttggagcgtgattgtgggaagggcgaa

SEQ ID NO: 14186 - DNA, 27 bp, Artificial Sequences
  Synthetic
ggcgcgcgggttttcgtttggttttta

SEQ ID NO: 14187 - DNA, 28 bp, Artificial Sequences
  Synthetic
gcgcgcgggttttcgtttggtttttagg

SEQ ID NO: 14188 - DNA, 28 bp, Artificial Sequences
  Synthetic
ggcgcgcgggttttcgtttggtttttag

SEQ ID NO: 14189 - DNA, 26 bp, Artificial Sequences
  Synthetic
ggcgcgcgggttttcgtttggttttt

SEQ ID NO: 14190 - DNA, 28 bp, Artificial Sequences
  Synthetic
cgcgcgggttttcgtttggtttttaggg

SEQ ID NO: 14191 - DNA, 27 bp, Artificial Sequences
  Synthetic
gattggagcgtgattgtgggaagggcg

SEQ ID NO: 14192 - DNA, 27 bp, Artificial Sequences
  Synthetic
attggagcgtgattgtgggaagggcga

SEQ ID NO: 14193 - DNA, 27 bp, Artificial Sequences
  Synthetic
ggagcgtgattgtgggaagggcgaaat

SEQ ID NO: 14194 - DNA, 27 bp, Artificial Sequences
  Synthetic
tggagcgtgattgtgggaagggcgaaa

SEQ ID NO: 14195 - DNA, 27 bp, Artificial Sequences
  Synthetic
ttggagcgtgattgtgggaagggcgaa

SEQ ID NO: 14196 - DNA, 27 bp, Artificial Sequences
  Synthetic
tgaattgttcggatttggggtggcggt

SEQ ID NO: 14197 - DNA, 28 bp, Artificial Sequences
  Synthetic
tgaattgttcggatttggggtggcggtt

SEQ ID NO: 14198 - DNA, 28 bp, Artificial Sequences
  Synthetic
ttgaattgttcggatttggggtggcggt

SEQ ID NO: 14199 - DNA, 27 bp, Artificial Sequences
  Synthetic
gaattgttcggatttggggtggcggtt

SEQ ID NO: 14200 - DNA, 27 bp, Artificial Sequences
  Synthetic
gggcgttgaattgttcggatttggggt

SEQ ID NO: 14201 - DNA, 27 bp, Artificial Sequences
  Synthetic
agcgcggggttaatggaatgtagggtt

SEQ ID NO: 14202 - DNA, 27 bp, Artificial Sequences
  Synthetic
tagcgcggggttaatggaatgtagggt

SEQ ID NO: 14203 - DNA, 27 bp, Artificial Sequences
  Synthetic
gcgcggggttaatggaatgtagggttt

SEQ ID NO: 14204 - DNA, 28 bp, Artificial Sequences
  Synthetic
agcgcggggttaatggaatgtagggttt

SEQ ID NO: 14205 - DNA, 26 bp, Artificial Sequences
  Synthetic
agcgcggggttaatggaatgtagggt

SEQ ID NO: 14206 - DNA, 28 bp, Artificial Sequences
  Synthetic
ggggttggagaggataaggggaaggacg

SEQ ID NO: 14207 - DNA, 29 bp, Artificial Sequences
  Synthetic
ggggttggagaggataaggggaaggacga

SEQ ID NO: 14208 - DNA, 29 bp, Artificial Sequences
  Synthetic
aggggttggagaggataaggggaaggacg

SEQ ID NO: 14209 - DNA, 27 bp, Artificial Sequences
  Synthetic
aggggttggagaggataaggggaagga

SEQ ID NO: 14210 - DNA, 27 bp, Artificial Sequences
  Synthetic
gggttggagaggataaggggaaggacg

SEQ ID NO: 14211 - DNA, 27 bp, Artificial Sequences
  Synthetic
agggcgagagaatggtgcgtttgaaga

SEQ ID NO: 14212 - DNA, 29 bp, Artificial Sequences
  Synthetic
gggcgagagaatggtgcgtttgaagatcg

SEQ ID NO: 14213 - DNA, 27 bp, Artificial Sequences
  Synthetic
gggcgagagaatggtgcgtttgaagat

SEQ ID NO: 14214 - DNA, 28 bp, Artificial Sequences
  Synthetic
agggcgagagaatggtgcgtttgaagat

SEQ ID NO: 14215 - DNA, 28 bp, Artificial Sequences
  Synthetic
tggtgcgtttgaagatcgttttgggtcg

SEQ ID NO: 14216 - DNA, 27 bp, Artificial Sequences
  Synthetic
tagaaggggcggacggagggtaaagtc

SEQ ID NO: 14217 - DNA, 27 bp, Artificial Sequences
  Synthetic
ttagaaggggcggacggagggtaaagt

SEQ ID NO: 14218 - DNA, 26 bp, Artificial Sequences
  Synthetic
agaaggggcggacggagggtaaagtc

SEQ ID NO: 14219 - DNA, 28 bp, Artificial Sequences
  Synthetic
ggggttggagaggataaggggaaggacg

SEQ ID NO: 14220 - DNA, 28 bp, Artificial Sequences
  Synthetic
ttagaaggggcggacggagggtaaagtc

SEQ ID NO: 14221 - DNA, 27 bp, Artificial Sequences
  Synthetic
agggcgagagaatggtgcgtttgaaga

SEQ ID NO: 14222 - DNA, 28 bp, Artificial Sequences
  Synthetic
cgggtggggtggttggtttaagtttcgt

SEQ ID NO: 14223 - DNA, 27 bp, Artificial Sequences
  Synthetic
cgggtggggtggttggtttaagtttcg

SEQ ID NO: 14224 - DNA, 28 bp, Artificial Sequences
  Synthetic
tcgggtggggtggttggtttaagtttcg

SEQ ID NO: 14225 - DNA, 29 bp, Artificial Sequences
  Synthetic
tcgggtggggtggttggtttaagtttcgt

SEQ ID NO: 14226 - DNA, 27 bp, Artificial Sequences
  Synthetic
gcggagggtggttgtttagtcgggagt

SEQ ID NO: 14227 - DNA, 27 bp, Artificial Sequences
  Synthetic
agcggagggtggttgtttagtcgggag

SEQ ID NO: 14228 - DNA, 27 bp, Artificial Sequences
  Synthetic
cgttttggagggatagggaagggcgga

SEQ ID NO: 14229 - DNA, 27 bp, Artificial Sequences
  Synthetic
tcgttttggagggatagggaagggcgg

SEQ ID NO: 14230 - DNA, 27 bp, Artificial Sequences
  Synthetic
aagcggagggtggttgtttagtcggga

SEQ ID NO: 14231 - DNA, 28 bp, Artificial Sequences
  Synthetic
cgggtggggtggttggtttaagtttcgt

SEQ ID NO: 14232 - DNA, 27 bp, Artificial Sequences
  Synthetic
cgggtggggtggttggtttaagtttcg

SEQ ID NO: 14233 - DNA, 28 bp, Artificial Sequences
  Synthetic
tcgggtggggtggttggtttaagtttcg

SEQ ID NO: 14234 - DNA, 29 bp, Artificial Sequences
  Synthetic
tcgggtggggtggttggtttaagtttcgt

SEQ ID NO: 14235 - DNA, 29 bp, Artificial Sequences
  Synthetic
cgggtggggtggttggtttaagtttcgtg

SEQ ID NO: 14236 - DNA, 27 bp, Artificial Sequences
  Synthetic
gcggagggtggttgtttagtcgggagt

SEQ ID NO: 14237 - DNA, 27 bp, Artificial Sequences
  Synthetic
agcggagggtggttgtttagtcgggag

SEQ ID NO: 14238 - DNA, 27 bp, Artificial Sequences
  Synthetic
cgttttggagggatagggaagggcgga

SEQ ID NO: 14239 - DNA, 27 bp, Artificial Sequences
  Synthetic
tcgttttggagggatagggaagggcgg

SEQ ID NO: 14240 - DNA, 27 bp, Artificial Sequences
  Synthetic
aagcggagggtggttgtttagtcggga

SEQ ID NO: 14241 - DNA, 27 bp, Artificial Sequences
  Synthetic
gtgtagttgttgtttttgggtcggggt

SEQ ID NO: 14242 - DNA, 28 bp, Artificial Sequences
  Synthetic
agtgtagttgttgtttttgggtcggggt

SEQ ID NO: 14243 - DNA, 28 bp, Artificial Sequences
  Synthetic
gtgtagttgttgtttttgggtcggggtc

SEQ ID NO: 14244 - DNA, 29 bp, Artificial Sequences
  Synthetic
agtgtagttgttgtttttgggtcggggtc

SEQ ID NO: 14245 - DNA, 29 bp, Artificial Sequences
  Synthetic
aagtgtagttgttgtttttgggtcggggt

SEQ ID NO: 14246 - DNA, 27 bp, Artificial Sequences
  Synthetic
aagagaggaggaggtgggggatgaggg

SEQ ID NO: 14247 - DNA, 27 bp, Artificial Sequences
  Synthetic
gagaggaggaggtgggggatgagggat

SEQ ID NO: 14248 - DNA, 27 bp, Artificial Sequences
  Synthetic
agaggaggaggtgggggatgagggatt

SEQ ID NO: 14249 - DNA, 27 bp, Artificial Sequences
  Synthetic
agagaggaggaggtgggggatgaggga

SEQ ID NO: 14250 - DNA, 28 bp, Artificial Sequences
  Synthetic
aaagagaggaggaggtgggggatgaggg

SEQ ID NO: 14251 - DNA, 27 bp, Artificial Sequences
  Synthetic
cgtttgggttttgagtgttttcggcgg

SEQ ID NO: 14252 - DNA, 28 bp, Artificial Sequences
  Synthetic
cgtttgggttttgagtgttttcggcgga

SEQ ID NO: 14253 - DNA, 28 bp, Artificial Sequences
  Synthetic
tcgtttgggttttgagtgttttcggcgg

SEQ ID NO: 14254 - DNA, 29 bp, Artificial Sequences
  Synthetic
tcgtttgggttttgagtgttttcggcgga

SEQ ID NO: 14255 - DNA, 27 bp, Artificial Sequences
  Synthetic
tcgtttgggttttgagtgttttcggcg

SEQ ID NO: 14256 - DNA, 27 bp, Artificial Sequences
  Synthetic
aaggttaggcggggtatgagtcgtggc

SEQ ID NO: 14257 - DNA, 27 bp, Artificial Sequences
  Synthetic
cggggtatgagtcgtggcgggatgtag

SEQ ID NO: 14258 - DNA, 27 bp, Artificial Sequences
  Synthetic
ggggtatgagtcgtggcgggatgtaga

SEQ ID NO: 14259 - DNA, 26 bp, Artificial Sequences
  Synthetic
aggttaggcggggtatgagtcgtggc

SEQ ID NO: 14260 - DNA, 26 bp, Artificial Sequences
  Synthetic
cggggtatgagtcgtggcgggatgta

SEQ ID NO: 14261 - DNA, 27 bp, Artificial Sequences
  Synthetic
gtcgtttttgttcgggggttcgttcgc

SEQ ID NO: 14262 - DNA, 28 bp, Artificial Sequences
  Synthetic
agtcgtttttgttcgggggttcgttcgc

SEQ ID NO: 14263 - DNA, 27 bp, Artificial Sequences
  Synthetic
aggagtcgtttttgttcgggggttcgt

SEQ ID NO: 14264 - DNA, 27 bp, Artificial Sequences
  Synthetic
agtcgtttttgttcgggggttcgttcg

SEQ ID NO: 14265 - DNA, 27 bp, Artificial Sequences
  Synthetic
ggagtcgtttttgttcgggggttcgtt

SEQ ID NO: 14266 - DNA, 27 bp, Artificial Sequences
  Synthetic
agggtttttaggagggcgttcgggtcg

SEQ ID NO: 14267 - DNA, 27 bp, Artificial Sequences
  Synthetic
gggtttttaggagggcgttcgggtcgt

SEQ ID NO: 14268 - DNA, 27 bp, Artificial Sequences
  Synthetic
gcgtagggtttttaggagggcgttcgg

SEQ ID NO: 14269 - DNA, 27 bp, Artificial Sequences
  Synthetic
ggtttttaggagggcgttcgggtcgtc

SEQ ID NO: 14270 - DNA, 27 bp, Artificial Sequences
  Synthetic
cgtagggtttttaggagggcgttcggg

SEQ ID NO: 14271 - DNA, 27 bp, Artificial Sequences
  Synthetic
gtcgtttttgttcgggggttcgttcgc

SEQ ID NO: 14272 - DNA, 28 bp, Artificial Sequences
  Synthetic
agtcgtttttgttcgggggttcgttcgc

SEQ ID NO: 14273 - DNA, 27 bp, Artificial Sequences
  Synthetic
aggagtcgtttttgttcgggggttcgt

SEQ ID NO: 14274 - DNA, 27 bp, Artificial Sequences
  Synthetic
agtcgtttttgttcgggggttcgttcg

SEQ ID NO: 14275 - DNA, 29 bp, Artificial Sequences
  Synthetic
cggtttcgggtttatatttacggcggcgg

SEQ ID NO: 14276 - DNA, 27 bp, Artificial Sequences
  Synthetic
agggtttttaggagggcgttcgggtcg

SEQ ID NO: 14277 - DNA, 27 bp, Artificial Sequences
  Synthetic
gggtttttaggagggcgttcgggtcgt

SEQ ID NO: 14278 - DNA, 27 bp, Artificial Sequences
  Synthetic
gcgtagggtttttaggagggcgttcgg

SEQ ID NO: 14279 - DNA, 27 bp, Artificial Sequences
  Synthetic
ggtttttaggagggcgttcgggtcgtc

SEQ ID NO: 14280 - DNA, 27 bp, Artificial Sequences
  Synthetic
cgtagggtttttaggagggcgttcggg

SEQ ID NO: 14281 - DNA, 27 bp, Artificial Sequences
  Synthetic
gtcgtttttgttcgggggttcgttcgc

SEQ ID NO: 14282 - DNA, 28 bp, Artificial Sequences
  Synthetic
agtcgtttttgttcgggggttcgttcgc

SEQ ID NO: 14283 - DNA, 27 bp, Artificial Sequences
  Synthetic
aggagtcgtttttgttcgggggttcgt

SEQ ID NO: 14284 - DNA, 27 bp, Artificial Sequences
  Synthetic
agtcgtttttgttcgggggttcgttcg

SEQ ID NO: 14285 - DNA, 29 bp, Artificial Sequences
  Synthetic
cggtttcgggtttatatttacggcggcgg

SEQ ID NO: 14286 - DNA, 24 bp, Artificial Sequences
  Synthetic
gttttggggcgggcggggatagtc

SEQ ID NO: 14287 - DNA, 25 bp, Artificial Sequences
  Synthetic
gttttggggcgggcggggatagtcg

SEQ ID NO: 14288 - DNA, 25 bp, Artificial Sequences
  Synthetic
cgttttggggcgggcggggatagtc

SEQ ID NO: 14289 - DNA, 26 bp, Artificial Sequences
  Synthetic
gttttggggcgggcggggatagtcgg

SEQ ID NO: 14290 - DNA, 24 bp, Artificial Sequences
  Synthetic
ttttggggcgggcggggatagtcg

SEQ ID NO: 14291 - DNA, 29 bp, Artificial Sequences
  Synthetic
cggtttcgggtttatatttacggcggcgg

SEQ ID NO: 14292 - DNA, 28 bp, Artificial Sequences
  Synthetic
cggtttcgggtttatatttacggcggcg

SEQ ID NO: 14293 - DNA, 28 bp, Artificial Sequences
  Synthetic
ggtttcgggtttatatttacggcggcgg

SEQ ID NO: 14294 - DNA, 27 bp, Artificial Sequences
  Synthetic
gtttcgggtttatatttacggcggcgg

SEQ ID NO: 14295 - DNA, 27 bp, Artificial Sequences
  Synthetic
ggtttcgggtttatatttacggcggcg

SEQ ID NO: 14296 - DNA, 26 bp, Artificial Sequences
  Synthetic
gcgcggcgttttttgttttcgttttc

SEQ ID NO: 14297 - DNA, 27 bp, Artificial Sequences
  Synthetic
gcgggttgggaggagtcgtcgtttgat

SEQ ID NO: 14298 - DNA, 27 bp, Artificial Sequences
  Synthetic
ttgcgggttgggaggagtcgtcgtttg

SEQ ID NO: 14299 - DNA, 27 bp, Artificial Sequences
  Synthetic
gttgcgggttgggaggagtcgtcgttt

SEQ ID NO: 14300 - DNA, 27 bp, Artificial Sequences
  Synthetic
ttgggaggagtcgtcgtttgattcgcg

SEQ ID NO: 14301 - DNA, 27 bp, Artificial Sequences
  Synthetic
cgggttgggaggagtcgtcgtttgatt

SEQ ID NO: 14302 - DNA, 27 bp, Artificial Sequences
  Synthetic
gtcggcgcggtttagagttacggtgtt

SEQ ID NO: 14303 - DNA, 27 bp, Artificial Sequences
  Synthetic
cgtcggcgcggtttagagttacggtgt

SEQ ID NO: 14304 - DNA, 27 bp, Artificial Sequences
  Synthetic
tcggcgcggtttagagttacggtgttt

SEQ ID NO: 14305 - DNA, 26 bp, Artificial Sequences
  Synthetic
cgtcggcgcggtttagagttacggtg

SEQ ID NO: 14306 - DNA, 26 bp, Artificial Sequences
  Synthetic
gggttcgggtcggggattgggagttc

SEQ ID NO: 14307 - DNA, 28 bp, Artificial Sequences
  Synthetic
gcgggttaggggtcggattaggttagcg

SEQ ID NO: 14308 - DNA, 27 bp, Artificial Sequences
  Synthetic
gcgggttaggggtcggattaggttagc

SEQ ID NO: 14309 - DNA, 28 bp, Artificial Sequences
  Synthetic
agcgggttaggggtcggattaggttagc

SEQ ID NO: 14310 - DNA, 27 bp, Artificial Sequences
  Synthetic
cgggttaggggtcggattaggttagcg

SEQ ID NO: 14311 - DNA, 28 bp, Artificial Sequences
  Synthetic
cgggttaggggtcggattaggttagcga

SEQ ID NO: 14312 - DNA, 27 bp, Artificial Sequences
  Synthetic
tcggtttttggtcggggaaggggagtt

SEQ ID NO: 14313 - DNA, 27 bp, Artificial Sequences
  Synthetic
ttcggtttttggtcggggaaggggagt

SEQ ID NO: 14314 - DNA, 27 bp, Artificial Sequences
  Synthetic
cggtttttggtcggggaaggggagttt

SEQ ID NO: 14315 - DNA, 28 bp, Artificial Sequences
  Synthetic
tcggtttttggtcggggaaggggagttt

SEQ ID NO: 14316 - DNA, 28 bp, Artificial Sequences
  Synthetic
ttcggtttttggtcggggaaggggagtt

SEQ ID NO: 14317 - DNA, 28 bp, Artificial Sequences
  Synthetic
gcgggttaggggtcggattaggttagcg

SEQ ID NO: 14318 - DNA, 27 bp, Artificial Sequences
  Synthetic
gcgggttaggggtcggattaggttagc

SEQ ID NO: 14319 - DNA, 28 bp, Artificial Sequences
  Synthetic
agcgggttaggggtcggattaggttagc

SEQ ID NO: 14320 - DNA, 27 bp, Artificial Sequences
  Synthetic
cgggttaggggtcggattaggttagcg

SEQ ID NO: 14321 - DNA, 28 bp, Artificial Sequences
  Synthetic
cgggttaggggtcggattaggttagcga

SEQ ID NO: 14322 - DNA, 27 bp, Artificial Sequences
  Synthetic
tcggtttttggtcggggaaggggagtt

SEQ ID NO: 14323 - DNA, 27 bp, Artificial Sequences
  Synthetic
ttcggtttttggtcggggaaggggagt

SEQ ID NO: 14324 - DNA, 27 bp, Artificial Sequences
  Synthetic
cggtttttggtcggggaaggggagttt

SEQ ID NO: 14325 - DNA, 28 bp, Artificial Sequences
  Synthetic
tcggtttttggtcggggaaggggagttt

SEQ ID NO: 14326 - DNA, 28 bp, Artificial Sequences
  Synthetic
ttcggtttttggtcggggaaggggagtt

SEQ ID NO: 14327 - DNA, 27 bp, Artificial Sequences
  Synthetic
cgggtgtaagaggagtttggggaggga

SEQ ID NO: 14328 - DNA, 27 bp, Artificial Sequences
  Synthetic
tcgggtgtaagaggagtttggggaggg

SEQ ID NO: 14329 - DNA, 28 bp, Artificial Sequences
  Synthetic
tcgggtgtaagaggagtttggggaggga

SEQ ID NO: 14330 - DNA, 28 bp, Artificial Sequences
  Synthetic
gtcgggtgtaagaggagtttggggaggg

SEQ ID NO: 14331 - DNA, 28 bp, Artificial Sequences
  Synthetic
cgggtgtaagaggagtttggggagggag

SEQ ID NO: 14332 - DNA, 27 bp, Artificial Sequences
  Synthetic
cgggcgggttgttttttatggtcgtga

SEQ ID NO: 14333 - DNA, 27 bp, Artificial Sequences
  Synthetic
tcgggcgggttgttttttatggtcgtg

SEQ ID NO: 14334 - DNA, 28 bp, Artificial Sequences
  Synthetic
tcgggcgggttgttttttatggtcgtga

SEQ ID NO: 14335 - DNA, 27 bp, Artificial Sequences
  Synthetic
atcgggcgggttgttttttatggtcgt

SEQ ID NO: 14336 - DNA, 28 bp, Artificial Sequences
  Synthetic
cgggcgggttgttttttatggtcgtgag

SEQ ID NO: 14337 - DNA, 32 bp, Artificial Sequences
  Synthetic
tgagttcgttttttaggagagcgtttgagtgt

SEQ ID NO: 14338 - DNA, 32 bp, Artificial Sequences
  Synthetic
gagttcgttttttaggagagcgtttgagtgtt

SEQ ID NO: 14339 - DNA, 32 bp, Artificial Sequences
  Synthetic
ttgagttcgttttttaggagagcgtttgagtg

SEQ ID NO: 14340 - DNA, 33 bp, Artificial Sequences
  Synthetic
tgagttcgttttttaggagagcgtttgagtgtt

SEQ ID NO: 14341 - DNA, 33 bp, Artificial Sequences
  Synthetic
ttgagttcgttttttaggagagcgtttgagtgt

SEQ ID NO: 14342 - DNA, 27 bp, Artificial Sequences
  Synthetic
agcgggttagttggggttggggtgaat

SEQ ID NO: 14343 - DNA, 27 bp, Artificial Sequences
  Synthetic
atagagtagggggaggtggacgggtgg

SEQ ID NO: 14344 - DNA, 27 bp, Artificial Sequences
  Synthetic
gagcgggttagttggggttggggtgaa

SEQ ID NO: 14345 - DNA, 27 bp, Artificial Sequences
  Synthetic
ggacgggtgggtgtgttgggggtattt

SEQ ID NO: 14346 - DNA, 27 bp, Artificial Sequences
  Synthetic
ttgagtttcgtgtgttgggtgaggcgg

SEQ ID NO: 14347 - DNA, 28 bp, Artificial Sequences
  Synthetic
cggagtttagcggttgtagtggcgaagt

SEQ ID NO: 14348 - DNA, 27 bp, Artificial Sequences
  Synthetic
cggagtttagcggttgtagtggcgaag

SEQ ID NO: 14349 - DNA, 29 bp, Artificial Sequences
  Synthetic
cggagtttagcggttgtagtggcgaagtc

SEQ ID NO: 14350 - DNA, 27 bp, Artificial Sequences
  Synthetic
ggagtttagcggttgtagtggcgaagt

SEQ ID NO: 14351 - DNA, 28 bp, Artificial Sequences
  Synthetic
ggagtttagcggttgtagtggcgaagtc

SEQ ID NO: 14352 - DNA, 30 bp, Artificial Sequences
  Synthetic
cgcgtagttttggtatttcggcgtttatgt

SEQ ID NO: 14353 - DNA, 31 bp, Artificial Sequences
  Synthetic
cgcgtagttttggtatttcggcgtttatgtt

SEQ ID NO: 14354 - DNA, 32 bp, Artificial Sequences
  Synthetic
cgcgtagttttggtatttcggcgtttatgttt

SEQ ID NO: 14355 - DNA, 33 bp, Artificial Sequences
  Synthetic
cgcgtagttttggtatttcggcgtttatgtttg

SEQ ID NO: 14356 - DNA, 34 bp, Artificial Sequences
  Synthetic
cgcgtagttttggtatttcggcgtttatgtttgt

SEQ ID NO: 14357 - DNA, 27 bp, Artificial Sequences
  Synthetic
tcggagtgttagggttgcgcgttggta

SEQ ID NO: 14358 - DNA, 27 bp, Artificial Sequences
  Synthetic
tgcggggtttgttggcgcggtagatat

SEQ ID NO: 14359 - DNA, 27 bp, Artificial Sequences
  Synthetic
cggagtgttagggttgcgcgttggtaa

SEQ ID NO: 14360 - DNA, 27 bp, Artificial Sequences
  Synthetic
gcggggtttgttggcgcggtagatata

SEQ ID NO: 14361 - DNA, 27 bp, Artificial Sequences
  Synthetic
gtcggagtgttagggttgcgcgttggt

SEQ ID NO: 14362 - DNA, 29 bp, Artificial Sequences
  Synthetic
gggtgtagagtgtttttgaggttcggaga

SEQ ID NO: 14363 - DNA, 30 bp, Artificial Sequences; identical to SEQ ID NO: 14352
  Synthetic

SEQ ID NO: 14364 - DNA, 31 bp, Artificial Sequences
  Synthetic
cggagattgaagggaagggtagtttttagcg

SEQ ID NO: 14365 - DNA, 32 bp, Artificial Sequences
  Synthetic
cggagattgaagggaagggtagtttttagcgt

SEQ ID NO: 14366 - DNA, 32 bp, Artificial Sequences
  Synthetic
tcggagattgaagggaagggtagtttttagcg

SEQ ID NO: 14367 - DNA, 27 bp, Artificial Sequences
  Synthetic
tcggagtgttagggttgcgcgttggta

SEQ ID NO: 14368 - DNA, 27 bp, Artificial Sequences
  Synthetic
tttggggaaggagagggagacgcgttg

SEQ ID NO: 14369 - DNA, 27 bp, Artificial Sequences
  Synthetic
gtttggggaaggagagggagacgcgtt

SEQ ID NO: 14370 - DNA, 27 bp, Artificial Sequences
  Synthetic
tgcggggtttgttggcgcggtagatat

SEQ ID NO: 14371 - DNA, 27 bp, Artificial Sequences
  Synthetic
cggagtgttagggttgcgcgttggtaa

SEQ ID NO: 14372 - DNA, 28 bp, Artificial Sequences
  Synthetic
cgggtgtagagtgtttttgaggttcgga

SEQ ID NO: 14373 - DNA, 28 bp, Artificial Sequences
  Synthetic
tcgggtgtagagtgtttttgaggttcgg

SEQ ID NO: 14374 - DNA, 29 bp, Artificial Sequences
  Synthetic
tcgggtgtagagtgtttttgaggttcgga

SEQ ID NO: 14375 - DNA, 28 bp, Artificial Sequences
  Synthetic
gggacggttgtgtttgttttattcgggt

SEQ ID NO: 14376 - DNA, 29 bp, Artificial Sequences
  Synthetic
cgggtgtagagtgtttttgaggttcggag

SEQ ID NO: 14377 - DNA, 27 bp, Artificial Sequences
  Synthetic
cgagggaaaaacgaggcgagaggggag

SEQ ID NO: 14378 - DNA, 27 bp, Artificial Sequences
  Synthetic
cgaggcgagaggggagaaggcgatttc

SEQ ID NO: 14379 - DNA, 27 bp, Artificial Sequences
  Synthetic
gagggaaaaacgaggcgagaggggaga

SEQ ID NO: 14380 - DNA, 27 bp, Artificial Sequences
  Synthetic
aaaaacgaggcgagaggggagaaggcg

SEQ ID NO: 14381 - DNA, 27 bp, Artificial Sequences
  Synthetic
agggaaaaacgaggcgagaggggagaa

SEQ ID NO: 14382 - DNA, 25 bp, Artificial Sequences
  Synthetic
cgggtcgtttgggtagggggcgtag

SEQ ID NO: 14383 - DNA, 24 bp, Artificial Sequences
  Synthetic
cgggtcgtttgggtagggggcgta

SEQ ID NO: 14384 - DNA, 27 bp, Artificial Sequences
  Synthetic
tagggatggtttggggcgcgacgggtc

SEQ ID NO: 14385 - DNA, 27 bp, Artificial Sequences
  Synthetic
agtttgtttttggaattcgggaggcgt

SEQ ID NO: 14386 - DNA, 24 bp, Artificial Sequences
  Synthetic
tagggatggtttggggcgcgacgg

SEQ ID NO: 14387 - DNA, 27 bp, Artificial Sequences
  Synthetic
cgagggaaaaacgaggcgagaggggag

SEQ ID NO: 14388 - DNA, 27 bp, Artificial Sequences
  Synthetic
cgaggcgagaggggagaaggcgatttc

SEQ ID NO: 14389 - DNA, 27 bp, Artificial Sequences
  Synthetic
gagggaaaaacgaggcgagaggggaga

SEQ ID NO: 14390 - DNA, 27 bp, Artificial Sequences
  Synthetic
aaaaacgaggcgagaggggagaaggcg

SEQ ID NO: 14391 - DNA, 27 bp, Artificial Sequences
  Synthetic
agggaaaaacgaggcgagaggggagaa

SEQ ID NO: 14392 - DNA, 27 bp, Artificial Sequences
  Synthetic
taatggtagggatggtttggggcgcga

SEQ ID NO: 14393 - DNA, 27 bp, Artificial Sequences
  Synthetic
aatggtagggatggtttggggcgcgac

SEQ ID NO: 14394 - DNA, 27 bp, Artificial Sequences
  Synthetic
ataatggtagggatggtttggggcgcg

SEQ ID NO: 14395 - DNA, 28 bp, Artificial Sequences
  Synthetic
ataatggtagggatggtttggggcgcga

SEQ ID NO: 14396 - DNA, 28 bp, Artificial Sequences
  Synthetic
taatggtagggatggtttggggcgcgac

SEQ ID NO: 14397 - DNA, 29 bp, Artificial Sequences
  Synthetic
cgtggtcgttgcgttttttgtttaggcgg

SEQ ID NO: 14398 - DNA, 28 bp, Artificial Sequences
  Synthetic
tggtcgttgcgttttttgtttaggcggt

SEQ ID NO: 14399 - DNA, 27 bp, Artificial Sequences
  Synthetic
ggtcgttgcgttttttgtttaggcggt

SEQ ID NO: 14400 - DNA, 27 bp, Artificial Sequences
  Synthetic
tggtcgttgcgttttttgtttaggcgg

SEQ ID NO: 14401 - DNA, 28 bp, Artificial Sequences
  Synthetic
cgtggtcgttgcgttttttgtttaggcg

SEQ ID NO: 14402 - DNA, 27 bp, Artificial Sequences
  Synthetic
taatggtagggatggtttggggcgcga

SEQ ID NO: 14403 - DNA, 27 bp, Artificial Sequences
  Synthetic
aatggtagggatggtttggggcgcgac

SEQ ID NO: 14404 - DNA, 27 bp, Artificial Sequences
  Synthetic
ataatggtagggatggtttggggcgcg

SEQ ID NO: 14405 - DNA, 28 bp, Artificial Sequences
  Synthetic
ataatggtagggatggtttggggcgcga

SEQ ID NO: 14406 - DNA, 28 bp, Artificial Sequences
  Synthetic
taatggtagggatggtttggggcgcgac

SEQ ID NO: 14407 - DNA, 27 bp, Artificial Sequences
  Synthetic
gggagagatcgttgcggggtagttcgg

SEQ ID NO: 14408 - DNA, 27 bp, Artificial Sequences
  Synthetic
ggagagatcgttgcggggtagttcggt

SEQ ID NO: 14409 - DNA, 27 bp, Artificial Sequences
  Synthetic
agatcgttgcggggtagttcggttcgg

SEQ ID NO: 14410 - DNA, 27 bp, Artificial Sequences
  Synthetic
cgggagagatcgttgcggggtagttcg

SEQ ID NO: 14411 - DNA, 27 bp, Artificial Sequences
  Synthetic
tcgggagagatcgttgcggggtagttc

SEQ ID NO: 14412 - DNA, 27 bp, Artificial Sequences
  Synthetic
ttgcggggagggagtggttgtttaggg

SEQ ID NO: 14413 - DNA, 27 bp, Artificial Sequences
  Synthetic
tcgttgcggggagggagtggttgttta

SEQ ID NO: 14414 - DNA, 27 bp, Artificial Sequences
  Synthetic
gcggggagggagtggttgtttagggat

SEQ ID NO: 14415 - DNA, 27 bp, Artificial Sequences
  Synthetic
cgttgcggggagggagtggttgtttag

SEQ ID NO: 14416 - DNA, 27 bp, Artificial Sequences
  Synthetic
gttgcggggagggagtggttgtttagg

SEQ ID NO: 14417 - DNA, 27 bp, Artificial Sequences
  Synthetic
tcgtttgggaggagtattgggggcgtt

SEQ ID NO: 14418 - DNA, 27 bp, Artificial Sequences
  Synthetic
ttcgtttgggaggagtattgggggcgt

SEQ ID NO: 14419 - DNA, 27 bp, Artificial Sequences
  Synthetic
ggtcgttcgttgggttcgcggtagttt

SEQ ID NO: 14420 - DNA, 27 bp, Artificial Sequences
  Synthetic
ggaggagtattgggggcgttaggggtt

SEQ ID NO: 14421 - DNA, 27 bp, Artificial Sequences
  Synthetic
ttgggaggagtattgggggcgttaggg

SEQ ID NO: 14422 - DNA, 27 bp, Artificial Sequences
  Synthetic
gagtcgtagggtcgggttgagtttcgc

SEQ ID NO: 14423 - DNA, 28 bp, Artificial Sequences
  Synthetic
cggagtcgtagggtcgggttgagtttcg

SEQ ID NO: 14424 - DNA, 28 bp, Artificial Sequences
  Synthetic
ggagtcgtagggtcgggttgagtttcgc

SEQ ID NO: 14425 - DNA, 27 bp, Artificial Sequences
  Synthetic
ggagtcgtagggtcgggttgagtttcg

SEQ ID NO: 14426 - DNA, 27 bp, Artificial Sequences
  Synthetic
cggagtcgtagggtcgggttgagtttc

SEQ ID NO: 14427 - DNA, 27 bp, Artificial Sequences
  Synthetic
gtttcgttttttggtgttcggcggcgg

SEQ ID NO: 14428 - DNA, 27 bp, Artificial Sequences
  Synthetic
ggtttcgttttttggtgttcggcggcg

SEQ ID NO: 14429 - DNA, 27 bp, Artificial Sequences
  Synthetic
gggtttcgttttttggtgttcggcggc

SEQ ID NO: 14430 - DNA, 27 bp, Artificial Sequences
  Synthetic
tttcgttttttggtgttcggcggcgga

SEQ ID NO: 14431 - DNA, 27 bp, Artificial Sequences
  Synthetic
ttcgttttttggtgttcggcggcggag

SEQ ID NO: 14432 - DNA, 27 bp, Artificial Sequences
  Synthetic
cgagggcggggattcgtagttttaagt

SEQ ID NO: 14433 - DNA, 28 bp, Artificial Sequences
  Synthetic
cgagggcggggattcgtagttttaagtt

SEQ ID NO: 14434 - DNA, 23 bp, Artificial Sequences
  Synthetic
gggtgtttagcgcggcgtttcgg

SEQ ID NO: 14435 - DNA, 29 bp, Artificial Sequences
  Synthetic
cgagggcggggattcgtagttttaagtta

SEQ ID NO: 14436 - DNA, 31 bp, Artificial Sequences
  Synthetic
gggcggggattcgtagttttaagttagaggg

SEQ ID NO: 14437 - DNA, 27 bp, Artificial Sequences
  Synthetic
gtttcgttttttggtgttcggcggcgg

SEQ ID NO: 14438 - DNA, 27 bp, Artificial Sequences
  Synthetic
ggtttcgttttttggtgttcggcggcg

SEQ ID NO: 14439 - DNA, 27 bp, Artificial Sequences
  Synthetic
gggtttcgttttttggtgttcggcggc

SEQ ID NO: 14440 - DNA, 27 bp, Artificial Sequences
  Synthetic
tttcgttttttggtgttcggcggcgga

SEQ ID NO: 14441 - DNA, 27 bp, Artificial Sequences
  Synthetic
ttcgttttttggtgttcggcggcggag

SEQ ID NO: 14442 - DNA, 27 bp, Artificial Sequences
  Synthetic
cgagggcggggattcgtagttttaagt

SEQ ID NO: 14443 - DNA, 28 bp, Artificial Sequences
  Synthetic
cgagggcggggattcgtagttttaagtt

SEQ ID NO: 14444 - DNA, 23 bp, Artificial Sequences
  Synthetic
gggtgtttagcgcggcgtttcgg

SEQ ID NO: 14445 - DNA, 29 bp, Artificial Sequences
  Synthetic
cgagggcggggattcgtagttttaagtta

SEQ ID NO: 14446 - DNA, 31 bp, Artificial Sequences; identical to SEQ ID NO: 14436
  Synthetic

SEQ ID NO: 14447 - DNA, 27 bp, Artificial Sequences
  Synthetic
gtttcgttttttggtgttcggcggcgg

SEQ ID NO: 14448 - DNA, 27 bp, Artificial Sequences
  Synthetic
ggtttcgttttttggtgttcggcggcg

SEQ ID NO: 14449 - DNA, 27 bp, Artificial Sequences
  Synthetic
gggtttcgttttttggtgttcggcggc

SEQ ID NO: 14450 - DNA, 27 bp, Artificial Sequences
  Synthetic
tttcgttttttggtgttcggcggcgga

SEQ ID NO: 14451 - DNA, 27 bp, Artificial Sequences
  Synthetic
ttcgttttttggtgttcggcggcggag

SEQ ID NO: 14452 - DNA, 23 bp, Artificial Sequences
  Synthetic
gggtgtttagcgcggcgtttcgg

SEQ ID NO: 14453 - DNA, 22 bp, Artificial Sequences
  Synthetic
ggtgtttagcgcggcgtttcgg

SEQ ID NO: 14454 - DNA, 22 bp, Artificial Sequences
  Synthetic
gggtgtttagcgcggcgtttcg

SEQ ID NO: 14455 - DNA, 19 bp, Artificial Sequences
  Synthetic
gcgcggcgtttcggttcga

SEQ ID NO: 14456 - DNA, 30 bp, Artificial Sequences
  Synthetic
tgaggtgagaataggttttttgtggggtga

SEQ ID NO: 14457 - DNA, 31 bp, Artificial Sequences
  Synthetic
tgaggtgagaataggttttttgtggggtgaa

SEQ ID NO: 14458 - DNA, 31 bp, Artificial Sequences
  Synthetic
ttgaggtgagaataggttttttgtggggtga

SEQ ID NO: 14459 - DNA, 32 bp, Artificial Sequences
  Synthetic
ttgaggtgagaataggttttttgtggggtgaa

SEQ ID NO: 14460 - DNA, 32 bp, Artificial Sequences
  Synthetic
tttgaggtgagaataggttttttgtggggtga

SEQ ID NO: 14461 - DNA, 31 bp, Artificial Sequences
  Synthetic
agcgtttgttaagtgggggagattttatcga

SEQ ID NO: 14462 - DNA, 33 bp, Artificial Sequences
  Synthetic
gcgtttgttaagtgggggagattttatcgatcg

SEQ ID NO: 14463 - DNA, 32 bp, Artificial Sequences
  Synthetic
aagcgtttgttaagtgggggagattttatcga

SEQ ID NO: 14464 - DNA, 32 bp, Artificial Sequences
  Synthetic
tgttaagtgggggagattttatcgatcgaacg

SEQ ID NO: 14465 - DNA, 32 bp, Artificial Sequences
  Synthetic
agcgtttgttaagtgggggagattttatcgat

SEQ ID NO: 14466 - DNA, 27 bp, Artificial Sequences
  Synthetic
agtcgaggttggatttttagcggtcgt

SEQ ID NO: 14467 - DNA, 28 bp, Artificial Sequences
  Synthetic
cgaggttggatttttagcggtcgtttgc

SEQ ID NO: 14468 - DNA, 28 bp, Artificial Sequences
  Synthetic
gagtcgaggttggatttttagcggtcgt

SEQ ID NO: 14469 - DNA, 29 bp, Artificial Sequences
  Synthetic
tcgaggttggatttttagcggtcgtttgc

SEQ ID NO: 14470 - DNA, 27 bp, Artificial Sequences
  Synthetic
gagtcgaggttggatttttagcggtcg

SEQ ID NO: 14471 - DNA, 27 bp, Artificial Sequences
  Synthetic
tggcggtggttatacgggttttaggga

SEQ ID NO: 14472 - DNA, 27 bp, Artificial Sequences
  Synthetic
atggcggtggttatacgggttttaggg

SEQ ID NO: 14473 - DNA, 28 bp, Artificial Sequences
  Synthetic
tggcggtggttatacgggttttagggat

SEQ ID NO: 14474 - DNA, 28 bp, Artificial Sequences
  Synthetic
atggcggtggttatacgggttttaggga

SEQ ID NO: 14475 - DNA, 27 bp, Artificial Sequences
  Synthetic
ggcggtggttatacgggttttagggat

SEQ ID NO: 14476 - DNA, 27 bp, Artificial Sequences
  Synthetic
agtcgaggttggatttttagcggtcgt

SEQ ID NO: 14477 - DNA, 28 bp, Artificial Sequences
  Synthetic
cgaggttggatttttagcggtcgtttgc

SEQ ID NO: 14478 - DNA, 28 bp, Artificial Sequences
  Synthetic
gagtcgaggttggatttttagcggtcgt

SEQ ID NO: 14479 - DNA, 29 bp, Artificial Sequences
  Synthetic
tcgaggttggatttttagcggtcgtttgc

SEQ ID NO: 14480 - DNA, 27 bp, Artificial Sequences
  Synthetic
gagtcgaggttggatttttagcggtcg

SEQ ID NO: 14481 - DNA, 27 bp, Artificial Sequences
  Synthetic
tttcggggttttgcgacggtgttggag

SEQ ID NO: 14482 - DNA, 27 bp, Artificial Sequences
  Synthetic
ggttttgcgacggtgttggagggtgtt

SEQ ID NO: 14483 - DNA, 27 bp, Artificial Sequences
  Synthetic
ttgcgacggtgttggagggtgttttcg

SEQ ID NO: 14484 - DNA, 27 bp, Artificial Sequences
  Synthetic
ttttcggggttttgcgacggtgttgga

SEQ ID NO: 14485 - DNA, 27 bp, Artificial Sequences
  Synthetic
cgacggtgttggagggtgttttcggtt

SEQ ID NO: 14486 - DNA, 28 bp, Artificial Sequences
  Synthetic
ggagttggggaggtatggttattggcgt

SEQ ID NO: 14487 - DNA, 27 bp, Artificial Sequences
  Synthetic
ggagttggggaggtatggttattggcg

SEQ ID NO: 14488 - DNA, 29 bp, Artificial Sequences
  Synthetic
aggagttggggaggtatggttattggcgt

SEQ ID NO: 14489 - DNA, 28 bp, Artificial Sequences
  Synthetic
aggagttggggaggtatggttattggcg

SEQ ID NO: 14490 - DNA, 27 bp, Artificial Sequences
  Synthetic
gagttggggaggtatggttattggcgt

SEQ ID NO: 14491 - DNA, 27 bp, Artificial Sequences
  Synthetic
tttcggggttttgcgacggtgttggag

SEQ ID NO: 14492 - DNA, 27 bp, Artificial Sequences
  Synthetic
ggttttgcgacggtgttggagggtgtt

SEQ ID NO: 14493 - DNA, 27 bp, Artificial Sequences
  Synthetic
ttgcgacggtgttggagggtgttttcg

SEQ ID NO: 14494 - DNA, 27 bp, Artificial Sequences
  Synthetic
ttttcggggttttgcgacggtgttgga

SEQ ID NO: 14495 - DNA, 27 bp, Artificial Sequences
  Synthetic
gggaggtttgcgcggggattaggtttt

SEQ ID NO: 14496 - DNA, 27 bp, Artificial Sequences
  Synthetic
gattggggttgggaggagttggggagg

SEQ ID NO: 14497 - DNA, 27 bp, Artificial Sequences
  Synthetic
tggggttgggaggagttggggaggtat

SEQ ID NO: 14498 - DNA, 27 bp, Artificial Sequences
  Synthetic
tgggaggattttcgggttaggcgtcgg

SEQ ID NO: 14499 - DNA, 27 bp, Artificial Sequences
  Synthetic
gggaggattttcgggttaggcgtcggt

SEQ ID NO: 14500 - DNA, 27 bp, Artificial Sequences
  Synthetic
agtgattggggttgggaggagttgggg

SEQ ID NO: 14501 - DNA, 27 bp, Artificial Sequences
  Synthetic
ggggtcggatgcgggatttttgggttg

SEQ ID NO: 14502 - DNA, 27 bp, Artificial Sequences
  Synthetic
cggatgcgggatttttgggttgcggtt

SEQ ID NO: 14503 - DNA, 27 bp, Artificial Sequences
  Synthetic
gggaggtttgcgcggggattaggtttt

SEQ ID NO: 14504 - DNA, 27 bp, Artificial Sequences
  Synthetic
gggtcggatgcgggatttttgggttgc

SEQ ID NO: 14505 - DNA, 27 bp, Artificial Sequences
  Synthetic
gatgtggggaggtttgcgcggggatta

SEQ ID NO: 14506 - DNA, 27 bp, Artificial Sequences
  Synthetic
gattggggttgggaggagttggggagg

SEQ ID NO: 14507 - DNA, 27 bp, Artificial Sequences
  Synthetic
tggggttgggaggagttggggaggtat

SEQ ID NO: 14508 - DNA, 27 bp, Artificial Sequences
  Synthetic
tgggaggattttcgggttaggcgtcgg

SEQ ID NO: 14509 - DNA, 27 bp, Artificial Sequences
  Synthetic
gggaggattttcgggttaggcgtcggt

SEQ ID NO: 14510 - DNA, 27 bp, Artificial Sequences
  Synthetic
agtgattggggttgggaggagttgggg

SEQ ID NO: 14511 - DNA, 27 bp, Artificial Sequences
  Synthetic
ggagggggagaggggtggattttgtcg

SEQ ID NO: 14512 - DNA, 27 bp, Artificial Sequences
  Synthetic
ttaggggtcgcgggtagtaggaggagg

SEQ ID NO: 14513 - DNA, 27 bp, Artificial Sequences
  Synthetic
cgggtagtaggaggagggggcggttta

SEQ ID NO: 14514 - DNA, 27 bp, Artificial Sequences
  Synthetic
ggggagtcgcgggtggttttggatttt

SEQ ID NO: 14515 - DNA, 27 bp, Artificial Sequences
  Synthetic
tgttaggggtcgcgggtagtaggagga

SEQ ID NO: 14516 - DNA, 27 bp, Artificial Sequences
  Synthetic
cgtttcgggtcgtgttttggcgtggtt

SEQ ID NO: 14517 - DNA, 27 bp, Artificial Sequences
  Synthetic
gcgggtcggttgtaggcggagatttgt

SEQ ID NO: 14518 - DNA, 28 bp, Artificial Sequences
  Synthetic
cgtttcgggtcgtgttttggcgtggtta

SEQ ID NO: 14519 - DNA, 28 bp, Artificial Sequences
  Synthetic
gcgggtcggttgtaggcggagatttgta

SEQ ID NO: 14520 - DNA, 26 bp, Artificial Sequences
  Synthetic
gcgggtcggttgtaggcggagatttg

SEQ ID NO: 14521 - DNA, 27 bp, Artificial Sequences
  Synthetic
cgggtaggggagtcgtcgtgttttggt

SEQ ID NO: 14522 - DNA, 27 bp, Artificial Sequences
  Synthetic
ggtttcgaggtggggtttggtcgggta

SEQ ID NO: 14523 - DNA, 27 bp, Artificial Sequences
  Synthetic
tttcgaggtggggtttggtcgggtagg

SEQ ID NO: 14524 - DNA, 27 bp, Artificial Sequences
  Synthetic
gaaggtgaggagtgggcggggattagg

SEQ ID NO: 14525 - DNA, 27 bp, Artificial Sequences
  Synthetic
ggtcgggtaggggagtcgtcgtgtttt

SEQ ID NO: 14526 - DNA, 27 bp, Artificial Sequences
  Synthetic
tcgggggtttttgggtttttagcggcg

SEQ ID NO: 14527 - DNA, 27 bp, Artificial Sequences
  Synthetic
tgtagttttgcggagaggggcgtgagg

SEQ ID NO: 14528 - DNA, 27 bp, Artificial Sequences
  Synthetic
cgggggtttttgggtttttagcggcgt

SEQ ID NO: 14529 - DNA, 27 bp, Artificial Sequences
  Synthetic
cgcgcgtcgtttcggaaggtgagtagt

SEQ ID NO: 14530 - DNA, 27 bp, Artificial Sequences
  Synthetic
gcggcgttttgtagttttgcggagagg

SEQ ID NO: 14531 - DNA, 27 bp, Artificial Sequences
  Synthetic
gcggtgagttttagttcggcgcgtttt

SEQ ID NO: 14532 - DNA, 28 bp, Artificial Sequences
  Synthetic
gcggtgagttttagttcggcgcgttttg

SEQ ID NO: 14533 - DNA, 26 bp, Artificial Sequences
  Synthetic
gcggtgagttttagttcggcgcgttt

SEQ ID NO: 14534 - DNA, 28 bp, Artificial Sequences
  Synthetic
cggtgagttttagttcggcgcgttttgt

SEQ ID NO: 14535 - DNA, 27 bp, Artificial Sequences
  Synthetic
cggtgagttttagttcggcgcgttttg

SEQ ID NO: 14536 - DNA, 27 bp, Artificial Sequences
  Synthetic
tcgggggtttttgggtttttagcggcg

SEQ ID NO: 14537 - DNA, 27 bp, Artificial Sequences
  Synthetic
tgtagttttgcggagaggggcgtgagg

SEQ ID NO: 14538 - DNA, 27 bp, Artificial Sequences
  Synthetic
cgggggtttttgggtttttagcggcgt

SEQ ID NO: 14539 - DNA, 27 bp, Artificial Sequences
  Synthetic
cggtcggcggagttttaggtttggggt

SEQ ID NO: 14540 - DNA, 27 bp, Artificial Sequences
  Synthetic
ggtcggcggagttttaggtttggggtt

SEQ ID NO: 14541 - DNA, 36 bp, Artificial Sequences
  Synthetic
tgaggattgtggcgggtagaatttgtatttttatga

SEQ ID NO: 14542 - DNA, 36 bp, Artificial Sequences
  Synthetic
ttgaggattgtggcgggtagaatttgtatttttatg

SEQ ID NO: 14543 - DNA, 27 bp, Artificial Sequences
  Synthetic
cggggaggggagggtagtaagagtcgt

SEQ ID NO: 14544 - DNA, 27 bp, Artificial Sequences
  Synthetic
acggggaggggagggtagtaagagtcg

SEQ ID NO: 14545 - DNA, 27 bp, Artificial Sequences
  Synthetic
tggttgacggggaggggagggtagtaa

SEQ ID NO: 14546 - DNA, 27 bp, Artificial Sequences
  Synthetic
ttggttgacggggaggggagggtagta

SEQ ID NO: 14547 - DNA, 27 bp, Artificial Sequences
  Synthetic
ggggggagtggggttgaggattaacgt

SEQ ID NO: 14548 - DNA, 27 bp, Artificial Sequences
  Synthetic
ggaaggtgggcgtgtgatgtaggggaa

SEQ ID NO: 14549 - DNA, 27 bp, Artificial Sequences
  Synthetic
ttggggaaggtgggcgtgtgatgtagg

SEQ ID NO: 14550 - DNA, 27 bp, Artificial Sequences
  Synthetic
tgggtttattggggaaggtgggcgtgt

SEQ ID NO: 14551 - DNA, 27 bp, Artificial Sequences
  Synthetic
ggttgggtttattggggaaggtgggcg

SEQ ID NO: 14552 - DNA, 27 bp, Artificial Sequences
  Synthetic
gggtttattggggaaggtgggcgtgtg

SEQ ID NO: 14553 - DNA, 27 bp, Artificial Sequences
  Synthetic
ttatggggggaattgggggtggtagcg

SEQ ID NO: 14554 - DNA, 27 bp, Artificial Sequences
  Synthetic
ttgtcgggtgcgagcgggtttaggttt

SEQ ID NO: 14555 - DNA, 27 bp, Artificial Sequences
  Synthetic
ggggaattgggggtggtagcggttgtc

SEQ ID NO: 14556 - DNA, 28 bp, Artificial Sequences
  Synthetic
tttatggggggaattgggggtggtagcg

SEQ ID NO: 14557 - DNA, 27 bp, Artificial Sequences
  Synthetic
tcgggtgcgagcgggtttaggtttgtg

SEQ ID NO: 14558 - DNA, 27 bp, Artificial Sequences
  Synthetic
gaggtagcggaggaggaagggggtagt

SEQ ID NO: 14559 - DNA, 27 bp, Artificial Sequences
  Synthetic
tcgttgggttggagggtggagtgttgt

SEQ ID NO: 14560 - DNA, 27 bp, Artificial Sequences
  Synthetic
ggtcgttgggttggagggtggagtgtt

SEQ ID NO: 14561 - DNA, 27 bp, Artificial Sequences
  Synthetic
aggtagcggaggaggaagggggtagtt

SEQ ID NO: 14562 - DNA, 27 bp, Artificial Sequences
  Synthetic
aggggtttcgggttggtgtagttcggt

SEQ ID NO: 14563 - DNA, 30 bp, Artificial Sequences
  Synthetic
gggattataggcgtgagttattgtgtcggg

SEQ ID NO: 14564 - DNA, 31 bp, Artificial Sequences
  Synthetic
gggattataggcgtgagttattgtgtcgggt

SEQ ID NO: 14565 - DNA, 31 bp, Artificial Sequences
  Synthetic
tgggattataggcgtgagttattgtgtcggg

SEQ ID NO: 14566 - DNA, 32 bp, Artificial Sequences
  Synthetic
tgggattataggcgtgagttattgtgtcgggt

SEQ ID NO: 14567 - DNA, 30 bp, Artificial Sequences
  Synthetic
ggattataggcgtgagttattgtgtcgggt

SEQ ID NO: 14568 - DNA, 27 bp, Artificial Sequences
  Synthetic
tgcggtttttggcggtgattgtagttt

SEQ ID NO: 14569 - DNA, 27 bp, Artificial Sequences
  Synthetic
ttgcggtttttggcggtgattgtagtt

SEQ ID NO: 14570 - DNA, 27 bp, Artificial Sequences
  Synthetic
tttgcggtttttggcggtgattgtagt

SEQ ID NO: 14571 - DNA, 28 bp, Artificial Sequences
  Synthetic
tgcggtttttggcggtgattgtagtttt

SEQ ID NO: 14572 - DNA, 28 bp, Artificial Sequences
  Synthetic
ttgcggtttttggcggtgattgtagttt

SEQ ID NO: 14573 - DNA, 27 bp, Artificial Sequences
  Synthetic
gcggcgtttcgaggattaggaatgggg

SEQ ID NO: 14574 - DNA, 27 bp, Artificial Sequences
  Synthetic
cgaggattaggaatggggtttcgggcg

SEQ ID NO: 14575 - DNA, 27 bp, Artificial Sequences
  Synthetic
attaggaatggggtttcgggcgttggg

SEQ ID NO: 14576 - DNA, 27 bp, Artificial Sequences
  Synthetic
cgtgagcggcgtttcgaggattaggaa

SEQ ID NO: 14577 - DNA, 28 bp, Artificial Sequences
  Synthetic
tcgaggattaggaatggggtttcgggcg

SEQ ID NO: 14578 - DNA, 27 bp, Artificial Sequences
  Synthetic
gcggtttttcggggaataggcggttgt

SEQ ID NO: 14579 - DNA, 27 bp, Artificial Sequences
  Synthetic
ttcgggggtagcggtttttcggggaat

SEQ ID NO: 14580 - DNA, 27 bp, Artificial Sequences
  Synthetic
gttagggggtttcgggggtagcggttt

SEQ ID NO: 14581 - DNA, 27 bp, Artificial Sequences
  Synthetic
gtagtcgggcggttcgggcgtttttag

SEQ ID NO: 14582 - DNA, 27 bp, Artificial Sequences
  Synthetic
tagggggtttcgggggtagcggttttt

SEQ ID NO: 14583 - DNA, 30 bp, Artificial Sequences
  Synthetic
gaggagtcgttgttttcgggattttttggt

SEQ ID NO: 14584 - DNA, 31 bp, Artificial Sequences
  Synthetic
cgttgttttcgggattttttggtattgtgcg

SEQ ID NO: 14585 - DNA, 32 bp, Artificial Sequences
  Synthetic
cgttgttttcgggattttttggtattgtgcgt

SEQ ID NO: 14586 - DNA, 32 bp, Artificial Sequences
  Synthetic
tcgttgttttcgggattttttggtattgtgcg

SEQ ID NO: 14587 - DNA, 33 bp, Artificial Sequences
  Synthetic
tcgttgttttcgggattttttggtattgtgcgt

SEQ ID NO: 14588 - DNA, 27 bp, Artificial Sequences
  Synthetic
gtcgggggttatggttttcgagggggt

SEQ ID NO: 14589 - DNA, 27 bp, Artificial Sequences
  Synthetic
ggttcgcgtcgggggttatggttttcg

SEQ ID NO: 14590 - DNA, 27 bp, Artificial Sequences
  Synthetic
agggggtatcggcggttgagttgttgt

SEQ ID NO: 14591 - DNA, 27 bp, Artificial Sequences
  Synthetic
gggttcgcgtcgggggttatggttttc

SEQ ID NO: 14592 - DNA, 27 bp, Artificial Sequences
  Synthetic
ggttgaggtggtttcgcgcggtttagg

SEQ ID NO: 14593 - DNA, 34 bp, Artificial Sequences
  Synthetic
ggcgatcgtagggttatagtagtttagtcgtcgg

SEQ ID NO: 14594 - DNA, 32 bp, Artificial Sequences
  Synthetic
gcgagttttttaggcgatcgtagggttatagt

SEQ ID NO: 14595 - DNA, 35 bp, Artificial Sequences
  Synthetic
ggcgatcgtagggttatagtagtttagtcgtcggt

SEQ ID NO: 14596 - DNA, 33 bp, Artificial Sequences
  Synthetic
gcgatcgtagggttatagtagtttagtcgtcgg

SEQ ID NO: 14597 - DNA, 33 bp, Artificial Sequences
  Synthetic
ggcgatcgtagggttatagtagtttagtcgtcg

SEQ ID NO: 14598 - DNA, 27 bp, Artificial Sequences
  Synthetic
ggttgaggtggtttcgcgcggtttagg

SEQ ID NO: 14599 - DNA, 27 bp, Artificial Sequences
  Synthetic
cggttgaggtggtttcgcgcggtttag

SEQ ID NO: 14600 - DNA, 27 bp, Artificial Sequences
  Synthetic
gttgaggtggtttcgcgcggtttagga

SEQ ID NO: 14601 - DNA, 26 bp, Artificial Sequences
  Synthetic
cggttgaggtggtttcgcgcggttta

SEQ ID NO: 14602 - DNA, 27 bp, Artificial Sequences
  Synthetic
tgaggtggtttcgcgcggtttaggatt

SEQ ID NO: 14603 - DNA, 27 bp, Artificial Sequences
  Synthetic
gtttatagggttttgggtcgcgcgggg

SEQ ID NO: 14604 - DNA, 27 bp, Artificial Sequences
  Synthetic
ggtttatagggttttgggtcgcgcggg

SEQ ID NO: 14605 - DNA, 27 bp, Artificial Sequences
  Synthetic
tatagggttttgggtcgcgcggggtta

SEQ ID NO: 14606 - DNA, 27 bp, Artificial Sequences
  Synthetic
atagggttttgggtcgcgcggggttat

SEQ ID NO: 14607 - DNA, 27 bp, Artificial Sequences
  Synthetic
gggttttgggtcgcgcggggttatttt

SEQ ID NO: 14608 - DNA, 26 bp, Artificial Sequences
  Synthetic
cgtttttcgcggttgaggtggtttcg

SEQ ID NO: 14609 - DNA, 36 bp, Artificial Sequences
  Synthetic
aggaagttgtaatataggtaagtgtaggagagcgag

SEQ ID NO: 14610 - DNA, 36 bp, Artificial Sequences
  Synthetic
ggaagttgtaatataggtaagtgtaggagagcgaga

SEQ ID NO: 14611 - DNA, 27 bp, Artificial Sequences
  Synthetic
gtttatagggttttgggtcgcgcgggg

SEQ ID NO: 14612 - DNA, 27 bp, Artificial Sequences
  Synthetic
ggtttatagggttttgggtcgcgcggg

SEQ ID NO: 14613 - DNA, 27 bp, Artificial Sequences
  Synthetic
tatagggttttgggtcgcgcggggtta

SEQ ID NO: 14614 - DNA, 27 bp, Artificial Sequences
  Synthetic
atagggttttgggtcgcgcggggttat

SEQ ID NO: 14615 - DNA, 27 bp, Artificial Sequences
  Synthetic
gggttttgggtcgcgcggggttatttt

SEQ ID NO: 14616 - DNA, 36 bp, Artificial Sequences; identical to SEQ ID NO: 14609
  Synthetic

SEQ ID NO: 14617 - DNA, 36 bp, Artificial Sequences; identical to SEQ ID NO: 14610
  Synthetic

SEQ ID NO: 14618 - DNA, 27 bp, Artificial Sequences
  Synthetic
cggagggcgcgtaggttgtttttcgtt

SEQ ID NO: 14619 - DNA, 27 bp, Artificial Sequences
  Synthetic
gtttatagggttttgggtcgcgcgggg

SEQ ID NO: 14620 - DNA, 27 bp, Artificial Sequences
  Synthetic
ggtttatagggttttgggtcgcgcggg

SEQ ID NO: 14621 - DNA, 27 bp, Artificial Sequences
  Synthetic
tatagggttttgggtcgcgcggggtta

SEQ ID NO: 14622 - DNA, 27 bp, Artificial Sequences
  Synthetic
atagggttttgggtcgcgcggggttat

SEQ ID NO: 14623 - DNA, 21 bp, Artificial Sequences
  Synthetic
cgttggggtcgcggaggtagc

SEQ ID NO: 14624 - DNA, 36 bp, Artificial Sequences; identical to SEQ ID NO: 14609
  Synthetic

SEQ ID NO: 14625 - DNA, 36 bp, Artificial Sequences; identical to SEQ ID NO: 14610
  Synthetic

SEQ ID NO: 14626 - DNA, 27 bp, Artificial Sequences
  Synthetic
cggagggcgcgtaggttgtttttcgtt

SEQ ID NO: 14627 - DNA, 27 bp, Artificial Sequences
  Synthetic
gtttatagggttttgggtcgcgcgggg

SEQ ID NO: 14628 - DNA, 27 bp, Artificial Sequences
  Synthetic
ggtttatagggttttgggtcgcgcggg

SEQ ID NO: 14629 - DNA, 27 bp, Artificial Sequences
  Synthetic
tatagggttttgggtcgcgcggggtta

SEQ ID NO: 14630 - DNA, 27 bp, Artificial Sequences
  Synthetic
atagggttttgggtcgcgcggggttat

SEQ ID NO: 14631 - DNA, 27 bp, Artificial Sequences
  Synthetic
cgtcggttcggagggattataggggcg

SEQ ID NO: 14632 - DNA, 27 bp, Artificial Sequences
  Synthetic
gtcggttcggagggattataggggcgg

SEQ ID NO: 14633 - DNA, 27 bp, Artificial Sequences
  Synthetic
ggcgtcggttcggagggattatagggg

SEQ ID NO: 14634 - DNA, 27 bp, Artificial Sequences
  Synthetic
gggcgtcggttcggagggattataggg

SEQ ID NO: 14635 - DNA, 27 bp, Artificial Sequences
  Synthetic
gcgtcggttcggagggattataggggc

SEQ ID NO: 14636 - DNA, 27 bp, Artificial Sequences
  Synthetic
gaatgtcgcgttgggtgggtgttgagg

SEQ ID NO: 14637 - DNA, 27 bp, Artificial Sequences
  Synthetic
gggtgggtgttgagggagcgttagagt

SEQ ID NO: 14638 - DNA, 27 bp, Artificial Sequences
  Synthetic
tgggtgggtgttgagggagcgttagag

SEQ ID NO: 14639 - DNA, 27 bp, Artificial Sequences
  Synthetic
cgttgggtgggtgttgagggagcgtta

SEQ ID NO: 14640 - DNA, 27 bp, Artificial Sequences
  Synthetic
ttgggtgggtgttgagggagcgttaga

SEQ ID NO: 14641 - DNA, 27 bp, Artificial Sequences
  Synthetic
agggttaaggaaaggggaaggggagcg

SEQ ID NO: 14642 - DNA, 27 bp, Artificial Sequences
  Synthetic
gggttaaggaaaggggaaggggagcga

SEQ ID NO: 14643 - DNA, 28 bp, Artificial Sequences
  Synthetic
aagggttaaggaaaggggaaggggagcg

SEQ ID NO: 14644 - DNA, 28 bp, Artificial Sequences
  Synthetic
gggttaaggaaaggggaaggggagcgaa

SEQ ID NO: 14645 - DNA, 28 bp, Artificial Sequences
  Synthetic
agggttaaggaaaggggaaggggagcga

SEQ ID NO: 14646 - DNA, 27 bp, Artificial Sequences
  Synthetic
cggaggaatcgggtcgtgttgtagcgt

SEQ ID NO: 14647 - DNA, 27 bp, Artificial Sequences
  Synthetic
gggtgggtgttgagggagcgttagagt

SEQ ID NO: 14648 - DNA, 27 bp, Artificial Sequences
  Synthetic
tgggtgggtgttgagggagcgttagag

SEQ ID NO: 14649 - DNA, 27 bp, Artificial Sequences
  Synthetic
agcggaggaatcgggtcgtgttgtagc

SEQ ID NO: 14650 - DNA, 27 bp, Artificial Sequences
  Synthetic
cgttgggtgggtgttgagggagcgtta

SEQ ID NO: 14651 - DNA, 27 bp, Artificial Sequences
  Synthetic
gtcgttcgggttagaaattcggggtgt

SEQ ID NO: 14652 - DNA, 27 bp, Artificial Sequences
  Synthetic
tcgttcgggttagaaattcggggtgtt

SEQ ID NO: 14653 - DNA, 28 bp, Artificial Sequences
  Synthetic
gtcgttcgggttagaaattcggggtgtt

SEQ ID NO: 14654 - DNA, 26 bp, Artificial Sequences
  Synthetic
tcgttcgggttagaaattcggggtgt

SEQ ID NO: 14655 - DNA, 28 bp, Artificial Sequences
  Synthetic
tcgggttagttagtcggttcggttttgt

SEQ ID NO: 14656 - DNA, 29 bp, Artificial Sequences
  Synthetic
ttcgggttgtttttcgtttgttcgtttcg

SEQ ID NO: 14657 - DNA, 30 bp, Artificial Sequences
  Synthetic
tttcgggttgtttttcgtttgttcgtttcg

SEQ ID NO: 14658 - DNA, 31 bp, Artificial Sequences
  Synthetic
ttttcgggttgtttttcgtttgttcgtttcg

SEQ ID NO: 14659 - DNA, 32 bp, Artificial Sequences
  Synthetic
gcgtatttttcgggttgtttttcgtttgttcg

SEQ ID NO: 14660 - DNA, 33 bp, Artificial Sequences
  Synthetic
gcgtatttttcgggttgtttttcgtttgttcgt

SEQ ID NO: 14661 - DNA, 27 bp, Artificial Sequences
  Synthetic
tgggagttgtttggagtttggggtggg

SEQ ID NO: 14662 - DNA, 28 bp, Artificial Sequences
  Synthetic
tgggagttgtttggagtttggggtggga

SEQ ID NO: 14663 - DNA, 27 bp, Artificial Sequences
  Synthetic
gggagttgtttggagtttggggtggga

SEQ ID NO: 14664 - DNA, 28 bp, Artificial Sequences
  Synthetic
gtgggagttgtttggagtttggggtggg

SEQ ID NO: 14665 - DNA, 28 bp, Artificial Sequences
  Synthetic
ggagttgtttggagtttggggtgggagg

SEQ ID NO: 14666 - DNA, 28 bp, Artificial Sequences
  Synthetic
cgggttgtttttcgtttgttcgtttcgt

SEQ ID NO: 14667 - DNA, 29 bp, Artificial Sequences
  Synthetic
tcgggttgtttttcgtttgttcgtttcgt

SEQ ID NO: 14668 - DNA, 29 bp, Artificial Sequences
  Synthetic
ttcgggttgtttttcgtttgttcgtttcg

SEQ ID NO: 14669 - DNA, 30 bp, Artificial Sequences
  Synthetic
ttcgggttgtttttcgtttgttcgtttcgt

SEQ ID NO: 14670 - DNA, 30 bp, Artificial Sequences
  Synthetic
tcgggttgtttttcgtttgttcgtttcgta

SEQ ID NO: 14671 - DNA, 27 bp, Artificial Sequences
  Synthetic
tgggagttgtttggagtttggggtggg

SEQ ID NO: 14672 - DNA, 28 bp, Artificial Sequences
  Synthetic
tgggagttgtttggagtttggggtggga

SEQ ID NO: 14673 - DNA, 27 bp, Artificial Sequences
  Synthetic
gggagttgtttggagtttggggtggga

SEQ ID NO: 14674 - DNA, 28 bp, Artificial Sequences
  Synthetic
tggggttatggtttggagggggagttcg

SEQ ID NO: 14675 - DNA, 27 bp, Artificial Sequences
  Synthetic
ggggttatggtttggagggggagttcg

SEQ ID NO: 14676 - DNA, 25 bp, Artificial Sequences
  Synthetic
gggcgtcgggtgtagcgtcgtgatc

SEQ ID NO: 14677 - DNA, 24 bp, Artificial Sequences
  Synthetic
ggcgtcgggtgtagcgtcgtgatc

SEQ ID NO: 14678 - DNA, 27 bp, Artificial Sequences
  Synthetic
cgaagtatggagtaggtttgggtgggt

SEQ ID NO: 14679 - DNA, 24 bp, Artificial Sequences
  Synthetic
gggcgtcgggtgtagcgtcgtgat

SEQ ID NO: 14680 - DNA, 28 bp, Artificial Sequences
  Synthetic
tcgaagtatggagtaggtttgggtgggt

SEQ ID NO: 14681 - DNA, 27 bp, Artificial Sequences
  Synthetic
ttggagatagtttttggtggcgggcgg

SEQ ID NO: 14682 - DNA, 28 bp, Artificial Sequences
  Synthetic
tttggagatagtttttggtggcgggcgg

SEQ ID NO: 14683 - DNA, 26 bp, Artificial Sequences
  Synthetic
tggagatagtttttggtggcgggcgg

SEQ ID NO: 14684 - DNA, 27 bp, Artificial Sequences
  Synthetic
tttggagatagtttttggtggcgggcg

SEQ ID NO: 14685 - DNA, 29 bp, Artificial Sequences
  Synthetic
gtttggagatagtttttggtggcgggcgg

SEQ ID NO: 14686 - DNA, 27 bp, Artificial Sequences
  Synthetic
ggtggtaagcggagggtgggtttggta

SEQ ID NO: 14687 - DNA, 27 bp, Artificial Sequences
  Synthetic
gggtgggtttggtaattattcgcgcgc

SEQ ID NO: 14688 - DNA, 28 bp, Artificial Sequences
  Synthetic
ggtggtaagcggagggtgggtttggtaa

SEQ ID NO: 14689 - DNA, 28 bp, Artificial Sequences
  Synthetic
agggtgggtttggtaattattcgcgcgc

SEQ ID NO: 14690 - DNA, 27 bp, Artificial Sequences
  Synthetic
gtggtaagcggagggtgggtttggtaa

SEQ ID NO: 14691 - DNA, 27 bp, Artificial Sequences
  Synthetic
ttggcgaggtattgttgtatgcggggc

SEQ ID NO: 14692 - DNA, 27 bp, Artificial Sequences
  Synthetic
gcgaggtattgttgtatgcggggcgta

SEQ ID NO: 14693 - DNA, 27 bp, Artificial Sequences
  Synthetic
tggcgaggtattgttgtatgcggggcg

SEQ ID NO: 14694 - DNA, 26 bp, Artificial Sequences
  Synthetic
ggcgaggtattgttgtatgcggggcg

SEQ ID NO: 14695 - DNA, 27 bp, Artificial Sequences
  Synthetic
ggcgaggtattgttgtatgcggggcgt

SEQ ID NO: 14696 - DNA, 33 bp, Artificial Sequences
  Synthetic
tggaggaaggagaagagagatttaagtgtgtgt

SEQ ID NO: 14697 - DNA, 34 bp, Artificial Sequences
  Synthetic
tggaggaaggagaagagagatttaagtgtgtgtt

SEQ ID NO: 14698 - DNA, 34 bp, Artificial Sequences
  Synthetic
ttggaggaaggagaagagagatttaagtgtgtgt

SEQ ID NO: 14699 - DNA, 34 bp, Artificial Sequences
  Synthetic
ggaggaaggagaagagagatttaagtgtgtgttt

SEQ ID NO: 14700 - DNA, 34 bp, Artificial Sequences
  Synthetic
tttggaggaaggagaagagagatttaagtgtgtg

SEQ ID NO: 14701 - DNA, 28 bp, Artificial Sequences
  Synthetic
ggggtagagaagaagacggtgatttggg

SEQ ID NO: 14702 - DNA, 29 bp, Artificial Sequences
  Synthetic
aggggtagagaagaagacggtgatttggg

SEQ ID NO: 14703 - DNA, 29 bp, Artificial Sequences
  Synthetic
ggggtagagaagaagacggtgatttggga

SEQ ID NO: 14704 - DNA, 30 bp, Artificial Sequences
  Synthetic
aggggtagagaagaagacggtgatttggga

SEQ ID NO: 14705 - DNA, 30 bp, Artificial Sequences
  Synthetic
aaggggtagagaagaagacggtgatttggg

SEQ ID NO: 14706 - DNA, 27 bp, Artificial Sequences
  Synthetic
agtgcgggcgggagtatttagggatgt

SEQ ID NO: 14707 - DNA, 27 bp, Artificial Sequences
  Synthetic
cgggttagtgcgggcgggagtatttag

SEQ ID NO: 14708 - DNA, 28 bp, Artificial Sequences
  Synthetic
gggttagtgcgggcgggagtatttaggg

SEQ ID NO: 14709 - DNA, 27 bp, Artificial Sequences
  Synthetic
ggttagtgcgggcgggagtatttaggg

SEQ ID NO: 14710 - DNA, 27 bp, Artificial Sequences
  Synthetic
gggttagtgcgggcgggagtatttagg

SEQ ID NO: 14711 - DNA, 28 bp, Artificial Sequences
  Synthetic
cgtagttgagcgggtatttttgggtcgt

SEQ ID NO: 14712 - DNA, 27 bp, Artificial Sequences
  Synthetic
cgtagttgagcgggtatttttgggtcg

SEQ ID NO: 14713 - DNA, 29 bp, Artificial Sequences
  Synthetic
tcgtagttgagcgggtatttttgggtcgt

SEQ ID NO: 14714 - DNA, 28 bp, Artificial Sequences
  Synthetic
tcgtagttgagcgggtatttttgggtcg

SEQ ID NO: 14715 - DNA, 29 bp, Artificial Sequences
  Synthetic
cgtagttgagcgggtatttttgggtcgtt

SEQ ID NO: 14716 - DNA, 27 bp, Artificial Sequences
  Synthetic
gttcgtttagttgcggggttggggtcg

SEQ ID NO: 14717 - DNA, 27 bp, Artificial Sequences
  Synthetic
ttcgtttagttgcggggttggggtcga

SEQ ID NO: 14718 - DNA, 27 bp, Artificial Sequences
  Synthetic
gtgttcgtttagttgcggggttggggt

SEQ ID NO: 14719 - DNA, 27 bp, Artificial Sequences
  Synthetic
tcgtttagttgcggggttggggtcgag

SEQ ID NO: 14720 - DNA, 27 bp, Artificial Sequences
  Synthetic
agtgttcgtttagttgcggggttgggg

SEQ ID NO: 14721 - DNA, 27 bp, Artificial Sequences
  Synthetic
aaagaggttcgttgtgagagggaggga

SEQ ID NO: 14722 - DNA, 27 bp, Artificial Sequences
  Synthetic
agaggttcgttgtgagagggagggatt

SEQ ID NO: 14723 - DNA, 27 bp, Artificial Sequences
  Synthetic
aagaggttcgttgtgagagggagggat

SEQ ID NO: 14724 - DNA, 27 bp, Artificial Sequences
  Synthetic
aaaagaggttcgttgtgagagggaggg

SEQ ID NO: 14725 - DNA, 28 bp, Artificial Sequences
  Synthetic
aaaagaggttcgttgtgagagggaggga

SEQ ID NO: 14726 - DNA, 27 bp, Artificial Sequences
  Synthetic
ggttttgggaggaggtggaaggggagg

SEQ ID NO: 14727 - DNA, 27 bp, Artificial Sequences
  Synthetic
aggtaagagacgggtgggggatagggg

SEQ ID NO: 14728 - DNA, 27 bp, Artificial Sequences
  Synthetic
tgtggttttgggaggaggtggaagggg

SEQ ID NO: 14729 - DNA, 27 bp, Artificial Sequences
  Synthetic
tttgggaggaggtggaaggggaggagt

SEQ ID NO: 14730 - DNA, 27 bp, Artificial Sequences
  Synthetic
gggaggaggtggaaggggaggagtagg

SEQ ID NO: 14731 - DNA, 27 bp, Artificial Sequences
  Synthetic
aggaggaagttgtttagggcgttgcgg

SEQ ID NO: 14732 - DNA, 27 bp, Artificial Sequences
  Synthetic
ggaggaagttgtttagggcgttgcgga

SEQ ID NO: 14733 - DNA, 27 bp, Artificial Sequences
  Synthetic
agggcgttgcggaaagtaggtaggaga

SEQ ID NO: 14734 - DNA, 28 bp, Artificial Sequences
  Synthetic
aggaggaagttgtttagggcgttgcgga

SEQ ID NO: 14735 - DNA, 28 bp, Artificial Sequences
  Synthetic
ggaggaagttgtttagggcgttgcggaa

SEQ ID NO: 14736 - DNA, 29 bp, Artificial Sequences
  Synthetic
tggaaggaatagggtgtaggtttgggggg

SEQ ID NO: 14737 - DNA, 28 bp, Artificial Sequences
  Synthetic
ggaaggaatagggtgtaggtttgggggg

SEQ ID NO: 14738 - DNA, 28 bp, Artificial Sequences
  Synthetic
tggaaggaatagggtgtaggtttggggg

SEQ ID NO: 14739 - DNA, 27 bp, Artificial Sequences
  Synthetic
gaaggaatagggtgtaggtttgggggg

SEQ ID NO: 14740 - DNA, 27 bp, Artificial Sequences
  Synthetic
ggaaggaatagggtgtaggtttggggg

SEQ ID NO: 14741 - DNA, 27 bp, Artificial Sequences
  Synthetic
gggagggagggttgtgatgttgggtgt

SEQ ID NO: 14742 - DNA, 27 bp, Artificial Sequences
  Synthetic
ggggagggagggttgtgatgttgggtg

SEQ ID NO: 14743 - DNA, 27 bp, Artificial Sequences
  Synthetic
aggggagggagggttgtgatgttgggt

SEQ ID NO: 14744 - DNA, 27 bp, Artificial Sequences
  Synthetic
taggggagggagggttgtgatgttggg

SEQ ID NO: 14745 - DNA, 27 bp, Artificial Sequences
  Synthetic
tcggtggagggagggatcgtttgaagt

SEQ ID NO: 14746 - DNA, 27 bp, Artificial Sequences
  Synthetic
cgggggcggggaggaggtttttgtata

SEQ ID NO: 14747 - DNA, 27 bp, Artificial Sequences
  Synthetic
attttggttagtggatcgggggcgggg

SEQ ID NO: 14748 - DNA, 27 bp, Artificial Sequences
  Synthetic
gattttggttagtggatcgggggcggg

SEQ ID NO: 14749 - DNA, 28 bp, Artificial Sequences
  Synthetic
cgggggcggggaggaggtttttgtatag

SEQ ID NO: 14750 - DNA, 27 bp, Artificial Sequences
  Synthetic
tcgggggcggggaggaggtttttgtat

SEQ ID NO: 14751 - DNA, 27 bp, Artificial Sequences
  Synthetic
gggtcgggtttttggatggttcgtggt

SEQ ID NO: 14752 - DNA, 27 bp, Artificial Sequences
  Synthetic
agggtcgggtttttggatggttcgtgg

SEQ ID NO: 14753 - DNA, 28 bp, Artificial Sequences
  Synthetic
agggtcgggtttttggatggttcgtggt

SEQ ID NO: 14754 - DNA, 28 bp, Artificial Sequences
  Synthetic
gggtcgggtttttggatggttcgtggtt

SEQ ID NO: 14755 - DNA, 27 bp, Artificial Sequences
  Synthetic
ggtcgggtttttggatggttcgtggtt

SEQ ID NO: 14756 - DNA, 27 bp, Artificial Sequences
  Synthetic
ttaggggtttttacggtcggcgggatc

SEQ ID NO: 14757 - DNA, 27 bp, Artificial Sequences
  Synthetic
ttttaggggtttttacggtcggcggga

SEQ ID NO: 14758 - DNA, 27 bp, Artificial Sequences
  Synthetic
tttaggggtttttacggtcggcgggat

SEQ ID NO: 14759 - DNA, 28 bp, Artificial Sequences
  Synthetic
tttaggggtttttacggtcggcgggatc

SEQ ID NO: 14760 - DNA, 27 bp, Artificial Sequences
  Synthetic
attttaggggtttttacggtcggcggg

SEQ ID NO: 14761 - DNA, 27 bp, Artificial Sequences
  Synthetic
agtcggtggggcgggtattgttgagtc

SEQ ID NO: 14762 - DNA, 27 bp, Artificial Sequences
  Synthetic
cgggtattgttgagtcgtgggggaggg

SEQ ID NO: 14763 - DNA, 27 bp, Artificial Sequences
  Synthetic
gagtcgtgggggagggaggtcgatttc

SEQ ID NO: 14764 - DNA, 27 bp, Artificial Sequences
  Synthetic
tgagtcgtgggggagggaggtcgattt

SEQ ID NO: 14765 - DNA, 27 bp, Artificial Sequences
  Synthetic
ttgagtcgtgggggagggaggtcgatt

SEQ ID NO: 14766 - DNA, 27 bp, Artificial Sequences
  Synthetic
ggcggtcgggaggttggtttggtttag

SEQ ID NO: 14767 - DNA, 27 bp, Artificial Sequences
  Synthetic
gcggtcgggaggttggtttggtttagt

SEQ ID NO: 14768 - DNA, 27 bp, Artificial Sequences
  Synthetic
ttttaggggtttttacggtcggcggga

SEQ ID NO: 14769 - DNA, 28 bp, Artificial Sequences
  Synthetic
ggcggtcgggaggttggtttggtttagt

SEQ ID NO: 14770 - DNA, 27 bp, Artificial Sequences
  Synthetic
ttaggggtttttacggtcggcgggatt

SEQ ID NO: 14771 - DNA, 27 bp, Artificial Sequences
  Synthetic
cgagtggtaggcgtcggtagggttagc

SEQ ID NO: 14772 - DNA, 27 bp, Artificial Sequences
  Synthetic
ttcggtgcggtaaggatggggtgttgt

SEQ ID NO: 14773 - DNA, 27 bp, Artificial Sequences
  Synthetic
cgggtattgttgagtcgtgggggaggg

SEQ ID NO: 14774 - DNA, 27 bp, Artificial Sequences
  Synthetic
gagtcgtgggggagggaggtcgatttc

SEQ ID NO: 14775 - DNA, 27 bp, Artificial Sequences
  Synthetic
agggttagcggcgtgtatagggttggc

SEQ ID NO: 14776 - DNA, 27 bp, Artificial Sequences
  Synthetic
gcgtttgggtagcgtcgttttggtcgt

SEQ ID NO: 14777 - DNA, 27 bp, Artificial Sequences
  Synthetic
ggcggtcgggaggttggtttggtttag

SEQ ID NO: 14778 - DNA, 27 bp, Artificial Sequences
  Synthetic
gggcggtcgggaggttggtttggttta

SEQ ID NO: 14779 - DNA, 27 bp, Artificial Sequences
  Synthetic
gcggtcgggaggttggtttggtttagt

SEQ ID NO: 14780 - DNA, 28 bp, Artificial Sequences
  Synthetic
gcgtttgggtagcgtcgttttggtcgtt

SEQ ID NO: 14781 - DNA, 27 bp, Artificial Sequences
  Synthetic
agcggcggttgggggttttaggttttg

SEQ ID NO: 14782 - DNA, 27 bp, Artificial Sequences
  Synthetic
cgagtggtaggcgtcggtagggttagc

SEQ ID NO: 14783 - DNA, 27 bp, Artificial Sequences
  Synthetic
gagcggcggttgggggttttaggtttt

SEQ ID NO: 14784 - DNA, 27 bp, Artificial Sequences
  Synthetic
ggcggttgggggttttaggttttgcgt

SEQ ID NO: 14785 - DNA, 27 bp, Artificial Sequences
  Synthetic
agggttagcggcgtgtatagggttggc

SEQ ID NO: 14786 - DNA, 27 bp, Artificial Sequences
  Synthetic
tgggaattcgagggaggggaaggtaga

SEQ ID NO: 14787 - DNA, 27 bp, Artificial Sequences
  Synthetic
ttttgggaattcgagggaggggaaggt

SEQ ID NO: 14788 - DNA, 29 bp, Artificial Sequences
  Synthetic
tgggaattcgagggaggggaaggtagagt

SEQ ID NO: 14789 - DNA, 28 bp, Artificial Sequences
  Synthetic
gggaattcgagggaggggaaggtagagt

SEQ ID NO: 14790 - DNA, 28 bp, Artificial Sequences
  Synthetic
tgggaattcgagggaggggaaggtagag

SEQ ID NO: 14791 - DNA, 30 bp, Artificial Sequences
  Synthetic
tgtagagggtaggagtatgagggagagtgt

SEQ ID NO: 14792 - DNA, 31 bp, Artificial Sequences
  Synthetic
tgtagagggtaggagtatgagggagagtgtt

SEQ ID NO: 14793 - DNA, 31 bp, Artificial Sequences
  Synthetic
ttgtagagggtaggagtatgagggagagtgt

SEQ ID NO: 14794 - DNA, 31 bp, Artificial Sequences
  Synthetic
tttgtagagggtaggagtatgagggagagtg

SEQ ID NO: 14795 - DNA, 32 bp, Artificial Sequences
  Synthetic
ttgtagagggtaggagtatgagggagagtgtt

SEQ ID NO: 14796 - DNA, 27 bp, Artificial Sequences
  Synthetic
agtttgggtttttgtgtggagtgcgtt

SEQ ID NO: 14797 - DNA, 28 bp, Artificial Sequences
  Synthetic
tgggtttttgtgtggagtgcgtttttgt

SEQ ID NO: 14798 - DNA, 28 bp, Artificial Sequences
  Synthetic
agtttgggtttttgtgtggagtgcgttt

SEQ ID NO: 14799 - DNA, 29 bp, Artificial Sequences
  Synthetic
gggtttttgtgtggagtgcgtttttgtgt

SEQ ID NO: 14800 - DNA, 29 bp, Artificial Sequences
  Synthetic
tgggtttttgtgtggagtgcgtttttgtg

SEQ ID NO: 14801 - DNA, 27 bp, Artificial Sequences
  Synthetic
ggtgggcggtcggggagttagttttgt

SEQ ID NO: 14802 - DNA, 27 bp, Artificial Sequences
  Synthetic
gggtgggcggtcggggagttagttttg

SEQ ID NO: 14803 - DNA, 28 bp, Artificial Sequences
  Synthetic
ggtgggcggtcggggagttagttttgta

SEQ ID NO: 14804 - DNA, 26 bp, Artificial Sequences
  Synthetic
gggtgggcggtcggggagttagtttt

SEQ ID NO: 14805 - DNA, 27 bp, Artificial Sequences
  Synthetic
gtgggcggtcggggagttagttttgta

SEQ ID NO: 14806 - DNA, 27 bp, Artificial Sequences
  Synthetic
ggagggaggtcggagtggagtagggat

SEQ ID NO: 14807 - DNA, 27 bp, Artificial Sequences
  Synthetic
tagggagggaggtcggagtggagtagg

SEQ ID NO: 14808 - DNA, 28 bp, Artificial Sequences
  Synthetic
ggagggaggtcggagtggagtagggatt

SEQ ID NO: 14809 - DNA, 28 bp, Artificial Sequences
  Synthetic
gtagggagggaggtcggagtggagtagg

SEQ ID NO: 14810 - DNA, 26 bp, Artificial Sequences
  Synthetic
agggagggaggtcggagtggagtagg

SEQ ID NO: 14811 - DNA, 27 bp, Artificial Sequences
  Synthetic
tgtttgagttcggggtgtagaggttgt

SEQ ID NO: 14812 - DNA, 28 bp, Artificial Sequences
  Synthetic
agttcggggtgtagaggttgtagtgagt

SEQ ID NO: 14813 - DNA, 28 bp, Artificial Sequences
  Synthetic
tgagttcggggtgtagaggttgtagtga

SEQ ID NO: 14814 - DNA, 28 bp, Artificial Sequences
  Synthetic
ttgtttgagttcggggtgtagaggttgt

SEQ ID NO: 14815 - DNA, 30 bp, Artificial Sequences
  Synthetic
tgagttcggggtgtagaggttgtagtgagt

SEQ ID NO: 14816 - DNA, 27 bp, Artificial Sequences
  Synthetic
tggagtggggtaagtgagtaggaggaa

SEQ ID NO: 14817 - DNA, 28 bp, Artificial Sequences
  Synthetic
tggagtggggtaagtgagtaggaggaag

SEQ ID NO: 14818 - DNA, 29 bp, Artificial Sequences
  Synthetic
tggagtggggtaagtgagtaggaggaaga

SEQ ID NO: 14819 - DNA, 28 bp, Artificial Sequences
  Synthetic
ggagtggggtaagtgagtaggaggaaga

SEQ ID NO: 14820 - DNA, 28 bp, Artificial Sequences
  Synthetic
atggagtggggtaagtgagtaggaggaa

SEQ ID NO: 14821 - DNA, 33 bp, Artificial Sequences
  Synthetic
gggtttagtaaattggtaggtgtatggggttgt

SEQ ID NO: 14822 - DNA, 33 bp, Artificial Sequences
  Synthetic
agggtttagtaaattggtaggtgtatggggttg

SEQ ID NO: 14823 - DNA, 34 bp, Artificial Sequences
  Synthetic
agggtttagtaaattggtaggtgtatggggttgt

SEQ ID NO: 14824 - DNA, 34 bp, Artificial Sequences
  Synthetic
tggtaggtgtatggggttgtaaatttggttttgt

SEQ ID NO: 14825 - DNA, 34 bp, Artificial Sequences
  Synthetic
aggtgtatggggttgtaaatttggttttgtagga

SEQ ID NO: 14826 - DNA, 27 bp, Artificial Sequences
  Synthetic
tgagggagtaggagggtgagttgtggt

SEQ ID NO: 14827 - DNA, 27 bp, Artificial Sequences
  Synthetic
tgggttttgtgaggggtaaaggacggt

SEQ ID NO: 14828 - DNA, 29 bp, Artificial Sequences
  Synthetic
gggagtaggagggtgagttgtggtagggt

SEQ ID NO: 14829 - DNA, 28 bp, Artificial Sequences
  Synthetic
gggagtaggagggtgagttgtggtaggg

SEQ ID NO: 14830 - DNA, 29 bp, Artificial Sequences
  Synthetic
agggagtaggagggtgagttgtggtaggg

SEQ ID NO: 14831 - DNA, 27 bp, Artificial Sequences
  Synthetic
tggacggtgttgatgggatcggggatg

SEQ ID NO: 14832 - DNA, 27 bp, Artificial Sequences
  Synthetic
ggacggtgttgatgggatcggggatga

SEQ ID NO: 14833 - DNA, 27 bp, Artificial Sequences
  Synthetic
tttggacggtgttgatgggatcgggga

SEQ ID NO: 14834 - DNA, 27 bp, Artificial Sequences
  Synthetic
ttggacggtgttgatgggatcggggat

SEQ ID NO: 14835 - DNA, 27 bp, Artificial Sequences
  Synthetic
gtttggacggtgttgatgggatcgggg

SEQ ID NO: 14836 - DNA, 27 bp, Artificial Sequences
  Synthetic
acggaaggggagggtgggtagattgga

SEQ ID NO: 14837 - DNA, 27 bp, Artificial Sequences
  Synthetic
cggaaggggagggtgggtagattggag

SEQ ID NO: 14838 - DNA, 27 bp, Artificial Sequences
  Synthetic
aacggaaggggagggtgggtagattgg

SEQ ID NO: 14839 - DNA, 28 bp, Artificial Sequences
  Synthetic
aacggaaggggagggtgggtagattgga

SEQ ID NO: 14840 - DNA, 28 bp, Artificial Sequences
  Synthetic
cggaaggggagggtgggtagattggaga

SEQ ID NO: 14841 - DNA, 27 bp, Artificial Sequences
  Synthetic
ggatagagtacggagcggtcggggaga

SEQ ID NO: 14842 - DNA, 27 bp, Artificial Sequences
  Synthetic
aagggatagagtacggagcggtcgggg

SEQ ID NO: 14843 - DNA, 27 bp, Artificial Sequences
  Synthetic
tggtttttcgggagggtttttgcggcg

SEQ ID NO: 14844 - DNA, 27 bp, Artificial Sequences
  Synthetic
gaagggatagagtacggagcggtcggg

SEQ ID NO: 14845 - DNA, 27 bp, Artificial Sequences
  Synthetic
gggatagagtacggagcggtcggggag

SEQ ID NO: 14846 - DNA, 27 bp, Artificial Sequences
  Synthetic
gaggcggttagggtaggtagtcgggga

SEQ ID NO: 14847 - DNA, 27 bp, Artificial Sequences
  Synthetic
aggcggttagggtaggtagtcggggat

SEQ ID NO: 14848 - DNA, 27 bp, Artificial Sequences
  Synthetic
atgggcgaggcggttagggtaggtagt

SEQ ID NO: 14849 - DNA, 27 bp, Artificial Sequences
  Synthetic
agtatgggcgaggcggttagggtaggt

SEQ ID NO: 14850 - DNA, 27 bp, Artificial Sequences
  Synthetic
tgggcgaggcggttagggtaggtagtc

SEQ ID NO: 14851 - DNA, 27 bp, Artificial Sequences
  Synthetic
ggggcgtagtgtttaggtcgttcgggt

SEQ ID NO: 14852 - DNA, 27 bp, Artificial Sequences
  Synthetic
ggatagagtacggagcggtcggggaga

SEQ ID NO: 14853 - DNA, 27 bp, Artificial Sequences
  Synthetic
aagggatagagtacggagcggtcgggg

SEQ ID NO: 14854 - DNA, 27 bp, Artificial Sequences
  Synthetic
tggtttttcgggagggtttttgcggcg

SEQ ID NO: 14855 - DNA, 27 bp, Artificial Sequences
  Synthetic
gaagggatagagtacggagcggtcggg

SEQ ID NO: 14856 - DNA, 27 bp, Artificial Sequences
  Synthetic
gaggcggttagggtaggtagtcgggga

SEQ ID NO: 14857 - DNA, 27 bp, Artificial Sequences
  Synthetic
ggcgaaggttagagggaggtcgggttt

SEQ ID NO: 14858 - DNA, 27 bp, Artificial Sequences
  Synthetic
aggcggttagggtaggtagtcggggat

SEQ ID NO: 14859 - DNA, 27 bp, Artificial Sequences
  Synthetic
atgggcgaggcggttagggtaggtagt

SEQ ID NO: 14860 - DNA, 27 bp, Artificial Sequences
  Synthetic
agtatgggcgaggcggttagggtaggt

SEQ ID NO: 14861 - DNA, 27 bp, Artificial Sequences
  Synthetic
ggggcgtagtgtttaggtcgttcgggt

SEQ ID NO: 14862 - DNA, 27 bp, Artificial Sequences
  Synthetic
tggtttttcgggagggtttttgcggcg

SEQ ID NO: 14863 - DNA, 27 bp, Artificial Sequences
  Synthetic
cggggcgtagtgtttaggtcgttcggg

SEQ ID NO: 14864 - DNA, 27 bp, Artificial Sequences
  Synthetic
aggtcgttcgggttttttgcgttgcgg

SEQ ID NO: 14865 - DNA, 27 bp, Artificial Sequences
  Synthetic
ttggtttttcgggagggtttttgcggc

SEQ ID NO: 14866 - DNA, 27 bp, Artificial Sequences
  Synthetic
gaggtttttgcggggtttcggttcggt

SEQ ID NO: 14867 - DNA, 27 bp, Artificial Sequences
  Synthetic
gaggcggttagggtaggtagtcgggga

SEQ ID NO: 14868 - DNA, 27 bp, Artificial Sequences
  Synthetic
ggcgaaggttagagggaggtcgggttt

SEQ ID NO: 14869 - DNA, 27 bp, Artificial Sequences
  Synthetic
aggcggttagggtaggtagtcggggat

SEQ ID NO: 14870 - DNA, 27 bp, Artificial Sequences
  Synthetic
aggtttttgcggggtttcggttcggtt

SEQ ID NO: 14871 - DNA, 32 bp, Artificial Sequences
  Synthetic
tcggttgtttgttttggtcgtttcgtttatgt

SEQ ID NO: 14872 - DNA, 32 bp, Artificial Sequences
  Synthetic
cggttgtttgttttggtcgtttcgtttatgtt

SEQ ID NO: 14873 - DNA, 33 bp, Artificial Sequences
  Synthetic
tcggttgtttgttttggtcgtttcgtttatgtt

SEQ ID NO: 14874 - DNA, 33 bp, Artificial Sequences
  Synthetic
cggttgtttgttttggtcgtttcgtttatgttg

SEQ ID NO: 14875 - DNA, 34 bp, Artificial Sequences
  Synthetic
cggttgtttgttttggtcgtttcgtttatgttgt

SEQ ID NO: 14876 - DNA, 27 bp, Artificial Sequences
  Synthetic
gaggtttttgcggggtttcggttcggt

SEQ ID NO: 14877 - DNA, 27 bp, Artificial Sequences
  Synthetic
ttcgggcgcgttttggatcgttatggc

SEQ ID NO: 14878 - DNA, 27 bp, Artificial Sequences
  Synthetic
aggtttttgcggggtttcggttcggtt

SEQ ID NO: 14879 - DNA, 27 bp, Artificial Sequences
  Synthetic
tttttgcggggtttcggttcggttcga

SEQ ID NO: 14880 - DNA, 27 bp, Artificial Sequences
  Synthetic
ggaggtttttgcggggtttcggttcgg

SEQ ID NO: 14881 - DNA, 28 bp, Artificial Sequences
  Synthetic
cgcggttgttttagttgtttcgggtcgg

SEQ ID NO: 14882 - DNA, 28 bp, Artificial Sequences
  Synthetic
gcggttgttttagttgtttcgggtcggg

SEQ ID NO: 14883 - DNA, 29 bp, Artificial Sequences
  Synthetic
cgcggttgttttagttgtttcgggtcggg

SEQ ID NO: 14884 - DNA, 29 bp, Artificial Sequences
  Synthetic
gcggttgttttagttgtttcgggtcgggt

SEQ ID NO: 14885 - DNA, 29 bp, Artificial Sequences
  Synthetic
tcgcggttgttttagttgtttcgggtcgg

SEQ ID NO: 14886 - DNA, 27 bp, Artificial Sequences
  Synthetic
gaggtttttgcggggtttcggttcggt

SEQ ID NO: 14887 - DNA, 27 bp, Artificial Sequences
  Synthetic
ttcgggcgcgttttggatcgttatggc

SEQ ID NO: 14888 - DNA, 27 bp, Artificial Sequences
  Synthetic
aggtttttgcggggtttcggttcggtt

SEQ ID NO: 14889 - DNA, 27 bp, Artificial Sequences
  Synthetic
ggaggtttttgcggggtttcggttcgg

SEQ ID NO: 14890 - DNA, 27 bp, Artificial Sequences
  Synthetic
gggaggtttttgcggggtttcggttcg

SEQ ID NO: 14891 - DNA, 28 bp, Artificial Sequences
  Synthetic
cgcggttgttttagttgtttcgggtcgg

SEQ ID NO: 14892 - DNA, 28 bp, Artificial Sequences
  Synthetic
gcggttgttttagttgtttcgggtcggg

SEQ ID NO: 14893 - DNA, 29 bp, Artificial Sequences
  Synthetic
cgcggttgttttagttgtttcgggtcggg

SEQ ID NO: 14894 - DNA, 29 bp, Artificial Sequences
  Synthetic
gcggttgttttagttgtttcgggtcgggt

SEQ ID NO: 14895 - DNA, 29 bp, Artificial Sequences
  Synthetic
tcgcggttgttttagttgtttcgggtcgg

SEQ ID NO: 14896 - DNA, 27 bp, Artificial Sequences
  Synthetic
ggttgtcgtggtagaaggggaagcggt

SEQ ID NO: 14897 - DNA, 27 bp, Artificial Sequences
  Synthetic
ttcgggcgcgttttggatcgttatggc

SEQ ID NO: 14898 - DNA, 27 bp, Artificial Sequences
  Synthetic
cggttgtcgtggtagaaggggaagcgg

SEQ ID NO: 14899 - DNA, 27 bp, Artificial Sequences
  Synthetic
gttcgggcgcgttttggatcgttatgg

SEQ ID NO: 14900 - DNA, 28 bp, Artificial Sequences
  Synthetic
tgttcgggcgcgttttggatcgttatgg

SEQ ID NO: 14901 - DNA, 27 bp, Artificial Sequences
  Synthetic
gcgagaggttgtggcggatgttgtttt

SEQ ID NO: 14902 - DNA, 28 bp, Artificial Sequences
  Synthetic
gcgagaggttgtggcggatgttgttttg

SEQ ID NO: 14903 - DNA, 29 bp, Artificial Sequences
  Synthetic
gcgagaggttgtggcggatgttgttttgt

SEQ ID NO: 14904 - DNA, 26 bp, Artificial Sequences
  Synthetic
gcgagaggttgtggcggatgttgttt

SEQ ID NO: 14905 - DNA, 28 bp, Artificial Sequences
  Synthetic
cgagaggttgtggcggatgttgttttgt

SEQ ID NO: 14906 - DNA, 27 bp, Artificial Sequences
  Synthetic
cgagaaagggcggtcgggtaagggtag

SEQ ID NO: 14907 - DNA, 27 bp, Artificial Sequences
  Synthetic
gagaaagggcggtcgggtaagggtagt

SEQ ID NO: 14908 - DNA, 27 bp, Artificial Sequences
  Synthetic
agaaagggcggtcgggtaagggtagtt

SEQ ID NO: 14909 - DNA, 26 bp, Artificial Sequences
  Synthetic
cgagaaagggcggtcgggtaagggta

SEQ ID NO: 14910 - DNA, 27 bp, Artificial Sequences
  Synthetic
gggcggtcgggtaagggtagttattgg

SEQ ID NO: 14911 - DNA, 27 bp, Artificial Sequences
  Synthetic
cgttgtttgtaggcgggagattgcggg

SEQ ID NO: 14912 - DNA, 27 bp, Artificial Sequences
  Synthetic
cgggcgttgtttgtaggcgggagattg

SEQ ID NO: 14913 - DNA, 27 bp, Artificial Sequences
  Synthetic
gttgtttgtaggcgggagattgcgggg

SEQ ID NO: 14914 - DNA, 27 bp, Artificial Sequences
  Synthetic
cgtttcggcgcggggttttttggtttt

SEQ ID NO: 14915 - DNA, 27 bp, Artificial Sequences
  Synthetic
gggcgttgtttgtaggcgggagattgc

SEQ ID NO: 14916 - DNA, 28 bp, Artificial Sequences
  Synthetic
ggggtttcggaggttaagaggtttcgcg

SEQ ID NO: 14917 - DNA, 28 bp, Artificial Sequences
  Synthetic
cggggtttcggaggttaagaggtttcgc

SEQ ID NO: 14918 - DNA, 29 bp, Artificial Sequences
  Synthetic
tcggggtttcggaggttaagaggtttcgc

SEQ ID NO: 14919 - DNA, 28 bp, Artificial Sequences
  Synthetic
gggtttcggaggttaagaggtttcgcgt

SEQ ID NO: 14920 - DNA, 27 bp, Artificial Sequences
  Synthetic
gggtttcggaggttaagaggtttcgcg

SEQ ID NO: 14921 - DNA, 27 bp, Artificial Sequences
  Synthetic
cgttgtttgtaggcgggagattgcggg

SEQ ID NO: 14922 - DNA, 27 bp, Artificial Sequences
  Synthetic
cgggcgttgtttgtaggcgggagattg

SEQ ID NO: 14923 - DNA, 27 bp, Artificial Sequences
  Synthetic
tgcgcgttgtttggtcgatcgttacgg

SEQ ID NO: 14924 - DNA, 27 bp, Artificial Sequences
  Synthetic
gcgcgttgtttggtcgatcgttacggt

SEQ ID NO: 14925 - DNA, 27 bp, Artificial Sequences
  Synthetic
gttgtttgtaggcgggagattgcgggg

SEQ ID NO: 14926 - DNA, 25 bp, Artificial Sequences
  Synthetic
cggtcgtggcggtcggttaggtagc

SEQ ID NO: 14927 - DNA, 25 bp, Artificial Sequences
  Synthetic
gcggtcgtggcggtcggttaggtag

SEQ ID NO: 14928 - DNA, 24 bp, Artificial Sequences
  Synthetic
gcggtcgtggcggtcggttaggta

SEQ ID NO: 14929 - DNA, 24 bp, Artificial Sequences
  Synthetic
ggtcgtggcggtcggttaggtagc

SEQ ID NO: 14930 - DNA, 26 bp, Artificial Sequences
  Synthetic
gcggtcgtggcggtcggttaggtagc

SEQ ID NO: 14931 - DNA, 29 bp, Artificial Sequences
  Synthetic
ggagttcgttttttgaaggcggtttttgg

SEQ ID NO: 14932 - DNA, 30 bp, Artificial Sequences
  Synthetic
ggagttcgttttttgaaggcggtttttggt

SEQ ID NO: 14933 - DNA, 30 bp, Artificial Sequences
  Synthetic
aggagttcgttttttgaaggcggtttttgg

SEQ ID NO: 14934 - DNA, 31 bp, Artificial Sequences
  Synthetic
aggagttcgttttttgaaggcggtttttggt

SEQ ID NO: 14935 - DNA, 31 bp, Artificial Sequences
  Synthetic
ggagttcgttttttgaaggcggtttttggtt

SEQ ID NO: 14936 - DNA, 27 bp, Artificial Sequences
  Synthetic
ggggtgttaagtttgggttcggcggtc

SEQ ID NO: 14937 - DNA, 27 bp, Artificial Sequences
  Synthetic
agggggtgttaagtttgggttcggcgg

SEQ ID NO: 14938 - DNA, 27 bp, Artificial Sequences
  Synthetic
gggggtgttaagtttgggttcggcggt

SEQ ID NO: 14939 - DNA, 26 bp, Artificial Sequences
  Synthetic
gggggtgttaagtttgggttcggcgg

SEQ ID NO: 14940 - DNA, 28 bp, Artificial Sequences
  Synthetic
tagggggtgttaagtttgggttcggcgg

SEQ ID NO: 14941 - DNA, 27 bp, Artificial Sequences
  Synthetic
ttgaaaggcggacggaggttggaggag

SEQ ID NO: 14942 - DNA, 27 bp, Artificial Sequences
  Synthetic
gttgaaaggcggacggaggttggagga

SEQ ID NO: 14943 - DNA, 27 bp, Artificial Sequences
  Synthetic
gacggaggttggaggaggcggttagga

SEQ ID NO: 14944 - DNA, 27 bp, Artificial Sequences
  Synthetic
acggaggttggaggaggcggttaggag

SEQ ID NO: 14945 - DNA, 26 bp, Artificial Sequences
  Synthetic
tgaaaggcggacggaggttggaggag

SEQ ID NO: 14946 - DNA, 27 bp, Artificial Sequences
  Synthetic
ggggtgttaagtttgggttcggcggtc

SEQ ID NO: 14947 - DNA, 27 bp, Artificial Sequences
  Synthetic
agggggtgttaagtttgggttcggcgg

SEQ ID NO: 14948 - DNA, 27 bp, Artificial Sequences
  Synthetic
cggcggtcgtttgggtgtttcgttttt

SEQ ID NO: 14949 - DNA, 27 bp, Artificial Sequences
  Synthetic
gggggtgttaagtttgggttcggcggt

SEQ ID NO: 14950 - DNA, 26 bp, Artificial Sequences
  Synthetic
gggggtgttaagtttgggttcggcgg

SEQ ID NO: 14951 - DNA, 26 bp, Artificial Sequences
  Synthetic
gcggaggtttaggttgggtcgggaga

SEQ ID NO: 14952 - DNA, 25 bp, Artificial Sequences
  Synthetic
gcggaggtttaggttgggtcgggag

SEQ ID NO: 14953 - DNA, 27 bp, Artificial Sequences
  Synthetic
aagtcgttttggatatgcgggtcgagt

SEQ ID NO: 14954 - DNA, 27 bp, Artificial Sequences
  Synthetic
tcgtgtcgggaatttgtagggggaaat

SEQ ID NO: 14955 - DNA, 27 bp, Artificial Sequences
  Synthetic
atcgtgtcgggaatttgtagggggaaa

SEQ ID NO: 14956 - DNA, 27 bp, Artificial Sequences
  Synthetic
gcgagttgggtttggtcggggttttgt

SEQ ID NO: 14957 - DNA, 27 bp, Artificial Sequences
  Synthetic
ggcgagttgggtttggtcggggttttg

SEQ ID NO: 14958 - DNA, 27 bp, Artificial Sequences
  Synthetic
attaaggtggaggcggtggaggagtcg

SEQ ID NO: 14959 - DNA, 28 bp, Artificial Sequences
  Synthetic
gcgagttgggtttggtcggggttttgtt

SEQ ID NO: 14960 - DNA, 27 bp, Artificial Sequences
  Synthetic
ttaaggtggaggcggtggaggagtcgg

SEQ ID NO: 14961 - DNA, 27 bp, Artificial Sequences
  Synthetic
ttcggttttgattttggtcggggcggg

SEQ ID NO: 14962 - DNA, 27 bp, Artificial Sequences
  Synthetic
ggttttgattttggtcggggcggggtt

SEQ ID NO: 14963 - DNA, 27 bp, Artificial Sequences
  Synthetic
tcggcgtggggttggatagttcggttt

SEQ ID NO: 14964 - DNA, 27 bp, Artificial Sequences
  Synthetic
ttcggcgtggggttggatagttcggtt

SEQ ID NO: 14965 - DNA, 27 bp, Artificial Sequences
  Synthetic
tgggggtttcggggaagagttcggttt

SEQ ID NO: 14966 - DNA, 28 bp, Artificial Sequences
  Synthetic
tgtatagtcggttgtagtagggcgcggg

SEQ ID NO: 14967 - DNA, 27 bp, Artificial Sequences
  Synthetic
gtatagtcggttgtagtagggcgcggg

SEQ ID NO: 14968 - DNA, 29 bp, Artificial Sequences
  Synthetic
gtgtatagtcggttgtagtagggcgcggg

SEQ ID NO: 14969 - DNA, 29 bp, Artificial Sequences
  Synthetic
ggtgtatagtcggttgtagtagggcgcgg

SEQ ID NO: 14970 - DNA, 27 bp, Artificial Sequences
  Synthetic
tgtatagtcggttgtagtagggcgcgg

SEQ ID NO: 14971 - DNA, 24 bp, Artificial Sequences
  Synthetic
cgttttgggtttgcgcgcggtagg

SEQ ID NO: 14972 - DNA, 27 bp, Artificial Sequences
  Synthetic
gtcgggtcggggggcgttttgggtttg

SEQ ID NO: 14973 - DNA, 24 bp, Artificial Sequences
  Synthetic
gggtcggggggcgttttgggtttg

SEQ ID NO: 14974 - DNA, 23 bp, Artificial Sequences
  Synthetic
gggtcggggggcgttttgggttt

SEQ ID NO: 14975 - DNA, 24 bp, Artificial Sequences
  Synthetic
ggtcggggggcgttttgggtttgc

SEQ ID NO: 14976 - DNA, 27 bp, Artificial Sequences
  Synthetic
attggtagggcggttgggttcgaggag

SEQ ID NO: 14977 - DNA, 27 bp, Artificial Sequences
  Synthetic
tagggcggttgggttcgaggagtagga

SEQ ID NO: 14978 - DNA, 27 bp, Artificial Sequences
  Synthetic
gattggtagggcggttgggttcgagga

SEQ ID NO: 14979 - DNA, 27 bp, Artificial Sequences
  Synthetic
aaggaagtggttgagggcgatgggtgt

SEQ ID NO: 14980 - DNA, 27 bp, Artificial Sequences
  Synthetic
ttcgattggtagggcggttgggttcga

SEQ ID NO: 14981 - DNA, 27 bp, Artificial Sequences
  Synthetic
gggtgtttgttgggagggttagtgcgc

SEQ ID NO: 14982 - DNA, 27 bp, Artificial Sequences
  Synthetic
ggtgtttgttgggagggttagtgcgcg

SEQ ID NO: 14983 - DNA, 27 bp, Artificial Sequences
  Synthetic
cgggtgtttgttgggagggttagtgcg

SEQ ID NO: 14984 - DNA, 27 bp, Artificial Sequences
  Synthetic
gtgtttgttgggagggttagtgcgcga

SEQ ID NO: 14985 - DNA, 27 bp, Artificial Sequences
  Synthetic
tgtttgttgggagggttagtgcgcgat

SEQ ID NO: 14986 - DNA, 30 bp, Artificial Sequences
  Synthetic
acgtgggtagtttgaatttagttagggcgg

SEQ ID NO: 14987 - DNA, 32 bp, Artificial Sequences
  Synthetic
cgacgtgggtagtttgaatttagttagggcgg

SEQ ID NO: 14988 - DNA, 30 bp, Artificial Sequences
  Synthetic
cgtgggtagtttgaatttagttagggcgga

SEQ ID NO: 14989 - DNA, 31 bp, Artificial Sequences
  Synthetic
acgtgggtagtttgaatttagttagggcgga

SEQ ID NO: 14990 - DNA, 33 bp, Artificial Sequences
  Synthetic
acgacgtgggtagtttgaatttagttagggcgg

SEQ ID NO: 14991 - DNA, 31 bp, Artificial Sequences
  Synthetic
gtgttgggattataggggtgagttatcgtgt

SEQ ID NO: 14992 - DNA, 32 bp, Artificial Sequences
  Synthetic
agtgttgggattataggggtgagttatcgtgt

SEQ ID NO: 14993 - DNA, 32 bp, Artificial Sequences
  Synthetic
gtgttgggattataggggtgagttatcgtgtt

SEQ ID NO: 14994 - DNA, 32 bp, Artificial Sequences
  Synthetic
aagtgttgggattataggggtgagttatcgtg

SEQ ID NO: 14995 - DNA, 32 bp, Artificial Sequences
  Synthetic
tgttgggattataggggtgagttatcgtgttc

SEQ ID NO: 14996 - DNA, 27 bp, Artificial Sequences
  Synthetic
tggtcggggtgggaaaaggaaaatcga

SEQ ID NO: 14997 - DNA, 27 bp, Artificial Sequences
  Synthetic
gtggtcggggtgggaaaaggaaaatcg

SEQ ID NO: 14998 - DNA, 28 bp, Artificial Sequences
  Synthetic
agtggtcggggtgggaaaaggaaaatcg

SEQ ID NO: 14999 - DNA, 28 bp, Artificial Sequences
  Synthetic
gtggtcggggtgggaaaaggaaaatcga

SEQ ID NO: 15000 - DNA, 29 bp, Artificial Sequences
  Synthetic
agtggtcggggtgggaaaaggaaaatcga

SEQ ID NO: 15001 - DNA, 29 bp, Artificial Sequences
  Synthetic
tggatttggaatttagagtcggcggttgt

SEQ ID NO: 15002 - DNA, 29 bp, Artificial Sequences
  Synthetic
tgttggatttggaatttagagtcggcggt

SEQ ID NO: 15003 - DNA, 30 bp, Artificial Sequences
  Synthetic
tggatttggaatttagagtcggcggttgtt

SEQ ID NO: 15004 - DNA, 30 bp, Artificial Sequences
  Synthetic
ttggatttggaatttagagtcggcggttgt

SEQ ID NO: 15005 - DNA, 30 bp, Artificial Sequences
  Synthetic
tgttggatttggaatttagagtcggcggtt

SEQ ID NO: 15006 - DNA, 27 bp, Artificial Sequences
  Synthetic
ttagtgggaggtttggcggggaggttg

SEQ ID NO: 15007 - DNA, 27 bp, Artificial Sequences
  Synthetic
ttgttagtgggaggtttggcggggagg

SEQ ID NO: 15008 - DNA, 27 bp, Artificial Sequences
  Synthetic
gttagtgggaggtttggcggggaggtt

SEQ ID NO: 15009 - DNA, 27 bp, Artificial Sequences
  Synthetic
ttaggagagtgcgggtatgggtcgggt

SEQ ID NO: 15010 - DNA, 27 bp, Artificial Sequences
  Synthetic
gggaggtttggcggggaggttgttttt

SEQ ID NO: 15011 - DNA, 27 bp, Artificial Sequences
  Synthetic
agggaaagtggggtaaggagaggagaa

SEQ ID NO: 15012 - DNA, 28 bp, Artificial Sequences
  Synthetic
agggaaagtggggtaaggagaggagaaa

SEQ ID NO: 15013 - DNA, 29 bp, Artificial Sequences
  Synthetic
gggaaagtggggtaaggagaggagaaagt

SEQ ID NO: 15014 - DNA, 28 bp, Artificial Sequences
  Synthetic
gggaaagtggggtaaggagaggagaaag

SEQ ID NO: 15015 - DNA, 26 bp, Artificial Sequences
  Synthetic
agggaaagtggggtaaggagaggaga

SEQ ID NO: 15016 - DNA, 27 bp, Artificial Sequences
  Synthetic
cgtgggcgtttttgagggttgggtagt

SEQ ID NO: 15017 - DNA, 27 bp, Artificial Sequences
  Synthetic
tcggagttgggtgttatggtcgttgcg

SEQ ID NO: 15018 - DNA, 28 bp, Artificial Sequences
  Synthetic
cgtgggcgtttttgagggttgggtagtg

SEQ ID NO: 15019 - DNA, 27 bp, Artificial Sequences
  Synthetic
tgggcgtttttgagggttgggtagtgt

SEQ ID NO: 15020 - DNA, 28 bp, Artificial Sequences
  Synthetic
ttcggagttgggtgttatggtcgttgcg

SEQ ID NO: 15021 - DNA, 31 bp, Artificial Sequences
  Synthetic
aggaggtttttggaggttgtgatgtagttga

SEQ ID NO: 15022 - DNA, 32 bp, Artificial Sequences
  Synthetic
aaggaggtttttggaggttgtgatgtagttga

SEQ ID NO: 15023 - DNA, 32 bp, Artificial Sequences
  Synthetic
aggaggtttttggaggttgtgatgtagttgat

SEQ ID NO: 15024 - DNA, 32 bp, Artificial Sequences
  Synthetic
tgagaatgtaaggaggtttttggaggttgtga

SEQ ID NO: 15025 - DNA, 32 bp, Artificial Sequences
  Synthetic
tgtaaggaggtttttggaggttgtgatgtagt

SEQ ID NO: 15026 - DNA, 27 bp, Artificial Sequences
  Synthetic
cggggttagcggcgttgttggaagatg

SEQ ID NO: 15027 - DNA, 27 bp, Artificial Sequences
  Synthetic
gtttcggacgggaggagggtaggttcg

SEQ ID NO: 15028 - DNA, 27 bp, Artificial Sequences
  Synthetic
ggggttagcggcgttgttggaagatgg

SEQ ID NO: 15029 - DNA, 27 bp, Artificial Sequences
  Synthetic
ttagagggcgggatggggttgttaggc

SEQ ID NO: 15030 - DNA, 27 bp, Artificial Sequences
  Synthetic
cggttagagggcgggatggggttgtta

SEQ ID NO: 15031 - DNA, 27 bp, Artificial Sequences
  Synthetic
cgttaaggcggtcgttcgtttcggtcg

SEQ ID NO: 15032 - DNA, 27 bp, Artificial Sequences
  Synthetic
gcggtcgttcgtttcggtcgttcgtta

SEQ ID NO: 15033 - DNA, 27 bp, Artificial Sequences
  Synthetic
gttaaggcggtcgttcgtttcggtcgt

SEQ ID NO: 15034 - DNA, 27 bp, Artificial Sequences
  Synthetic
gtcgttaaggcggtcgttcgtttcggt

SEQ ID NO: 15035 - DNA, 27 bp, Artificial Sequences
  Synthetic
agtcgttaaggcggtcgttcgtttcgg

SEQ ID NO: 15036 - DNA, 27 bp, Artificial Sequences
  Synthetic
gcgggtgtattttgggagggacgagga

SEQ ID NO: 15037 - DNA, 27 bp, Artificial Sequences
  Synthetic
tgcgggtgtattttgggagggacgagg

SEQ ID NO: 15038 - DNA, 27 bp, Artificial Sequences
  Synthetic
tgggtttgcgggtgtattttgggaggg

SEQ ID NO: 15039 - DNA, 27 bp, Artificial Sequences
  Synthetic
gggtttgcgggtgtattttgggaggga

SEQ ID NO: 15040 - DNA, 28 bp, Artificial Sequences
  Synthetic
tgggtttgcgggtgtattttgggaggga

SEQ ID NO: 15041 - DNA, 27 bp, Artificial Sequences
  Synthetic
tgttcgggtttggagttttcggtgcgg

SEQ ID NO: 15042 - DNA, 27 bp, Artificial Sequences
  Synthetic
cgggtagcgtagagttcggcgggttag

SEQ ID NO: 15043 - DNA, 27 bp, Artificial Sequences
  Synthetic
cgggtttggagttttcggtgcgggtag

SEQ ID NO: 15044 - DNA, 27 bp, Artificial Sequences
  Synthetic
tcgggtttggagttttcggtgcgggta

SEQ ID NO: 15045 - DNA, 27 bp, Artificial Sequences
  Synthetic
gttcgggtttggagttttcggtgcggg

SEQ ID NO: 15046 - DNA, 27 bp, Artificial Sequences
  Synthetic
gcgggtgtattttgggagggacgagga

SEQ ID NO: 15047 - DNA, 27 bp, Artificial Sequences
  Synthetic
gggagttggttcgtcgggttttgcgtt

SEQ ID NO: 15048 - DNA, 27 bp, Artificial Sequences
  Synthetic
tgcgggtgtattttgggagggacgagg

SEQ ID NO: 15049 - DNA, 27 bp, Artificial Sequences
  Synthetic
ggttcggggagttggttcgtcgggttt

SEQ ID NO: 15050 - DNA, 27 bp, Artificial Sequences
  Synthetic
gttcggggagttggttcgtcgggtttt

SEQ ID NO: 15051 - DNA, 27 bp, Artificial Sequences
  Synthetic
tgttcgggtttggagttttcggtgcgg

SEQ ID NO: 15052 - DNA, 27 bp, Artificial Sequences
  Synthetic
cgggtagcgtagagttcggcgggttag

SEQ ID NO: 15053 - DNA, 27 bp, Artificial Sequences
  Synthetic
cgggtttggagttttcggtgcgggtag

SEQ ID NO: 15054 - DNA, 27 bp, Artificial Sequences
  Synthetic
tcgggtttggagttttcggtgcgggta

SEQ ID NO: 15055 - DNA, 27 bp, Artificial Sequences
  Synthetic
gttcgggtttggagttttcggtgcggg

SEQ ID NO: 15056 - DNA, 27 bp, Artificial Sequences
  Synthetic
gggagttggttcgtcgggttttgcgtt

SEQ ID NO: 15057 - DNA, 26 bp, Artificial Sequences
  Synthetic
gggagttggttcgtcgggttttgcgt

SEQ ID NO: 15058 - DNA, 28 bp, Artificial Sequences
  Synthetic
gggagttggttcgtcgggttttgcgtta

SEQ ID NO: 15059 - DNA, 28 bp, Artificial Sequences
  Synthetic
ggagatcggtatgtacgcgttgttgggc

SEQ ID NO: 15060 - DNA, 27 bp, Artificial Sequences
  Synthetic
ggagttggttcgtcgggttttgcgtta

SEQ ID NO: 15061 - DNA, 27 bp, Artificial Sequences
  Synthetic
cgggatgcgtttgtgtcggtagcgtag

SEQ ID NO: 15062 - DNA, 27 bp, Artificial Sequences
  Synthetic
gggatgcgtttgtgtcggtagcgtagt

SEQ ID NO: 15063 - DNA, 27 bp, Artificial Sequences
  Synthetic
gcgggatgcgtttgtgtcggtagcgta

SEQ ID NO: 15064 - DNA, 27 bp, Artificial Sequences
  Synthetic
tgatgaggaagacgaggatggcgaggt

SEQ ID NO: 15065 - DNA, 27 bp, Artificial Sequences
  Synthetic
agacgaggatggcgaggtagaagacgt

SEQ ID NO: 15066 - DNA, 28 bp, Artificial Sequences
  Synthetic
ggagatcggtatgtacgcgttgttgggc

SEQ ID NO: 15067 - DNA, 27 bp, Artificial Sequences
  Synthetic
gagatcggtatgtacgcgttgttgggc

SEQ ID NO: 15068 - DNA, 29 bp, Artificial Sequences
  Synthetic
tggagatcggtatgtacgcgttgttgggc

SEQ ID NO: 15069 - DNA, 28 bp, Artificial Sequences
  Synthetic
tggagatcggtatgtacgcgttgttggg

SEQ ID NO: 15070 - DNA, 27 bp, Artificial Sequences
  Synthetic
ggagatcggtatgtacgcgttgttggg

SEQ ID NO: 15071 - DNA, 27 bp, Artificial Sequences
  Synthetic
tttagcgggttgtttgttggcggcgat

SEQ ID NO: 15072 - DNA, 27 bp, Artificial Sequences
  Synthetic
ttttagcgggttgtttgttggcggcga

SEQ ID NO: 15073 - DNA, 27 bp, Artificial Sequences
  Synthetic
tagcgggttgtttgttggcggcgatag

SEQ ID NO: 15074 - DNA, 27 bp, Artificial Sequences
  Synthetic
tttttagcgggttgtttgttggcggcg

SEQ ID NO: 15075 - DNA, 27 bp, Artificial Sequences
  Synthetic
ttagcgggttgtttgttggcggcgata

SEQ ID NO: 15076 - DNA, 27 bp, Artificial Sequences
  Synthetic
tgcgggtgtaaggagagttgtcgtcgt

SEQ ID NO: 15077 - DNA, 27 bp, Artificial Sequences
  Synthetic
cgttgcgggtgtaaggagagttgtcgt

SEQ ID NO: 15078 - DNA, 28 bp, Artificial Sequences
  Synthetic
tgcgggtgtaaggagagttgtcgtcgtt

SEQ ID NO: 15079 - DNA, 28 bp, Artificial Sequences
  Synthetic
ttgcgggtgtaaggagagttgtcgtcgt

SEQ ID NO: 15080 - DNA, 27 bp, Artificial Sequences
  Synthetic
gcgggtgtaaggagagttgtcgtcgtt

SEQ ID NO: 15081 - DNA, 27 bp, Artificial Sequences
  Synthetic
tttagcgggttgtttgttggcggcgat

SEQ ID NO: 15082 - DNA, 27 bp, Artificial Sequences
  Synthetic
ttttagcgggttgtttgttggcggcga

SEQ ID NO: 15083 - DNA, 27 bp, Artificial Sequences
  Synthetic
gtggtcgtcgtggtagaaggcgggtac

SEQ ID NO: 15084 - DNA, 27 bp, Artificial Sequences
  Synthetic
ttggcggggttttcggtttggtttcgg

SEQ ID NO: 15085 - DNA, 27 bp, Artificial Sequences
  Synthetic
gcggggttttcggtttggtttcgggtt

SEQ ID NO: 15086 - DNA, 27 bp, Artificial Sequences
  Synthetic
tgttttatgtgaagggtggggcgggga

SEQ ID NO: 15087 - DNA, 27 bp, Artificial Sequences
  Synthetic
gtgaagggtggggcggggagagtttta

SEQ ID NO: 15088 - DNA, 27 bp, Artificial Sequences
  Synthetic
tggggtagggtggttgtgttgtgggtt

SEQ ID NO: 15089 - DNA, 27 bp, Artificial Sequences
  Synthetic
tttatgtgaagggtggggcggggagag

SEQ ID NO: 15090 - DNA, 27 bp, Artificial Sequences
  Synthetic
atggggtagggtggttgtgttgtgggt

SEQ ID NO: 15091 - DNA, 27 bp, Artificial Sequences
  Synthetic
tgcgtgggagggaagtgtaagagtgtt

SEQ ID NO: 15092 - DNA, 27 bp, Artificial Sequences
  Synthetic
ttgcgtgggagggaagtgtaagagtgt

SEQ ID NO: 15093 - DNA, 29 bp, Artificial Sequences
  Synthetic
gcgtgggagggaagtgtaagagtgtttcg

SEQ ID NO: 15094 - DNA, 28 bp, Artificial Sequences
  Synthetic
tgcgtgggagggaagtgtaagagtgttt

SEQ ID NO: 15095 - DNA, 28 bp, Artificial Sequences
  Synthetic
ttgcgtgggagggaagtgtaagagtgtt

SEQ ID NO: 15096 - DNA, 26 bp, Artificial Sequences
  Synthetic
gggaatcgtcgggtagggggtttgcg

SEQ ID NO: 15097 - DNA, 26 bp, Artificial Sequences
  Synthetic
cgggaatcgtcgggtagggggtttgc

SEQ ID NO: 15098 - DNA, 25 bp, Artificial Sequences
  Synthetic
gaatcgtcgggtagggggtttgcgc

SEQ ID NO: 15099 - DNA, 29 bp, Artificial Sequences
  Synthetic
gcggtttggttaagggtagcgttaagggc

SEQ ID NO: 15100 - DNA, 26 bp, Artificial Sequences
  Synthetic
ggaatcgtcgggtagggggtttgcgc

SEQ ID NO: 15101 - DNA, 27 bp, Artificial Sequences
  Synthetic
ggggtttcgttcggggtagttgcgttt

SEQ ID NO: 15102 - DNA, 27 bp, Artificial Sequences
  Synthetic
gggggtttcgttcggggtagttgcgtt

SEQ ID NO: 15103 - DNA, 28 bp, Artificial Sequences
  Synthetic
ggggtttcgttcggggtagttgcgtttt

SEQ ID NO: 15104 - DNA, 26 bp, Artificial Sequences
  Synthetic
ggggtttcgttcggggtagttgcgtt

SEQ ID NO: 15105 - DNA, 27 bp, Artificial Sequences
  Synthetic
tgttttggagtattcgcgcggttgtgg

SEQ ID NO: 15106 - DNA, 29 bp, Artificial Sequences
  Synthetic
gcggtttggttaagggtagcgttaagggc

SEQ ID NO: 15107 - DNA, 28 bp, Artificial Sequences
  Synthetic
cggtttggttaagggtagcgttaagggc

SEQ ID NO: 15108 - DNA, 28 bp, Artificial Sequences
  Synthetic
gcggtttggttaagggtagcgttaaggg

SEQ ID NO: 15109 - DNA, 27 bp, Artificial Sequences
  Synthetic
gcggtttggttaagggtagcgttaagg

SEQ ID NO: 15110 - DNA, 27 bp, Artificial Sequences
  Synthetic
ggtttggttaagggtagcgttaagggc

SEQ ID NO: 15111 - DNA, 27 bp, Artificial Sequences
  Synthetic
tgttttggagtattcgcgcggttgtgg

SEQ ID NO: 15112 - DNA, 27 bp, Artificial Sequences
  Synthetic
tggatgttttggagtattcgcgcggtt

SEQ ID NO: 15113 - DNA, 27 bp, Artificial Sequences
  Synthetic
ttggatgttttggagtattcgcgcggt

SEQ ID NO: 15114 - DNA, 28 bp, Artificial Sequences
  Synthetic
atgttttggagtattcgcgcggttgtgg

SEQ ID NO: 15115 - DNA, 28 bp, Artificial Sequences
  Synthetic
ggatgttttggagtattcgcgcggttgt

SEQ ID NO: 15116 - DNA, 24 bp, Artificial Sequences
  Synthetic
gcggagggcgtagttgtttcggac

SEQ ID NO: 15117 - DNA, 23 bp, Artificial Sequences
  Synthetic
gcggagggcgtagttgtttcgga

SEQ ID NO: 15118 - DNA, 32 bp, Artificial Sequences
  Synthetic
cggagttttcgttatttttatagtcgcgcggg

SEQ ID NO: 15119 - DNA, 33 bp, Artificial Sequences
  Synthetic
cggagttttcgttatttttatagtcgcgcgggt

SEQ ID NO: 15120 - DNA, 30 bp, Artificial Sequences
  Synthetic
tcgttatttttatagtcgcgcgggtgtttt

SEQ ID NO: 15121 - DNA, 27 bp, Artificial Sequences
  Synthetic
aggcgaggcggatataaaggagaggcg

SEQ ID NO: 15122 - DNA, 27 bp, Artificial Sequences
  Synthetic
ggcgaggcggatataaaggagaggcga

SEQ ID NO: 15123 - DNA, 27 bp, Artificial Sequences
  Synthetic
ggcgaggcgaggcggatataaaggaga

SEQ ID NO: 15124 - DNA, 28 bp, Artificial Sequences
  Synthetic
gcgaggcggatataaaggagaggcgagg

SEQ ID NO: 15125 - DNA, 28 bp, Artificial Sequences
  Synthetic
ggcgaggcggatataaaggagaggcgag

SEQ ID NO: 15126 - DNA, 27 bp, Artificial Sequences
  Synthetic
ttttattagcggtcggggagtcgggcg

SEQ ID NO: 15127 - DNA, 27 bp, Artificial Sequences
  Synthetic
cgggcgggagataggaggtcggttttg

SEQ ID NO: 15128 - DNA, 27 bp, Artificial Sequences
  Synthetic
gggcgggagataggaggtcggttttga

SEQ ID NO: 15129 - DNA, 27 bp, Artificial Sequences
  Synthetic
tcgggcgggagataggaggtcggtttt

SEQ ID NO: 15130 - DNA, 26 bp, Artificial Sequences
  Synthetic
cgggcgggagataggaggtcggtttt

SEQ ID NO: 15131 - DNA, 27 bp, Artificial Sequences
  Synthetic
aggcgaggcggatataaaggagaggcg

SEQ ID NO: 15132 - DNA, 27 bp, Artificial Sequences
  Synthetic
ggcgaggcggatataaaggagaggcga

SEQ ID NO: 15133 - DNA, 27 bp, Artificial Sequences
  Synthetic
ggcgaggcgaggcggatataaaggaga

SEQ ID NO: 15134 - DNA, 28 bp, Artificial Sequences
  Synthetic
gcgaggcggatataaaggagaggcgagg

SEQ ID NO: 15135 - DNA, 28 bp, Artificial Sequences
  Synthetic
ggcgaggcggatataaaggagaggcgag

SEQ ID NO: 15136 - DNA, 27 bp, Artificial Sequences
  Synthetic
ttttattagcggtcggggagtcgggcg

SEQ ID NO: 15137 - DNA, 27 bp, Artificial Sequences
  Synthetic
cgggcgggagataggaggtcggttttg

SEQ ID NO: 15138 - DNA, 27 bp, Artificial Sequences
  Synthetic
gggcgggagataggaggtcggttttga

SEQ ID NO: 15139 - DNA, 27 bp, Artificial Sequences
  Synthetic
tcgggcgggagataggaggtcggtttt

SEQ ID NO: 15140 - DNA, 26 bp, Artificial Sequences
  Synthetic
cgggcgggagataggaggtcggtttt

SEQ ID NO: 15141 - DNA, 27 bp, Artificial Sequences
  Synthetic
aggcgaggcggatataaaggagaggcg

SEQ ID NO: 15142 - DNA, 27 bp, Artificial Sequences
  Synthetic
ggcgaggcggatataaaggagaggcga

SEQ ID NO: 15143 - DNA, 27 bp, Artificial Sequences
  Synthetic
ggcgaggcgaggcggatataaaggaga

SEQ ID NO: 15144 - DNA, 28 bp, Artificial Sequences
  Synthetic
gcgaggcggatataaaggagaggcgagg

SEQ ID NO: 15145 - DNA, 28 bp, Artificial Sequences
  Synthetic
ggcgaggcggatataaaggagaggcgag

SEQ ID NO: 15146 - DNA, 27 bp, Artificial Sequences
  Synthetic
cgggcgggagataggaggtcggttttg

SEQ ID NO: 15147 - DNA, 27 bp, Artificial Sequences
  Synthetic
gggcgggagataggaggtcggttttga

SEQ ID NO: 15148 - DNA, 27 bp, Artificial Sequences
  Synthetic
tcgggcgggagataggaggtcggtttt

SEQ ID NO: 15149 - DNA, 26 bp, Artificial Sequences
  Synthetic
cgggcgggagataggaggtcggtttt

SEQ ID NO: 15150 - DNA, 27 bp, Artificial Sequences
  Synthetic
gtcgggcgggagataggaggtcggttt

SEQ ID NO: 15151 - DNA, 24 bp, Artificial Sequences
  Synthetic
gggttagcgtcgcgggaatggagc

SEQ ID NO: 15152 - DNA, 27 bp, Artificial Sequences
  Synthetic
aggagtagacgggttttggagtttcgc

SEQ ID NO: 15153 - DNA, 27 bp, Artificial Sequences
  Synthetic
gttttcggttgtttcggcgcgtttaac

SEQ ID NO: 15154 - DNA, 28 bp, Artificial Sequences
  Synthetic
taggagtagacgggttttggagtttcgc

SEQ ID NO: 15155 - DNA, 29 bp, Artificial Sequences
  Synthetic
tgggggtattaggagtagacgggttttgg

SEQ ID NO: 15156 - DNA, 26 bp, Artificial Sequences
  Synthetic
cgttttattttcgcggcgttggttcg

SEQ ID NO: 15157 - DNA, 32 bp, Artificial Sequences
  Synthetic
cggagattgttcgatacgttttggttagggcg

SEQ ID NO: 15158 - DNA, 33 bp, Artificial Sequences
  Synthetic
tcggagattgttcgatacgttttggttagggcg

SEQ ID NO: 15159 - DNA, 31 bp, Artificial Sequences
  Synthetic
ggagattgttcgatacgttttggttagggcg

SEQ ID NO: 15160 - DNA, 31 bp, Artificial Sequences
  Synthetic
cggagattgttcgatacgttttggttagggc

SEQ ID NO: 15161 - DNA, 27 bp, Artificial Sequences
  Synthetic
tcggtcggattttgaggagttgggggt

SEQ ID NO: 15162 - DNA, 28 bp, Artificial Sequences
  Synthetic
ttcggtcggattttgaggagttgggggt

SEQ ID NO: 15163 - DNA, 27 bp, Artificial Sequences
  Synthetic
ttcggtcggattttgaggagttggggg

SEQ ID NO: 15164 - DNA, 27 bp, Artificial Sequences
  Synthetic
cggtcggattttgaggagttgggggta

SEQ ID NO: 15165 - DNA, 28 bp, Artificial Sequences
  Synthetic
tcggtcggattttgaggagttgggggta

SEQ ID NO: 15166 - DNA, 27 bp, Artificial Sequences
  Synthetic
cgttttattttcgcggcgttggttcgg

SEQ ID NO: 15167 - DNA, 26 bp, Artificial Sequences
  Synthetic
cgttttattttcgcggcgttggttcg

SEQ ID NO: 15168 - DNA, 26 bp, Artificial Sequences
  Synthetic
gttttattttcgcggcgttggttcgg

SEQ ID NO: 15169 - DNA, 29 bp, Artificial Sequences
  Synthetic
cgggtcgagcgaattgttttgtttttggt

SEQ ID NO: 15170 - DNA, 28 bp, Artificial Sequences
  Synthetic
cgggtcgagcgaattgttttgtttttgg

SEQ ID NO: 15171 - DNA, 27 bp, Artificial Sequences
  Synthetic
ttgcgggggaggagtagcgaggttttt

SEQ ID NO: 15172 - DNA, 27 bp, Artificial Sequences
  Synthetic
tgcgggggaggagtagcgaggtttttg

SEQ ID NO: 15173 - DNA, 27 bp, Artificial Sequences
  Synthetic
gcgggggaggagtagcgaggtttttgt

SEQ ID NO: 15174 - DNA, 27 bp, Artificial Sequences
  Synthetic
gttgcgggggaggagtagcgaggtttt

SEQ ID NO: 15175 - DNA, 27 bp, Artificial Sequences
  Synthetic
tcggtcggattttgaggagttgggggt

SEQ ID NO: 15176 - DNA, 27 bp, Artificial Sequences
  Synthetic
aggcggtgaaggggtgttggttaggtt

SEQ ID NO: 15177 - DNA, 27 bp, Artificial Sequences
  Synthetic
gcggtgaaggggtgttggttaggttcg

SEQ ID NO: 15178 - DNA, 27 bp, Artificial Sequences
  Synthetic
ttggtggatcgtttggagtcgggcgag

SEQ ID NO: 15179 - DNA, 27 bp, Artificial Sequences
  Synthetic
ggtggatcgtttggagtcgggcgagtt

SEQ ID NO: 15180 - DNA, 27 bp, Artificial Sequences
  Synthetic
ggcggtgaaggggtgttggttaggttc

SEQ ID NO: 15181 - DNA, 28 bp, Artificial Sequences
  Synthetic
ggggatgagttcgttcggttttaggcgg

SEQ ID NO: 15182 - DNA, 27 bp, Artificial Sequences
  Synthetic
gtcgggcgtttagggcgtttagttgtt

SEQ ID NO: 15183 - DNA, 28 bp, Artificial Sequences
  Synthetic
gggatgagttcgttcggttttaggcggt

SEQ ID NO: 15184 - DNA, 28 bp, Artificial Sequences
  Synthetic
tggggatgagttcgttcggttttaggcg

SEQ ID NO: 15185 - DNA, 27 bp, Artificial Sequences
  Synthetic
gggatgagttcgttcggttttaggcgg

SEQ ID NO: 15186 - DNA, 27 bp, Artificial Sequences
  Synthetic
ttggtggatcgtttggagtcgggcgag

SEQ ID NO: 15187 - DNA, 27 bp, Artificial Sequences
  Synthetic
ggtggatcgtttggagtcgggcgagtt

SEQ ID NO: 15188 - DNA, 27 bp, Artificial Sequences
  Synthetic
gtcgttggtggatcgtttggagtcggg

SEQ ID NO: 15189 - DNA, 27 bp, Artificial Sequences
  Synthetic
ggtcgttggtggatcgtttggagtcgg

SEQ ID NO: 15190 - DNA, 27 bp, Artificial Sequences
  Synthetic
gttggtggatcgtttggagtcgggcga

SEQ ID NO: 15191 - DNA, 27 bp, Artificial Sequences
  Synthetic
agggtcgtgaattgggttttcggtttc

SEQ ID NO: 15192 - DNA, 27 bp, Artificial Sequences
  Synthetic
agtggtttatagagagcgaggcgtgtt

SEQ ID NO: 15193 - DNA, 28 bp, Artificial Sequences
  Synthetic
agtggtttatagagagcgaggcgtgttt

SEQ ID NO: 15194 - DNA, 29 bp, Artificial Sequences
  Synthetic
agtggtttatagagagcgaggcgtgtttt

SEQ ID NO: 15195 - DNA, 30 bp, Artificial Sequences
  Synthetic
agtggtttatagagagcgaggcgtgttttt

SEQ ID NO: 15196 - DNA, 27 bp, Artificial Sequences
  Synthetic
tgggagtaaattaaggggaggcggcga

SEQ ID NO: 15197 - DNA, 28 bp, Artificial Sequences
  Synthetic
tgggagtaaattaaggggaggcggcgag

SEQ ID NO: 15198 - DNA, 27 bp, Artificial Sequences
  Synthetic
gggagtaaattaaggggaggcggcgag

SEQ ID NO: 15199 - DNA, 27 bp, Artificial Sequences
  Synthetic
ttgggagtaaattaaggggaggcggcg

SEQ ID NO: 15200 - DNA, 28 bp, Artificial Sequences
  Synthetic
gggagtaaattaaggggaggcggcgaga

SEQ ID NO: 15201 - DNA, 27 bp, Artificial Sequences
  Synthetic
cggggggttttgcgggaagaagtcgta

SEQ ID NO: 15202 - DNA, 27 bp, Artificial Sequences
  Synthetic
taggacgttagggttcggtcgggggtc

SEQ ID NO: 15203 - DNA, 27 bp, Artificial Sequences
  Synthetic
ggggggttttgcgggaagaagtcgtag

SEQ ID NO: 15204 - DNA, 27 bp, Artificial Sequences
  Synthetic
gtaggacgttagggttcggtcgggggt

SEQ ID NO: 15205 - DNA, 27 bp, Artificial Sequences
  Synthetic
gaggacggggggttttgcgggaagaag

SEQ ID NO: 15206 - DNA, 27 bp, Artificial Sequences
  Synthetic
cggggggttttgcgggaagaagtcgta

SEQ ID NO: 15207 - DNA, 27 bp, Artificial Sequences
  Synthetic
ggggggttttgcgggaagaagtcgtag

SEQ ID NO: 15208 - DNA, 27 bp, Artificial Sequences
  Synthetic
gaggacggggggttttgcgggaagaag

SEQ ID NO: 15209 - DNA, 27 bp, Artificial Sequences
  Synthetic
ggacggggggttttgcgggaagaagtc

SEQ ID NO: 15210 - DNA, 28 bp, Artificial Sequences
  Synthetic
ggggggttttgcgggaagaagtcgtagt

SEQ ID NO: 15211 - DNA, 22 bp, Artificial Sequences
  Synthetic
gcgggtgcgtatagtcgttggc

SEQ ID NO: 15212 - DNA, 19 bp, Artificial Sequences
  Synthetic
gcgtttggtaggcgggcgg

SEQ ID NO: 15213 - DNA, 27 bp, Artificial Sequences
  Synthetic
ttggttggttcgggagcgttttgggtc

SEQ ID NO: 15214 - DNA, 27 bp, Artificial Sequences
  Synthetic
tttggttggttcgggagcgttttgggt

SEQ ID NO: 15215 - DNA, 28 bp, Artificial Sequences
  Synthetic
tttggttggttcgggagcgttttgggtc

SEQ ID NO: 15216 - DNA, 26 bp, Artificial Sequences
  Synthetic
tggttggttcgggagcgttttgggtc

SEQ ID NO: 15217 - DNA, 28 bp, Artificial Sequences
  Synthetic
ttttggttggttcgggagcgttttgggt

SEQ ID NO: 15218 - DNA, 27 bp, Artificial Sequences
  Synthetic
ggttcggggcgtttcggggtttgttaa

SEQ ID NO: 15219 - DNA, 27 bp, Artificial Sequences
  Synthetic
aagcgtcggaggaagggtagcgttagg

SEQ ID NO: 15220 - DNA, 27 bp, Artificial Sequences
  Synthetic
ggaagcgtcggaggaagggtagcgtta

SEQ ID NO: 15221 - DNA, 27 bp, Artificial Sequences
  Synthetic
tttggaagcgtcggaggaagggtagcg

SEQ ID NO: 15222 - DNA, 27 bp, Artificial Sequences
  Synthetic
aggttcggggcgtttcggggtttgtta

SEQ ID NO: 15223 - DNA, 27 bp, Artificial Sequences
  Synthetic
gatttgtggtcggacgtacggggggat

SEQ ID NO: 15224 - DNA, 27 bp, Artificial Sequences
  Synthetic
gggtaggtgtcggagttgggtgggaag

SEQ ID NO: 15225 - DNA, 27 bp, Artificial Sequences
  Synthetic
cgtttcggagtggggtaggtgtcggag

SEQ ID NO: 15226 - DNA, 27 bp, Artificial Sequences
  Synthetic
gagtggggtaggtgtcggagttgggtg

SEQ ID NO: 15227 - DNA, 27 bp, Artificial Sequences
  Synthetic
ttgtggtcggacgtacggggggatttc

SEQ ID NO: 15228 - DNA, 27 bp, Artificial Sequences
  Synthetic
gagtaggtagggacgggggtaggggag

SEQ ID NO: 15229 - DNA, 27 bp, Artificial Sequences
  Synthetic
gaggagtaggtagggacgggggtaggg

SEQ ID NO: 15230 - DNA, 27 bp, Artificial Sequences
  Synthetic
taggtagggacgggggtaggggaggtc

SEQ ID NO: 15231 - DNA, 27 bp, Artificial Sequences
  Synthetic
ggagtaggtagggacgggggtagggga

SEQ ID NO: 15232 - DNA, 27 bp, Artificial Sequences
  Synthetic
agtaggtagggacgggggtaggggagg

SEQ ID NO: 15233 - DNA, 28 bp, Artificial Sequences
  Synthetic
ggggcgtatagggtatttaagcgagcgt

SEQ ID NO: 15234 - DNA, 27 bp, Artificial Sequences
  Synthetic
ggggcgtatagggtatttaagcgagcg

SEQ ID NO: 15235 - DNA, 29 bp, Artificial Sequences
  Synthetic
aggggcgtatagggtatttaagcgagcgt

SEQ ID NO: 15236 - DNA, 28 bp, Artificial Sequences
  Synthetic
aggggcgtatagggtatttaagcgagcg

SEQ ID NO: 15237 - DNA, 29 bp, Artificial Sequences
  Synthetic
cgggaattagggtaaggggcgtatagggt

SEQ ID NO: 15238 - DNA, 27 bp, Artificial Sequences
  Synthetic
cgtcggggggtaggagaagttgcgatt

SEQ ID NO: 15239 - DNA, 27 bp, Artificial Sequences
  Synthetic
gtgtttgtggtggacgttgcggaggtt

SEQ ID NO: 15240 - DNA, 27 bp, Artificial Sequences
  Synthetic
tgtttgtggtggacgttgcggaggttg

SEQ ID NO: 15241 - DNA, 27 bp, Artificial Sequences
  Synthetic
ttaagtgtgggacgtcggggggtagga

SEQ ID NO: 15242 - DNA, 27 bp, Artificial Sequences
  Synthetic
gtttgtggtggacgttgcggaggttga

SEQ ID NO: 15243 - DNA, 27 bp, Artificial Sequences
  Synthetic
tcgtttgttcggcgggtataagagcgt

SEQ ID NO: 15244 - DNA, 27 bp, Artificial Sequences
  Synthetic
tattaggtgggaggaaagggagggggg

SEQ ID NO: 15245 - DNA, 26 bp, Artificial Sequences
  Synthetic
attaggtgggaggaaagggagggggg

SEQ ID NO: 15246 - DNA, 27 bp, Artificial Sequences
  Synthetic
cgtttgttcggcgggtataagagcgtt

SEQ ID NO: 15247 - DNA, 28 bp, Artificial Sequences
  Synthetic
tcgtttgttcggcgggtataagagcgtt

SEQ ID NO: 15248 - DNA, 27 bp, Artificial Sequences
  Synthetic
ggaattaggtagggtgtggtgggggat

SEQ ID NO: 15249 - DNA, 27 bp, Artificial Sequences
  Synthetic
ggtagggtgtggtgggggatagatagg

SEQ ID NO: 15250 - DNA, 28 bp, Artificial Sequences
  Synthetic
aggtagggtgtggtgggggatagatagg

SEQ ID NO: 15251 - DNA, 28 bp, Artificial Sequences
  Synthetic
ggtagggtgtggtgggggatagatagga

SEQ ID NO: 15252 - DNA, 29 bp, Artificial Sequences
  Synthetic
aggtagggtgtggtgggggatagatagga

SEQ ID NO: 15253 - DNA, 27 bp, Artificial Sequences
  Synthetic
ggagagttcgggtggatgtgggaaggg

SEQ ID NO: 15254 - DNA, 27 bp, Artificial Sequences
  Synthetic
gggtggatgtgggaagggaaggagagc

SEQ ID NO: 15255 - DNA, 27 bp, Artificial Sequences
  Synthetic
cgggtggatgtgggaagggaaggagag

SEQ ID NO: 15256 - DNA, 27 bp, Artificial Sequences
  Synthetic
gtggatgtgggaagggaaggagagcgg

SEQ ID NO: 15257 - DNA, 27 bp, Artificial Sequences
  Synthetic
ggtggatgtgggaagggaaggagagcg

SEQ ID NO: 15258 - DNA, 27 bp, Artificial Sequences
  Synthetic
tcggttgggtcggcgttttttgtagcg

SEQ ID NO: 15259 - DNA, 27 bp, Artificial Sequences
  Synthetic
ggttgggtcggcgttttttgtagcggt

SEQ ID NO: 15260 - DNA, 27 bp, Artificial Sequences
  Synthetic
gtaggggcgggggtagatttcggttgg

SEQ ID NO: 15261 - DNA, 27 bp, Artificial Sequences
  Synthetic
tgggtcggcgttttttgtagcggttgt

SEQ ID NO: 15262 - DNA, 27 bp, Artificial Sequences
  Synthetic
cgtaggggcgggggtagatttcggttg

SEQ ID NO: 15263 - DNA, 27 bp, Artificial Sequences
  Synthetic
cgaggagagcgggagggagatagggaa

SEQ ID NO: 15264 - DNA, 27 bp, Artificial Sequences
  Synthetic
atttgcggggagagaaggaggagcgag

SEQ ID NO: 15265 - DNA, 27 bp, Artificial Sequences
  Synthetic
gatttgcggggagagaaggaggagcga

SEQ ID NO: 15266 - DNA, 27 bp, Artificial Sequences
  Synthetic
tgtttaaaatggcgttggggtcgggcg

SEQ ID NO: 15267 - DNA, 27 bp, Artificial Sequences
  Synthetic
ggatttgcggggagagaaggaggagcg

SEQ ID NO: 15268 - DNA, 27 bp, Artificial Sequences
  Synthetic
tcggttgggtcggcgttttttgtagcg

SEQ ID NO: 15269 - DNA, 27 bp, Artificial Sequences
  Synthetic
ggttgggtcggcgttttttgtagcggt

SEQ ID NO: 15270 - DNA, 27 bp, Artificial Sequences
  Synthetic
gtaggggcgggggtagatttcggttgg

SEQ ID NO: 15271 - DNA, 27 bp, Artificial Sequences
  Synthetic
tgggtcggcgttttttgtagcggttgt

SEQ ID NO: 15272 - DNA, 27 bp, Artificial Sequences
  Synthetic
cgtaggggcgggggtagatttcggttg

SEQ ID NO: 15273 - DNA, 27 bp, Artificial Sequences
  Synthetic
cgaggagagcgggagggagatagggaa

SEQ ID NO: 15274 - DNA, 27 bp, Artificial Sequences
  Synthetic
tcgggcgagaagtttagggtggttcgg

SEQ ID NO: 15275 - DNA, 27 bp, Artificial Sequences
  Synthetic
tggatttgcggggagagaaggaggagc

SEQ ID NO: 15276 - DNA, 27 bp, Artificial Sequences
  Synthetic
atttgcggggagagaaggaggagcgag

SEQ ID NO: 15277 - DNA, 27 bp, Artificial Sequences
  Synthetic
gatttgcggggagagaaggaggagcga

SEQ ID NO: 15278 - DNA, 27 bp, Artificial Sequences
  Synthetic
tcgagtttatgggtgtttcggtagcgt

SEQ ID NO: 15279 - DNA, 27 bp, Artificial Sequences
  Synthetic
tgggtgcgggattttgtttttcgagaa

SEQ ID NO: 15280 - DNA, 27 bp, Artificial Sequences
  Synthetic
ttgggtgcgggattttgtttttcgaga

SEQ ID NO: 15281 - DNA, 28 bp, Artificial Sequences
  Synthetic
tcgagtttatgggtgtttcggtagcgtt

SEQ ID NO: 15282 - DNA, 28 bp, Artificial Sequences
  Synthetic
ttcgagtttatgggtgtttcggtagcgt

SEQ ID NO: 15283 - DNA, 27 bp, Artificial Sequences
  Synthetic
ggagtggggtcggggattttttcggga

SEQ ID NO: 15284 - DNA, 27 bp, Artificial Sequences
  Synthetic
tagggacgcgaggtttggggtttgagt

SEQ ID NO: 15285 - DNA, 27 bp, Artificial Sequences
  Synthetic
tggagtggggtcggggattttttcggg

SEQ ID NO: 15286 - DNA, 27 bp, Artificial Sequences
  Synthetic
gcgaggtttggggtttgagtcgggttt

SEQ ID NO: 15287 - DNA, 27 bp, Artificial Sequences
  Synthetic
agggacgcgaggtttggggtttgagtc

SEQ ID NO: 15288 - DNA, 27 bp, Artificial Sequences
  Synthetic
tcgggttggaggttggggaaggtttgt

SEQ ID NO: 15289 - DNA, 27 bp, Artificial Sequences
  Synthetic
gcggtggcggcggtagagtaggtttat

SEQ ID NO: 15290 - DNA, 27 bp, Artificial Sequences
  Synthetic
gtggcggattggttgggttttttggcg

SEQ ID NO: 15291 - DNA, 27 bp, Artificial Sequences
  Synthetic
cgtggcggattggttgggttttttggc

SEQ ID NO: 15292 - DNA, 27 bp, Artificial Sequences
  Synthetic
cggagaaggagacgtggcggattggtt

SEQ ID NO: 15293 - DNA, 27 bp, Artificial Sequences
  Synthetic
cggggtcggatcgtttgtaggtcggta

SEQ ID NO: 15294 - DNA, 26 bp, Artificial Sequences
  Synthetic
cggggtcggatcgtttgtaggtcggt

SEQ ID NO: 15295 - DNA, 28 bp, Artificial Sequences
  Synthetic
cggggtcggatcgtttgtaggtcggtaa

SEQ ID NO: 15296 - DNA, 29 bp, Artificial Sequences
  Synthetic
cggggtcggatcgtttgtaggtcggtaag

SEQ ID NO: 15297 - DNA, 27 bp, Artificial Sequences
  Synthetic
ggggtcggatcgtttgtaggtcggtaa

SEQ ID NO: 15298 - DNA, 27 bp, Artificial Sequences
  Synthetic
tcgggttggaggttggggaaggtttgt

SEQ ID NO: 15299 - DNA, 27 bp, Artificial Sequences
  Synthetic
cgtcgggttggaggttggggaaggttt

SEQ ID NO: 15300 - DNA, 27 bp, Artificial Sequences
  Synthetic
gtcgggttggaggttggggaaggtttg

SEQ ID NO: 15301 - DNA, 27 bp, Artificial Sequences
  Synthetic
cgggttggaggttggggaaggtttgtt

SEQ ID NO: 15302 - DNA, 28 bp, Artificial Sequences
  Synthetic
tcgggttggaggttggggaaggtttgtt

SEQ ID NO: 15303 - DNA, 36 bp, Artificial Sequences
  Synthetic
agagggagattgggtttataaatagttagtcgtcgt

SEQ ID NO: 15304 - DNA, 36 bp, Artificial Sequences
  Synthetic
gagagggagattgggtttataaatagttagtcgtcg

SEQ ID NO: 15305 - DNA, 26 bp, Artificial Sequences
  Synthetic
cgggttcgggttttgcgttggagtcg

SEQ ID NO: 15306 - DNA, 27 bp, Artificial Sequences
  Synthetic
agcgagagggaacgggttggtttagtt

SEQ ID NO: 15307 - DNA, 27 bp, Artificial Sequences
  Synthetic
gcgagagggaacgggttggtttagttt

SEQ ID NO: 15308 - DNA, 28 bp, Artificial Sequences
  Synthetic
agcgagagggaacgggttggtttagttt

SEQ ID NO: 15309 - DNA, 26 bp, Artificial Sequences
  Synthetic
agcgagagggaacgggttggtttagt

SEQ ID NO: 15310 - DNA, 27 bp, Artificial Sequences
  Synthetic
tcgacgttgagttttgtaggcggggtt

SEQ ID NO: 15311 - DNA, 27 bp, Artificial Sequences
  Synthetic
ttcgacgttgagttttgtaggcggggt

SEQ ID NO: 15312 - DNA, 27 bp, Artificial Sequences
  Synthetic
cgacgttgagttttgtaggcggggttt

SEQ ID NO: 15313 - DNA, 28 bp, Artificial Sequences
  Synthetic
tcgacgttgagttttgtaggcggggttt

SEQ ID NO: 15314 - DNA, 28 bp, Artificial Sequences
  Synthetic
ttcgacgttgagttttgtaggcggggtt

SEQ ID NO: 15315 - DNA, 27 bp, Artificial Sequences
  Synthetic
tgcgttggagtcgggatgtttttcggc

SEQ ID NO: 15316 - DNA, 27 bp, Artificial Sequences
  Synthetic
gttcgggttttgcgttggagtcgggat

SEQ ID NO: 15317 - DNA, 27 bp, Artificial Sequences
  Synthetic
tcgggttttgcgttggagtcgggatgt

SEQ ID NO: 15318 - DNA, 26 bp, Artificial Sequences
  Synthetic
gtcgggatgtttttcggcggagggtg

SEQ ID NO: 15319 - DNA, 28 bp, Artificial Sequences
  Synthetic
ttgcgttggagtcgggatgtttttcggc

SEQ ID NO: 15320 - DNA, 27 bp, Artificial Sequences
  Synthetic
tcgacgttgagttttgtaggcggggtt

SEQ ID NO: 15321 - DNA, 27 bp, Artificial Sequences
  Synthetic
ttcgacgttgagttttgtaggcggggt

SEQ ID NO: 15322 - DNA, 27 bp, Artificial Sequences
  Synthetic
cgacgttgagttttgtaggcggggttt

SEQ ID NO: 15323 - DNA, 28 bp, Artificial Sequences
  Synthetic
tcgacgttgagttttgtaggcggggttt

SEQ ID NO: 15324 - DNA, 28 bp, Artificial Sequences
  Synthetic
ttcgacgttgagttttgtaggcggggtt

SEQ ID NO: 15325 - DNA, 27 bp, Artificial Sequences
  Synthetic
tgcgttggagtcgggatgtttttcggc

SEQ ID NO: 15326 - DNA, 27 bp, Artificial Sequences
  Synthetic
gttcgggttttgcgttggagtcgggat

SEQ ID NO: 15327 - DNA, 27 bp, Artificial Sequences
  Synthetic
tcgggttttgcgttggagtcgggatgt

SEQ ID NO: 15328 - DNA, 26 bp, Artificial Sequences
  Synthetic
gtcgggatgtttttcggcggagggtg

SEQ ID NO: 15329 - DNA, 28 bp, Artificial Sequences
  Synthetic
ttgcgttggagtcgggatgtttttcggc

SEQ ID NO: 15330 - DNA, 33 bp, Artificial Sequences
  Synthetic
gagtttttgagtttcgagttttttggcggaaaa

SEQ ID NO: 15331 - DNA, 36 bp, Artificial Sequences
  Synthetic
tgtttgaaattggagattaggacgtttagagaggaa

SEQ ID NO: 15332 - DNA, 36 bp, Artificial Sequences
  Synthetic
ttgtttgaaattggagattaggacgtttagagagga

SEQ ID NO: 15333 - DNA, 26 bp, Artificial Sequences
  Synthetic
tcggagaggggggacgtaggtttttt

SEQ ID NO: 15334 - DNA, 25 bp, Artificial Sequences
  Synthetic
tcggagaggggggacgtaggttttt

SEQ ID NO: 15335 - DNA, 25 bp, Artificial Sequences
  Synthetic
cggagaggggggacgtaggtttttt

SEQ ID NO: 15336 - DNA, 24 bp, Artificial Sequences
  Synthetic
tcggagaggggggacgtaggtttt

SEQ ID NO: 15337 - DNA, 24 bp, Artificial Sequences
  Synthetic
cggagaggggggacgtaggttttt

SEQ ID NO: 15338 - DNA, 27 bp, Artificial Sequences
  Synthetic
cggtttggcggcgggaaggaaagaatt

SEQ ID NO: 15339 - DNA, 27 bp, Artificial Sequences
  Synthetic
aattcggtttggcggcgggaaggaaag

SEQ ID NO: 15340 - DNA, 27 bp, Artificial Sequences
  Synthetic
tcggtttggcggcgggaaggaaagaat

SEQ ID NO: 15341 - DNA, 27 bp, Artificial Sequences
  Synthetic
attcggtttggcggcgggaaggaaaga

SEQ ID NO: 15342 - DNA, 27 bp, Artificial Sequences
  Synthetic
taattcggtttggcggcgggaaggaaa

SEQ ID NO: 15343 - DNA, 27 bp, Artificial Sequences
  Synthetic
cgggtttcgttgaatgcgggggtttta

SEQ ID NO: 15344 - DNA, 26 bp, Artificial Sequences
  Synthetic
cgggtttcgttgaatgcgggggtttt

SEQ ID NO: 15345 - DNA, 28 bp, Artificial Sequences
  Synthetic
cgggtttcgttgaatgcgggggttttat

SEQ ID NO: 15346 - DNA, 27 bp, Artificial Sequences
  Synthetic
aatgcgggggttttatttatagcgcgc

SEQ ID NO: 15347 - DNA, 25 bp, Artificial Sequences
  Synthetic
cgggtttcgttgaatgcgggggttt

SEQ ID NO: 15348 - DNA, 27 bp, Artificial Sequences
  Synthetic
cggtttggcggcgggaaggaaagaatt

SEQ ID NO: 15349 - DNA, 27 bp, Artificial Sequences
  Synthetic
aattcggtttggcggcgggaaggaaag

SEQ ID NO: 15350 - DNA, 27 bp, Artificial Sequences
  Synthetic
tcggtttggcggcgggaaggaaagaat

SEQ ID NO: 15351 - DNA, 27 bp, Artificial Sequences
  Synthetic
attcggtttggcggcgggaaggaaaga

SEQ ID NO: 15352 - DNA, 27 bp, Artificial Sequences
  Synthetic
taattcggtttggcggcgggaaggaaa

SEQ ID NO: 15353 - DNA, 27 bp, Artificial Sequences
  Synthetic
gtcggtgggtgggatggaggagaaagg

SEQ ID NO: 15354 - DNA, 27 bp, Artificial Sequences
  Synthetic
ggtcggtgggtgggatggaggagaaag

SEQ ID NO: 15355 - DNA, 27 bp, Artificial Sequences
  Synthetic
gggtgggatggaggagaaagggtacgg

SEQ ID NO: 15356 - DNA, 27 bp, Artificial Sequences
  Synthetic
ttcgttttggggtcggtgggtgggatg

SEQ ID NO: 15357 - DNA, 27 bp, Artificial Sequences
  Synthetic
gttcgttttggggtcggtgggtgggat

SEQ ID NO: 15358 - DNA, 27 bp, Artificial Sequences
  Synthetic
gagtcgtatttgcgcggatgtgttagc

SEQ ID NO: 15359 - DNA, 28 bp, Artificial Sequences
  Synthetic
agagtcgtatttgcgcggatgtgttagc

SEQ ID NO: 15360 - DNA, 26 bp, Artificial Sequences
  Synthetic
agtcgtatttgcgcggatgtgttagc

SEQ ID NO: 15361 - DNA, 29 bp, Artificial Sequences
  Synthetic
tagagtcgtatttgcgcggatgtgttagc

SEQ ID NO: 15362 - DNA, 30 bp, Artificial Sequences
  Synthetic
ttagagtcgtatttgcgcggatgtgttagc

SEQ ID NO: 15363 - DNA, 27 bp, Artificial Sequences
  Synthetic
gtcggtgggtgggatggaggagaaagg

SEQ ID NO: 15364 - DNA, 27 bp, Artificial Sequences
  Synthetic
ggtcggtgggtgggatggaggagaaag

SEQ ID NO: 15365 - DNA, 27 bp, Artificial Sequences
  Synthetic
gggtgggatggaggagaaagggtacgg

SEQ ID NO: 15366 - DNA, 27 bp, Artificial Sequences
  Synthetic
cggagtgaggaggattatggtcgcggt

SEQ ID NO: 15367 - DNA, 27 bp, Artificial Sequences
  Synthetic
gcggagtgaggaggattatggtcgcgg

SEQ ID NO: 15368 - DNA, 27 bp, Artificial Sequences
  Synthetic
gagtcgtatttgcgcggatgtgttagc

SEQ ID NO: 15369 - DNA, 28 bp, Artificial Sequences
  Synthetic
agagtcgtatttgcgcggatgtgttagc

SEQ ID NO: 15370 - DNA, 26 bp, Artificial Sequences
  Synthetic
agtcgtatttgcgcggatgtgttagc

SEQ ID NO: 15371 - DNA, 29 bp, Artificial Sequences
  Synthetic
tagagtcgtatttgcgcggatgtgttagc

SEQ ID NO: 15372 - DNA, 30 bp, Artificial Sequences; identical to SEQ ID NO: 15362
  Synthetic

SEQ ID NO: 15373 - DNA, 27 bp, Artificial Sequences
  Synthetic
gtgcggttttgagtgttggttcggggt

SEQ ID NO: 15374 - DNA, 27 bp, Artificial Sequences
  Synthetic
aggtgcggttttgagtgttggttcggg

SEQ ID NO: 15375 - DNA, 27 bp, Artificial Sequences
  Synthetic
ggtgcggttttgagtgttggttcgggg

SEQ ID NO: 15376 - DNA, 27 bp, Artificial Sequences
  Synthetic
tgcggttttgagtgttggttcggggtt

SEQ ID NO: 15377 - DNA, 28 bp, Artificial Sequences
  Synthetic
gtgcggttttgagtgttggttcggggtt

SEQ ID NO: 15378 - DNA, 27 bp, Artificial Sequences
  Synthetic
tggtgagtgcgtagtgttttcggtagt

SEQ ID NO: 15379 - DNA, 28 bp, Artificial Sequences
  Synthetic
tggtgagtgcgtagtgttttcggtagtt

SEQ ID NO: 15380 - DNA, 28 bp, Artificial Sequences
  Synthetic
ttggtgagtgcgtagtgttttcggtagt

SEQ ID NO: 15381 - DNA, 29 bp, Artificial Sequences
  Synthetic
tggtgagtgcgtagtgttttcggtagttt

SEQ ID NO: 15382 - DNA, 29 bp, Artificial Sequences
  Synthetic
ttggtgagtgcgtagtgttttcggtagtt

SEQ ID NO: 15383 - DNA, 27 bp, Artificial Sequences
  Synthetic
gttcggtcgggtgttttggatgcgagg

SEQ ID NO: 15384 - DNA, 27 bp, Artificial Sequences
  Synthetic
gtgttttggatgcgaggcgggaggaag

SEQ ID NO: 15385 - DNA, 27 bp, Artificial Sequences
  Synthetic
cgttcggtcgggtgttttggatgcgag

SEQ ID NO: 15386 - DNA, 27 bp, Artificial Sequences
  Synthetic
cgtgtatgagggggtgggatcgtggtt

SEQ ID NO: 15387 - DNA, 27 bp, Artificial Sequences
  Synthetic
tcgtgtatgagggggtgggatcgtggt

SEQ ID NO: 15388 - DNA, 27 bp, Artificial Sequences
  Synthetic
taggagagcggggggttatagtcgggg

SEQ ID NO: 15389 - DNA, 27 bp, Artificial Sequences
  Synthetic
gcggggggttatagtcggggtttaggg

SEQ ID NO: 15390 - DNA, 27 bp, Artificial Sequences
  Synthetic
ggatggcgcggcgtggaggtttaaatt

SEQ ID NO: 15391 - DNA, 27 bp, Artificial Sequences
  Synthetic
gtaagcggggttggaagagaggggtgg

SEQ ID NO: 15392 - DNA, 27 bp, Artificial Sequences
  Synthetic
tggcgcggcgtggaggtttaaatttga

SEQ ID NO: 15393 - DNA, 27 bp, Artificial Sequences
  Synthetic
gacgcgtcgaagttggttttgggtaga

SEQ ID NO: 15394 - DNA, 27 bp, Artificial Sequences
  Synthetic
acgcgtcgaagttggttttgggtagat

SEQ ID NO: 15395 - DNA, 28 bp, Artificial Sequences
  Synthetic
gacgcgtcgaagttggttttgggtagat

SEQ ID NO: 15396 - DNA, 28 bp, Artificial Sequences
  Synthetic
acgcgtcgaagttggttttgggtagatt

SEQ ID NO: 15397 - DNA, 27 bp, Artificial Sequences
  Synthetic
cgcgtcgaagttggttttgggtagatt

SEQ ID NO: 15398 - DNA, 27 bp, Artificial Sequences
  Synthetic
ggggggatggtgcgattgtgtttgtgg

SEQ ID NO: 15399 - DNA, 27 bp, Artificial Sequences
  Synthetic
gggggatggtgcgattgtgtttgtggt

SEQ ID NO: 15400 - DNA, 27 bp, Artificial Sequences
  Synthetic
tagcggtggaaaaaggggatgagggcg

SEQ ID NO: 15401 - DNA, 27 bp, Artificial Sequences
  Synthetic
ggtggaaaaaggggatgagggcgtcgg

SEQ ID NO: 15402 - DNA, 27 bp, Artificial Sequences
  Synthetic
ttagcggtggaaaaaggggatgagggc

SEQ ID NO: 15403 - DNA, 27 bp, Artificial Sequences
  Synthetic
tcggttttgggtaaagggagtgggggg

SEQ ID NO: 15404 - DNA, 27 bp, Artificial Sequences
  Synthetic
cggttttgggtaaagggagtggggggt

SEQ ID NO: 15405 - DNA, 28 bp, Artificial Sequences
  Synthetic
ttcggttttgggtaaagggagtgggggg

SEQ ID NO: 15406 - DNA, 27 bp, Artificial Sequences
  Synthetic
agggagtggggggttatgtgtggagtt

SEQ ID NO: 15407 - DNA, 27 bp, Artificial Sequences
  Synthetic
aagggagtggggggttatgtgtggagt

SEQ ID NO: 15408 - DNA, 28 bp, Artificial Sequences
  Synthetic
gtcgaggagaggtagtttttgtcggtgt

SEQ ID NO: 15409 - DNA, 29 bp, Artificial Sequences
  Synthetic
tggtggttggggtatagattgggtagtcg

SEQ ID NO: 15410 - DNA, 29 bp, Artificial Sequences
  Synthetic
agtcgaggagaggtagtttttgtcggtgt

SEQ ID NO: 15411 - DNA, 28 bp, Artificial Sequences
  Synthetic
ggtggttggggtatagattgggtagtcg

SEQ ID NO: 15412 - DNA, 28 bp, Artificial Sequences
  Synthetic
agtcgaggagaggtagtttttgtcggtg

SEQ ID NO: 15413 - DNA, 28 bp, Artificial Sequences
  Synthetic
ggtgttggggagttttttaggaggtcgt

SEQ ID NO: 15414 - DNA, 29 bp, Artificial Sequences
  Synthetic
aggtgttggggagttttttaggaggtcgt

SEQ ID NO: 15415 - DNA, 28 bp, Artificial Sequences
  Synthetic
aggtgttggggagttttttaggaggtcg

SEQ ID NO: 15416 - DNA, 29 bp, Artificial Sequences
  Synthetic
ggtgttggggagttttttaggaggtcgtg

SEQ ID NO: 15417 - DNA, 30 bp, Artificial Sequences
  Synthetic
ggtgttggggagttttttaggaggtcgtgt

SEQ ID NO: 15418 - DNA, 28 bp, Artificial Sequences
  Synthetic
acgggtttggaaagagcggttttagagt

SEQ ID NO: 15419 - DNA, 29 bp, Artificial Sequences
  Synthetic
acgggtttggaaagagcggttttagagta

SEQ ID NO: 15420 - DNA, 30 bp, Artificial Sequences
  Synthetic
acgggtttggaaagagcggttttagagtat

SEQ ID NO: 15421 - DNA, 31 bp, Artificial Sequences
  Synthetic
acgggtttggaaagagcggttttagagtatt

SEQ ID NO: 15422 - DNA, 32 bp, Artificial Sequences
  Synthetic
acgggtttggaaagagcggttttagagtattt

SEQ ID NO: 15423 - DNA, 27 bp, Artificial Sequences
  Synthetic
gtcgggcggtgggggttgttttagttt

SEQ ID NO: 15424 - DNA, 27 bp, Artificial Sequences
  Synthetic
tgcgtggagatgtgagtgtggaaggga

SEQ ID NO: 15425 - DNA, 27 bp, Artificial Sequences
  Synthetic
cgtgcgtggagatgtgagtgtggaagg

SEQ ID NO: 15426 - DNA, 27 bp, Artificial Sequences
  Synthetic
gtgcgtggagatgtgagtgtggaaggg

SEQ ID NO: 15427 - DNA, 27 bp, Artificial Sequences
  Synthetic
tcgggcggtgggggttgttttagtttt

SEQ ID NO: 15428 - DNA, 27 bp, Artificial Sequences
  Synthetic
gggagtttgggggttagggagggtgtg

SEQ ID NO: 15429 - DNA, 27 bp, Artificial Sequences
  Synthetic
tagtgagggggcgggcgggatttttag

SEQ ID NO: 15430 - DNA, 27 bp, Artificial Sequences
  Synthetic
ttagtgagggggcgggcgggattttta

SEQ ID NO: 15431 - DNA, 27 bp, Artificial Sequences
  Synthetic
tttagtgagggggcgggcgggattttt

SEQ ID NO: 15432 - DNA, 27 bp, Artificial Sequences
  Synthetic
ttttttagtgagggggcgggcgggatt

SEQ ID NO: 15433 - DNA, 27 bp, Artificial Sequences
  Synthetic
tgtttgtgtgtgtgtgtgtgggtgttt

SEQ ID NO: 15434 - DNA, 28 bp, Artificial Sequences
  Synthetic
tgtttgtgtgtgtgtgtgtgggtgtttg

SEQ ID NO: 15435 - DNA, 28 bp, Artificial Sequences
  Synthetic
ttgtttgtgtgtgtgtgtgtgggtgttt

SEQ ID NO: 15436 - DNA, 26 bp, Artificial Sequences
  Synthetic
tgtttgtgtgtgtgtgtgtgggtgtt

SEQ ID NO: 15437 - DNA, 29 bp, Artificial Sequences
  Synthetic
agtgtcgtgtagttgtgtgtatcggtgtc

SEQ ID NO: 15438 - DNA, 27 bp, Artificial Sequences
  Synthetic
agtttttggtcgggttgaggggttgcg

SEQ ID NO: 15439 - DNA, 27 bp, Artificial Sequences
  Synthetic
gtttttggtcgggttgaggggttgcga

SEQ ID NO: 15440 - DNA, 27 bp, Artificial Sequences
  Synthetic
tttttggtcgggttgaggggttgcgat

SEQ ID NO: 15441 - DNA, 28 bp, Artificial Sequences
  Synthetic
aagtttttggtcgggttgaggggttgcg

SEQ ID NO: 15442 - DNA, 27 bp, Artificial Sequences
  Synthetic
tttggtcgggttgaggggttgcgatag

SEQ ID NO: 15443 - DNA, 29 bp, Artificial Sequences
  Synthetic
gggggtgatttttagtggttcgttgtggt

SEQ ID NO: 15444 - DNA, 29 bp, Artificial Sequences
  Synthetic
tgggggtgatttttagtggttcgttgtgg

SEQ ID NO: 15445 - DNA, 30 bp, Artificial Sequences
  Synthetic
tgggggtgatttttagtggttcgttgtggt

SEQ ID NO: 15446 - DNA, 28 bp, Artificial Sequences
  Synthetic
gggggtgatttttagtggttcgttgtgg

SEQ ID NO: 15447 - DNA, 30 bp, Artificial Sequences
  Synthetic
cggttagaggttttaggagttgttgggggt

SEQ ID NO: 15448 - DNA, 33 bp, Artificial Sequences
  Synthetic
agcgaaagagtagtagtagagagtagagtcgga

SEQ ID NO: 15449 - DNA, 33 bp, Artificial Sequences
  Synthetic
gcgaaagagtagtagtagagagtagagtcggag

SEQ ID NO: 15450 - DNA, 33 bp, Artificial Sequences
  Synthetic
aagcgaaagagtagtagtagagagtagagtcgg

SEQ ID NO: 15451 - DNA, 34 bp, Artificial Sequences
  Synthetic
agcgaaagagtagtagtagagagtagagtcggag

SEQ ID NO: 15452 - DNA, 34 bp, Artificial Sequences
  Synthetic
gcgaaagagtagtagtagagagtagagtcggaga

SEQ ID NO: 15453 - DNA, 27 bp, Artificial Sequences
  Synthetic
ggcgggagaaaaggtgagaggtcgagg

SEQ ID NO: 15454 - DNA, 27 bp, Artificial Sequences
  Synthetic
agcgagtaggagggatggagggatggg

SEQ ID NO: 15455 - DNA, 27 bp, Artificial Sequences
  Synthetic
gaacggtcggcgggagaaaaggtgaga

SEQ ID NO: 15456 - DNA, 27 bp, Artificial Sequences
  Synthetic
aacggtcggcgggagaaaaggtgagag

SEQ ID NO: 15457 - DNA, 27 bp, Artificial Sequences
  Synthetic
cggcgggagaaaaggtgagaggtcgag

SEQ ID NO: 15458 - DNA, 27 bp, Artificial Sequences
  Synthetic
ttgcgttcggggaggtgggtggttttc

SEQ ID NO: 15459 - DNA, 27 bp, Artificial Sequences
  Synthetic
gttgcgttcggggaggtgggtggtttt

SEQ ID NO: 15460 - DNA, 26 bp, Artificial Sequences
  Synthetic
ttgcgttcggggaggtgggtggtttt

SEQ ID NO: 15461 - DNA, 25 bp, Artificial Sequences
  Synthetic
gttcggggaggtgggtggttttcgc

SEQ ID NO: 15462 - DNA, 25 bp, Artificial Sequences
  Synthetic
gcgttcggggaggtgggtggttttc

SEQ ID NO: 15463 - DNA, 25 bp, Artificial Sequences
  Synthetic
cgatggcgcggagttagacgtttcg

SEQ ID NO: 15464 - DNA, 28 bp, Artificial Sequences
  Synthetic
gcgtttagttcgttgcgtttgtatcggg

SEQ ID NO: 15465 - DNA, 29 bp, Artificial Sequences
  Synthetic
gcgtttagttcgttgcgtttgtatcgggt

SEQ ID NO: 15466 - DNA, 29 bp, Artificial Sequences
  Synthetic
agcgtttagttcgttgcgtttgtatcggg

SEQ ID NO: 15467 - DNA, 30 bp, Artificial Sequences
  Synthetic
agcgtttagttcgttgcgtttgtatcgggt

SEQ ID NO: 15468 - DNA, 33 bp, Artificial Sequences
  Synthetic
agcgggtggtttagtaaaagattagtttagcga

SEQ ID NO: 15469 - DNA, 34 bp, Artificial Sequences
  Synthetic
agcgggtggtttagtaaaagattagtttagcgat

SEQ ID NO: 15470 - DNA, 34 bp, Artificial Sequences
  Synthetic
ttttttggttttttaggttagcgggtggtttagt

SEQ ID NO: 15471 - DNA, 34 bp, Artificial Sequences
  Synthetic
tagcgggtggtttagtaaaagattagtttagcga

SEQ ID NO: 15472 - DNA, 35 bp, Artificial Sequences
  Synthetic
tggttttttaggttagcgggtggtttagtaaaaga

SEQ ID NO: 15473 - DNA, 27 bp, Artificial Sequences
  Synthetic
gcggggggtttttaggtcgttgggttg

SEQ ID NO: 15474 - DNA, 27 bp, Artificial Sequences
  Synthetic
ggtgagggtcggatcggaggagggata

SEQ ID NO: 15475 - DNA, 27 bp, Artificial Sequences
  Synthetic
gtcggatcggaggagggatagggaggt

SEQ ID NO: 15476 - DNA, 27 bp, Artificial Sequences
  Synthetic
tcggatcggaggagggatagggaggtg

SEQ ID NO: 15477 - DNA, 27 bp, Artificial Sequences
  Synthetic
tgagggtcggatcggaggagggatagg

SEQ ID NO: 15478 - DNA, 28 bp, Artificial Sequences
  Synthetic
acggcgtttaaggggttaggttcggagt

SEQ ID NO: 15479 - DNA, 27 bp, Artificial Sequences
  Synthetic
cggcgtttaaggggttaggttcggagt

SEQ ID NO: 15480 - DNA, 27 bp, Artificial Sequences
  Synthetic
acggcgtttaaggggttaggttcggag

SEQ ID NO: 15481 - DNA, 28 bp, Artificial Sequences
  Synthetic
cggcgtttaaggggttaggttcggagtt

SEQ ID NO: 15482 - DNA, 29 bp, Artificial Sequences
  Synthetic
acggcgtttaaggggttaggttcggagtt

SEQ ID NO: 15483 - DNA, 27 bp, Artificial Sequences
  Synthetic
agggtttggcgtcgttggtggtgtaga

SEQ ID NO: 15484 - DNA, 27 bp, Artificial Sequences
  Synthetic
aggcggtcgagggtaaggagtagggtt

SEQ ID NO: 15485 - DNA, 27 bp, Artificial Sequences
  Synthetic
gaggagtttggagaaggagcgcgtcga

SEQ ID NO: 15486 - DNA, 27 bp, Artificial Sequences
  Synthetic
aggaggcggtcgagggtaaggagtagg

SEQ ID NO: 15487 - DNA, 27 bp, Artificial Sequences
  Synthetic
aggagtttggagaaggagcgcgtcgaa

SEQ ID NO: 15488 - DNA, 27 bp, Artificial Sequences
  Synthetic
gagtggggttggcgttgtttggagtcg

SEQ ID NO: 15489 - DNA, 27 bp, Artificial Sequences
  Synthetic
cgagtggggttggcgttgtttggagtc

SEQ ID NO: 15490 - DNA, 27 bp, Artificial Sequences
  Synthetic
ggttaggtcgggtaggtgttcggcgtt

SEQ ID NO: 15491 - DNA, 27 bp, Artificial Sequences
  Synthetic
tcgggaagggttgttttcggggaggtc

SEQ ID NO: 15492 - DNA, 27 bp, Artificial Sequences
  Synthetic
aggtcgggtaggtgttcggcgtttagg

SEQ ID NO: 15493 - DNA, 27 bp, Artificial Sequences
  Synthetic
tgtcgcggaattttggttttgggtcgt

SEQ ID NO: 15494 - DNA, 28 bp, Artificial Sequences
  Synthetic
ttgtcgcggaattttggttttgggtcgt

SEQ ID NO: 15495 - DNA, 27 bp, Artificial Sequences
  Synthetic
ttgtcgcggaattttggttttgggtcg

SEQ ID NO: 15496 - DNA, 28 bp, Artificial Sequences
  Synthetic
gttgtcgcggaattttggttttgggtcg

SEQ ID NO: 15497 - DNA, 29 bp, Artificial Sequences
  Synthetic
gttgtcgcggaattttggttttgggtcgt

SEQ ID NO: 15498 - DNA, 27 bp, Artificial Sequences
  Synthetic
gcggaggttaggggtgaggattgggag

SEQ ID NO: 15499 - DNA, 27 bp, Artificial Sequences
  Synthetic
gtcgcggaggttaggggtgaggattgg

SEQ ID NO: 15500 - DNA, 27 bp, Artificial Sequences
  Synthetic
ggtcgcggaggttaggggtgaggattg

SEQ ID NO: 15501 - DNA, 27 bp, Artificial Sequences
  Synthetic
ttttgtttcggtttagggggtcgcggg

SEQ ID NO: 15502 - DNA, 27 bp, Artificial Sequences
  Synthetic
ggggtgaggattgggaggaagttcggt

SEQ ID NO: 15503 - DNA, 28 bp, Artificial Sequences
  Synthetic
ggttttttgggtcgggataaggagggcg

SEQ ID NO: 15504 - DNA, 28 bp, Artificial Sequences
  Synthetic
cggttttttgggtcgggataaggagggc

SEQ ID NO: 15505 - DNA, 28 bp, Artificial Sequences
  Synthetic
gcggttttttgggtcgggataaggaggg

SEQ ID NO: 15506 - DNA, 27 bp, Artificial Sequences
  Synthetic
gttttttgggtcgggataaggagggcg

SEQ ID NO: 15507 - DNA, 27 bp, Artificial Sequences
  Synthetic
gcggttttttgggtcgggataaggagg

SEQ ID NO: 15508 - DNA, 27 bp, Artificial Sequences
  Synthetic
ttttgtttcggtttagggggtcgcggg

SEQ ID NO: 15509 - DNA, 28 bp, Artificial Sequences
  Synthetic
tttttgtttcggtttagggggtcgcggg

SEQ ID NO: 15510 - DNA, 26 bp, Artificial Sequences
  Synthetic
tttgtttcggtttagggggtcgcggg

SEQ ID NO: 15511 - DNA, 27 bp, Artificial Sequences
  Synthetic
tttttgtttcggtttagggggtcgcgg

SEQ ID NO: 15512 - DNA, 29 bp, Artificial Sequences
  Synthetic
ttttttgtttcggtttagggggtcgcggg

SEQ ID NO: 15513 - DNA, 27 bp, Artificial Sequences
  Synthetic
ttaagaggagggtattgggtcgcgcgg

SEQ ID NO: 15514 - DNA, 27 bp, Artificial Sequences
  Synthetic
cgtggtgggtatggtagggaagcggag

SEQ ID NO: 15515 - DNA, 27 bp, Artificial Sequences
  Synthetic
ttggaagtgtaaggtcgcgtggtgggt

SEQ ID NO: 15516 - DNA, 27 bp, Artificial Sequences
  Synthetic
gggcgtcggtagggggtggttagattc

SEQ ID NO: 15517 - DNA, 27 bp, Artificial Sequences
  Synthetic
gggcgggtgagtagaagggtcgtgttt

SEQ ID NO: 15518 - DNA, 27 bp, Artificial Sequences
  Synthetic
ttgcgttcgttgtttttcggggagggg

SEQ ID NO: 15519 - DNA, 27 bp, Artificial Sequences
  Synthetic
cgagtcgggtaggggttgggagtttcg

SEQ ID NO: 15520 - DNA, 27 bp, Artificial Sequences
  Synthetic
gcgagtcgggtaggggttgggagtttc

SEQ ID NO: 15521 - DNA, 27 bp, Artificial Sequences
  Synthetic
gggaggggggttttagggtttttcggc

SEQ ID NO: 15522 - DNA, 27 bp, Artificial Sequences
  Synthetic
gagtcgggtaggggttgggagtttcgt

SEQ ID NO: 15523 - DNA, 27 bp, Artificial Sequences
  Synthetic
cgcggaggagtggatgtgaaggacgag

SEQ ID NO: 15524 - DNA, 27 bp, Artificial Sequences
  Synthetic
gcggaggagtggatgtgaaggacgaga

SEQ ID NO: 15525 - DNA, 27 bp, Artificial Sequences
  Synthetic
tcgcggaggagtggatgtgaaggacga

SEQ ID NO: 15526 - DNA, 26 bp, Artificial Sequences
  Synthetic
cgcggaggagtggatgtgaaggacga

SEQ ID NO: 15527 - DNA, 26 bp, Artificial Sequences
  Synthetic
tcgcggaggagtggatgtgaaggacg

SEQ ID NO: 15528 - DNA, 27 bp, Artificial Sequences
  Synthetic
cgaggtttggatgtggtttcgtggcgg

SEQ ID NO: 15529 - DNA, 27 bp, Artificial Sequences
  Synthetic
tcgaggtttggatgtggtttcgtggcg

SEQ ID NO: 15530 - DNA, 27 bp, Artificial Sequences
  Synthetic
aggtttggatgtggtttcgtggcggag

SEQ ID NO: 15531 - DNA, 27 bp, Artificial Sequences
  Synthetic
ggtttggatgtggtttcgtggcggaga

SEQ ID NO: 15532 - DNA, 27 bp, Artificial Sequences
  Synthetic
gaggtttggatgtggtttcgtggcgga

SEQ ID NO: 15533 - DNA, 30 bp, Artificial Sequences
  Synthetic
tgttttgtgaggagttggtttatcgttcgc

SEQ ID NO: 15534 - DNA, 31 bp, Artificial Sequences
  Synthetic
cgcgtttagttttgttttgtgaggagttggt

SEQ ID NO: 15535 - DNA, 31 bp, Artificial Sequences
  Synthetic
acgcgtttagttttgttttgtgaggagttgg

SEQ ID NO: 15536 - DNA, 32 bp, Artificial Sequences
  Synthetic
acgcgtttagttttgttttgtgaggagttggt

SEQ ID NO: 15537 - DNA, 31 bp, Artificial Sequences
  Synthetic
ttgttttgtgaggagttggtttatcgttcgc

SEQ ID NO: 15538 - DNA, 25 bp, Artificial Sequences
  Synthetic
gggttgagcgcgtaggattgagagc

SEQ ID NO: 15539 - DNA, 29 bp, Artificial Sequences
  Synthetic
cgggagggagagtattgagtaggtttcgt

SEQ ID NO: 15540 - DNA, 30 bp, Artificial Sequences
  Synthetic
tcgggagggagagtattgagtaggtttcgt

SEQ ID NO: 15541 - DNA, 29 bp, Artificial Sequences
  Synthetic
tcgggagggagagtattgagtaggtttcg

SEQ ID NO: 15542 - DNA, 30 bp, Artificial Sequences
  Synthetic
tgagttcgggagggagagtattgagtaggt

SEQ ID NO: 15543 - DNA, 27 bp, Artificial Sequences
  Synthetic
cgcgtttggttcgtatggttatggggt

SEQ ID NO: 15544 - DNA, 28 bp, Artificial Sequences
  Synthetic
tcgcgtttggttcgtatggttatggggt

SEQ ID NO: 15545 - DNA, 27 bp, Artificial Sequences
  Synthetic
tcgcgtttggttcgtatggttatgggg

SEQ ID NO: 15546 - DNA, 28 bp, Artificial Sequences
  Synthetic
gcgattcgttggttttagatgtggcggt

SEQ ID NO: 15547 - DNA, 27 bp, Artificial Sequences
  Synthetic
gcgattcgttggttttagatgtggcgg

SEQ ID NO: 15548 - DNA, 25 bp, Artificial Sequences
  Synthetic
gggttgagcgcgtaggattgagagc

SEQ ID NO: 15549 - DNA, 24 bp, Artificial Sequences
  Synthetic
ggttgagcgcgtaggattgagagc

SEQ ID NO: 15550 - DNA, 33 bp, Artificial Sequences
  Synthetic
gcgggcggtgaattagttttttatagggtaggg

SEQ ID NO: 15551 - DNA, 34 bp, Artificial Sequences
  Synthetic
gcgggcggtgaattagttttttatagggtagggt

SEQ ID NO: 15552 - DNA, 32 bp, Artificial Sequences
  Synthetic
gcgggcggtgaattagttttttatagggtagg

SEQ ID NO: 15553 - DNA, 27 bp, Artificial Sequences
  Synthetic
tgttcgtttcggttagcgcgttgggtt

SEQ ID NO: 15554 - DNA, 27 bp, Artificial Sequences
  Synthetic
ttgttcgtttcggttagcgcgttgggt

SEQ ID NO: 15555 - DNA, 27 bp, Artificial Sequences
  Synthetic
gttgttcgtttcggttagcgcgttggg

SEQ ID NO: 15556 - DNA, 28 bp, Artificial Sequences
  Synthetic
agttgttcgtttcggttagcgcgttggg

SEQ ID NO: 15557 - DNA, 28 bp, Artificial Sequences
  Synthetic
gttgttcgtttcggttagcgcgttgggt

SEQ ID NO: 15558 - DNA, 27 bp, Artificial Sequences
  Synthetic
tagcggatcgtttggtcgttggagtcg

SEQ ID NO: 15559 - DNA, 26 bp, Artificial Sequences
  Synthetic
agcggatcgtttggtcgttggagtcg

SEQ ID NO: 15560 - DNA, 28 bp, Artificial Sequences
  Synthetic
tgggattagcggatcgtttggtcgttgg

SEQ ID NO: 15561 - DNA, 27 bp, Artificial Sequences
  Synthetic
gggattagcggatcgtttggtcgttgg

SEQ ID NO: 15562 - DNA, 28 bp, Artificial Sequences
  Synthetic
ttagcggatcgtttggtcgttggagtcg

SEQ ID NO: 15563 - DNA, 27 bp, Artificial Sequences
  Synthetic
tgttcgtttcggttagcgcgttgggtt

SEQ ID NO: 15564 - DNA, 27 bp, Artificial Sequences
  Synthetic
ttgttcgtttcggttagcgcgttgggt

SEQ ID NO: 15565 - DNA, 27 bp, Artificial Sequences
  Synthetic
gttgttcgtttcggttagcgcgttggg

SEQ ID NO: 15566 - DNA, 28 bp, Artificial Sequences
  Synthetic
agttgttcgtttcggttagcgcgttggg

SEQ ID NO: 15567 - DNA, 28 bp, Artificial Sequences
  Synthetic
gttgttcgtttcggttagcgcgttgggt

SEQ ID NO: 15568 - DNA, 27 bp, Artificial Sequences
  Synthetic
tagcggatcgtttggtcgttggagtcg

SEQ ID NO: 15569 - DNA, 26 bp, Artificial Sequences
  Synthetic
agcggatcgtttggtcgttggagtcg

SEQ ID NO: 15570 - DNA, 28 bp, Artificial Sequences
  Synthetic
tgggattagcggatcgtttggtcgttgg

SEQ ID NO: 15571 - DNA, 27 bp, Artificial Sequences
  Synthetic
gggattagcggatcgtttggtcgttgg

SEQ ID NO: 15572 - DNA, 28 bp, Artificial Sequences
  Synthetic
ttagcggatcgtttggtcgttggagtcg

SEQ ID NO: 15573 - DNA, 27 bp, Artificial Sequences
  Synthetic
tgttcgtttcggttagcgcgttgggtt

SEQ ID NO: 15574 - DNA, 27 bp, Artificial Sequences
  Synthetic
ttgttcgtttcggttagcgcgttgggt

SEQ ID NO: 15575 - DNA, 27 bp, Artificial Sequences
  Synthetic
gttgttcgtttcggttagcgcgttggg

SEQ ID NO: 15576 - DNA, 28 bp, Artificial Sequences
  Synthetic
agttgttcgtttcggttagcgcgttggg

SEQ ID NO: 15577 - DNA, 28 bp, Artificial Sequences
  Synthetic
gttgttcgtttcggttagcgcgttgggt

SEQ ID NO: 15578 - DNA, 29 bp, Artificial Sequences
  Synthetic
ggtcggagcgggtagttattttattggcg

SEQ ID NO: 15579 - DNA, 30 bp, Artificial Sequences
  Synthetic
ggtcggagcgggtagttattttattggcgt

SEQ ID NO: 15580 - DNA, 30 bp, Artificial Sequences
  Synthetic
tggtcggagcgggtagttattttattggcg

SEQ ID NO: 15581 - DNA, 28 bp, Artificial Sequences
  Synthetic
tcggagcgggtagttattttattggcgt

SEQ ID NO: 15582 - DNA, 31 bp, Artificial Sequences
  Synthetic
tggtcggagcgggtagttattttattggcgt

SEQ ID NO: 15583 - DNA, 30 bp, Artificial Sequences
  Synthetic
gggagtgagattcgttggatatggttagcg

SEQ ID NO: 15584 - DNA, 31 bp, Artificial Sequences
  Synthetic
gggagtgagattcgttggatatggttagcgt

SEQ ID NO: 15585 - DNA, 31 bp, Artificial Sequences
  Synthetic
agggagtgagattcgttggatatggttagcg

SEQ ID NO: 15586 - DNA, 32 bp, Artificial Sequences
  Synthetic
agggagtgagattcgttggatatggttagcgt

SEQ ID NO: 15587 - DNA, 30 bp, Artificial Sequences
  Synthetic
ggagtgagattcgttggatatggttagcgt

SEQ ID NO: 15588 - DNA, 28 bp, Artificial Sequences
  Synthetic
gcggtggggagattgtgggtagttttgg

SEQ ID NO: 15589 - DNA, 27 bp, Artificial Sequences
  Synthetic
tgcggtggggagattgtgggtagtttt

SEQ ID NO: 15590 - DNA, 27 bp, Artificial Sequences
  Synthetic
ttgcggtggggagattgtgggtagttt

SEQ ID NO: 15591 - DNA, 27 bp, Artificial Sequences
  Synthetic
tttgcggtggggagattgtgggtagtt

SEQ ID NO: 15592 - DNA, 27 bp, Artificial Sequences
  Synthetic
ttttgcggtggggagattgtgggtagt

SEQ ID NO: 15593 - DNA, 27 bp, Artificial Sequences
  Synthetic
cgtttaggcgggatagggttcggggag

SEQ ID NO: 15594 - DNA, 27 bp, Artificial Sequences
  Synthetic
ggttcggggagcggtaggaaatgggtt

SEQ ID NO: 15595 - DNA, 27 bp, Artificial Sequences
  Synthetic
tcggggagcggtaggaaatgggttgtt

SEQ ID NO: 15596 - DNA, 27 bp, Artificial Sequences
  Synthetic
ttcggggagcggtaggaaatgggttgt

SEQ ID NO: 15597 - DNA, 27 bp, Artificial Sequences
  Synthetic
gtttaggcgggatagggttcggggagc

SEQ ID NO: 15598 - DNA, 27 bp, Artificial Sequences
  Synthetic
ggttgggatgcgggttttgtaggcgtt

SEQ ID NO: 15599 - DNA, 27 bp, Artificial Sequences
  Synthetic
tgggatgcgggttttgtaggcgtttcg

SEQ ID NO: 15600 - DNA, 27 bp, Artificial Sequences
  Synthetic
gggatgcgggttttgtaggcgtttcgg

SEQ ID NO: 15601 - DNA, 27 bp, Artificial Sequences
  Synthetic
ggggttagggttgggatgcgggttttg

SEQ ID NO: 15602 - DNA, 27 bp, Artificial Sequences
  Synthetic
gggttagggttgggatgcgggttttgt

SEQ ID NO: 15603 - DNA, 27 bp, Artificial Sequences
  Synthetic
ggtagagttgttcgtcggggcgtttgt

SEQ ID NO: 15604 - DNA, 28 bp, Artificial Sequences
  Synthetic
aggtagagttgttcgtcggggcgtttgt

SEQ ID NO: 15605 - DNA, 27 bp, Artificial Sequences
  Synthetic
aggtagagttgttcgtcggggcgtttg

SEQ ID NO: 15606 - DNA, 27 bp, Artificial Sequences
  Synthetic
cgttgaagtcgttggggaaggggagag

SEQ ID NO: 15607 - DNA, 28 bp, Artificial Sequences
  Synthetic
cgttgaagtcgttggggaaggggagaga

SEQ ID NO: 15608 - DNA, 27 bp, Artificial Sequences
  Synthetic
gtgggggttttcgttgttaaggcgggg

SEQ ID NO: 15609 - DNA, 27 bp, Artificial Sequences
  Synthetic
ggttgggatgcgggttttgtaggcgtt

SEQ ID NO: 15610 - DNA, 27 bp, Artificial Sequences
  Synthetic
tgggatgcgggttttgtaggcgtttcg

SEQ ID NO: 15611 - DNA, 27 bp, Artificial Sequences
  Synthetic
gggatgcgggttttgtaggcgtttcgg

SEQ ID NO: 15612 - DNA, 27 bp, Artificial Sequences
  Synthetic
ggggttagggttgggatgcgggttttg

SEQ ID NO: 15613 - DNA, 27 bp, Artificial Sequences
  Synthetic
ttgcgttgaagtcgttggggaagggga

SEQ ID NO: 15614 - DNA, 27 bp, Artificial Sequences
  Synthetic
gcgttgaagtcgttggggaaggggaga

SEQ ID NO: 15615 - DNA, 27 bp, Artificial Sequences
  Synthetic
tttgcgttgaagtcgttggggaagggg

SEQ ID NO: 15616 - DNA, 27 bp, Artificial Sequences
  Synthetic
tgcgttgaagtcgttggggaaggggag

SEQ ID NO: 15617 - DNA, 28 bp, Artificial Sequences
  Synthetic
gtttgcgttgaagtcgttggggaagggg

SEQ ID NO: 15618 - DNA, 27 bp, Artificial Sequences
  Synthetic
gtgggggttttcgttgttaaggcgggg

SEQ ID NO: 15619 - DNA, 27 bp, Artificial Sequences
  Synthetic
tgtgggggttttcgttgttaaggcggg

SEQ ID NO: 15620 - DNA, 27 bp, Artificial Sequences
  Synthetic
ggggttttcgttgttaaggcgggggaa

SEQ ID NO: 15621 - DNA, 27 bp, Artificial Sequences
  Synthetic
gggggttttcgttgttaaggcggggga

SEQ ID NO: 15622 - DNA, 27 bp, Artificial Sequences
  Synthetic
tgggggttttcgttgttaaggcggggg

SEQ ID NO: 15623 - DNA, 26 bp, Artificial Sequences
  Synthetic
ttttttcggggggcggcgtgagagtc

SEQ ID NO: 15624 - DNA, 27 bp, Artificial Sequences
  Synthetic
ttttttcggggggcggcgtgagagtcg

SEQ ID NO: 15625 - DNA, 25 bp, Artificial Sequences
  Synthetic
ttttttcggggggcggcgtgagagt

SEQ ID NO: 15626 - DNA, 24 bp, Artificial Sequences
  Synthetic
ttttttcggggggcggcgtgagag

SEQ ID NO: 15627 - DNA, 25 bp, Artificial Sequences
  Synthetic
tttttcggggggcggcgtgagagtc

SEQ ID NO: 15628 - DNA, 28 bp, Artificial Sequences
  Synthetic
tgttcgtgcggagttttaaagtaggggt

SEQ ID NO: 15629 - DNA, 29 bp, Artificial Sequences
  Synthetic
tgttcgtgcggagttttaaagtaggggtt

SEQ ID NO: 15630 - DNA, 29 bp, Artificial Sequences
  Synthetic
ttgttcgtgcggagttttaaagtaggggt

SEQ ID NO: 15631 - DNA, 30 bp, Artificial Sequences
  Synthetic
tgttcgtgcggagttttaaagtaggggttt

SEQ ID NO: 15632 - DNA, 30 bp, Artificial Sequences
  Synthetic
ttgttcgtgcggagttttaaagtaggggtt

SEQ ID NO: 15633 - DNA, 27 bp, Artificial Sequences
  Synthetic
ttatggttttggtggaggggcgtcggt

SEQ ID NO: 15634 - DNA, 27 bp, Artificial Sequences
  Synthetic
ggttttggtggaggggcgtcggtagat

SEQ ID NO: 15635 - DNA, 27 bp, Artificial Sequences
  Synthetic
atggttttggtggaggggcgtcggtag

SEQ ID NO: 15636 - DNA, 27 bp, Artificial Sequences
  Synthetic
tatggttttggtggaggggcgtcggta

SEQ ID NO: 15637 - DNA, 27 bp, Artificial Sequences
  Synthetic
tttatggttttggtggaggggcgtcgg

SEQ ID NO: 15638 - DNA, 27 bp, Artificial Sequences
  Synthetic
aaggttagggtaggtggggtgggaggt

SEQ ID NO: 15639 - DNA, 27 bp, Artificial Sequences
  Synthetic
gggtgggaggtggggagagggatatgt

SEQ ID NO: 15640 - DNA, 27 bp, Artificial Sequences
  Synthetic
aggttagggtaggtggggtgggaggtg

SEQ ID NO: 15641 - DNA, 27 bp, Artificial Sequences
  Synthetic
gggaaggttagggtaggtggggtggga

SEQ ID NO: 15642 - DNA, 27 bp, Artificial Sequences
  Synthetic
agggaaggttagggtaggtggggtggg

SEQ ID NO: 15643 - DNA, 27 bp, Artificial Sequences
  Synthetic
tgtttggttcgtgttgttcggggttgt

SEQ ID NO: 15644 - DNA, 28 bp, Artificial Sequences
  Synthetic
tgtttggttcgtgttgttcggggttgtt

SEQ ID NO: 15645 - DNA, 28 bp, Artificial Sequences
  Synthetic
tggtagtggggagggatagttcgaaggt

SEQ ID NO: 15646 - DNA, 27 bp, Artificial Sequences
  Synthetic
gtttggttcgtgttgttcggggttgtt

SEQ ID NO: 15647 - DNA, 27 bp, Artificial Sequences
  Synthetic
ggtagtggggagggatagttcgaaggt

SEQ ID NO: 15648 - DNA, 27 bp, Artificial Sequences
  Synthetic
ggggttggagtggtcgggtagggtttt

SEQ ID NO: 15649 - DNA, 27 bp, Artificial Sequences
  Synthetic
ttttggggttggagtggtcgggtaggg

SEQ ID NO: 15650 - DNA, 27 bp, Artificial Sequences
  Synthetic
agaggttttggggttggagtggtcggg

SEQ ID NO: 15651 - DNA, 27 bp, Artificial Sequences
  Synthetic
gggaagtgttggaacgagtggaggggt

SEQ ID NO: 15652 - DNA, 27 bp, Artificial Sequences
  Synthetic
gaggttttggggttggagtggtcgggt

SEQ ID NO: 15653 - DNA, 29 bp, Artificial Sequences
  Synthetic
agggtatttgaggggaatggaaagaggga

SEQ ID NO: 15654 - DNA, 30 bp, Artificial Sequences
  Synthetic
tgagggtatttgaggggaatggaaagaggg

SEQ ID NO: 15655 - DNA, 29 bp, Artificial Sequences
  Synthetic
gagggtatttgaggggaatggaaagaggg

SEQ ID NO: 15656 - DNA, 30 bp, Artificial Sequences
  Synthetic
gagggtatttgaggggaatggaaagaggga

SEQ ID NO: 15657 - DNA, 31 bp, Artificial Sequences
  Synthetic
tgagggtatttgaggggaatggaaagaggga

SEQ ID NO: 15658 - DNA, 27 bp, Artificial Sequences
  Synthetic
cgagggtggaatttcggtgttgcgacg

SEQ ID NO: 15659 - DNA, 27 bp, Artificial Sequences
  Synthetic
cggtgttgcgacgagtgtggggttagt

SEQ ID NO: 15660 - DNA, 27 bp, Artificial Sequences
  Synthetic
ggtgttgcgacgagtgtggggttagtc

SEQ ID NO: 15661 - DNA, 26 bp, Artificial Sequences
  Synthetic
cggtgttgcgacgagtgtggggttag

SEQ ID NO: 15662 - DNA, 28 bp, Artificial Sequences
  Synthetic
cggtgttgcgacgagtgtggggttagtc

SEQ ID NO: 15663 - DNA, 27 bp, Artificial Sequences
  Synthetic
ttgtttcgggggttgtcggttaaggcg

SEQ ID NO: 15664 - DNA, 27 bp, Artificial Sequences
  Synthetic
tgtttcgggggttgtcggttaaggcgg

SEQ ID NO: 15665 - DNA, 27 bp, Artificial Sequences
  Synthetic
gtttcgggggttgtcggttaaggcggt

SEQ ID NO: 15666 - DNA, 27 bp, Artificial Sequences
  Synthetic
aagggtttgtttcgggggttgtcggtt

SEQ ID NO: 15667 - DNA, 26 bp, Artificial Sequences
  Synthetic
gtttcgggggttgtcggttaaggcgg

SEQ ID NO: 15668 - DNA, 27 bp, Artificial Sequences
  Synthetic
tttcgggatttcggggtgtgtgttggg

SEQ ID NO: 15669 - DNA, 27 bp, Artificial Sequences
  Synthetic
ttcgggatttcggggtgtgtgttgggg

SEQ ID NO: 15670 - DNA, 28 bp, Artificial Sequences
  Synthetic
ttttcgggatttcggggtgtgtgttggg

SEQ ID NO: 15671 - DNA, 26 bp, Artificial Sequences
  Synthetic
tcgggatttcggggtgtgtgttgggg

SEQ ID NO: 15672 - DNA, 26 bp, Artificial Sequences
  Synthetic
ttcgggatttcggggtgtgtgttggg

SEQ ID NO: 15673 - DNA, 27 bp, Artificial Sequences
  Synthetic
ttcgggatttcgggagttggagacggg

SEQ ID NO: 15674 - DNA, 27 bp, Artificial Sequences
  Synthetic
gcgttacgtggcggttgttttcggagt

SEQ ID NO: 15675 - DNA, 27 bp, Artificial Sequences
  Synthetic
aggttcgggttttggcggttgggagta

SEQ ID NO: 15676 - DNA, 27 bp, Artificial Sequences
  Synthetic
cgggatttcgggagttggagacgggtt

SEQ ID NO: 15677 - DNA, 27 bp, Artificial Sequences
  Synthetic
gtcgcggttttttcgtttcggtcgtgc

SEQ ID NO: 15678 - DNA, 27 bp, Artificial Sequences
  Synthetic
gggggcggcgggtgagtttgttatttt

SEQ ID NO: 15679 - DNA, 27 bp, Artificial Sequences
  Synthetic
agtagggttaggcgggggaaggtcgta

SEQ ID NO: 15680 - DNA, 27 bp, Artificial Sequences
  Synthetic
gcgggatgagtttcgggggtagtcgtt

SEQ ID NO: 15681 - DNA, 27 bp, Artificial Sequences
  Synthetic
taggcgggggaaggtcgtaggttttgc

SEQ ID NO: 15682 - DNA, 27 bp, Artificial Sequences
  Synthetic
ggttaggcgggggaaggtcgtaggttt

SEQ ID NO: 15683 - DNA, 27 bp, Artificial Sequences
  Synthetic
gggtttgcgtgcgggtagggagagtat

SEQ ID NO: 15684 - DNA, 27 bp, Artificial Sequences
  Synthetic
ttgaggggcgggtttgtttttgtcggg

SEQ ID NO: 15685 - DNA, 27 bp, Artificial Sequences
  Synthetic
ggagaggattttgcgggtgggtttggc

SEQ ID NO: 15686 - DNA, 27 bp, Artificial Sequences
  Synthetic
aaggtgggtgttgggttggttgttgcg

SEQ ID NO: 15687 - DNA, 27 bp, Artificial Sequences
  Synthetic
cgtgttggagaggattttgcgggtggg

SEQ ID NO: 15688 - DNA, 27 bp, Artificial Sequences
  Synthetic
aggggcgggggttttaggtttcggtag

SEQ ID NO: 15689 - DNA, 27 bp, Artificial Sequences
  Synthetic
ggggcgggggttttaggtttcggtaga

SEQ ID NO: 15690 - DNA, 27 bp, Artificial Sequences
  Synthetic
gaggggcgggggttttaggtttcggta

SEQ ID NO: 15691 - DNA, 27 bp, Artificial Sequences
  Synthetic
tcgtcggggagagttaaagggagggga

SEQ ID NO: 15692 - DNA, 27 bp, Artificial Sequences
  Synthetic
gcgtgggggaggggagggttgtttatt

SEQ ID NO: 15693 - DNA, 31 bp, Artificial Sequences
  Synthetic
agggttttagttgagaaggaggttttggagt

SEQ ID NO: 15694 - DNA, 32 bp, Artificial Sequences
  Synthetic
gagggttttagttgagaaggaggttttggagt

SEQ ID NO: 15695 - DNA, 32 bp, Artificial Sequences
  Synthetic
agagggttttagttgagaaggaggttttggag

SEQ ID NO: 15696 - DNA, 32 bp, Artificial Sequences
  Synthetic
agagagggttttagttgagaaggaggttttgg

SEQ ID NO: 15697 - DNA, 32 bp, Artificial Sequences
  Synthetic
gagagggttttagttgagaaggaggttttgga

SEQ ID NO: 15698 - DNA, 27 bp, Artificial Sequences
  Synthetic
tttcggtcgggtggttggttacggaga

SEQ ID NO: 15699 - DNA, 27 bp, Artificial Sequences
  Synthetic
ttcggtcgggtggttggttacggagat

SEQ ID NO: 15700 - DNA, 27 bp, Artificial Sequences
  Synthetic
cggtcgggtggttggttacggagattc

SEQ ID NO: 15701 - DNA, 27 bp, Artificial Sequences
  Synthetic
ttttcggtcgggtggttggttacggag

SEQ ID NO: 15702 - DNA, 28 bp, Artificial Sequences
  Synthetic
tcggtcgggtggttggttacggagattc

SEQ ID NO: 15703 - DNA, 27 bp, Artificial Sequences
  Synthetic
tttcggtcgggtggttggttacggaga

SEQ ID NO: 15704 - DNA, 27 bp, Artificial Sequences
  Synthetic
tcggtcgggtggttggttacggagatt

SEQ ID NO: 15705 - DNA, 27 bp, Artificial Sequences
  Synthetic
ttcggtcgggtggttggttacggagat

SEQ ID NO: 15706 - DNA, 27 bp, Artificial Sequences
  Synthetic
tcgggtggttggttacggagattcgga

SEQ ID NO: 15707 - DNA, 27 bp, Artificial Sequences
  Synthetic
gtcgggtggttggttacggagattcgg

SEQ ID NO: 15708 - DNA, 27 bp, Artificial Sequences
  Synthetic
gcggtgggcgggtaggtacgttttttc

SEQ ID NO: 15709 - DNA, 27 bp, Artificial Sequences
  Synthetic
gcgggcgggataggaggggaatagttg

SEQ ID NO: 15710 - DNA, 27 bp, Artificial Sequences
  Synthetic
cggtgggcgggtaggtacgttttttcg

SEQ ID NO: 15711 - DNA, 27 bp, Artificial Sequences
  Synthetic
cgggcgggataggaggggaatagttgg

SEQ ID NO: 15712 - DNA, 27 bp, Artificial Sequences
  Synthetic
gggcgggataggaggggaatagttggt

SEQ ID NO: 15713 - DNA, 27 bp, Artificial Sequences
  Synthetic
tggataaggcggttggttggacgtggg

SEQ ID NO: 15714 - DNA, 27 bp, Artificial Sequences
  Synthetic
atggataaggcggttggttggacgtgg

SEQ ID NO: 15715 - DNA, 27 bp, Artificial Sequences
  Synthetic
gataaggcggttggttggacgtggggg

SEQ ID NO: 15716 - DNA, 27 bp, Artificial Sequences
  Synthetic
ggataaggcggttggttggacgtgggg

SEQ ID NO: 15717 - DNA, 26 bp, Artificial Sequences
  Synthetic
gataaggcggttggttggacgtgggg

SEQ ID NO: 15718 - DNA, 27 bp, Artificial Sequences
  Synthetic
gcggtgggcgggtaggtacgttttttc

SEQ ID NO: 15719 - DNA, 27 bp, Artificial Sequences
  Synthetic
gcgggcgggataggaggggaatagttg

SEQ ID NO: 15720 - DNA, 27 bp, Artificial Sequences
  Synthetic
cggtgggcgggtaggtacgttttttcg

SEQ ID NO: 15721 - DNA, 27 bp, Artificial Sequences
  Synthetic
cgggcgggataggaggggaatagttgg

SEQ ID NO: 15722 - DNA, 27 bp, Artificial Sequences
  Synthetic
gggcgggataggaggggaatagttggt

SEQ ID NO: 15723 - DNA, 27 bp, Artificial Sequences
  Synthetic
cgtggcgggtggtattcgggtattgga

SEQ ID NO: 15724 - DNA, 27 bp, Artificial Sequences
  Synthetic
acgtggcgggtggtattcgggtattgg

SEQ ID NO: 15725 - DNA, 27 bp, Artificial Sequences
  Synthetic
tggataaggcggttggttggacgtggg

SEQ ID NO: 15726 - DNA, 27 bp, Artificial Sequences
  Synthetic
atggataaggcggttggttggacgtgg

SEQ ID NO: 15727 - DNA, 27 bp, Artificial Sequences
  Synthetic
gataaggcggttggttggacgtggggg

SEQ ID NO: 15728 - DNA, 27 bp, Artificial Sequences
  Synthetic
agtcgaggggagaaaatggtcggtggc

SEQ ID NO: 15729 - DNA, 27 bp, Artificial Sequences
  Synthetic
gtggtcgtcgggttgtcgtttcggttt

SEQ ID NO: 15730 - DNA, 27 bp, Artificial Sequences
  Synthetic
cgggttgtcgtttcggtttttgtgcgg

SEQ ID NO: 15731 - DNA, 27 bp, Artificial Sequences
  Synthetic
gggttgtcgtttcggtttttgtgcggg

SEQ ID NO: 15732 - DNA, 27 bp, Artificial Sequences
  Synthetic
tggtcgtcgggttgtcgtttcggtttt

SEQ ID NO: 15733 - DNA, 27 bp, Artificial Sequences
  Synthetic
cgtttgatcgagttttgagagcggcgt

SEQ ID NO: 15734 - DNA, 27 bp, Artificial Sequences
  Synthetic
tcgggtattaggagtcgtaggggtcgt

SEQ ID NO: 15735 - DNA, 28 bp, Artificial Sequences
  Synthetic
gtcgggtattaggagtcgtaggggtcgt

SEQ ID NO: 15736 - DNA, 27 bp, Artificial Sequences
  Synthetic
gtcgggtattaggagtcgtaggggtcg

SEQ ID NO: 15737 - DNA, 28 bp, Artificial Sequences
  Synthetic
cgtttgatcgagttttgagagcggcgtt

SEQ ID NO: 15738 - DNA, 27 bp, Artificial Sequences
  Synthetic
agtcgaggggagaaaatggtcggtggc

SEQ ID NO: 15739 - DNA, 27 bp, Artificial Sequences
  Synthetic
gtggtcgtcgggttgtcgtttcggttt

SEQ ID NO: 15740 - DNA, 27 bp, Artificial Sequences
  Synthetic
cgggttgtcgtttcggtttttgtgcgg

SEQ ID NO: 15741 - DNA, 27 bp, Artificial Sequences
  Synthetic
gggttgtcgtttcggtttttgtgcggg

SEQ ID NO: 15742 - DNA, 27 bp, Artificial Sequences
  Synthetic
tggtcgtcgggttgtcgtttcggtttt

SEQ ID NO: 15743 - DNA, 27 bp, Artificial Sequences
  Synthetic
cgtttgatcgagttttgagagcggcgt

SEQ ID NO: 15744 - DNA, 27 bp, Artificial Sequences
  Synthetic
tcgggtattaggagtcgtaggggtcgt

SEQ ID NO: 15745 - DNA, 28 bp, Artificial Sequences
  Synthetic
gtcgggtattaggagtcgtaggggtcgt

SEQ ID NO: 15746 - DNA, 27 bp, Artificial Sequences
  Synthetic
gtcgggtattaggagtcgtaggggtcg

SEQ ID NO: 15747 - DNA, 28 bp, Artificial Sequences
  Synthetic
cgtttgatcgagttttgagagcggcgtt

SEQ ID NO: 15748 - DNA, 27 bp, Artificial Sequences
  Synthetic
tcgttggaggggcgtcgtttttagggt

SEQ ID NO: 15749 - DNA, 27 bp, Artificial Sequences
  Synthetic
agtcgaggggagaaaatggtcggtggc

SEQ ID NO: 15750 - DNA, 27 bp, Artificial Sequences
  Synthetic
cggtcgttggaggggcgtcgtttttag

SEQ ID NO: 15751 - DNA, 27 bp, Artificial Sequences
  Synthetic
gtcgttggaggggcgtcgtttttaggg

SEQ ID NO: 15752 - DNA, 27 bp, Artificial Sequences
  Synthetic
ggtcgttggaggggcgtcgtttttagg

SEQ ID NO: 15753 - DNA, 27 bp, Artificial Sequences
  Synthetic
aaaagcgagatggggtgagaaggggcg

SEQ ID NO: 15754 - DNA, 27 bp, Artificial Sequences
  Synthetic
aaaaagcgagatggggtgagaaggggc

SEQ ID NO: 15755 - DNA, 26 bp, Artificial Sequences
  Synthetic
aaagcgagatggggtgagaaggggcg

SEQ ID NO: 15756 - DNA, 27 bp, Artificial Sequences
  Synthetic
agatggggtgagaaggggcggggtttc

SEQ ID NO: 15757 - DNA, 27 bp, Artificial Sequences
  Synthetic
gagatggggtgagaaggggcggggttt

SEQ ID NO: 15758 - DNA, 27 bp, Artificial Sequences
  Synthetic
tcgttggaggggcgtcgtttttagggt

SEQ ID NO: 15759 - DNA, 27 bp, Artificial Sequences
  Synthetic
cggtcgttggaggggcgtcgtttttag

SEQ ID NO: 15760 - DNA, 27 bp, Artificial Sequences
  Synthetic
gtcgttggaggggcgtcgtttttaggg

SEQ ID NO: 15761 - DNA, 27 bp, Artificial Sequences
  Synthetic
ggtcgttggaggggcgtcgtttttagg

SEQ ID NO: 15762 - DNA, 27 bp, Artificial Sequences
  Synthetic
tggaggggcgtcgtttttagggttcgg

SEQ ID NO: 15763 - DNA, 27 bp, Artificial Sequences
  Synthetic
aaaagcgagatggggtgagaaggggcg

SEQ ID NO: 15764 - DNA, 27 bp, Artificial Sequences
  Synthetic
aaaaagcgagatggggtgagaaggggc

SEQ ID NO: 15765 - DNA, 26 bp, Artificial Sequences
  Synthetic
aaagcgagatggggtgagaaggggcg

SEQ ID NO: 15766 - DNA, 27 bp, Artificial Sequences
  Synthetic
agatggggtgagaaggggcggggtttc

SEQ ID NO: 15767 - DNA, 27 bp, Artificial Sequences
  Synthetic
gagatggggtgagaaggggcggggttt

SEQ ID NO: 15768 - DNA, 28 bp, Artificial Sequences
  Synthetic
aggttttggtagtagtttgcggcgtttt

SEQ ID NO: 15769 - DNA, 28 bp, Artificial Sequences
  Synthetic
aaggttttggtagtagtttgcggcgttt

SEQ ID NO: 15770 - DNA, 28 bp, Artificial Sequences
  Synthetic
aaaggttttggtagtagtttgcggcgtt

SEQ ID NO: 15771 - DNA, 28 bp, Artificial Sequences
  Synthetic
tggtagtagtttgcggcgttttttggaa

SEQ ID NO: 15772 - DNA, 28 bp, Artificial Sequences
  Synthetic
ttggtagtagtttgcggcgttttttgga

SEQ ID NO: 15773 - DNA, 27 bp, Artificial Sequences
  Synthetic
agggttggttagagatggcggtcgtgg

SEQ ID NO: 15774 - DNA, 27 bp, Artificial Sequences
  Synthetic
tcggggtttagaggaggcgtggttgtg

SEQ ID NO: 15775 - DNA, 27 bp, Artificial Sequences
  Synthetic
gggttggttagagatggcggtcgtggt

SEQ ID NO: 15776 - DNA, 27 bp, Artificial Sequences
  Synthetic
cggggtttagaggaggcgtggttgtgt

SEQ ID NO: 15777 - DNA, 27 bp, Artificial Sequences
  Synthetic
ttaggaggcgggtagggtgggacgtag

SEQ ID NO: 15778 - DNA, 27 bp, Artificial Sequences
  Synthetic
tggcgttaagtcggttggagattggtt

SEQ ID NO: 15779 - DNA, 27 bp, Artificial Sequences
  Synthetic
ttggcgttaagtcggttggagattggt

SEQ ID NO: 15780 - DNA, 27 bp, Artificial Sequences
  Synthetic
cggtagttttggcgttaagtcggttgg

SEQ ID NO: 15781 - DNA, 28 bp, Artificial Sequences
  Synthetic
cggtagttttggcgttaagtcggttgga

SEQ ID NO: 15782 - DNA, 28 bp, Artificial Sequences
  Synthetic
tcggtagttttggcgttaagtcggttgg

SEQ ID NO: 15783 - DNA, 27 bp, Artificial Sequences
  Synthetic
agggttggttagagatggcggtcgtgg

SEQ ID NO: 15784 - DNA, 27 bp, Artificial Sequences
  Synthetic
gggttggttagagatggcggtcgtggt

SEQ ID NO: 15785 - DNA, 27 bp, Artificial Sequences
  Synthetic
ttaggaggcgggtagggtgggacgtag

SEQ ID NO: 15786 - DNA, 27 bp, Artificial Sequences
  Synthetic
ttaggggttaggaggcgggtagggtgg

SEQ ID NO: 15787 - DNA, 27 bp, Artificial Sequences
  Synthetic
tggttaggggttaggaggcgggtaggg

SEQ ID NO: 15788 - DNA, 27 bp, Artificial Sequences
  Synthetic
ttgtgtggtttcgtggttgggttgggg

SEQ ID NO: 15789 - DNA, 28 bp, Artificial Sequences
  Synthetic
gttgtgtggtttcgtggttgggttgggg

SEQ ID NO: 15790 - DNA, 27 bp, Artificial Sequences
  Synthetic
gttgtgtggtttcgtggttgggttggg

SEQ ID NO: 15791 - DNA, 26 bp, Artificial Sequences
  Synthetic
tgtgtggtttcgtggttgggttgggg

SEQ ID NO: 15792 - DNA, 28 bp, Artificial Sequences
  Synthetic
agttgtgtggtttcgtggttgggttggg

SEQ ID NO: 15793 - DNA, 27 bp, Artificial Sequences
  Synthetic
aggggttaggttggatgtgtagcgggg

SEQ ID NO: 15794 - DNA, 27 bp, Artificial Sequences
  Synthetic
ggggttaggttggatgtgtagcgggga

SEQ ID NO: 15795 - DNA, 28 bp, Artificial Sequences
  Synthetic
gggttaggttggatgtgtagcggggagg

SEQ ID NO: 15796 - DNA, 28 bp, Artificial Sequences
  Synthetic
ggggttaggttggatgtgtagcggggag

SEQ ID NO: 15797 - DNA, 28 bp, Artificial Sequences
  Synthetic
gaggggttaggttggatgtgtagcgggg

SEQ ID NO: 15798 - DNA, 27 bp, Artificial Sequences
  Synthetic
cgggcggtcgggttaaggtttcgtagt

SEQ ID NO: 15799 - DNA, 27 bp, Artificial Sequences
  Synthetic
taatttgtatgtagggcgtggcgggcg

SEQ ID NO: 15800 - DNA, 27 bp, Artificial Sequences
  Synthetic
gcgggcggtcgggttaaggtttcgtag

SEQ ID NO: 15801 - DNA, 26 bp, Artificial Sequences
  Synthetic
aatttgtatgtagggcgtggcgggcg

SEQ ID NO: 15802 - DNA, 27 bp, Artificial Sequences
  Synthetic
gggcggtcgggttaaggtttcgtagtt

SEQ ID NO: 15803 - DNA, 27 bp, Artificial Sequences
  Synthetic
gcggtatgtatagagggttcggcgggg

SEQ ID NO: 15804 - DNA, 27 bp, Artificial Sequences
  Synthetic
ggcggtatgtatagagggttcggcggg

SEQ ID NO: 15805 - DNA, 27 bp, Artificial Sequences
  Synthetic
ataggcggggtaggagtttgttcgggg

SEQ ID NO: 15806 - DNA, 27 bp, Artificial Sequences
  Synthetic
gcggggtaggagtttgttcggggttgt

SEQ ID NO: 15807 - DNA, 27 bp, Artificial Sequences
  Synthetic
taggcggggtaggagtttgttcggggt

SEQ ID NO: 15808 - DNA, 27 bp, Artificial Sequences
  Synthetic
cgggcggtcgggttaaggtttcgtagt

SEQ ID NO: 15809 - DNA, 27 bp, Artificial Sequences
  Synthetic
taatttgtatgtagggcgtggcgggcg

SEQ ID NO: 15810 - DNA, 26 bp, Artificial Sequences
  Synthetic
aatttgtatgtagggcgtggcgggcg

SEQ ID NO: 15811 - DNA, 27 bp, Artificial Sequences
  Synthetic
gggcggtcgggttaaggtttcgtagtt

SEQ ID NO: 15812 - DNA, 27 bp, Artificial Sequences
  Synthetic
aatttgtatgtagggcgtggcgggcgg

SEQ ID NO: 15813 - DNA, 27 bp, Artificial Sequences
  Synthetic
gcggtatgtatagagggttcggcgggg

SEQ ID NO: 15814 - DNA, 27 bp, Artificial Sequences
  Synthetic
ggcggtatgtatagagggttcggcggg

SEQ ID NO: 15815 - DNA, 27 bp, Artificial Sequences
  Synthetic
cggtatgtatagagggttcggcggggt

SEQ ID NO: 15816 - DNA, 28 bp, Artificial Sequences
  Synthetic
cggtatgtatagagggttcggcggggtt

SEQ ID NO: 15817 - DNA, 28 bp, Artificial Sequences
  Synthetic
cgagattttggttcgtagtgtcggcggt

SEQ ID NO: 15818 - DNA, 27 bp, Artificial Sequences
  Synthetic
ttgtttaggttggagtgtagtggcgcg

SEQ ID NO: 15819 - DNA, 28 bp, Artificial Sequences
  Synthetic
gttgtttaggttggagtgtagtggcgcg

SEQ ID NO: 15820 - DNA, 29 bp, Artificial Sequences
  Synthetic
tgttgtttaggttggagtgtagtggcgcg

SEQ ID NO: 15821 - DNA, 28 bp, Artificial Sequences
  Synthetic
tgttgtttaggttggagtgtagtggcgc

SEQ ID NO: 15822 - DNA, 28 bp, Artificial Sequences
  Synthetic
cgtcgatattgcgggttaaggtttcggt

SEQ ID NO: 15823 - DNA, 31 bp, Artificial Sequences
  Synthetic
ggaggtaaaggttgtagtgagttgagatcgc

SEQ ID NO: 15824 - DNA, 32 bp, Artificial Sequences
  Synthetic
aggaggtaaaggttgtagtgagttgagatcgc

SEQ ID NO: 15825 - DNA, 33 bp, Artificial Sequences
  Synthetic
taggaggtaaaggttgtagtgagttgagatcgc

SEQ ID NO: 15826 - DNA, 34 bp, Artificial Sequences
  Synthetic
ttaggaggtaaaggttgtagtgagttgagatcgc

SEQ ID NO: 15827 - DNA, 35 bp, Artificial Sequences
  Synthetic
tttaggaggtaaaggttgtagtgagttgagatcgc

SEQ ID NO: 15828 - DNA, 27 bp, Artificial Sequences
  Synthetic
ggttagaggtggtgggcgcgtttgttt

SEQ ID NO: 15829 - DNA, 27 bp, Artificial Sequences
  Synthetic
tgattggttagaggtggtgggcgcgtt

SEQ ID NO: 15830 - DNA, 27 bp, Artificial Sequences
  Synthetic
gtgtgattggttagaggtggtgggcgc

SEQ ID NO: 15831 - DNA, 27 bp, Artificial Sequences
  Synthetic
attggttagaggtggtgggcgcgtttg

SEQ ID NO: 15832 - DNA, 27 bp, Artificial Sequences
  Synthetic
gattggttagaggtggtgggcgcgttt

SEQ ID NO: 15833 - DNA, 27 bp, Artificial Sequences
  Synthetic
gtaaggggcgaggttagggaggttggc

SEQ ID NO: 15834 - DNA, 27 bp, Artificial Sequences
  Synthetic
ggcgaggttagggaggttggcggtttt

SEQ ID NO: 15835 - DNA, 27 bp, Artificial Sequences
  Synthetic
agtaaggggcgaggttagggaggttgg

SEQ ID NO: 15836 - DNA, 27 bp, Artificial Sequences
  Synthetic
gcgaggttagggaggttggcggtttta

SEQ ID NO: 15837 - DNA, 28 bp, Artificial Sequences
  Synthetic
ggcgaggttagggaggttggcggtttta

SEQ ID NO: 15838 - DNA, 27 bp, Artificial Sequences
  Synthetic
gttggtggtgtgtgtggtgtggtcgtg

SEQ ID NO: 15839 - DNA, 27 bp, Artificial Sequences
  Synthetic
tatcgtgttatgggtgcgggtagggcg

SEQ ID NO: 15840 - DNA, 27 bp, Artificial Sequences
  Synthetic
gttttcgcgtgggtgttgttgggaggt

SEQ ID NO: 15841 - DNA, 27 bp, Artificial Sequences
  Synthetic
taaggggggtagggtgtttggggagga

SEQ ID NO: 15842 - DNA, 27 bp, Artificial Sequences
  Synthetic
ttggtcggtgcgtttaaggggggtagg

SEQ ID NO: 15843 - DNA, 27 bp, Artificial Sequences
  Synthetic
cgtgtcgttttttagggagggcgtttt

SEQ ID NO: 15844 - DNA, 29 bp, Artificial Sequences
  Synthetic
cgtgtcgttttttagggagggcgttttgt

SEQ ID NO: 15845 - DNA, 28 bp, Artificial Sequences
  Synthetic
cgtgtcgttttttagggagggcgttttg

SEQ ID NO: 15846 - DNA, 28 bp, Artificial Sequences
  Synthetic
cgttttttagggagggcgttttgttcgt

SEQ ID NO: 15847 - DNA, 29 bp, Artificial Sequences
  Synthetic
tcgttttttagggagggcgttttgttcgt

SEQ ID NO: 15848 - DNA, 28 bp, Artificial Sequences
  Synthetic
gggagaaaggttaggtttgaagcgcgcg

SEQ ID NO: 15849 - DNA, 27 bp, Artificial Sequences
  Synthetic
ggagaaaggttaggtttgaagcgcgcg

SEQ ID NO: 15850 - DNA, 28 bp, Artificial Sequences
  Synthetic
ggagaaaggttaggtttgaagcgcgcgt

SEQ ID NO: 15851 - DNA, 28 bp, Artificial Sequences
  Synthetic
tgggagaaaggttaggtttgaagcgcgc

SEQ ID NO: 15852 - DNA, 27 bp, Artificial Sequences
  Synthetic
gggagaaaggttaggtttgaagcgcgc

SEQ ID NO: 15853 - DNA, 27 bp, Artificial Sequences
  Synthetic
cggagggggttcgggataagattcggg

SEQ ID NO: 15854 - DNA, 27 bp, Artificial Sequences
  Synthetic
tgcggagggggttcgggataagattcg

SEQ ID NO: 15855 - DNA, 27 bp, Artificial Sequences
  Synthetic
tggaagtagtcgtggggagggtcgaga

SEQ ID NO: 15856 - DNA, 27 bp, Artificial Sequences
  Synthetic
gcggagggggttcgggataagattcgg

SEQ ID NO: 15857 - DNA, 27 bp, Artificial Sequences
  Synthetic
tcgtggggagggtcgagacggtagttt

SEQ ID NO: 15858 - DNA, 27 bp, Artificial Sequences
  Synthetic
gattttgcgtggggaggggggtatcga

SEQ ID NO: 15859 - DNA, 27 bp, Artificial Sequences
  Synthetic
attttgcgtggggaggggggtatcgag

SEQ ID NO: 15860 - DNA, 27 bp, Artificial Sequences
  Synthetic
agattttgcgtggggaggggggtatcg

SEQ ID NO: 15861 - DNA, 27 bp, Artificial Sequences
  Synthetic
ggagattttgcgtggggaggggggtat

SEQ ID NO: 15862 - DNA, 27 bp, Artificial Sequences
  Synthetic
ttaggagattttgcgtggggagggggg

SEQ ID NO: 15863 - DNA, 27 bp, Artificial Sequences
  Synthetic
aagtaaaggggtcgggaagagggtggc

SEQ ID NO: 15864 - DNA, 27 bp, Artificial Sequences
  Synthetic
ggtggcggggcgggagatataggttta

SEQ ID NO: 15865 - DNA, 27 bp, Artificial Sequences
  Synthetic
ggagttttcggggagggttcggggttc

SEQ ID NO: 15866 - DNA, 27 bp, Artificial Sequences
  Synthetic
gaagagggtggcggggcgggagatata

SEQ ID NO: 15867 - DNA, 27 bp, Artificial Sequences
  Synthetic
aagagggtggcggggcgggagatatag

SEQ ID NO: 15868 - DNA, 27 bp, Artificial Sequences
  Synthetic
gattttgcgtggggaggggggtatcga

SEQ ID NO: 15869 - DNA, 27 bp, Artificial Sequences
  Synthetic
attttgcgtggggaggggggtatcgag

SEQ ID NO: 15870 - DNA, 27 bp, Artificial Sequences
  Synthetic
agattttgcgtggggaggggggtatcg

SEQ ID NO: 15871 - DNA, 27 bp, Artificial Sequences
  Synthetic
ggagattttgcgtggggaggggggtat

SEQ ID NO: 15872 - DNA, 27 bp, Artificial Sequences
  Synthetic
tggggtggggttcgtttgtttttcgcg

SEQ ID NO: 15873 - DNA, 27 bp, Artificial Sequences
  Synthetic
aagtaaaggggtcgggaagagggtggc

SEQ ID NO: 15874 - DNA, 27 bp, Artificial Sequences
  Synthetic
ggtggcggggcgggagatataggttta

SEQ ID NO: 15875 - DNA, 27 bp, Artificial Sequences
  Synthetic
gaagagggtggcggggcgggagatata

SEQ ID NO: 15876 - DNA, 27 bp, Artificial Sequences
  Synthetic
aagagggtggcggggcgggagatatag

SEQ ID NO: 15877 - DNA, 26 bp, Artificial Sequences
  Synthetic
ggtggcggggcgggagatataggttt

SEQ ID NO: 15878 - DNA, 27 bp, Artificial Sequences
  Synthetic
tgtttagcggggatgttttgtgcggag

SEQ ID NO: 15879 - DNA, 27 bp, Artificial Sequences
  Synthetic
ttgtttagcggggatgttttgtgcgga

SEQ ID NO: 15880 - DNA, 27 bp, Artificial Sequences
  Synthetic
cgggggtcgttgttttagtttggggaa

SEQ ID NO: 15881 - DNA, 28 bp, Artificial Sequences
  Synthetic
ttgtttagcggggatgttttgtgcggag

SEQ ID NO: 15882 - DNA, 27 bp, Artificial Sequences
  Synthetic
tttgtttagcggggatgttttgtgcgg

SEQ ID NO: 15883 - DNA, 27 bp, Artificial Sequences
  Synthetic
ttttttcggggaggtgcgggggatagg

SEQ ID NO: 15884 - DNA, 26 bp, Artificial Sequences
  Synthetic
agttgtttttcgggttgggggcgagc

SEQ ID NO: 15885 - DNA, 26 bp, Artificial Sequences
  Synthetic
tttttcggggaggtgcgggggatagg

SEQ ID NO: 15886 - DNA, 27 bp, Artificial Sequences
  Synthetic
gaggtgcgggggatagggggcgatatt

SEQ ID NO: 15887 - DNA, 27 bp, Artificial Sequences
  Synthetic
aggtgcgggggatagggggcgatattg

SEQ ID NO: 15888 - DNA, 30 bp, Artificial Sequences
  Synthetic
cggcgtcgtagtgtcgttttttgtttttcg

SEQ ID NO: 15889 - DNA, 29 bp, Artificial Sequences
  Synthetic
ggcgtcgtagtgtcgttttttgtttttcg

SEQ ID NO: 15890 - DNA, 29 bp, Artificial Sequences
  Synthetic
cggcgtcgtagtgtcgttttttgtttttc

SEQ ID NO: 15891 - DNA, 27 bp, Artificial Sequences
  Synthetic
aagttgtttttcgggttgggggcgagc

SEQ ID NO: 15892 - DNA, 27 bp, Artificial Sequences
  Synthetic
ttttttcggggaggtgcgggggatagg

SEQ ID NO: 15893 - DNA, 26 bp, Artificial Sequences
  Synthetic
agttgtttttcgggttgggggcgagc

SEQ ID NO: 15894 - DNA, 26 bp, Artificial Sequences
  Synthetic
tttttcggggaggtgcgggggatagg

SEQ ID NO: 15895 - DNA, 27 bp, Artificial Sequences
  Synthetic
gaggtgcgggggatagggggcgatatt

SEQ ID NO: 15896 - DNA, 27 bp, Artificial Sequences
  Synthetic
tcgtattttttcgggggaggggtcggt

SEQ ID NO: 15897 - DNA, 27 bp, Artificial Sequences
  Synthetic
attttttcgggggaggggtcggttcgc

SEQ ID NO: 15898 - DNA, 27 bp, Artificial Sequences
  Synthetic
cgtattttttcgggggaggggtcggtt

SEQ ID NO: 15899 - DNA, 28 bp, Artificial Sequences
  Synthetic
tcgtattttttcgggggaggggtcggtt

SEQ ID NO: 15900 - DNA, 28 bp, Artificial Sequences
  Synthetic
ttcgtattttttcgggggaggggtcggt

SEQ ID NO: 15901 - DNA, 27 bp, Artificial Sequences
  Synthetic
tagtggttgggtcggcgcgtagagttt

SEQ ID NO: 15902 - DNA, 27 bp, Artificial Sequences
  Synthetic
gtagtggttgggtcggcgcgtagagtt

SEQ ID NO: 15903 - DNA, 27 bp, Artificial Sequences
  Synthetic
ggtcggcgcgtagagtttgagtttcgg

SEQ ID NO: 15904 - DNA, 27 bp, Artificial Sequences
  Synthetic
gggtcggcgcgtagagtttgagtttcg

SEQ ID NO: 15905 - DNA, 27 bp, Artificial Sequences
  Synthetic
tggttgggtcggcgcgtagagtttgag

SEQ ID NO: 15906 - DNA, 27 bp, Artificial Sequences
  Synthetic
gcgtttcgggcgggggatttgtgtaaa

SEQ ID NO: 15907 - DNA, 27 bp, Artificial Sequences
  Synthetic
tcgtattttttcgggggaggggtcggt

SEQ ID NO: 15908 - DNA, 27 bp, Artificial Sequences
  Synthetic
attttttcgggggaggggtcggttcgc

SEQ ID NO: 15909 - DNA, 26 bp, Artificial Sequences
  Synthetic
gcgtttcgggcgggggatttgtgtaa

SEQ ID NO: 15910 - DNA, 27 bp, Artificial Sequences
  Synthetic
cgtattttttcgggggaggggtcggtt

SEQ ID NO: 15911 - DNA, 27 bp, Artificial Sequences
  Synthetic
tagtggttgggtcggcgcgtagagttt

SEQ ID NO: 15912 - DNA, 27 bp, Artificial Sequences
  Synthetic
gtagtggttgggtcggcgcgtagagtt

SEQ ID NO: 15913 - DNA, 27 bp, Artificial Sequences
  Synthetic
ggtcggcgcgtagagtttgagtttcgg

SEQ ID NO: 15914 - DNA, 27 bp, Artificial Sequences
  Synthetic
gggtcggcgcgtagagtttgagtttcg

SEQ ID NO: 15915 - DNA, 27 bp, Artificial Sequences
  Synthetic
gtagtagtggttgggtcggcgcgtaga

SEQ ID NO: 15916 - DNA, 27 bp, Artificial Sequences
  Synthetic
gaggtcggggtttaggttttgcgcgtc

SEQ ID NO: 15917 - DNA, 27 bp, Artificial Sequences
  Synthetic
gcgtttcgggcgggggatttgtgtaaa

SEQ ID NO: 15918 - DNA, 27 bp, Artificial Sequences
  Synthetic
cggggtttaggttttgcgcgtcggttt

SEQ ID NO: 15919 - DNA, 26 bp, Artificial Sequences
  Synthetic
gcgtttcgggcgggggatttgtgtaa

SEQ ID NO: 15920 - DNA, 27 bp, Artificial Sequences
  Synthetic
tcggggtttaggttttgcgcgtcggtt

SEQ ID NO: 15921 - DNA, 27 bp, Artificial Sequences
  Synthetic
gttcgtcgcggcgtagtagtggttggg

SEQ ID NO: 15922 - DNA, 26 bp, Artificial Sequences
  Synthetic
cgttcgtcgcggcgtagtagtggttg

SEQ ID NO: 15923 - DNA, 27 bp, Artificial Sequences
  Synthetic
cgttcgtcgcggcgtagtagtggttgg

SEQ ID NO: 15924 - DNA, 26 bp, Artificial Sequences
  Synthetic
gttcgtcgcggcgtagtagtggttgg

SEQ ID NO: 15925 - DNA, 27 bp, Artificial Sequences
  Synthetic
ttcgtcgcggcgtagtagtggttgggt

SEQ ID NO: 15926 - DNA, 27 bp, Artificial Sequences
  Synthetic
gaggtcggggtttaggttttgcgcgtc

SEQ ID NO: 15927 - DNA, 27 bp, Artificial Sequences
  Synthetic
cggggtttaggttttgcgcgtcggttt

SEQ ID NO: 15928 - DNA, 27 bp, Artificial Sequences
  Synthetic
gtaggttcggttcggtgggggtttcgg

SEQ ID NO: 15929 - DNA, 27 bp, Artificial Sequences
  Synthetic
cgtaggttcggttcggtgggggtttcg

SEQ ID NO: 15930 - DNA, 27 bp, Artificial Sequences
  Synthetic
tcggggtttaggttttgcgcgtcggtt

SEQ ID NO: 15931 - DNA, 27 bp, Artificial Sequences
  Synthetic
tgcggaggaagagttcgaggtttgggg

SEQ ID NO: 15932 - DNA, 27 bp, Artificial Sequences
  Synthetic
ggaggaagagttcgaggtttggggcga

SEQ ID NO: 15933 - DNA, 27 bp, Artificial Sequences
  Synthetic
cggaggaagagttcgaggtttggggcg

SEQ ID NO: 15934 - DNA, 27 bp, Artificial Sequences
  Synthetic
gtgcggaggaagagttcgaggtttggg

SEQ ID NO: 15935 - DNA, 27 bp, Artificial Sequences
  Synthetic
ggtgcggaggaagagttcgaggtttgg

SEQ ID NO: 15936 - DNA, 27 bp, Artificial Sequences
  Synthetic
gtaggttcggttcggtgggggtttcgg

SEQ ID NO: 15937 - DNA, 27 bp, Artificial Sequences
  Synthetic
cgtaggttcggttcggtgggggtttcg

SEQ ID NO: 15938 - DNA, 27 bp, Artificial Sequences
  Synthetic
gcgtaggttcggttcggtgggggtttc

SEQ ID NO: 15939 - DNA, 26 bp, Artificial Sequences
  Synthetic
taggttcggttcggtgggggtttcgg

SEQ ID NO: 15940 - DNA, 26 bp, Artificial Sequences
  Synthetic
gtaggttcggttcggtgggggtttcg

SEQ ID NO: 15941 - DNA, 27 bp, Artificial Sequences
  Synthetic
tgcggaggaagagttcgaggtttgggg

SEQ ID NO: 15942 - DNA, 27 bp, Artificial Sequences
  Synthetic
ggaggaagagttcgaggtttggggcga

SEQ ID NO: 15943 - DNA, 27 bp, Artificial Sequences
  Synthetic
cggaggaagagttcgaggtttggggcg

SEQ ID NO: 15944 - DNA, 27 bp, Artificial Sequences
  Synthetic
gtgcggaggaagagttcgaggtttggg

SEQ ID NO: 15945 - DNA, 27 bp, Artificial Sequences
  Synthetic
ggtgcggaggaagagttcgaggtttgg

SEQ ID NO: 15946 - DNA, 27 bp, Artificial Sequences
  Synthetic
tggggagaggaagttgattggttgggg

SEQ ID NO: 15947 - DNA, 28 bp, Artificial Sequences
  Synthetic
tggggagaggaagttgattggttgggga

SEQ ID NO: 15948 - DNA, 27 bp, Artificial Sequences
  Synthetic
ggggagaggaagttgattggttgggga

SEQ ID NO: 15949 - DNA, 29 bp, Artificial Sequences
  Synthetic
tggggagaggaagttgattggttggggag

SEQ ID NO: 15950 - DNA, 28 bp, Artificial Sequences
  Synthetic
ggggagaggaagttgattggttggggag

SEQ ID NO: 15951 - DNA, 29 bp, Artificial Sequences
  Synthetic
cggttttttgtcgtttggagtttggaggg

SEQ ID NO: 15952 - DNA, 30 bp, Artificial Sequences
  Synthetic
cggttttttgtcgtttggagtttggagggt

SEQ ID NO: 15953 - DNA, 30 bp, Artificial Sequences
  Synthetic
tcggttttttgtcgtttggagtttggaggg

SEQ ID NO: 15954 - DNA, 31 bp, Artificial Sequences
  Synthetic
tcggttttttgtcgtttggagtttggagggt

SEQ ID NO: 15955 - DNA, 29 bp, Artificial Sequences
  Synthetic
tcggttttttgtcgtttggagtttggagg

SEQ ID NO: 15956 - DNA, 27 bp, Artificial Sequences
  Synthetic
tggggagaggaagttgattggttgggg

SEQ ID NO: 15957 - DNA, 28 bp, Artificial Sequences
  Synthetic
tggggagaggaagttgattggttgggga

SEQ ID NO: 15958 - DNA, 27 bp, Artificial Sequences
  Synthetic
ggggagaggaagttgattggttgggga

SEQ ID NO: 15959 - DNA, 29 bp, Artificial Sequences
  Synthetic
tggggagaggaagttgattggttggggag

SEQ ID NO: 15960 - DNA, 28 bp, Artificial Sequences
  Synthetic
ggggagaggaagttgattggttggggag

SEQ ID NO: 15961 - DNA, 29 bp, Artificial Sequences
  Synthetic
tgtttgttggggtttgggtaaagtcgttg

SEQ ID NO: 15962 - DNA, 30 bp, Artificial Sequences
  Synthetic
tgtttgttggggtttgggtaaagtcgttga

SEQ ID NO: 15963 - DNA, 29 bp, Artificial Sequences
  Synthetic
gtttgttggggtttgggtaaagtcgttga

SEQ ID NO: 15964 - DNA, 29 bp, Artificial Sequences
  Synthetic
ttgtttgttggggtttgggtaaagtcgtt

SEQ ID NO: 15965 - DNA, 29 bp, Artificial Sequences
  Synthetic
tttgtttgttggggtttgggtaaagtcgt

SEQ ID NO: 15966 - DNA, 27 bp, Artificial Sequences
  Synthetic
gggtttcggtgggtgattgtggttggg

SEQ ID NO: 15967 - DNA, 27 bp, Artificial Sequences
  Synthetic
gggcggttaggttaggggtgatgggtg

SEQ ID NO: 15968 - DNA, 27 bp, Artificial Sequences
  Synthetic
ggcggttaggttaggggtgatgggtga

SEQ ID NO: 15969 - DNA, 27 bp, Artificial Sequences
  Synthetic
gggtgatgggtgacgagcggtgttttt

SEQ ID NO: 15970 - DNA, 27 bp, Artificial Sequences
  Synthetic
gttaggggtgatgggtgacgagcggtg

SEQ ID NO: 15971 - DNA, 27 bp, Artificial Sequences
  Synthetic
tggtttggtcgttttggggcgtggttt

SEQ ID NO: 15972 - DNA, 27 bp, Artificial Sequences
  Synthetic
ttggtttggtcgttttggggcgtggtt

SEQ ID NO: 15973 - DNA, 27 bp, Artificial Sequences
  Synthetic
tttggtttggtcgttttggggcgtggt

SEQ ID NO: 15974 - DNA, 27 bp, Artificial Sequences
  Synthetic
agttcgtttagggtgagggcggggttc

SEQ ID NO: 15975 - DNA, 27 bp, Artificial Sequences
  Synthetic
gagttcgtttagggtgagggcggggtt

SEQ ID NO: 15976 - DNA, 27 bp, Artificial Sequences
  Synthetic
gggtttcggtgggtgattgtggttggg

SEQ ID NO: 15977 - DNA, 27 bp, Artificial Sequences
  Synthetic
gggcggttaggttaggggtgatgggtg

SEQ ID NO: 15978 - DNA, 27 bp, Artificial Sequences
  Synthetic
ggcggttaggttaggggtgatgggtga

SEQ ID NO: 15979 - DNA, 27 bp, Artificial Sequences
  Synthetic
gggtgatgggtgacgagcggtgttttt

SEQ ID NO: 15980 - DNA, 27 bp, Artificial Sequences
  Synthetic
gttaggggtgatgggtgacgagcggtg

SEQ ID NO: 15981 - DNA, 27 bp, Artificial Sequences
  Synthetic
tatttatttaggtcgcgggggcggggg

SEQ ID NO: 15982 - DNA, 27 bp, Artificial Sequences
  Synthetic
ttgttggtgggttcgttagggggcgtt

SEQ ID NO: 15983 - DNA, 27 bp, Artificial Sequences
  Synthetic
tttgttggtgggttcgttagggggcgt

SEQ ID NO: 15984 - DNA, 27 bp, Artificial Sequences
  Synthetic
atttgttggtgggttcgttagggggcg

SEQ ID NO: 15985 - DNA, 27 bp, Artificial Sequences
  Synthetic
cggggggttggttgaaggttgaggttt

SEQ ID NO: 15986 - DNA, 29 bp, Artificial Sequences
  Synthetic
gtcggttagtttttcgcggttgtatacgt

SEQ ID NO: 15987 - DNA, 29 bp, Artificial Sequences
  Synthetic
tgtcggttagtttttcgcggttgtatacg

SEQ ID NO: 15988 - DNA, 30 bp, Artificial Sequences
  Synthetic
tgtcggttagtttttcgcggttgtatacgt

SEQ ID NO: 15989 - DNA, 30 bp, Artificial Sequences
  Synthetic
ggttgattttgtcggttagtttttcgcggt

SEQ ID NO: 15990 - DNA, 30 bp, Artificial Sequences
  Synthetic
cggttagtttttcgcggttgtatacgttcg

SEQ ID NO: 15991 - DNA, 27 bp, Artificial Sequences
  Synthetic
tagttgtatgagttggagcgcgcgttc

SEQ ID NO: 15992 - DNA, 27 bp, Artificial Sequences
  Synthetic
ttagttgtatgagttggagcgcgcgtt

SEQ ID NO: 15993 - DNA, 27 bp, Artificial Sequences
  Synthetic
attagttgtatgagttggagcgcgcgt

SEQ ID NO: 15994 - DNA, 26 bp, Artificial Sequences
  Synthetic
agttgtatgagttggagcgcgcgttc

SEQ ID NO: 15995 - DNA, 28 bp, Artificial Sequences
  Synthetic
ttagttgtatgagttggagcgcgcgttc

SEQ ID NO: 15996 - DNA, 27 bp, Artificial Sequences
  Synthetic
cgcggttgtatacgttcgggtagtggg

SEQ ID NO: 15997 - DNA, 28 bp, Artificial Sequences
  Synthetic
cgcggttgtatacgttcgggtagtggga

SEQ ID NO: 15998 - DNA, 27 bp, Artificial Sequences
  Synthetic
gcggttgtatacgttcgggtagtggga

SEQ ID NO: 15999 - DNA, 27 bp, Artificial Sequences
  Synthetic
agtttcgtttcgtcggtggttggttcg

SEQ ID NO: 16000 - DNA, 27 bp, Artificial Sequences
  Synthetic
gtttcgtttcgtcggtggttggttcga

SEQ ID NO: 16001 - DNA, 27 bp, Artificial Sequences
  Synthetic
tcggggaggtacggtcgagtttagggt

SEQ ID NO: 16002 - DNA, 27 bp, Artificial Sequences
  Synthetic
aggagttcggggaggtacggtcgagtt

SEQ ID NO: 16003 - DNA, 27 bp, Artificial Sequences
  Synthetic
aaggagttcggggaggtacggtcgagt

SEQ ID NO: 16004 - DNA, 27 bp, Artificial Sequences
  Synthetic
cggggtcggtttaagggtgttttgggg

SEQ ID NO: 16005 - DNA, 27 bp, Artificial Sequences
  Synthetic
ggagttcggggaggtacggtcgagttt

SEQ ID NO: 16006 - DNA, 27 bp, Artificial Sequences
  Synthetic
agatggttcggggaggttcgtggtgag

SEQ ID NO: 16007 - DNA, 27 bp, Artificial Sequences
  Synthetic
gagatggttcggggaggttcgtggtga

SEQ ID NO: 16008 - DNA, 27 bp, Artificial Sequences
  Synthetic
gatggttcggggaggttcgtggtgagg

SEQ ID NO: 16009 - DNA, 27 bp, Artificial Sequences
  Synthetic
ttggggtagtagggtcgaggggttggg

SEQ ID NO: 16010 - DNA, 27 bp, Artificial Sequences
  Synthetic
tttggggtagtagggtcgaggggttgg

SEQ ID NO: 16011 - DNA, 27 bp, Artificial Sequences
  Synthetic
gggttggggatcgtttatggcgggagt

SEQ ID NO: 16012 - DNA, 27 bp, Artificial Sequences
  Synthetic
attaaggtaattgggcgcggggttggg

SEQ ID NO: 16013 - DNA, 27 bp, Artificial Sequences
  Synthetic
ggggttggggatcgtttatggcgggag

SEQ ID NO: 16014 - DNA, 27 bp, Artificial Sequences
  Synthetic
ttaaggtaattgggcgcggggttgggg

SEQ ID NO: 16015 - DNA, 27 bp, Artificial Sequences
  Synthetic
ggttggggatcgtttatggcgggagtt

SEQ ID NO: 16016 - DNA, 27 bp, Artificial Sequences
  Synthetic
gtagtgggcgtggcggtgttgtttagg

SEQ ID NO: 16017 - DNA, 27 bp, Artificial Sequences
  Synthetic
ggtagtgggcgtggcggtgttgtttag

SEQ ID NO: 16018 - DNA, 27 bp, Artificial Sequences
  Synthetic
tagtgggcgtggcggtgttgtttaggt

SEQ ID NO: 16019 - DNA, 27 bp, Artificial Sequences
  Synthetic
ggcgtggcggtgttgtttaggtgagtt

SEQ ID NO: 16020 - DNA, 27 bp, Artificial Sequences
  Synthetic
tggtagtgggcgtggcggtgttgttta

SEQ ID NO: 16021 - DNA, 27 bp, Artificial Sequences
  Synthetic
tggatgtggaggcgatcgtgtttgggt

SEQ ID NO: 16022 - DNA, 27 bp, Artificial Sequences
  Synthetic
ttggatgtggaggcgatcgtgtttggg

SEQ ID NO: 16023 - DNA, 27 bp, Artificial Sequences
  Synthetic
cgtttcgtttcgtttcgtttcggcggt

SEQ ID NO: 16024 - DNA, 28 bp, Artificial Sequences
  Synthetic
ttggatgtggaggcgatcgtgtttgggt

SEQ ID NO: 16025 - DNA, 28 bp, Artificial Sequences
  Synthetic
tggatgtggaggcgatcgtgtttgggta

SEQ ID NO: 16026 - DNA, 27 bp, Artificial Sequences
  Synthetic
cggaggatttagggcggagttgtcggt

SEQ ID NO: 16027 - DNA, 27 bp, Artificial Sequences
  Synthetic
tcggaggatttagggcggagttgtcgg

SEQ ID NO: 16028 - DNA, 28 bp, Artificial Sequences
  Synthetic
cggaggatttagggcggagttgtcggtt

SEQ ID NO: 16029 - DNA, 28 bp, Artificial Sequences
  Synthetic
ttcggaggatttagggcggagttgtcgg

SEQ ID NO: 16030 - DNA, 27 bp, Artificial Sequences
  Synthetic
ggaggatttagggcggagttgtcggtt

SEQ ID NO: 16031 - DNA, 27 bp, Artificial Sequences
  Synthetic
aacggggaaagtacggtgaggtcggag

SEQ ID NO: 16032 - DNA, 27 bp, Artificial Sequences
  Synthetic
aaacggggaaagtacggtgaggtcgga

SEQ ID NO: 16033 - DNA, 27 bp, Artificial Sequences
  Synthetic
gaaacggggaaagtacggtgaggtcgg

SEQ ID NO: 16034 - DNA, 28 bp, Artificial Sequences
  Synthetic
aaacggggaaagtacggtgaggtcggag

SEQ ID NO: 16035 - DNA, 28 bp, Artificial Sequences
  Synthetic
gaaacggggaaagtacggtgaggtcgga

SEQ ID NO: 16036 - DNA, 28 bp, Artificial Sequences
  Synthetic
cggtggttgtgatcggaggttttacgcg

SEQ ID NO: 16037 - DNA, 28 bp, Artificial Sequences
  Synthetic
acggtggttgtgatcggaggttttacgc

SEQ ID NO: 16038 - DNA, 27 bp, Artificial Sequences
  Synthetic
ggtggttgtgatcggaggttttacgcg

SEQ ID NO: 16039 - DNA, 27 bp, Artificial Sequences
  Synthetic
cggtggttgtgatcggaggttttacgc

SEQ ID NO: 16040 - DNA, 27 bp, Artificial Sequences
  Synthetic
acggtggttgtgatcggaggttttacg

SEQ ID NO: 16041 - DNA, 27 bp, Artificial Sequences
  Synthetic
gtgggagggaaacggggaaagtacggt

SEQ ID NO: 16042 - DNA, 27 bp, Artificial Sequences
  Synthetic
tgggagggaaacggggaaagtacggtg

SEQ ID NO: 16043 - DNA, 27 bp, Artificial Sequences
  Synthetic
agtgggagggaaacggggaaagtacgg

SEQ ID NO: 16044 - DNA, 27 bp, Artificial Sequences
  Synthetic
cggtagtgggagggaaacggggaaagt

SEQ ID NO: 16045 - DNA, 27 bp, Artificial Sequences
  Synthetic
gggagggaaacggggaaagtacggtga

SEQ ID NO: 16046 - DNA, 27 bp, Artificial Sequences
  Synthetic
cggaggttttacgcgtttgtttgagga

SEQ ID NO: 16047 - DNA, 27 bp, Artificial Sequences
  Synthetic
tcggaggttttacgcgtttgtttgagg

SEQ ID NO: 16048 - DNA, 28 bp, Artificial Sequences
  Synthetic
tcggaggttttacgcgtttgtttgagga

SEQ ID NO: 16049 - DNA, 28 bp, Artificial Sequences
  Synthetic
cggaggttttacgcgtttgtttgaggaa

SEQ ID NO: 16050 - DNA, 28 bp, Artificial Sequences
  Synthetic
atcggaggttttacgcgtttgtttgagg

SEQ ID NO: 16051 - DNA, 26 bp, Artificial Sequences
  Synthetic
ttttttaggggttggcgagggggacg

SEQ ID NO: 16052 - DNA, 25 bp, Artificial Sequences
  Synthetic
tttttaggggttggcgagggggacg

SEQ ID NO: 16053 - DNA, 24 bp, Artificial Sequences
  Synthetic
ttttaggggttggcgagggggacg

SEQ ID NO: 16054 - DNA, 25 bp, Artificial Sequences
  Synthetic
ttttttaggggttggcgagggggac

SEQ ID NO: 16055 - DNA, 23 bp, Artificial Sequences
  Synthetic
tttaggggttggcgagggggacg

SEQ ID NO: 16056 - DNA, 33 bp, Artificial Sequences
  Synthetic
tgtggacgggattgatgtttttagaaaagaggt

SEQ ID NO: 16057 - DNA, 33 bp, Artificial Sequences
  Synthetic
gtgtggacgggattgatgtttttagaaaagagg

SEQ ID NO: 16058 - DNA, 34 bp, Artificial Sequences
  Synthetic
gtgtggacgggattgatgtttttagaaaagaggt

SEQ ID NO: 16059 - DNA, 34 bp, Artificial Sequences
  Synthetic
tgtggacgggattgatgtttttagaaaagaggtt

SEQ ID NO: 16060 - DNA, 35 bp, Artificial Sequences
  Synthetic
gtgtggacgggattgatgtttttagaaaagaggtt

SEQ ID NO: 16061 - DNA, 29 bp, Artificial Sequences
  Synthetic
tggatgttggtgttggatttcggtgaggt

SEQ ID NO: 16062 - DNA, 28 bp, Artificial Sequences
  Synthetic
ggatgttggtgttggatttcggtgaggt

SEQ ID NO: 16063 - DNA, 28 bp, Artificial Sequences
  Synthetic
tggatgttggtgttggatttcggtgagg

SEQ ID NO: 16064 - DNA, 27 bp, Artificial Sequences
  Synthetic
ggatgttggtgttggatttcggtgagg

SEQ ID NO: 16065 - DNA, 28 bp, Artificial Sequences
  Synthetic
tggtgttggatttcggtgaggttgttgt

SEQ ID NO: 16066 - DNA, 27 bp, Artificial Sequences
  Synthetic
ttcgcggcgtataagggttgttcgagc

SEQ ID NO: 16067 - DNA, 28 bp, Artificial Sequences
  Synthetic
tttcgcggcgtataagggttgttcgagc

SEQ ID NO: 16068 - DNA, 26 bp, Artificial Sequences
  Synthetic
tcgcggcgtataagggttgttcgagc

SEQ ID NO: 16069 - DNA, 27 bp, Artificial Sequences
  Synthetic
cggttttcgcggcgtataagggttgtt

SEQ ID NO: 16070 - DNA, 29 bp, Artificial Sequences
  Synthetic
cggttttcgcggcgtataagggttgttcg

SEQ ID NO: 16071 - DNA, 27 bp, Artificial Sequences
  Synthetic
ttcgttaggagggattcgggaggtcgc

SEQ ID NO: 16072 - DNA, 28 bp, Artificial Sequences
  Synthetic
tttcgttaggagggattcgggaggtcgc

SEQ ID NO: 16073 - DNA, 28 bp, Artificial Sequences
  Synthetic
cggtttcgttaggagggattcgggaggt

SEQ ID NO: 16074 - DNA, 26 bp, Artificial Sequences
  Synthetic
tcgttaggagggattcgggaggtcgc

SEQ ID NO: 16075 - DNA, 26 bp, Artificial Sequences
  Synthetic
gcggggattttttgcgtttcggggac

SEQ ID NO: 16076 - DNA, 27 bp, Artificial Sequences
  Synthetic
gcggcgtataagggttgttcgagcgtt

SEQ ID NO: 16077 - DNA, 27 bp, Artificial Sequences
  Synthetic
ttcgcggcgtataagggttgttcgagc

SEQ ID NO: 16078 - DNA, 28 bp, Artificial Sequences
  Synthetic
gcggcgtataagggttgttcgagcgttt

SEQ ID NO: 16079 - DNA, 28 bp, Artificial Sequences
  Synthetic
tttcgcggcgtataagggttgttcgagc

SEQ ID NO: 16080 - DNA, 26 bp, Artificial Sequences
  Synthetic
gcggcgtataagggttgttcgagcgt

SEQ ID NO: 16081 - DNA, 27 bp, Artificial Sequences
  Synthetic
ttcgttaggagggattcgggaggtcgc

SEQ ID NO: 16082 - DNA, 28 bp, Artificial Sequences
  Synthetic
tttcgttaggagggattcgggaggtcgc

SEQ ID NO: 16083 - DNA, 28 bp, Artificial Sequences
  Synthetic
cggtttcgttaggagggattcgggaggt

SEQ ID NO: 16084 - DNA, 26 bp, Artificial Sequences
  Synthetic
tcgttaggagggattcgggaggtcgc

SEQ ID NO: 16085 - DNA, 26 bp, Artificial Sequences
  Synthetic
gcggggattttttgcgtttcggggac

SEQ ID NO: 16086 - DNA, 27 bp, Artificial Sequences
  Synthetic
gcggcgtataagggttgttcgagcgtt

SEQ ID NO: 16087 - DNA, 27 bp, Artificial Sequences
  Synthetic
ttcgcggcgtataagggttgttcgagc

SEQ ID NO: 16088 - DNA, 28 bp, Artificial Sequences
  Synthetic
gcggcgtataagggttgttcgagcgttt

SEQ ID NO: 16089 - DNA, 28 bp, Artificial Sequences
  Synthetic
tttcgcggcgtataagggttgttcgagc

SEQ ID NO: 16090 - DNA, 26 bp, Artificial Sequences
  Synthetic
gcggcgtataagggttgttcgagcgt

SEQ ID NO: 16091 - DNA, 27 bp, Artificial Sequences
  Synthetic
ttttaagcgggtttatcgggtcggcgg

SEQ ID NO: 16092 - DNA, 27 bp, Artificial Sequences
  Synthetic
tttaagcgggtttatcgggtcggcggg

SEQ ID NO: 16093 - DNA, 27 bp, Artificial Sequences
  Synthetic
ttcgttaggagggattcgggaggtcgt

SEQ ID NO: 16094 - DNA, 28 bp, Artificial Sequences
  Synthetic
tttttaagcgggtttatcgggtcggcgg

SEQ ID NO: 16095 - DNA, 28 bp, Artificial Sequences
  Synthetic
cggtttcgttaggagggattcgggaggt

SEQ ID NO: 16096 - DNA, 27 bp, Artificial Sequences
  Synthetic
gcggcgtataagggttgttcgagcgtt

SEQ ID NO: 16097 - DNA, 27 bp, Artificial Sequences
  Synthetic
ttcgcggcgtataagggttgttcgagc

SEQ ID NO: 16098 - DNA, 27 bp, Artificial Sequences
  Synthetic
gcgtaggtttcgtcggttcggtggatt

SEQ ID NO: 16099 - DNA, 27 bp, Artificial Sequences
  Synthetic
cgtcggttcggtggattcgtttgagga

SEQ ID NO: 16100 - DNA, 27 bp, Artificial Sequences
  Synthetic
tcgtcggttcggtggattcgtttgagg

SEQ ID NO: 16101 - DNA, 27 bp, Artificial Sequences
  Synthetic
cgggggcggtagttgagtttcgttcga

SEQ ID NO: 16102 - DNA, 27 bp, Artificial Sequences
  Synthetic
ttttaagcgggtttatcgggtcggcgg

SEQ ID NO: 16103 - DNA, 27 bp, Artificial Sequences
  Synthetic
acgggggcggtagttgagtttcgttcg

SEQ ID NO: 16104 - DNA, 27 bp, Artificial Sequences
  Synthetic
tttaagcgggtttatcgggtcggcggg

SEQ ID NO: 16105 - DNA, 27 bp, Artificial Sequences
  Synthetic
ggtaacgggggcggtagttgagtttcg

SEQ ID NO: 16106 - DNA, 27 bp, Artificial Sequences
  Synthetic
gcgtaggtttcgtcggttcggtggatt

SEQ ID NO: 16107 - DNA, 27 bp, Artificial Sequences
  Synthetic
cgtcggttcggtggattcgtttgagga

SEQ ID NO: 16108 - DNA, 27 bp, Artificial Sequences
  Synthetic
tcgtcggttcggtggattcgtttgagg

SEQ ID NO: 16109 - DNA, 28 bp, Artificial Sequences
  Synthetic
tcgtcggttcggtggattcgtttgagga

SEQ ID NO: 16110 - DNA, 27 bp, Artificial Sequences
  Synthetic
aggtttcgtcggttcggtggattcgtt

SEQ ID NO: 16111 - DNA, 27 bp, Artificial Sequences
  Synthetic
cgggggcggtagttgagtttcgttcga

SEQ ID NO: 16112 - DNA, 27 bp, Artificial Sequences
  Synthetic
acgggggcggtagttgagtttcgttcg

SEQ ID NO: 16113 - DNA, 27 bp, Artificial Sequences
  Synthetic
ggtaacgggggcggtagttgagtttcg

SEQ ID NO: 16114 - DNA, 27 bp, Artificial Sequences
  Synthetic
gggggcggtagttgagtttcgttcgag

SEQ ID NO: 16115 - DNA, 28 bp, Artificial Sequences
  Synthetic
gggggcggtagttgagtttcgttcgagt

SEQ ID NO: 16116 - DNA, 27 bp, Artificial Sequences
  Synthetic
gcgtaggtttcgtcggttcggtggatt

SEQ ID NO: 16117 - DNA, 27 bp, Artificial Sequences
  Synthetic
cgtcggttcggtggattcgtttgagga

SEQ ID NO: 16118 - DNA, 27 bp, Artificial Sequences
  Synthetic
tcgtcggttcggtggattcgtttgagg

SEQ ID NO: 16119 - DNA, 28 bp, Artificial Sequences
  Synthetic
tcgtcggttcggtggattcgtttgagga

SEQ ID NO: 16120 - DNA, 27 bp, Artificial Sequences
  Synthetic
aggtttcgtcggttcggtggattcgtt

SEQ ID NO: 16121 - DNA, 27 bp, Artificial Sequences
  Synthetic
cgggggcggtagttgagtttcgttcga

SEQ ID NO: 16122 - DNA, 27 bp, Artificial Sequences
  Synthetic
acgggggcggtagttgagtttcgttcg

SEQ ID NO: 16123 - DNA, 27 bp, Artificial Sequences
  Synthetic
ggtaacgggggcggtagttgagtttcg

SEQ ID NO: 16124 - DNA, 27 bp, Artificial Sequences
  Synthetic
gggggcggtagttgagtttcgttcgag

SEQ ID NO: 16125 - DNA, 28 bp, Artificial Sequences
  Synthetic
gggggcggtagttgagtttcgttcgagt

SEQ ID NO: 16126 - DNA, 27 bp, Artificial Sequences
  Synthetic
gggtggatgggattttgcgcgtggaat

SEQ ID NO: 16127 - DNA, 26 bp, Artificial Sequences
  Synthetic
gggtggatgggattttgcgcgtggaa

SEQ ID NO: 16128 - DNA, 28 bp, Artificial Sequences
  Synthetic
gggtggatgggattttgcgcgtggaatt

SEQ ID NO: 16129 - DNA, 27 bp, Artificial Sequences
  Synthetic
tttttcgggtggatgggattttgcgcg

SEQ ID NO: 16130 - DNA, 27 bp, Artificial Sequences
  Synthetic
ggtggatgggattttgcgcgtggaatt

SEQ ID NO: 16131 - DNA, 27 bp, Artificial Sequences
  Synthetic
tcgtggagaaggaatgggttttgcggt

SEQ ID NO: 16132 - DNA, 27 bp, Artificial Sequences
  Synthetic
cgtggagaaggaatgggttttgcggtt

SEQ ID NO: 16133 - DNA, 29 bp, Artificial Sequences
  Synthetic
cgtggagaaggaatgggttttgcggttcg

SEQ ID NO: 16134 - DNA, 28 bp, Artificial Sequences
  Synthetic
tcgtggagaaggaatgggttttgcggtt

SEQ ID NO: 16135 - DNA, 27 bp, Artificial Sequences
  Synthetic
tggagaaggaatgggttttgcggttcg

SEQ ID NO: 16136 - DNA, 27 bp, Artificial Sequences
  Synthetic
gggtggatgggattttgcgcgtggaat

SEQ ID NO: 16137 - DNA, 26 bp, Artificial Sequences
  Synthetic
gggtggatgggattttgcgcgtggaa

SEQ ID NO: 16138 - DNA, 28 bp, Artificial Sequences
  Synthetic
gggtggatgggattttgcgcgtggaatt

SEQ ID NO: 16139 - DNA, 27 bp, Artificial Sequences
  Synthetic
tttttcgggtggatgggattttgcgcg

SEQ ID NO: 16140 - DNA, 27 bp, Artificial Sequences
  Synthetic
ggtggatgggattttgcgcgtggaatt

SEQ ID NO: 16141 - DNA, 27 bp, Artificial Sequences
  Synthetic
tttttaagcggggcggggttgtcgttc

SEQ ID NO: 16142 - DNA, 27 bp, Artificial Sequences
  Synthetic
ttgtttttaagcggggcggggttgtcg

SEQ ID NO: 16143 - DNA, 27 bp, Artificial Sequences
  Synthetic
gtttttaagcggggcggggttgtcgtt

SEQ ID NO: 16144 - DNA, 27 bp, Artificial Sequences
  Synthetic
cggggttgtcgttcggatgtgagtcgt

SEQ ID NO: 16145 - DNA, 28 bp, Artificial Sequences
  Synthetic
cggggttgtcgttcggatgtgagtcgta

SEQ ID NO: 16146 - DNA, 27 bp, Artificial Sequences
  Synthetic
gggtggatgggattttgcgcgtggaat

SEQ ID NO: 16147 - DNA, 27 bp, Artificial Sequences
  Synthetic
tttttacggtggcgttggggaggggtt

SEQ ID NO: 16148 - DNA, 27 bp, Artificial Sequences
  Synthetic
ttttttacggtggcgttggggaggggt

SEQ ID NO: 16149 - DNA, 27 bp, Artificial Sequences
  Synthetic
ggtggcgttggggaggggttgttttta

SEQ ID NO: 16150 - DNA, 27 bp, Artificial Sequences
  Synthetic
ttttacggtggcgttggggaggggttg

SEQ ID NO: 16151 - DNA, 27 bp, Artificial Sequences
  Synthetic
tttttaagcggggcggggttgtcgttc

SEQ ID NO: 16152 - DNA, 27 bp, Artificial Sequences
  Synthetic
ttgtttttaagcggggcggggttgtcg

SEQ ID NO: 16153 - DNA, 27 bp, Artificial Sequences
  Synthetic
gtttttaagcggggcggggttgtcgtt

SEQ ID NO: 16154 - DNA, 27 bp, Artificial Sequences
  Synthetic
cggggttgtcgttcggatgtgagtcgt

SEQ ID NO: 16155 - DNA, 28 bp, Artificial Sequences
  Synthetic
cggggttgtcgttcggatgtgagtcgta

SEQ ID NO: 16156 - DNA, 27 bp, Artificial Sequences
  Synthetic
ggtcgggttgggaggttgtttcgagga

SEQ ID NO: 16157 - DNA, 27 bp, Artificial Sequences
  Synthetic
aggtcgggttgggaggttgtttcgagg

SEQ ID NO: 16158 - DNA, 27 bp, Artificial Sequences
  Synthetic
tcgggttgggaggttgtttcgaggagt

SEQ ID NO: 16159 - DNA, 27 bp, Artificial Sequences
  Synthetic
ggaaggtcgggttgggaggttgtttcg

SEQ ID NO: 16160 - DNA, 28 bp, Artificial Sequences
  Synthetic
gtcgggttgggaggttgtttcgaggagt

SEQ ID NO: 16161 - DNA, 28 bp, Artificial Sequences
  Synthetic
ggggttagttgaggtttgggagtggtag

SEQ ID NO: 16162 - DNA, 26 bp, Artificial Sequences
  Synthetic
ggggttagttgaggtttgggagtggt

SEQ ID NO: 16163 - DNA, 29 bp, Artificial Sequences
  Synthetic
ggggttagttgaggtttgggagtggtaga

SEQ ID NO: 16164 - DNA, 30 bp, Artificial Sequences
  Synthetic
ggggttagttgaggtttgggagtggtagag

SEQ ID NO: 16165 - DNA, 31 bp, Artificial Sequences
  Synthetic
ggggttagttgaggtttgggagtggtagagt

SEQ ID NO: 16166 - DNA, 28 bp, Artificial Sequences
  Synthetic
tgggagttggtgtgttttgattggaggt

SEQ ID NO: 16167 - DNA, 29 bp, Artificial Sequences
  Synthetic
ttgggagttggtgtgttttgattggaggt

SEQ ID NO: 16168 - DNA, 30 bp, Artificial Sequences
  Synthetic
gggagttggtgtgttttgattggaggttgt

SEQ ID NO: 16169 - DNA, 30 bp, Artificial Sequences
  Synthetic
tgggagttggtgtgttttgattggaggttg

SEQ ID NO: 16170 - DNA, 29 bp, Artificial Sequences
  Synthetic
gggagttggtgtgttttgattggaggttg

SEQ ID NO: 16171 - DNA, 27 bp, Artificial Sequences
  Synthetic
cggacgtttgaggtttgtttggaaggt

SEQ ID NO: 16172 - DNA, 28 bp, Artificial Sequences
  Synthetic
tcggacgtttgaggtttgtttggaaggt

SEQ ID NO: 16173 - DNA, 27 bp, Artificial Sequences
  Synthetic
tcggacgtttgaggtttgtttggaagg

SEQ ID NO: 16174 - DNA, 28 bp, Artificial Sequences
  Synthetic
aggatcggacgtttgaggtttgtttgga

SEQ ID NO: 16175 - DNA, 28 bp, Artificial Sequences
  Synthetic
cggacgtttgaggtttgtttggaaggtt

SEQ ID NO: 16176 - DNA, 27 bp, Artificial Sequences
  Synthetic
aggcgttcggttttttagttggtgtgg

SEQ ID NO: 16177 - DNA, 27 bp, Artificial Sequences
  Synthetic
ggcgttcggttttttagttggtgtgga

SEQ ID NO: 16178 - DNA, 28 bp, Artificial Sequences
  Synthetic
aggcgttcggttttttagttggtgtgga

SEQ ID NO: 16179 - DNA, 28 bp, Artificial Sequences
  Synthetic
ggcgttcggttttttagttggtgtggaa

SEQ ID NO: 16180 - DNA, 29 bp, Artificial Sequences
  Synthetic
aggcgttcggttttttagttggtgtggaa

SEQ ID NO: 16181 - DNA, 27 bp, Artificial Sequences
  Synthetic
ttttgggaaggaagggaagagacggga

SEQ ID NO: 16182 - DNA, 27 bp, Artificial Sequences
  Synthetic
tgggaaggaagggaagagacgggattt

SEQ ID NO: 16183 - DNA, 27 bp, Artificial Sequences
  Synthetic
ttgggaaggaagggaagagacgggatt

SEQ ID NO: 16184 - DNA, 27 bp, Artificial Sequences
  Synthetic
tttgggaaggaagggaagagacgggat

SEQ ID NO: 16185 - DNA, 27 bp, Artificial Sequences
  Synthetic
tttttgggaaggaagggaagagacggg

SEQ ID NO: 16186 - DNA, 27 bp, Artificial Sequences
  Synthetic
taaggggggtgggttggggtagatgga

SEQ ID NO: 16187 - DNA, 27 bp, Artificial Sequences
  Synthetic
ggttggggtagatggagtcggcgtgag

SEQ ID NO: 16188 - DNA, 27 bp, Artificial Sequences
  Synthetic
gttggggtagatggagtcggcgtgagt

SEQ ID NO: 16189 - DNA, 27 bp, Artificial Sequences
  Synthetic
tggggtagatggagtcggcgtgagttt

SEQ ID NO: 16190 - DNA, 27 bp, Artificial Sequences
  Synthetic
ttggggtagatggagtcggcgtgagtt

SEQ ID NO: 16191 - DNA, 27 bp, Artificial Sequences
  Synthetic
ttttgggaaggaagggaagagacggga

SEQ ID NO: 16192 - DNA, 27 bp, Artificial Sequences
  Synthetic
tgggaaggaagggaagagacgggattt

SEQ ID NO: 16193 - DNA, 27 bp, Artificial Sequences
  Synthetic
ttgggaaggaagggaagagacgggatt

SEQ ID NO: 16194 - DNA, 27 bp, Artificial Sequences
  Synthetic
tttgggaaggaagggaagagacgggat

SEQ ID NO: 16195 - DNA, 27 bp, Artificial Sequences
  Synthetic
tttttgggaaggaagggaagagacggg

SEQ ID NO: 16196 - DNA, 27 bp, Artificial Sequences
  Synthetic
ggagtagtttcggggcgcgggtaagaa

SEQ ID NO: 16197 - DNA, 27 bp, Artificial Sequences
  Synthetic
cggggcgcgggtaagaatagagtaggg

SEQ ID NO: 16198 - DNA, 27 bp, Artificial Sequences
  Synthetic
gggagtcgtcgtgtttgttcggttgcg

SEQ ID NO: 16199 - DNA, 27 bp, Artificial Sequences
  Synthetic
attttgtagggtatcggcggcgggagg

SEQ ID NO: 16200 - DNA, 27 bp, Artificial Sequences
  Synthetic
gagcgttcgtagggtcggaaggaggtt

SEQ ID NO: 16201 - DNA, 27 bp, Artificial Sequences
  Synthetic
gttcgttgagggagttggcggaggagt

SEQ ID NO: 16202 - DNA, 27 bp, Artificial Sequences
  Synthetic
tgagtcgtttttgtttgcgggggcgtt

SEQ ID NO: 16203 - DNA, 27 bp, Artificial Sequences
  Synthetic
gggagtgcgcggcgatttggtattagc

SEQ ID NO: 16204 - DNA, 27 bp, Artificial Sequences
  Synthetic
gcggcggggtagttggtgtagttttgg

SEQ ID NO: 16205 - DNA, 27 bp, Artificial Sequences
  Synthetic
ggcggcggggtagttggtgtagttttg

SEQ ID NO: 16206 - DNA, 36 bp, Artificial Sequences
  Synthetic
ttgtttcgtttaaggttgtattagttgtttcgtcgt

SEQ ID NO: 16207 - DNA, 27 bp, Artificial Sequences
  Synthetic
aggttagatacggggggtcggcgtttg

SEQ ID NO: 16208 - DNA, 27 bp, Artificial Sequences
  Synthetic
gtcggcgtttgggtagggtcgagttga

SEQ ID NO: 16209 - DNA, 27 bp, Artificial Sequences
  Synthetic
tcggcgtttgggtagggtcgagttgat

SEQ ID NO: 16210 - DNA, 27 bp, Artificial Sequences
  Synthetic
tagatacggggggtcggcgtttgggta

SEQ ID NO: 16211 - DNA, 27 bp, Artificial Sequences
  Synthetic
cggcgtttgggtagggtcgagttgatg

SEQ ID NO: 16212 - DNA, 27 bp, Artificial Sequences
  Synthetic
taaggattcgggtttaggaggcggacg

SEQ ID NO: 16213 - DNA, 26 bp, Artificial Sequences
  Synthetic
aaggattcgggtttaggaggcggacg

SEQ ID NO: 16214 - DNA, 28 bp, Artificial Sequences
  Synthetic
ttaaggattcgggtttaggaggcggacg

SEQ ID NO: 16215 - DNA, 27 bp, Artificial Sequences
  Synthetic
ttaaggattcgggtttaggaggcggac

SEQ ID NO: 16216 - DNA, 29 bp, Artificial Sequences
  Synthetic
gggagttcgcggttattaaggattcgggt

SEQ ID NO: 16217 - DNA, 27 bp, Artificial Sequences
  Synthetic
aggttagatacggggggtcggcgtttg

SEQ ID NO: 16218 - DNA, 27 bp, Artificial Sequences
  Synthetic
gtcggcgtttgggtagggtcgagttga

SEQ ID NO: 16219 - DNA, 27 bp, Artificial Sequences
  Synthetic
tcggcgtttgggtagggtcgagttgat

SEQ ID NO: 16220 - DNA, 27 bp, Artificial Sequences
  Synthetic
tagatacggggggtcggcgtttgggta

SEQ ID NO: 16221 - DNA, 27 bp, Artificial Sequences
  Synthetic
cggcgtttgggtagggtcgagttgatg

SEQ ID NO: 16222 - DNA, 27 bp, Artificial Sequences
  Synthetic
cggtttttcgtgtttggtttgcggcgt

SEQ ID NO: 16223 - DNA, 27 bp, Artificial Sequences
  Synthetic
tcggtttttcgtgtttggtttgcggcg

SEQ ID NO: 16224 - DNA, 28 bp, Artificial Sequences
  Synthetic
cggtttttcgtgtttggtttgcggcgtc

SEQ ID NO: 16225 - DNA, 28 bp, Artificial Sequences
  Synthetic
gtcggtttttcgtgtttggtttgcggcg

SEQ ID NO: 16226 - DNA, 28 bp, Artificial Sequences
  Synthetic
cgtcggtttttcgtgtttggtttgcggc

SEQ ID NO: 16227 - DNA, 27 bp, Artificial Sequences
  Synthetic
atttagtcgggtggttcggggtttgcg

SEQ ID NO: 16228 - DNA, 27 bp, Artificial Sequences
  Synthetic
tttagtcgggtggttcggggtttgcgg

SEQ ID NO: 16229 - DNA, 26 bp, Artificial Sequences
  Synthetic
tttagtcgggtggttcggggtttgcg

SEQ ID NO: 16230 - DNA, 27 bp, Artificial Sequences
  Synthetic
tgcgggtcgtttatttagtcgggtggt

SEQ ID NO: 16231 - DNA, 28 bp, Artificial Sequences
  Synthetic
atttagtcgggtggttcggggtttgcgg

SEQ ID NO: 16232 - DNA, 28 bp, Artificial Sequences
  Synthetic
tggttggaggggagggtatatttggggg

SEQ ID NO: 16233 - DNA, 27 bp, Artificial Sequences
  Synthetic
ggttggaggggagggtatatttggggg

SEQ ID NO: 16234 - DNA, 29 bp, Artificial Sequences
  Synthetic
tggttggaggggagggtatatttggggga

SEQ ID NO: 16235 - DNA, 28 bp, Artificial Sequences
  Synthetic
ggttggaggggagggtatatttggggga

SEQ ID NO: 16236 - DNA, 29 bp, Artificial Sequences
  Synthetic
gtggttggaggggagggtatatttggggg

SEQ ID NO: 16237 - DNA, 27 bp, Artificial Sequences
  Synthetic
gggtttgcggagttttggatgtttcgt

SEQ ID NO: 16238 - DNA, 28 bp, Artificial Sequences
  Synthetic
agggtttgcggagttttggatgtttcgt

SEQ ID NO: 16239 - DNA, 27 bp, Artificial Sequences
  Synthetic
agggtttgcggagttttggatgtttcg

SEQ ID NO: 16240 - DNA, 27 bp, Artificial Sequences
  Synthetic
tgcggagttttggatgtttcgttcgtt

SEQ ID NO: 16241 - DNA, 27 bp, Artificial Sequences
  Synthetic
ttgcggagttttggatgtttcgttcgt

SEQ ID NO: 16242 - DNA, 27 bp, Artificial Sequences
  Synthetic
taggtgggcgggtaggagttaggtcgg

SEQ ID NO: 16243 - DNA, 27 bp, Artificial Sequences
  Synthetic
ggtgggcgggtaggagttaggtcggta

SEQ ID NO: 16244 - DNA, 27 bp, Artificial Sequences
  Synthetic
gtaggtgggcgggtaggagttaggtcg

SEQ ID NO: 16245 - DNA, 27 bp, Artificial Sequences
  Synthetic
gtgggcgggtaggagttaggtcggtaa

SEQ ID NO: 16246 - DNA, 28 bp, Artificial Sequences
  Synthetic
agtaggtgggcgggtaggagttaggtcg

SEQ ID NO: 16247 - DNA, 27 bp, Artificial Sequences
  Synthetic
tcggttcgttcgggagtttggtgttga

SEQ ID NO: 16248 - DNA, 27 bp, Artificial Sequences
  Synthetic
cggttcgttcgggagtttggtgttgag

SEQ ID NO: 16249 - DNA, 28 bp, Artificial Sequences
  Synthetic
cggttcgttcgggagtttggtgttgaga

SEQ ID NO: 16250 - DNA, 28 bp, Artificial Sequences
  Synthetic
tcggttcgttcgggagtttggtgttgag

SEQ ID NO: 16251 - DNA, 28 bp, Artificial Sequences
  Synthetic
tgtttcggttcgttcgggagtttggtgt

SEQ ID NO: 16252 - DNA, 27 bp, Artificial Sequences
  Synthetic
ttaagttttcgggcgggtcggggtagg

SEQ ID NO: 16253 - DNA, 27 bp, Artificial Sequences
  Synthetic
taagttttcgggcgggtcggggtagga

SEQ ID NO: 16254 - DNA, 26 bp, Artificial Sequences
  Synthetic
taagttttcgggcgggtcggggtagg

SEQ ID NO: 16255 - DNA, 28 bp, Artificial Sequences
  Synthetic
attaagttttcgggcgggtcggggtagg

SEQ ID NO: 16256 - DNA, 27 bp, Artificial Sequences
  Synthetic
gtattaagttttcgggcgggtcggggt

SEQ ID NO: 16257 - DNA, 28 bp, Artificial Sequences
  Synthetic
cggtttcgttatttgcgggttggttacg

SEQ ID NO: 16258 - DNA, 29 bp, Artificial Sequences
  Synthetic
cggtttcgttatttgcgggttggttacgt

SEQ ID NO: 16259 - DNA, 27 bp, Artificial Sequences
  Synthetic
ttttaggggttggcgtgtgttttgtgt

SEQ ID NO: 16260 - DNA, 27 bp, Artificial Sequences
  Synthetic
aggggttggcgtgtgttttgtgtattt

SEQ ID NO: 16261 - DNA, 28 bp, Artificial Sequences
  Synthetic
ggtttcgttatttgcgggttggttacgt

SEQ ID NO: 16262 - DNA, 27 bp, Artificial Sequences
  Synthetic
tttttgggggaagttcggttcgtgcgg

SEQ ID NO: 16263 - DNA, 27 bp, Artificial Sequences
  Synthetic
tgtggggcgtggttagttcgtaggtgg

SEQ ID NO: 16264 - DNA, 27 bp, Artificial Sequences
  Synthetic
ttaagttttcgggcgggtcggggtagg

SEQ ID NO: 16265 - DNA, 27 bp, Artificial Sequences
  Synthetic
gggtaggaggttgtggggcgtggttag

SEQ ID NO: 16266 - DNA, 27 bp, Artificial Sequences
  Synthetic
aggaggttgtggggcgtggttagttcg

SEQ ID NO: 16267 - DNA, 27 bp, Artificial Sequences
  Synthetic
ttttgttgtgttggagacggagcgcgt

SEQ ID NO: 16268 - DNA, 27 bp, Artificial Sequences
  Synthetic
ttgttgtgttggagacggagcgcgtaa

SEQ ID NO: 16269 - DNA, 27 bp, Artificial Sequences
  Synthetic
tttgttgtgttggagacggagcgcgta

SEQ ID NO: 16270 - DNA, 27 bp, Artificial Sequences
  Synthetic
tttttgttgtgttggagacggagcgcg

SEQ ID NO: 16271 - DNA, 28 bp, Artificial Sequences
  Synthetic
tttttgttgtgttggagacggagcgcgt

SEQ ID NO: 16272 - DNA, 27 bp, Artificial Sequences
  Synthetic
tttttgggggaagttcggttcgtgcgg

SEQ ID NO: 16273 - DNA, 27 bp, Artificial Sequences
  Synthetic
gcgggttgcgggagattttgatgggtt

SEQ ID NO: 16274 - DNA, 27 bp, Artificial Sequences
  Synthetic
gtttttgggggaagttcggttcgtgcg

SEQ ID NO: 16275 - DNA, 28 bp, Artificial Sequences
  Synthetic
gcgggttgcgggagattttgatgggttt

SEQ ID NO: 16276 - DNA, 26 bp, Artificial Sequences
  Synthetic
ttttgggggaagttcggttcgtgcgg

SEQ ID NO: 16277 - DNA, 28 bp, Artificial Sequences
  Synthetic
gcgtttttggaggatagggacgttgggg

SEQ ID NO: 16278 - DNA, 28 bp, Artificial Sequences
  Synthetic
tgcgtttttggaggatagggacgttggg

SEQ ID NO: 16279 - DNA, 29 bp, Artificial Sequences
  Synthetic
gcgtttttggaggatagggacgttgggga

SEQ ID NO: 16280 - DNA, 27 bp, Artificial Sequences
  Synthetic
gcgtttttggaggatagggacgttggg

SEQ ID NO: 16281 - DNA, 29 bp, Artificial Sequences
  Synthetic
tgcgtttttggaggatagggacgttgggg

SEQ ID NO: 16282 - DNA, 27 bp, Artificial Sequences
  Synthetic
tcgtggtgggaaatagagcggggtgtc

SEQ ID NO: 16283 - DNA, 27 bp, Artificial Sequences
  Synthetic
gtcgtggtgggaaatagagcggggtgt

SEQ ID NO: 16284 - DNA, 27 bp, Artificial Sequences
  Synthetic
ggtcgtggtgggaaatagagcggggtg

SEQ ID NO: 16285 - DNA, 27 bp, Artificial Sequences
  Synthetic
taggtcgtggtgggaaatagagcgggg

SEQ ID NO: 16286 - DNA, 27 bp, Artificial Sequences
  Synthetic
cgtggtgggaaatagagcggggtgtcg

SEQ ID NO: 16287 - DNA, 27 bp, Artificial Sequences
  Synthetic
aggtgaggaataggagtttttgcgggt

SEQ ID NO: 16288 - DNA, 28 bp, Artificial Sequences
  Synthetic
aggtgaggaataggagtttttgcgggtt

SEQ ID NO: 16289 - DNA, 29 bp, Artificial Sequences
  Synthetic
cgtaggtgaggaataggagtttttgcggg

SEQ ID NO: 16290 - DNA, 30 bp, Artificial Sequences
  Synthetic
cgtaggtgaggaataggagtttttgcgggt

SEQ ID NO: 16291 - DNA, 30 bp, Artificial Sequences
  Synthetic
tcgtaggtgaggaataggagtttttgcggg

SEQ ID NO: 16292 - DNA, 27 bp, Artificial Sequences
  Synthetic
gtggagtatttggtggatcggtgcggc

SEQ ID NO: 16293 - DNA, 27 bp, Artificial Sequences
  Synthetic
ggtggagtatttggtggatcggtgcgg

SEQ ID NO: 16294 - DNA, 27 bp, Artificial Sequences
  Synthetic
tggagtatttggtggatcggtgcggcg

SEQ ID NO: 16295 - DNA, 26 bp, Artificial Sequences
  Synthetic
ggagtatttggtggatcggtgcggcg

SEQ ID NO: 16296 - DNA, 27 bp, Artificial Sequences
  Synthetic
tggtggagtatttggtggatcggtgcg

SEQ ID NO: 16297 - DNA, 27 bp, Artificial Sequences
  Synthetic
gaggtttcgcggcgtagtaggtttcgt

SEQ ID NO: 16298 - DNA, 27 bp, Artificial Sequences
  Synthetic
ttacgtttaggtggtcggttgcggagg

SEQ ID NO: 16299 - DNA, 27 bp, Artificial Sequences
  Synthetic
aggtttcgcggcgtagtaggtttcgta

SEQ ID NO: 16300 - DNA, 28 bp, Artificial Sequences
  Synthetic
attacgtttaggtggtcggttgcggagg

SEQ ID NO: 16301 - DNA, 26 bp, Artificial Sequences
  Synthetic
tacgtttaggtggtcggttgcggagg

SEQ ID NO: 16302 - DNA, 27 bp, Artificial Sequences
  Synthetic
gaggtggtgcgttatttggtcggcgag

SEQ ID NO: 16303 - DNA, 27 bp, Artificial Sequences
  Synthetic
ttggaggtggtgcgttatttggtcggc

SEQ ID NO: 16304 - DNA, 27 bp, Artificial Sequences
  Synthetic
aggtggtgcgttatttggtcggcgagt

SEQ ID NO: 16305 - DNA, 27 bp, Artificial Sequences
  Synthetic
ggtggtgcgttatttggtcggcgagta

SEQ ID NO: 16306 - DNA, 27 bp, Artificial Sequences
  Synthetic
ggaggtggtgcgttatttggtcggcga

SEQ ID NO: 16307 - DNA, 27 bp, Artificial Sequences
  Synthetic
gggtcgtgttgtttttggcgttgcgtc

SEQ ID NO: 16308 - DNA, 27 bp, Artificial Sequences
  Synthetic
agggtcgtgttgtttttggcgttgcgt

SEQ ID NO: 16309 - DNA, 27 bp, Artificial Sequences
  Synthetic
gcgttgcgtcggtttatttgggcgttt

SEQ ID NO: 16310 - DNA, 27 bp, Artificial Sequences
  Synthetic
ggcgttgcgtcggtttatttgggcgtt

SEQ ID NO: 16311 - DNA, 27 bp, Artificial Sequences
  Synthetic
tagggtcgtgttgtttttggcgttgcg

SEQ ID NO: 16312 - DNA, 27 bp, Artificial Sequences
  Synthetic
gcggtaggggagagaggaggaaggtga

SEQ ID NO: 16313 - DNA, 27 bp, Artificial Sequences
  Synthetic
aggtgagcgggggaggttagagatgga

SEQ ID NO: 16314 - DNA, 27 bp, Artificial Sequences
  Synthetic
taggggagagaggaggaaggtgagcgg

SEQ ID NO: 16315 - DNA, 27 bp, Artificial Sequences
  Synthetic
aggaaggtgagcgggggaggttagaga

SEQ ID NO: 16316 - DNA, 27 bp, Artificial Sequences
  Synthetic
gaggcggtaggggagagaggaggaagg

SEQ ID NO: 16317 - DNA, 27 bp, Artificial Sequences
  Synthetic
gtattgttcggggtagggtcgggcgtt

SEQ ID NO: 16318 - DNA, 27 bp, Artificial Sequences
  Synthetic
tattgttcggggtagggtcgggcgttt

SEQ ID NO: 16319 - DNA, 27 bp, Artificial Sequences
  Synthetic
attgttcggggtagggtcgggcgtttt

SEQ ID NO: 16320 - DNA, 27 bp, Artificial Sequences
  Synthetic
gtggtattgttcggggtagggtcgggc

SEQ ID NO: 16321 - DNA, 27 bp, Artificial Sequences
  Synthetic
tgttggtcgatgtttaggtgggcgggg

SEQ ID NO: 16322 - DNA, 27 bp, Artificial Sequences
  Synthetic
agggcgttcggttttgtttcgggtagt

SEQ ID NO: 16323 - DNA, 28 bp, Artificial Sequences
  Synthetic
gggcgttcggttttgtttcgggtagtgt

SEQ ID NO: 16324 - DNA, 27 bp, Artificial Sequences
  Synthetic
gggcgttcggttttgtttcgggtagtg

SEQ ID NO: 16325 - DNA, 28 bp, Artificial Sequences
  Synthetic
agggcgttcggttttgtttcgggtagtg

SEQ ID NO: 16326 - DNA, 27 bp, Artificial Sequences
  Synthetic
ggcgttcggttttgtttcgggtagtgt

SEQ ID NO: 16327 - DNA, 27 bp, Artificial Sequences
  Synthetic
tagggttgtggggggtgtgtaggaggt

SEQ ID NO: 16328 - DNA, 27 bp, Artificial Sequences
  Synthetic
gtggtattgttcggggtagggtcgggt

SEQ ID NO: 16329 - DNA, 27 bp, Artificial Sequences
  Synthetic
agtggtattgttcggggtagggtcggg

SEQ ID NO: 16330 - DNA, 27 bp, Artificial Sequences
  Synthetic
agggttgtggggggtgtgtaggaggtt

SEQ ID NO: 16331 - DNA, 27 bp, Artificial Sequences
  Synthetic
gggttgtggggggtgtgtaggaggtta

SEQ ID NO: 16332 - DNA, 27 bp, Artificial Sequences
  Synthetic
ggggggtggtttttagttcggtttgtt

SEQ ID NO: 16333 - DNA, 28 bp, Artificial Sequences
  Synthetic
ggggggtggtttttagttcggtttgttt

SEQ ID NO: 16334 - DNA, 31 bp, Artificial Sequences
  Synthetic
agttagtagggtttaaaaggatgttgggggg

SEQ ID NO: 16335 - DNA, 33 bp, Artificial Sequences
  Synthetic
ttagttagtagggtttaaaaggatgttgggggg

SEQ ID NO: 16336 - DNA, 34 bp, Artificial Sequences
  Synthetic
tttagttagtagggtttaaaaggatgttgggggg

SEQ ID NO: 16337 - DNA, 27 bp, Artificial Sequences
  Synthetic
agatgggcggggaagggatagagggag

SEQ ID NO: 16338 - DNA, 27 bp, Artificial Sequences
  Synthetic
aaaaggtaatggcgaaggttgggggcg

SEQ ID NO: 16339 - DNA, 27 bp, Artificial Sequences
  Synthetic
tagatgggcggggaagggatagaggga

SEQ ID NO: 16340 - DNA, 27 bp, Artificial Sequences
  Synthetic
ggggaagggatagagggaggaggggta

SEQ ID NO: 16341 - DNA, 27 bp, Artificial Sequences
  Synthetic
gatgggcggggaagggatagagggagg

SEQ ID NO: 16342 - DNA, 29 bp, Artificial Sequences
  Synthetic
ggggttgtagtcgggtaggttttgttcgt

SEQ ID NO: 16343 - DNA, 29 bp, Artificial Sequences
  Synthetic
tggggttgtagtcgggtaggttttgttcg

SEQ ID NO: 16344 - DNA, 28 bp, Artificial Sequences
  Synthetic
ggggttgtagtcgggtaggttttgttcg

SEQ ID NO: 16345 - DNA, 30 bp, Artificial Sequences
  Synthetic
tggggttgtagtcgggtaggttttgttcgt

SEQ ID NO: 16346 - DNA, 27 bp, Artificial Sequences
  Synthetic
tggggttgtagtcgggtaggttttgtt

SEQ ID NO: 16347 - DNA, 29 bp, Artificial Sequences
  Synthetic
agtgtttgagtaatttttgcggttcgggt

SEQ ID NO: 16348 - DNA, 30 bp, Artificial Sequences
  Synthetic
gagtgtttgagtaatttttgcggttcgggt

SEQ ID NO: 16349 - DNA, 30 bp, Artificial Sequences
  Synthetic
tgagtgtttgagtaatttttgcggttcggg

SEQ ID NO: 16350 - DNA, 31 bp, Artificial Sequences
  Synthetic
tgagtgtttgagtaatttttgcggttcgggt

SEQ ID NO: 16351 - DNA, 31 bp, Artificial Sequences
  Synthetic
atgagtgtttgagtaatttttgcggttcggg

SEQ ID NO: 16352 - DNA, 27 bp, Artificial Sequences
  Synthetic
tggcgggtaggtgtaggtgaaggaggt

SEQ ID NO: 16353 - DNA, 27 bp, Artificial Sequences
  Synthetic
cgtggtcggtataggtgttcgggtcgt

SEQ ID NO: 16354 - DNA, 27 bp, Artificial Sequences
  Synthetic
ggcgggtaggtgtaggtgaaggaggtt

SEQ ID NO: 16355 - DNA, 27 bp, Artificial Sequences
  Synthetic
ttggcgggtaggtgtaggtgaaggagg

SEQ ID NO: 16356 - DNA, 27 bp, Artificial Sequences
  Synthetic
cggtataggtgttcgggtcgtaggggt

SEQ ID NO: 16357 - DNA, 29 bp, Artificial Sequences
  Synthetic
agtgtttgagtaatttttgcggttcgggt

SEQ ID NO: 16358 - DNA, 30 bp, Artificial Sequences; identical to SEQ ID NO: 16348
  Synthetic

SEQ ID NO: 16359 - DNA, 30 bp, Artificial Sequences; identical to SEQ ID NO: 16349
  Synthetic

SEQ ID NO: 16360 - DNA, 31 bp, Artificial Sequences; identical to SEQ ID NO: 16350
  Synthetic

SEQ ID NO: 16361 - DNA, 31 bp, Artificial Sequences; identical to SEQ ID NO: 16351
  Synthetic

SEQ ID NO: 16362 - DNA, 27 bp, Artificial Sequences
  Synthetic
tcgtcgggaagttgggggtttggttga

SEQ ID NO: 16363 - DNA, 27 bp, Artificial Sequences
  Synthetic
agtcggtgcgtattagttggcggtggt

SEQ ID NO: 16364 - DNA, 27 bp, Artificial Sequences
  Synthetic
tcgggaagttgggggtttggttgaggt

SEQ ID NO: 16365 - DNA, 27 bp, Artificial Sequences
  Synthetic
aggtagggggtaggggtttcgtggagt

SEQ ID NO: 16366 - DNA, 27 bp, Artificial Sequences
  Synthetic
tcgtggagtttgtgtagacggaggggc

SEQ ID NO: 16367 - DNA, 27 bp, Artificial Sequences
  Synthetic
tcggggtttcggcgtggttatagtggg

SEQ ID NO: 16368 - DNA, 27 bp, Artificial Sequences
  Synthetic
tgtagtttcgtggtgggttcggacggt

SEQ ID NO: 16369 - DNA, 27 bp, Artificial Sequences
  Synthetic
cggggtttcggcgtggttatagtgggt

SEQ ID NO: 16370 - DNA, 28 bp, Artificial Sequences
  Synthetic
cggggtttcggcgtggttatagtgggta

SEQ ID NO: 16371 - DNA, 28 bp, Artificial Sequences
  Synthetic
tgtagtttcgtggtgggttcggacggtt

SEQ ID NO: 16372 - DNA, 27 bp, Artificial Sequences
  Synthetic
gtttcgggagttgtggtcgagcgtgtg

SEQ ID NO: 16373 - DNA, 27 bp, Artificial Sequences
  Synthetic
agtttcgggagttgtggtcgagcgtgt

SEQ ID NO: 16374 - DNA, 27 bp, Artificial Sequences
  Synthetic
aagtttcgggagttgtggtcgagcgtg

SEQ ID NO: 16375 - DNA, 27 bp, Artificial Sequences
  Synthetic
tttcgggagttgtggtcgagcgtgtgg

SEQ ID NO: 16376 - DNA, 27 bp, Artificial Sequences
  Synthetic
gaagtttcgggagttgtggtcgagcgt

SEQ ID NO: 16377 - DNA, 27 bp, Artificial Sequences
  Synthetic
cgggttttggggtcggtggtttttggt

SEQ ID NO: 16378 - DNA, 27 bp, Artificial Sequences
  Synthetic
gaggggagcggataagggttcgggttt

SEQ ID NO: 16379 - DNA, 27 bp, Artificial Sequences
  Synthetic
tgtagtttcgtggtgggttcggacggt

SEQ ID NO: 16380 - DNA, 27 bp, Artificial Sequences
  Synthetic
aggggagcggataagggttcgggtttt

SEQ ID NO: 16381 - DNA, 27 bp, Artificial Sequences
  Synthetic
aatcggggaggggagcggataagggtt

SEQ ID NO: 16382 - DNA, 27 bp, Artificial Sequences
  Synthetic
tattatgcggcgtgagggggattcggg

SEQ ID NO: 16383 - DNA, 27 bp, Artificial Sequences
  Synthetic
gtattatgcggcgtgagggggattcgg

SEQ ID NO: 16384 - DNA, 27 bp, Artificial Sequences
  Synthetic
cggcgtgagggggattcgggtttttat

SEQ ID NO: 16385 - DNA, 28 bp, Artificial Sequences
  Synthetic
agtattatgcggcgtgagggggattcgg

SEQ ID NO: 16386 - DNA, 27 bp, Artificial Sequences
  Synthetic
gcggcgtgagggggattcgggttttta

SEQ ID NO: 16387 - DNA, 27 bp, Artificial Sequences
  Synthetic
gggaggagaagggtagaaaggggcgtg

SEQ ID NO: 16388 - DNA, 27 bp, Artificial Sequences
  Synthetic
gtggggaggagaagggtagaaaggggc

SEQ ID NO: 16389 - DNA, 27 bp, Artificial Sequences
  Synthetic
aggggcgtgttagtattgaagggcgga

SEQ ID NO: 16390 - DNA, 27 bp, Artificial Sequences
  Synthetic
ggaggagaagggtagaaaggggcgtgt

SEQ ID NO: 16391 - DNA, 27 bp, Artificial Sequences
  Synthetic
tggggaggagaagggtagaaaggggcg

SEQ ID NO: 16392 - DNA, 27 bp, Artificial Sequences
  Synthetic
gaaggttggaggaggggtgttgggagg

SEQ ID NO: 16393 - DNA, 27 bp, Artificial Sequences
  Synthetic
ggaaggttggaggaggggtgttgggag

SEQ ID NO: 16394 - DNA, 27 bp, Artificial Sequences
  Synthetic
tttcgagagggatagagttgggcgcgg

SEQ ID NO: 16395 - DNA, 27 bp, Artificial Sequences
  Synthetic
aggttggaggaggggtgttgggaggta

SEQ ID NO: 16396 - DNA, 27 bp, Artificial Sequences
  Synthetic
ggcgttggggtaagaaggtaggagcgt

SEQ ID NO: 16397 - DNA, 27 bp, Artificial Sequences
  Synthetic
ggagtggtttaggttgggcgaggggta

SEQ ID NO: 16398 - DNA, 27 bp, Artificial Sequences
  Synthetic
tagggagtggtttaggttgggcgaggg

SEQ ID NO: 16399 - DNA, 26 bp, Artificial Sequences
  Synthetic
ggagtggtttaggttgggcgaggggt

SEQ ID NO: 16400 - DNA, 26 bp, Artificial Sequences
  Synthetic
agggagtggtttaggttgggcgaggg

SEQ ID NO: 16401 - DNA, 27 bp, Artificial Sequences
  Synthetic
agggagtggtttaggttgggcgagggg

SEQ ID NO: 16402 - DNA, 28 bp, Artificial Sequences
  Synthetic
agcggtattgttgacgttaggggtttga

SEQ ID NO: 16403 - DNA, 29 bp, Artificial Sequences
  Synthetic
agcggtattgttgacgttaggggtttgat

SEQ ID NO: 16404 - DNA, 29 bp, Artificial Sequences
  Synthetic
gcggtattgttgacgttaggggtttgatg

SEQ ID NO: 16405 - DNA, 30 bp, Artificial Sequences
  Synthetic
agcggtattgttgacgttaggggtttgatg

SEQ ID NO: 16406 - DNA, 30 bp, Artificial Sequences
  Synthetic
gcggtattgttgacgttaggggtttgatga

SEQ ID NO: 16407 - DNA, 27 bp, Artificial Sequences
  Synthetic
tgtgtttcgggaatagcgggtagtgtt

SEQ ID NO: 16408 - DNA, 27 bp, Artificial Sequences
  Synthetic
ttgtgtttcgggaatagcgggtagtgt

SEQ ID NO: 16409 - DNA, 28 bp, Artificial Sequences
  Synthetic
tgtgtttcgggaatagcgggtagtgttt

SEQ ID NO: 16410 - DNA, 28 bp, Artificial Sequences
  Synthetic
ttgtgtttcgggaatagcgggtagtgtt

SEQ ID NO: 16411 - DNA, 28 bp, Artificial Sequences
  Synthetic
tttgtgtttcgggaatagcgggtagtgt

SEQ ID NO: 16412 - DNA, 29 bp, Artificial Sequences
  Synthetic
agagttaggaggcggagttttttgtgagt

SEQ ID NO: 16413 - DNA, 30 bp, Artificial Sequences
  Synthetic
agagttaggaggcggagttttttgtgagtt

SEQ ID NO: 16414 - DNA, 31 bp, Artificial Sequences
  Synthetic
ggaggcggagttttttgtgagtttttaaggg

SEQ ID NO: 16415 - DNA, 31 bp, Artificial Sequences
  Synthetic
agagttaggaggcggagttttttgtgagttt

SEQ ID NO: 16416 - DNA, 32 bp, Artificial Sequences
  Synthetic
aggaggcggagttttttgtgagtttttaaggg

SEQ ID NO: 16417 - DNA, 27 bp, Artificial Sequences
  Synthetic
gttggagacgaggaggaggcggtgtac

SEQ ID NO: 16418 - DNA, 27 bp, Artificial Sequences
  Synthetic
gcggtttggtggagggcgttaagaagg

SEQ ID NO: 16419 - DNA, 27 bp, Artificial Sequences
  Synthetic
ggcggtttggtggagggcgttaagaag

SEQ ID NO: 16420 - DNA, 27 bp, Artificial Sequences
  Synthetic
cgtagtggcggcgttgttttgggtagt

SEQ ID NO: 16421 - DNA, 27 bp, Artificial Sequences
  Synthetic
tcgtagtggcggcgttgttttgggtag

SEQ ID NO: 16422 - DNA, 27 bp, Artificial Sequences
  Synthetic
tcgtcgttggtggggtcgggtatgttt

SEQ ID NO: 16423 - DNA, 27 bp, Artificial Sequences
  Synthetic
ttcgtcgttggtggggtcgggtatgtt

SEQ ID NO: 16424 - DNA, 27 bp, Artificial Sequences
  Synthetic
tttcgtcgttggtggggtcgggtatgt

SEQ ID NO: 16425 - DNA, 27 bp, Artificial Sequences
  Synthetic
tgtatttcgtcgttggtggggtcgggt

SEQ ID NO: 16426 - DNA, 27 bp, Artificial Sequences
  Synthetic
aggatgggagagttttcgggtgtgggc

SEQ ID NO: 16427 - DNA, 27 bp, Artificial Sequences
  Synthetic
gttggagacgaggaggaggcggtgtac

SEQ ID NO: 16428 - DNA, 26 bp, Artificial Sequences
  Synthetic
ttggagacgaggaggaggcggtgtac

SEQ ID NO: 16429 - DNA, 26 bp, Artificial Sequences
  Synthetic
gttggagacgaggaggaggcggtgta

SEQ ID NO: 16430 - DNA, 25 bp, Artificial Sequences
  Synthetic
gttggagacgaggaggaggcggtgt

SEQ ID NO: 16431 - DNA, 25 bp, Artificial Sequences
  Synthetic
tggagacgaggaggaggcggtgtac

SEQ ID NO: 16432 - DNA, 27 bp, Artificial Sequences
  Synthetic
aggatgggagagttttcgggtgtgggc

SEQ ID NO: 16433 - DNA, 27 bp, Artificial Sequences
  Synthetic
ggagagttttcgggtgtgggcggtttc

SEQ ID NO: 16434 - DNA, 27 bp, Artificial Sequences
  Synthetic
gggagagttttcgggtgtgggcggttt

SEQ ID NO: 16435 - DNA, 27 bp, Artificial Sequences
  Synthetic
gatgggagagttttcgggtgtgggcgg

SEQ ID NO: 16436 - DNA, 27 bp, Artificial Sequences
  Synthetic
ggatgggagagttttcgggtgtgggcg

SEQ ID NO: 16437 - DNA, 29 bp, Artificial Sequences
  Synthetic
cggacgttttttaggggatagtggtcggt

SEQ ID NO: 16438 - DNA, 28 bp, Artificial Sequences
  Synthetic
cggacgttttttaggggatagtggtcgg

SEQ ID NO: 16439 - DNA, 29 bp, Artificial Sequences
  Synthetic
tcggacgttttttaggggatagtggtcgg

SEQ ID NO: 16440 - DNA, 30 bp, Artificial Sequences
  Synthetic
tcggacgttttttaggggatagtggtcggt

SEQ ID NO: 16441 - DNA, 28 bp, Artificial Sequences
  Synthetic
tcggacgttttttaggggatagtggtcg

SEQ ID NO: 16442 - DNA, 28 bp, Artificial Sequences
  Synthetic
tgggttaggtttataggggaggcgtagt

SEQ ID NO: 16443 - DNA, 29 bp, Artificial Sequences
  Synthetic
ggtgttgtcggttattgttttttgggggg

SEQ ID NO: 16444 - DNA, 30 bp, Artificial Sequences
  Synthetic
ggtgttgtcggttattgttttttggggggt

SEQ ID NO: 16445 - DNA, 30 bp, Artificial Sequences
  Synthetic
aggtgttgtcggttattgttttttgggggg

SEQ ID NO: 16446 - DNA, 31 bp, Artificial Sequences
  Synthetic
aggtgttgtcggttattgttttttggggggt

SEQ ID NO: 16447 - DNA, 27 bp, Artificial Sequences
  Synthetic
aggtaggggattggacgcgtgggattt

SEQ ID NO: 16448 - DNA, 27 bp, Artificial Sequences
  Synthetic
aaggtaggggattggacgcgtgggatt

SEQ ID NO: 16449 - DNA, 27 bp, Artificial Sequences
  Synthetic
ttaaggtaggggattggacgcgtggga

SEQ ID NO: 16450 - DNA, 27 bp, Artificial Sequences
  Synthetic
taaggtaggggattggacgcgtgggat

SEQ ID NO: 16451 - DNA, 27 bp, Artificial Sequences
  Synthetic
ggtaggggattggacgcgtgggatttt

SEQ ID NO: 16452 - DNA, 27 bp, Artificial Sequences
  Synthetic
gttcggggttttagcgagcggtagtgc

SEQ ID NO: 16453 - DNA, 26 bp, Artificial Sequences
  Synthetic
ttcggggttttagcgagcggtagtgc

SEQ ID NO: 16454 - DNA, 26 bp, Artificial Sequences
  Synthetic
cgttagcgttcggggttttagcgagc

SEQ ID NO: 16455 - DNA, 25 bp, Artificial Sequences
  Synthetic
tcggggttttagcgagcggtagtgc

SEQ ID NO: 16456 - DNA, 26 bp, Artificial Sequences
  Synthetic
gttcggggttttagcgagcggtagtg

SEQ ID NO: 16457 - DNA, 27 bp, Artificial Sequences
  Synthetic
aggtaggggattggacgcgtgggattt

SEQ ID NO: 16458 - DNA, 27 bp, Artificial Sequences
  Synthetic
aaggtaggggattggacgcgtgggatt

SEQ ID NO: 16459 - DNA, 27 bp, Artificial Sequences
  Synthetic
ttaaggtaggggattggacgcgtggga

SEQ ID NO: 16460 - DNA, 27 bp, Artificial Sequences
  Synthetic
taaggtaggggattggacgcgtgggat

SEQ ID NO: 16461 - DNA, 27 bp, Artificial Sequences
  Synthetic
ggtaggggattggacgcgtgggatttt

SEQ ID NO: 16462 - DNA, 27 bp, Artificial Sequences
  Synthetic
aattcggcggggttagtgtatcggggg

SEQ ID NO: 16463 - DNA, 27 bp, Artificial Sequences
  Synthetic
tgtgtgggaattcggcggggttagtgt

SEQ ID NO: 16464 - DNA, 27 bp, Artificial Sequences
  Synthetic
gttcggggttttagcgagcggtagtgc

SEQ ID NO: 16465 - DNA, 27 bp, Artificial Sequences
  Synthetic
gtgtgtgggaattcggcggggttagtg

SEQ ID NO: 16466 - DNA, 27 bp, Artificial Sequences
  Synthetic
gttagcgacgggtgtgtgggaattcgg

SEQ ID NO: 16467 - DNA, 27 bp, Artificial Sequences
  Synthetic
gattatcgggtcgggggcggtggttta

SEQ ID NO: 16468 - DNA, 27 bp, Artificial Sequences
  Synthetic
attatcgggtcgggggcggtggtttac

SEQ ID NO: 16469 - DNA, 27 bp, Artificial Sequences
  Synthetic
aattgattatcgggtcgggggcggtgg

SEQ ID NO: 16470 - DNA, 27 bp, Artificial Sequences
  Synthetic
ggtcgggggcggtggtttacgtttgta

SEQ ID NO: 16471 - DNA, 27 bp, Artificial Sequences
  Synthetic
aaattgattatcgggtcgggggcggtg

SEQ ID NO: 16472 - DNA, 29 bp, Artificial Sequences
  Synthetic
cggggttttatcgtgttggttaggttggt

SEQ ID NO: 16473 - DNA, 28 bp, Artificial Sequences
  Synthetic
cggggttttatcgtgttggttaggttgg

SEQ ID NO: 16474 - DNA, 28 bp, Artificial Sequences
  Synthetic
agtcggggttttatcgtgttggttaggt

SEQ ID NO: 16475 - DNA, 29 bp, Artificial Sequences
  Synthetic
tcggggttttatcgtgttggttaggttgg

SEQ ID NO: 16476 - DNA, 30 bp, Artificial Sequences
  Synthetic
tcggggttttatcgtgttggttaggttggt

SEQ ID NO: 16477 - DNA, 27 bp, Artificial Sequences
  Synthetic
tttgggagttcgaggcgggcggattat

SEQ ID NO: 16478 - DNA, 27 bp, Artificial Sequences
  Synthetic
tattttgggagttcgaggcgggcggat

SEQ ID NO: 16479 - DNA, 27 bp, Artificial Sequences
  Synthetic
atattttgggagttcgaggcgggcgga

SEQ ID NO: 16480 - DNA, 27 bp, Artificial Sequences
  Synthetic
gattatcgggtcgggggcggtggttta

SEQ ID NO: 16481 - DNA, 27 bp, Artificial Sequences
  Synthetic
ttttgggagttcgaggcgggcggatta

SEQ ID NO: 16482 - DNA, 29 bp, Artificial Sequences
  Synthetic
cggggttttatcgtgttggttaggttggt

SEQ ID NO: 16483 - DNA, 28 bp, Artificial Sequences
  Synthetic
cggggttttatcgtgttggttaggttgg

SEQ ID NO: 16484 - DNA, 28 bp, Artificial Sequences
  Synthetic
agtcggggttttatcgtgttggttaggt

SEQ ID NO: 16485 - DNA, 29 bp, Artificial Sequences
  Synthetic
tcggggttttatcgtgttggttaggttgg

SEQ ID NO: 16486 - DNA, 30 bp, Artificial Sequences; identical to SEQ ID NO: 16476
  Synthetic

SEQ ID NO: 16487 - DNA, 32 bp, Artificial Sequences
  Synthetic
gagatggtagtggtatcgtttcggtttatcgt

SEQ ID NO: 16488 - DNA, 32 bp, Artificial Sequences
  Synthetic
tgagatggtagtggtatcgtttcggtttatcg

SEQ ID NO: 16489 - DNA, 33 bp, Artificial Sequences
  Synthetic
tgagatggtagtggtatcgtttcggtttatcgt

SEQ ID NO: 16490 - DNA, 33 bp, Artificial Sequences
  Synthetic
tgttttttgagatggtagtggtatcgtttcggt

SEQ ID NO: 16491 - DNA, 33 bp, Artificial Sequences
  Synthetic
ttgagatggtagtggtatcgtttcggtttatcg

SEQ ID NO: 16492 - DNA, 23 bp, Artificial Sequences
  Synthetic
cggaggttgcggtgagtcgagac

SEQ ID NO: 16493 - DNA, 22 bp, Artificial Sequences
  Synthetic
cggaggttgcggtgagtcgaga

SEQ ID NO: 16494 - DNA, 27 bp, Artificial Sequences
  Synthetic
cgtttaggttggagtatagtggggcga

SEQ ID NO: 16495 - DNA, 27 bp, Artificial Sequences
  Synthetic
tcgtttaggttggagtatagtggggcg

SEQ ID NO: 16496 - DNA, 28 bp, Artificial Sequences
  Synthetic
tcgtttaggttggagtatagtggggcga

SEQ ID NO: 16497 - DNA, 29 bp, Artificial Sequences
  Synthetic
tgtcgtttaggttggagtatagtggggcg

SEQ ID NO: 16498 - DNA, 28 bp, Artificial Sequences
  Synthetic
gtcgtttaggttggagtatagtggggcg

SEQ ID NO: 16499 - DNA, 27 bp, Artificial Sequences
  Synthetic
gcgtgggtatagggagagggaggggat

SEQ ID NO: 16500 - DNA, 27 bp, Artificial Sequences
  Synthetic
gcgtgggggaaggaagagggtatgagg

SEQ ID NO: 16501 - DNA, 27 bp, Artificial Sequences
  Synthetic
aggagcgtgggtatagggagagggagg

SEQ ID NO: 16502 - DNA, 27 bp, Artificial Sequences
  Synthetic
gagcgtgggtatagggagagggagggg

SEQ ID NO: 16503 - DNA, 27 bp, Artificial Sequences
  Synthetic
ggagcgtgggtatagggagagggaggg

SEQ ID NO: 16504 - DNA, 28 bp, Artificial Sequences
  Synthetic
tgttttggggtattaggttgggggaagg

SEQ ID NO: 16505 - DNA, 29 bp, Artificial Sequences
  Synthetic
atgttttggggtattaggttgggggaagg

SEQ ID NO: 16506 - DNA, 30 bp, Artificial Sequences
  Synthetic
aatgttttggggtattaggttgggggaagg

SEQ ID NO: 16507 - DNA, 31 bp, Artificial Sequences
  Synthetic
gaatgttttggggtattaggttgggggaagg

SEQ ID NO: 16508 - DNA, 30 bp, Artificial Sequences
  Synthetic
agaatgttttggggtattaggttgggggaa

SEQ ID NO: 16509 - DNA, 27 bp, Artificial Sequences
  Synthetic
ttgcggggtttgttcgtagtttgggcg

SEQ ID NO: 16510 - DNA, 27 bp, Artificial Sequences
  Synthetic
cggggtttgttcgtagtttgggcggtt

SEQ ID NO: 16511 - DNA, 27 bp, Artificial Sequences
  Synthetic
gcgggtgttttgcggggtttgttcgta

SEQ ID NO: 16512 - DNA, 27 bp, Artificial Sequences
  Synthetic
tcgtagtttgggcggttttttgggggg

SEQ ID NO: 16513 - DNA, 28 bp, Artificial Sequences
  Synthetic
gggcggttttttggggggttattagcgg

SEQ ID NO: 16514 - DNA, 27 bp, Artificial Sequences
  Synthetic
aagtaggaagaagaaggggagcgcggg

SEQ ID NO: 16515 - DNA, 27 bp, Artificial Sequences
  Synthetic
gggtaggcgaggttaagggttaggcgt

SEQ ID NO: 16516 - DNA, 27 bp, Artificial Sequences
  Synthetic
agggtaggcgaggttaagggttaggcg

SEQ ID NO: 16517 - DNA, 27 bp, Artificial Sequences
  Synthetic
gcgtcggggtttatgttagggtaggcg

SEQ ID NO: 16518 - DNA, 28 bp, Artificial Sequences
  Synthetic
gaagtaggaagaagaaggggagcgcggg

SEQ ID NO: 16519 - DNA, 28 bp, Artificial Sequences
  Synthetic
gcggttttggatttagtgggcgtttggt

SEQ ID NO: 16520 - DNA, 27 bp, Artificial Sequences
  Synthetic
gcggttttggatttagtgggcgtttgg

SEQ ID NO: 16521 - DNA, 27 bp, Artificial Sequences
  Synthetic
cgtttgttttggtatgggtttcggcgt

SEQ ID NO: 16522 - DNA, 27 bp, Artificial Sequences
  Synthetic
agtgggcgtttggtttttggtttcgtt

SEQ ID NO: 16523 - DNA, 28 bp, Artificial Sequences
  Synthetic
tcgtttgttttggtatgggtttcggcgt

SEQ ID NO: 16524 - DNA, 27 bp, Artificial Sequences
  Synthetic
tcggtcggcgcgttttttatcgttttc

SEQ ID NO: 16525 - DNA, 28 bp, Artificial Sequences
  Synthetic
tgatttcggtcggcgcgttttttatcgt

SEQ ID NO: 16526 - DNA, 27 bp, Artificial Sequences
  Synthetic
gatttcggtcggcgcgttttttatcgt

SEQ ID NO: 16527 - DNA, 27 bp, Artificial Sequences
  Synthetic
ttcggtcggcgcgttttttatcgtttt

SEQ ID NO: 16528 - DNA, 27 bp, Artificial Sequences
  Synthetic
tttcggtcggcgcgttttttatcgttt

SEQ ID NO: 16529 - DNA, 23 bp, Artificial Sequences
  Synthetic
ggtttcggaagcggtgggaggcg

SEQ ID NO: 16530 - DNA, 23 bp, Artificial Sequences
  Synthetic
gtttcggaagcggtgggaggcgc

SEQ ID NO: 16531 - DNA, 22 bp, Artificial Sequences
  Synthetic
tttcggaagcggtgggaggcgc

SEQ ID NO: 16532 - DNA, 24 bp, Artificial Sequences
  Synthetic
ggtttcggaagcggtgggaggcgc

SEQ ID NO: 16533 - DNA, 25 bp, Artificial Sequences
  Synthetic
gtttcggaagcggtgggaggcgcgt

SEQ ID NO: 16534 - DNA, 27 bp, Artificial Sequences
  Synthetic
tttaggggtttgatttcggtcggcgcg

SEQ ID NO: 16535 - DNA, 27 bp, Artificial Sequences
  Synthetic
ggggtttgatttcggtcggcgcgtttt

SEQ ID NO: 16536 - DNA, 27 bp, Artificial Sequences
  Synthetic
taggggtttgatttcggtcggcgcgtt

SEQ ID NO: 16537 - DNA, 27 bp, Artificial Sequences
  Synthetic
ttaggggtttgatttcggtcggcgcgt

SEQ ID NO: 16538 - DNA, 27 bp, Artificial Sequences
  Synthetic
gggtttgatttcggtcggcgcgttttt

SEQ ID NO: 16539 - DNA, 27 bp, Artificial Sequences
  Synthetic
ggagttaggtttttgggggtcgtgcgc

SEQ ID NO: 16540 - DNA, 27 bp, Artificial Sequences
  Synthetic
cggagttaggtttttgggggtcgtgcg

SEQ ID NO: 16541 - DNA, 27 bp, Artificial Sequences
  Synthetic
cggtcggagttaggtttttgggggtcg

SEQ ID NO: 16542 - DNA, 28 bp, Artificial Sequences
  Synthetic
tcggtcggagttaggtttttgggggtcg

SEQ ID NO: 16543 - DNA, 27 bp, Artificial Sequences
  Synthetic
tcggagttaggtttttgggggtcgtgc

SEQ ID NO: 16544 - DNA, 27 bp, Artificial Sequences
  Synthetic
ttaggaagtttcgggttaagagggcgc

SEQ ID NO: 16545 - DNA, 24 bp, Artificial Sequences
  Synthetic
cgaggggtcggaggaggtttcgga

SEQ ID NO: 16546 - DNA, 28 bp, Artificial Sequences
  Synthetic
tttaggaagtttcgggttaagagggcgc

SEQ ID NO: 16547 - DNA, 26 bp, Artificial Sequences
  Synthetic
taggaagtttcgggttaagagggcgc

SEQ ID NO: 16548 - DNA, 25 bp, Artificial Sequences
  Synthetic
aggaagtttcgggttaagagggcgc

SEQ ID NO: 16549 - DNA, 27 bp, Artificial Sequences
  Synthetic
ggagttaggtttttgggggtcgtgcgc

SEQ ID NO: 16550 - DNA, 27 bp, Artificial Sequences
  Synthetic
cggagttaggtttttgggggtcgtgcg

SEQ ID NO: 16551 - DNA, 27 bp, Artificial Sequences
  Synthetic
cggtcggagttaggtttttgggggtcg

SEQ ID NO: 16552 - DNA, 28 bp, Artificial Sequences
  Synthetic
tcggtcggagttaggtttttgggggtcg

SEQ ID NO: 16553 - DNA, 27 bp, Artificial Sequences
  Synthetic
tcggagttaggtttttgggggtcgtgc

SEQ ID NO: 16554 - DNA, 27 bp, Artificial Sequences
  Synthetic
gggggaggtattggcgtttttggtcgt

SEQ ID NO: 16555 - DNA, 27 bp, Artificial Sequences
  Synthetic
tgggggaggtattggcgtttttggtcg

SEQ ID NO: 16556 - DNA, 28 bp, Artificial Sequences
  Synthetic
tgggggaggtattggcgtttttggtcgt

SEQ ID NO: 16557 - DNA, 28 bp, Artificial Sequences
  Synthetic
gggggaggtattggcgtttttggtcgtt

SEQ ID NO: 16558 - DNA, 28 bp, Artificial Sequences
  Synthetic
ttgggggaggtattggcgtttttggtcg

SEQ ID NO: 16559 - DNA, 27 bp, Artificial Sequences
  Synthetic
ggagttaggtttttgggggtcgtgcgc

SEQ ID NO: 16560 - DNA, 27 bp, Artificial Sequences
  Synthetic
cggagttaggtttttgggggtcgtgcg

SEQ ID NO: 16561 - DNA, 27 bp, Artificial Sequences
  Synthetic
cggtcggagttaggtttttgggggtcg

SEQ ID NO: 16562 - DNA, 28 bp, Artificial Sequences
  Synthetic
tcggtcggagttaggtttttgggggtcg

SEQ ID NO: 16563 - DNA, 27 bp, Artificial Sequences
  Synthetic
tcggagttaggtttttgggggtcgtgc

SEQ ID NO: 16564 - DNA, 27 bp, Artificial Sequences
  Synthetic
gggggaggtattggcgtttttggtcgt

SEQ ID NO: 16565 - DNA, 27 bp, Artificial Sequences
  Synthetic
tgggggaggtattggcgtttttggtcg

SEQ ID NO: 16566 - DNA, 28 bp, Artificial Sequences
  Synthetic
tgggggaggtattggcgtttttggtcgt

SEQ ID NO: 16567 - DNA, 28 bp, Artificial Sequences
  Synthetic
gggggaggtattggcgtttttggtcgtt

SEQ ID NO: 16568 - DNA, 28 bp, Artificial Sequences
  Synthetic
ttgggggaggtattggcgtttttggtcg

SEQ ID NO: 16569 - DNA, 27 bp, Artificial Sequences
  Synthetic
tcgtttggggagggagattcggttgcg

SEQ ID NO: 16570 - DNA, 27 bp, Artificial Sequences
  Synthetic
cgtttggggagggagattcggttgcgt

SEQ ID NO: 16571 - DNA, 27 bp, Artificial Sequences
  Synthetic
gtttggggagggagattcggttgcgtt

SEQ ID NO: 16572 - DNA, 27 bp, Artificial Sequences
  Synthetic
ttcgtttggggagggagattcggttgc

SEQ ID NO: 16573 - DNA, 28 bp, Artificial Sequences
  Synthetic
ggggagggagattcggttgcgttaaggt

SEQ ID NO: 16574 - DNA, 27 bp, Artificial Sequences
  Synthetic
ggggatgacggggattttcgggagtgt

SEQ ID NO: 16575 - DNA, 27 bp, Artificial Sequences
  Synthetic
cgtggttttttcgggggttggagcgag

SEQ ID NO: 16576 - DNA, 27 bp, Artificial Sequences
  Synthetic
agaaggttgggcgtggttttttcgggg

SEQ ID NO: 16577 - DNA, 27 bp, Artificial Sequences
  Synthetic
gaaggttgggcgtggttttttcggggg

SEQ ID NO: 16578 - DNA, 27 bp, Artificial Sequences
  Synthetic
gtggttttttcgggggttggagcgagt

SEQ ID NO: 16579 - DNA, 35 bp, Artificial Sequences
  Synthetic
acgttttattagagtatttgaggttagcgcgtttc

SEQ ID NO: 16580 - DNA, 36 bp, Artificial Sequences
  Synthetic
ggattacgttttattagagtatttgaggttagcgcg

SEQ ID NO: 16581 - DNA, 27 bp, Artificial Sequences
  Synthetic
aaggttcggggcgcgttagttttaagt

SEQ ID NO: 16582 - DNA, 27 bp, Artificial Sequences
  Synthetic
agaaggttcggggcgcgttagttttaa

SEQ ID NO: 16583 - DNA, 27 bp, Artificial Sequences
  Synthetic
ttagaaggttcggggcgcgttagtttt

SEQ ID NO: 16584 - DNA, 27 bp, Artificial Sequences
  Synthetic
tttagaaggttcggggcgcgttagttt

SEQ ID NO: 16585 - DNA, 27 bp, Artificial Sequences
  Synthetic
ttttagaaggttcggggcgcgttagtt

SEQ ID NO: 16586 - DNA, 27 bp, Artificial Sequences
  Synthetic
gtatagggttttgggcgtgcggggttg

SEQ ID NO: 16587 - DNA, 27 bp, Artificial Sequences
  Synthetic
gatggggtatagggttttgggcgtgcg

SEQ ID NO: 16588 - DNA, 27 bp, Artificial Sequences
  Synthetic
atggggtatagggttttgggcgtgcgg

SEQ ID NO: 16589 - DNA, 27 bp, Artificial Sequences
  Synthetic
tatagggttttgggcgtgcggggttgg

SEQ ID NO: 16590 - DNA, 27 bp, Artificial Sequences
  Synthetic
ggtatagggttttgggcgtgcggggtt

SEQ ID NO: 16591 - DNA, 27 bp, Artificial Sequences
  Synthetic
gtatagggttttgggcgtgcggggttg

SEQ ID NO: 16592 - DNA, 27 bp, Artificial Sequences
  Synthetic
gtaggaagtaggggcggttgttggggg

SEQ ID NO: 16593 - DNA, 27 bp, Artificial Sequences
  Synthetic
gaagtaggggcggttgttgggggtttg

SEQ ID NO: 16594 - DNA, 27 bp, Artificial Sequences
  Synthetic
gatggggtatagggttttgggcgtgcg

SEQ ID NO: 16595 - DNA, 27 bp, Artificial Sequences
  Synthetic
agtaggaagtaggggcggttgttgggg

SEQ ID NO: 16596 - DNA, 27 bp, Artificial Sequences
  Synthetic
cgtcgggtggggtagcgttggttagtt

SEQ ID NO: 16597 - DNA, 27 bp, Artificial Sequences
  Synthetic
tcggagtttagtttttaggggcggcgg

SEQ ID NO: 16598 - DNA, 26 bp, Artificial Sequences
  Synthetic
cgtcgggtggggtagcgttggttagt

SEQ ID NO: 16599 - DNA, 27 bp, Artificial Sequences
  Synthetic
gtcgggtggggtagcgttggttagttt

SEQ ID NO: 16600 - DNA, 28 bp, Artificial Sequences
  Synthetic
cgtcgggtggggtagcgttggttagttt

SEQ ID NO: 16601 - DNA, 27 bp, Artificial Sequences
  Synthetic
atcggagggtgggggcggtttagtttt

SEQ ID NO: 16602 - DNA, 27 bp, Artificial Sequences
  Synthetic
acggtaggaggggcggggttttttgaa

SEQ ID NO: 16603 - DNA, 27 bp, Artificial Sequences
  Synthetic
tagcggtagtttgtggggtggttgggg

SEQ ID NO: 16604 - DNA, 27 bp, Artificial Sequences
  Synthetic
tttgcgggagggggagggttgttagtg

SEQ ID NO: 16605 - DNA, 27 bp, Artificial Sequences
  Synthetic
gtttgcgggagggggagggttgttagt

SEQ ID NO: 16606 - DNA, 27 bp, Artificial Sequences
  Synthetic
aggttttgcgcgtagttttggggggtg

SEQ ID NO: 16607 - DNA, 27 bp, Artificial Sequences
  Synthetic
ggttttgcgcgtagttttggggggtgt

SEQ ID NO: 16608 - DNA, 27 bp, Artificial Sequences
  Synthetic
tatttttcggtgttgggtggagcggcg

SEQ ID NO: 16609 - DNA, 27 bp, Artificial Sequences
  Synthetic
gaggttttgcgcgtagttttggggggt

SEQ ID NO: 16610 - DNA, 27 bp, Artificial Sequences
  Synthetic
tggaggttttgcgcgtagttttggggg

SEQ ID NO: 16611 - DNA, 27 bp, Artificial Sequences
  Synthetic
tggaggcgtggtttagggaagtttcgt

SEQ ID NO: 16612 - DNA, 27 bp, Artificial Sequences
  Synthetic
ttcggttcgttttttatgttgcgcgcg

SEQ ID NO: 16613 - DNA, 28 bp, Artificial Sequences
  Synthetic
tggaggcgtggtttagggaagtttcgtt

SEQ ID NO: 16614 - DNA, 28 bp, Artificial Sequences
  Synthetic
ttggaggcgtggtttagggaagtttcgt

SEQ ID NO: 16615 - DNA, 27 bp, Artificial Sequences
  Synthetic
ggaggcgtggtttagggaagtttcgtt

SEQ ID NO: 16616 - DNA, 27 bp, Artificial Sequences
  Synthetic
atttatacggggtggagggagcggtgc

SEQ ID NO: 16617 - DNA, 27 bp, Artificial Sequences
  Synthetic
aagcgcgggggagttgggaagtttaga

SEQ ID NO: 16618 - DNA, 27 bp, Artificial Sequences
  Synthetic
agaagcgcgggggagttgggaagttta

SEQ ID NO: 16619 - DNA, 27 bp, Artificial Sequences
  Synthetic
tagaagcgcgggggagttgggaagttt

SEQ ID NO: 16620 - DNA, 27 bp, Artificial Sequences
  Synthetic
gcgcggggtaggacgttgggttagtaa

SEQ ID NO: 16621 - DNA, 31 bp, Artificial Sequences
  Synthetic
cgggttttgttttcgttcgttttgttttggg

SEQ ID NO: 16622 - DNA, 32 bp, Artificial Sequences
  Synthetic
cgggttttgttttcgttcgttttgttttgggt

SEQ ID NO: 16623 - DNA, 32 bp, Artificial Sequences
  Synthetic
acgggttttgttttcgttcgttttgttttggg

SEQ ID NO: 16624 - DNA, 33 bp, Artificial Sequences
  Synthetic
acgggttttgttttcgttcgttttgttttgggt

SEQ ID NO: 16625 - DNA, 31 bp, Artificial Sequences
  Synthetic
acgggttttgttttcgttcgttttgttttgg

SEQ ID NO: 16626 - DNA, 27 bp, Artificial Sequences
  Synthetic
ggttgggaggtttttcgggcgggaatt

SEQ ID NO: 16627 - DNA, 27 bp, Artificial Sequences
  Synthetic
aggttgggaggtttttcgggcgggaat

SEQ ID NO: 16628 - DNA, 27 bp, Artificial Sequences
  Synthetic
ttttttcgtcgggattggggttgcggc

SEQ ID NO: 16629 - DNA, 27 bp, Artificial Sequences
  Synthetic
gaggttgggaggtttttcgggcgggaa

SEQ ID NO: 16630 - DNA, 27 bp, Artificial Sequences
  Synthetic
gtcgggggcgaggttgggaggtttttc

SEQ ID NO: 16631 - DNA, 27 bp, Artificial Sequences
  Synthetic
cgtagttttagtttcggcgggggaggt

SEQ ID NO: 16632 - DNA, 28 bp, Artificial Sequences
  Synthetic
tcgtagttttagtttcggcgggggaggt

SEQ ID NO: 16633 - DNA, 27 bp, Artificial Sequences
  Synthetic
tagttttagtttcggcgggggaggtcg

SEQ ID NO: 16634 - DNA, 27 bp, Artificial Sequences
  Synthetic
tcgtagttttagtttcggcgggggagg

SEQ ID NO: 16635 - DNA, 28 bp, Artificial Sequences
  Synthetic
gtagttttagtttcggcgggggaggtcg

SEQ ID NO: 16636 - DNA, 27 bp, Artificial Sequences
  Synthetic
ggttgcgaaggggaggtttggggagta

SEQ ID NO: 16637 - DNA, 27 bp, Artificial Sequences
  Synthetic
ttgcgaaggggaggtttggggagtagg

SEQ ID NO: 16638 - DNA, 27 bp, Artificial Sequences
  Synthetic
gatggttgcgaaggggaggtttgggga

SEQ ID NO: 16639 - DNA, 27 bp, Artificial Sequences
  Synthetic
atggttgcgaaggggaggtttggggag

SEQ ID NO: 16640 - DNA, 27 bp, Artificial Sequences
  Synthetic
ttttttcgtcgggattggggttgcggc

SEQ ID NO: 16641 - DNA, 27 bp, Artificial Sequences
  Synthetic
agtcgggcgcggtggtttacgtttata

SEQ ID NO: 16642 - DNA, 27 bp, Artificial Sequences
  Synthetic
tagtcgggcgcggtggtttacgtttat

SEQ ID NO: 16643 - DNA, 27 bp, Artificial Sequences
  Synthetic
atagtcgggcgcggtggtttacgttta

SEQ ID NO: 16644 - DNA, 27 bp, Artificial Sequences
  Synthetic
tatagtcgggcgcggtggtttacgttt

SEQ ID NO: 16645 - DNA, 27 bp, Artificial Sequences
  Synthetic
atatagtcgggcgcggtggtttacgtt

SEQ ID NO: 16646 - DNA, 27 bp, Artificial Sequences
  Synthetic
tcgggggaggttagcgggggttatagt

SEQ ID NO: 16647 - DNA, 27 bp, Artificial Sequences
  Synthetic
atgggaaattcgggggaggttagcggg

SEQ ID NO: 16648 - DNA, 27 bp, Artificial Sequences
  Synthetic
gaaattcgggggaggttagcgggggtt

SEQ ID NO: 16649 - DNA, 27 bp, Artificial Sequences
  Synthetic
cgggggaggttagcgggggttatagtg

SEQ ID NO: 16650 - DNA, 27 bp, Artificial Sequences
  Synthetic
aaattcgggggaggttagcgggggtta

SEQ ID NO: 16651 - DNA, 28 bp, Artificial Sequences
  Synthetic
aggattaggaggaggttgatgtggtggt

SEQ ID NO: 16652 - DNA, 29 bp, Artificial Sequences
  Synthetic
gaggattaggaggaggttgatgtggtggt

SEQ ID NO: 16653 - DNA, 28 bp, Artificial Sequences
  Synthetic
agtttggagtgagggtttggagaagagg

SEQ ID NO: 16654 - DNA, 28 bp, Artificial Sequences
  Synthetic
gtttggagtgagggtttggagaagagga

SEQ ID NO: 16655 - DNA, 28 bp, Artificial Sequences
  Synthetic
gaggattaggaggaggttgatgtggtgg

SEQ ID NO: 16656 - DNA, 27 bp, Artificial Sequences
  Synthetic
aggttcggttgcgcggtaatatcgtcg

SEQ ID NO: 16657 - DNA, 27 bp, Artificial Sequences
  Synthetic
cgttgggggattcgtggattcgtttcg

SEQ ID NO: 16658 - DNA, 28 bp, Artificial Sequences
  Synthetic
tcgttgggggattcgtggattcgtttcg

SEQ ID NO: 16659 - DNA, 27 bp, Artificial Sequences
  Synthetic
tttacgttttaggttcggttgcgcggt

SEQ ID NO: 16660 - DNA, 28 bp, Artificial Sequences
  Synthetic
gggttcgatttgtagaaggtgtggcggt

SEQ ID NO: 16661 - DNA, 27 bp, Artificial Sequences
  Synthetic
tcgttgtaggggggttcgagggtttgg

SEQ ID NO: 16662 - DNA, 27 bp, Artificial Sequences
  Synthetic
gttgtaggggggttcgagggtttgggg

SEQ ID NO: 16663 - DNA, 27 bp, Artificial Sequences
  Synthetic
cgttgtaggggggttcgagggtttggg

SEQ ID NO: 16664 - DNA, 27 bp, Artificial Sequences
  Synthetic
ggttcgagggtttggggcgggttttat

SEQ ID NO: 16665 - DNA, 27 bp, Artificial Sequences
  Synthetic
gggttcgagggtttggggcgggtttta

SEQ ID NO: 16666 - DNA, 32 bp, Artificial Sequences
  Synthetic
ggcgtggaaattataggtttttgtttcgtggt

SEQ ID NO: 16667 - DNA, 32 bp, Artificial Sequences
  Synthetic
aggcgtggaaattataggtttttgtttcgtgg

SEQ ID NO: 16668 - DNA, 33 bp, Artificial Sequences
  Synthetic
aggcgtggaaattataggtttttgtttcgtggt

SEQ ID NO: 16669 - DNA, 33 bp, Artificial Sequences
  Synthetic
ggcgtggaaattataggtttttgtttcgtggta

SEQ ID NO: 16670 - DNA, 33 bp, Artificial Sequences
  Synthetic
taggcgtggaaattataggtttttgtttcgtgg

SEQ ID NO: 16671 - DNA, 28 bp, Artificial Sequences
  Synthetic
ggttgtttgtattatcggtgttggcggt

SEQ ID NO: 16672 - DNA, 29 bp, Artificial Sequences
  Synthetic
aggttgtttgtattatcggtgttggcggt

SEQ ID NO: 16673 - DNA, 28 bp, Artificial Sequences
  Synthetic
aggttgtttgtattatcggtgttggcgg

SEQ ID NO: 16674 - DNA, 29 bp, Artificial Sequences
  Synthetic
ggttgtttgtattatcggtgttggcggtt

SEQ ID NO: 16675 - DNA, 30 bp, Artificial Sequences
  Synthetic
aggttgtttgtattatcggtgttggcggtt

SEQ ID NO: 16676 - DNA, 31 bp, Artificial Sequences
  Synthetic
aggaatgtgagggtttttaaatgatcggggt

SEQ ID NO: 16677 - DNA, 31 bp, Artificial Sequences
  Synthetic
ggaatgtgagggtttttaaatgatcggggtc

SEQ ID NO: 16678 - DNA, 31 bp, Artificial Sequences
  Synthetic
gaggaatgtgagggtttttaaatgatcgggg

SEQ ID NO: 16679 - DNA, 32 bp, Artificial Sequences
  Synthetic
aggaatgtgagggtttttaaatgatcggggtc

SEQ ID NO: 16680 - DNA, 32 bp, Artificial Sequences
  Synthetic
gaggaatgtgagggtttttaaatgatcggggt

SEQ ID NO: 16681 - DNA, 27 bp, Artificial Sequences
  Synthetic
gttgggagtagggtgtgattgttgcgt

SEQ ID NO: 16682 - DNA, 28 bp, Artificial Sequences
  Synthetic
agttgggagtagggtgtgattgttgcgt

SEQ ID NO: 16683 - DNA, 27 bp, Artificial Sequences
  Synthetic
agttgggagtagggtgtgattgttgcg

SEQ ID NO: 16684 - DNA, 27 bp, Artificial Sequences
  Synthetic
ttgggagtagggtgtgattgttgcgtt

SEQ ID NO: 16685 - DNA, 28 bp, Artificial Sequences
  Synthetic
gttgggagtagggtgtgattgttgcgtt

SEQ ID NO: 16686 - DNA, 28 bp, Artificial Sequences
  Synthetic
tgcggttgtgtaggtttttgatggttgt

SEQ ID NO: 16687 - DNA, 29 bp, Artificial Sequences
  Synthetic
aggtatcggtttattgcggttgtgtaggt

SEQ ID NO: 16688 - DNA, 29 bp, Artificial Sequences
  Synthetic
tgcggttgtgtaggtttttgatggttgtt

SEQ ID NO: 16689 - DNA, 29 bp, Artificial Sequences
  Synthetic
ttgcggttgtgtaggtttttgatggttgt

SEQ ID NO: 16690 - DNA, 30 bp, Artificial Sequences
  Synthetic
aggtatcggtttattgcggttgtgtaggtt

SEQ ID NO: 16691 - DNA, 27 bp, Artificial Sequences
  Synthetic
aggtgaaggtggaggggttttgtggtt

SEQ ID NO: 16692 - DNA, 27 bp, Artificial Sequences
  Synthetic
taggtgaaggtggaggggttttgtggt

SEQ ID NO: 16693 - DNA, 27 bp, Artificial Sequences
  Synthetic
ggtgaaggtggaggggttttgtggttt

SEQ ID NO: 16694 - DNA, 28 bp, Artificial Sequences
  Synthetic
aggtgaaggtggaggggttttgtggttt

SEQ ID NO: 16695 - DNA, 26 bp, Artificial Sequences
  Synthetic
aggtgaaggtggaggggttttgtggt

SEQ ID NO: 16696 - DNA, 27 bp, Artificial Sequences
  Synthetic
aggaggtatttgcggttaggggcgagg

SEQ ID NO: 16697 - DNA, 27 bp, Artificial Sequences
  Synthetic
gtatttgcggttaggggcgaggcgttt

SEQ ID NO: 16698 - DNA, 27 bp, Artificial Sequences
  Synthetic
atttgcggttaggggcgaggcgtttag

SEQ ID NO: 16699 - DNA, 27 bp, Artificial Sequences
  Synthetic
ggaggtatttgcggttaggggcgaggc

SEQ ID NO: 16700 - DNA, 27 bp, Artificial Sequences
  Synthetic
cggttaggggcgaggcgtttaggttcg

SEQ ID NO: 16701 - DNA, 36 bp, Artificial Sequences
  Synthetic
ttttttatgtttggtagtttggttatgggttcggtt

SEQ ID NO: 16702 - DNA, 27 bp, Artificial Sequences
  Synthetic
gtggtggtggtggttgtggtggtgttg

SEQ ID NO: 16703 - DNA, 27 bp, Artificial Sequences
  Synthetic
acgggtggttgaaggcgtagtggtgtt

SEQ ID NO: 16704 - DNA, 27 bp, Artificial Sequences
  Synthetic
ggtggtggtggttgtggtggtgttgtt

SEQ ID NO: 16705 - DNA, 27 bp, Artificial Sequences
  Synthetic
attttgtggggttggtggtggtggtgg

SEQ ID NO: 16706 - DNA, 27 bp, Artificial Sequences
  Synthetic
tggtggtggtggttgtggtggtgttgt

SEQ ID NO: 16707 - DNA, 27 bp, Artificial Sequences
  Synthetic
cgtcggttgcggcgttgagttttttag

SEQ ID NO: 16708 - DNA, 27 bp, Artificial Sequences
  Synthetic
aggtcgcggtttatttgttgggttcgt

SEQ ID NO: 16709 - DNA, 28 bp, Artificial Sequences
  Synthetic
cgtcggttgcggcgttgagttttttaga

SEQ ID NO: 16710 - DNA, 26 bp, Artificial Sequences
  Synthetic
gggtttgggagagttgaaggggacgt

SEQ ID NO: 16711 - DNA, 29 bp, Artificial Sequences
  Synthetic
cggttgcggcgttgagttttttagagtcg

SEQ ID NO: 16712 - DNA, 27 bp, Artificial Sequences
  Synthetic
aggtgggttttaggcggtaggttcggg

SEQ ID NO: 16713 - DNA, 27 bp, Artificial Sequences
  Synthetic
ttttaggcggtaggttcgggtggtggg

SEQ ID NO: 16714 - DNA, 27 bp, Artificial Sequences
  Synthetic
tgggttttaggcggtaggttcgggtgg

SEQ ID NO: 16715 - DNA, 27 bp, Artificial Sequences
  Synthetic
gggttttaggcggtaggttcgggtggt

SEQ ID NO: 16716 - DNA, 27 bp, Artificial Sequences
  Synthetic
ggtgggttttaggcggtaggttcgggt

SEQ ID NO: 16717 - DNA, 27 bp, Artificial Sequences
  Synthetic
agcgagggggtttgggagagttgaagg

SEQ ID NO: 16718 - DNA, 27 bp, Artificial Sequences
  Synthetic
ggggtttgggagagttgaaggggacgt

SEQ ID NO: 16719 - DNA, 27 bp, Artificial Sequences
  Synthetic
cgagggggtttgggagagttgaagggg

SEQ ID NO: 16720 - DNA, 27 bp, Artificial Sequences
  Synthetic
gggggtttgggagagttgaaggggacg

SEQ ID NO: 16721 - DNA, 27 bp, Artificial Sequences
  Synthetic
agggggtttgggagagttgaaggggac

SEQ ID NO: 16722 - DNA, 27 bp, Artificial Sequences
  Synthetic
aggtgggttttaggcggtaggttcggg

SEQ ID NO: 16723 - DNA, 27 bp, Artificial Sequences
  Synthetic
tttggtacggggaggcgttcgagtgag

SEQ ID NO: 16724 - DNA, 27 bp, Artificial Sequences
  Synthetic
ttttaggcggtaggttcgggtggtggg

SEQ ID NO: 16725 - DNA, 27 bp, Artificial Sequences
  Synthetic
tgggttttaggcggtaggttcgggtgg

SEQ ID NO: 16726 - DNA, 27 bp, Artificial Sequences
  Synthetic
gggttttaggcggtaggttcgggtggt

SEQ ID NO: 16727 - DNA, 27 bp, Artificial Sequences
  Synthetic
agcgagggggtttgggagagttgaagg

SEQ ID NO: 16728 - DNA, 27 bp, Artificial Sequences
  Synthetic
tttaattcggggaggtcgtcgggtcgg

SEQ ID NO: 16729 - DNA, 27 bp, Artificial Sequences
  Synthetic
ggggtttgggagagttgaaggggacgt

SEQ ID NO: 16730 - DNA, 27 bp, Artificial Sequences
  Synthetic
cgagggggtttgggagagttgaagggg

SEQ ID NO: 16731 - DNA, 27 bp, Artificial Sequences
  Synthetic
gggggtttgggagagttgaaggggacg

SEQ ID NO: 16732 - DNA, 27 bp, Artificial Sequences
  Synthetic
gtttggcgttggggggaaaaatggttt

SEQ ID NO: 16733 - DNA, 28 bp, Artificial Sequences
  Synthetic
ggtggtggcggttttatatcgttgaggg

SEQ ID NO: 16734 - DNA, 29 bp, Artificial Sequences
  Synthetic
aggtggtggcggttttatatcgttgaggg

SEQ ID NO: 16735 - DNA, 29 bp, Artificial Sequences
  Synthetic
ggtggtggcggttttatatcgttgaggga

SEQ ID NO: 16736 - DNA, 27 bp, Artificial Sequences
  Synthetic
tggtggcggttttatatcgttgaggga

SEQ ID NO: 16737 - DNA, 27 bp, Artificial Sequences
  Synthetic
taggcggggagtttagagcgaggtttc

SEQ ID NO: 16738 - DNA, 27 bp, Artificial Sequences
  Synthetic
ttaggcggggagtttagagcgaggttt

SEQ ID NO: 16739 - DNA, 27 bp, Artificial Sequences
  Synthetic
tttaggcggggagtttagagcgaggtt

SEQ ID NO: 16740 - DNA, 27 bp, Artificial Sequences
  Synthetic
atttaggcggggagtttagagcgaggt

SEQ ID NO: 16741 - DNA, 26 bp, Artificial Sequences
  Synthetic
aggcggggagtttagagcgaggtttc

SEQ ID NO: 16742 - DNA, 27 bp, Artificial Sequences
  Synthetic
aggatgtagtaaggggtaggcggcgta

SEQ ID NO: 16743 - DNA, 27 bp, Artificial Sequences
  Synthetic
taggatgtagtaaggggtaggcggcgt

SEQ ID NO: 16744 - DNA, 28 bp, Artificial Sequences
  Synthetic
ggatgtagtaaggggtaggcggcgtagt

SEQ ID NO: 16745 - DNA, 27 bp, Artificial Sequences
  Synthetic
ggatgtagtaaggggtaggcggcgtag

SEQ ID NO: 16746 - DNA, 26 bp, Artificial Sequences
  Synthetic
aggatgtagtaaggggtaggcggcgt

SEQ ID NO: 16747 - DNA, 27 bp, Artificial Sequences
  Synthetic
taggcggggagtttagagcgaggtttc

SEQ ID NO: 16748 - DNA, 27 bp, Artificial Sequences
  Synthetic
ttaggcggggagtttagagcgaggttt

SEQ ID NO: 16749 - DNA, 27 bp, Artificial Sequences
  Synthetic
tttaggcggggagtttagagcgaggtt

SEQ ID NO: 16750 - DNA, 27 bp, Artificial Sequences
  Synthetic
atttaggcggggagtttagagcgaggt

SEQ ID NO: 16751 - DNA, 26 bp, Artificial Sequences
  Synthetic
aggcggggagtttagagcgaggtttc

SEQ ID NO: 16752 - DNA, 27 bp, Artificial Sequences
  Synthetic
gatttgggtcgttggggttaggggtgc

SEQ ID NO: 16753 - DNA, 27 bp, Artificial Sequences
  Synthetic
atttgggtcgttggggttaggggtgcg

SEQ ID NO: 16754 - DNA, 27 bp, Artificial Sequences
  Synthetic
gcggtggggcgatggtttgtgattttt

SEQ ID NO: 16755 - DNA, 28 bp, Artificial Sequences
  Synthetic
agatttgggtcgttggggttaggggtgc

SEQ ID NO: 16756 - DNA, 28 bp, Artificial Sequences
  Synthetic
ggtggggcgatggtttgtgatttttgcg

SEQ ID NO: 16757 - DNA, 35 bp, Artificial Sequences
  Synthetic
cgtttttgtttttgttttttaggttttgagtcgcg

SEQ ID NO: 16758 - DNA, 36 bp, Artificial Sequences
  Synthetic
cgtttttgtttttgttttttaggttttgagtcgcgt

SEQ ID NO: 16759 - DNA, 36 bp, Artificial Sequences
  Synthetic
tcgtttttgtttttgttttttaggttttgagtcgcg

SEQ ID NO: 16760 - DNA, 36 bp, Artificial Sequences
  Synthetic
ttttgtttttgttttttaggttttgagtcgcgtagg

SEQ ID NO: 16761 - DNA, 27 bp, Artificial Sequences
  Synthetic
gcgcgggtttgattatcggacgtggag

SEQ ID NO: 16762 - DNA, 27 bp, Artificial Sequences
  Synthetic
agcgcgggtttgattatcggacgtgga

SEQ ID NO: 16763 - DNA, 27 bp, Artificial Sequences
  Synthetic
aagcgcgggtttgattatcggacgtgg

SEQ ID NO: 16764 - DNA, 27 bp, Artificial Sequences
  Synthetic
gatttgggtcgttggggttaggggtgc

SEQ ID NO: 16765 - DNA, 27 bp, Artificial Sequences
  Synthetic
cgttgtcgttgcgtttttggcggtcga

SEQ ID NO: 16766 - DNA, 27 bp, Artificial Sequences
  Synthetic
cggcggtcgttcgagtattttgtttgt

SEQ ID NO: 16767 - DNA, 28 bp, Artificial Sequences
  Synthetic
cggcggtcgttcgagtattttgtttgtt

SEQ ID NO: 16768 - DNA, 29 bp, Artificial Sequences
  Synthetic
cgtgtcgtttttgtcgtttaggggtttcg

SEQ ID NO: 16769 - DNA, 29 bp, Artificial Sequences
  Synthetic
cggcggtcgttcgagtattttgtttgttt

SEQ ID NO: 16770 - DNA, 30 bp, Artificial Sequences
  Synthetic
cgtgtcgtttttgtcgtttaggggtttcga

SEQ ID NO: 16771 - DNA, 27 bp, Artificial Sequences
  Synthetic
gcgcgggtttgattatcggacgtggag

SEQ ID NO: 16772 - DNA, 27 bp, Artificial Sequences
  Synthetic
agcgcgggtttgattatcggacgtgga

SEQ ID NO: 16773 - DNA, 27 bp, Artificial Sequences
  Synthetic
aagcgcgggtttgattatcggacgtgg

SEQ ID NO: 16774 - DNA, 27 bp, Artificial Sequences
  Synthetic
cgttgtcgttgcgtttttggcggtcga

SEQ ID NO: 16775 - DNA, 26 bp, Artificial Sequences
  Synthetic
cgttgtcgttgcgtttttggcggtcg

SEQ ID NO: 16776 - DNA, 27 bp, Artificial Sequences
  Synthetic
cggcggtcgttcgagtattttgtttgt

SEQ ID NO: 16777 - DNA, 28 bp, Artificial Sequences
  Synthetic
cggcggtcgttcgagtattttgtttgtt

SEQ ID NO: 16778 - DNA, 29 bp, Artificial Sequences
  Synthetic
cgtgtcgtttttgtcgtttaggggtttcg

SEQ ID NO: 16779 - DNA, 29 bp, Artificial Sequences
  Synthetic
cggcggtcgttcgagtattttgtttgttt

SEQ ID NO: 16780 - DNA, 30 bp, Artificial Sequences; identical to SEQ ID NO: 16770
  Synthetic

SEQ ID NO: 16781 - DNA, 27 bp, Artificial Sequences
  Synthetic
gttcggggtttttgggcggtaggaacg

SEQ ID NO: 16782 - DNA, 27 bp, Artificial Sequences
  Synthetic
gcgcgggtttgattatcggacgtggag

SEQ ID NO: 16783 - DNA, 27 bp, Artificial Sequences
  Synthetic
ggttcggggtttttgggcggtaggaac

SEQ ID NO: 16784 - DNA, 27 bp, Artificial Sequences
  Synthetic
agcgcgggtttgattatcggacgtgga

SEQ ID NO: 16785 - DNA, 27 bp, Artificial Sequences
  Synthetic
aagcgcgggtttgattatcggacgtgg

SEQ ID NO: 16786 - DNA, 27 bp, Artificial Sequences
  Synthetic
acggttttagtttggcgcgtggggttt

SEQ ID NO: 16787 - DNA, 27 bp, Artificial Sequences
  Synthetic
ttgacggttttagtttggcgcgtgggg

SEQ ID NO: 16788 - DNA, 27 bp, Artificial Sequences
  Synthetic
gacggttttagtttggcgcgtggggtt

SEQ ID NO: 16789 - DNA, 27 bp, Artificial Sequences
  Synthetic
tttggcgcgtggggttttatcgttggg

SEQ ID NO: 16790 - DNA, 27 bp, Artificial Sequences
  Synthetic
gtttggcgcgtggggttttatcgttgg

SEQ ID NO: 16791 - DNA, 27 bp, Artificial Sequences
  Synthetic
gttcggggtttttgggcggtaggaacg

SEQ ID NO: 16792 - DNA, 27 bp, Artificial Sequences
  Synthetic
ggttcggggtttttgggcggtaggaac

SEQ ID NO: 16793 - DNA, 27 bp, Artificial Sequences
  Synthetic
cggggtttttgggcggtaggaacggta

SEQ ID NO: 16794 - DNA, 27 bp, Artificial Sequences
  Synthetic
ggggtttttgggcggtaggaacggtac

SEQ ID NO: 16795 - DNA, 27 bp, Artificial Sequences
  Synthetic
gggttcggggtttttgggcggtaggaa

SEQ ID NO: 16796 - DNA, 27 bp, Artificial Sequences
  Synthetic
acggttttagtttggcgcgtggggttt

SEQ ID NO: 16797 - DNA, 27 bp, Artificial Sequences
  Synthetic
ttgacggttttagtttggcgcgtgggg

SEQ ID NO: 16798 - DNA, 27 bp, Artificial Sequences
  Synthetic
gacggttttagtttggcgcgtggggtt

SEQ ID NO: 16799 - DNA, 27 bp, Artificial Sequences
  Synthetic
tttggcgcgtggggttttatcgttggg

SEQ ID NO: 16800 - DNA, 27 bp, Artificial Sequences
  Synthetic
gtttggcgcgtggggttttatcgttgg

SEQ ID NO: 16801 - DNA, 27 bp, Artificial Sequences
  Synthetic
gttcggggtttttgggcggtaggaacg

SEQ ID NO: 16802 - DNA, 27 bp, Artificial Sequences
  Synthetic
ggttcggggtttttgggcggtaggaac

SEQ ID NO: 16803 - DNA, 27 bp, Artificial Sequences
  Synthetic
cggggtttttgggcggtaggaacggta

SEQ ID NO: 16804 - DNA, 27 bp, Artificial Sequences
  Synthetic
ggggtttttgggcggtaggaacggtac

SEQ ID NO: 16805 - DNA, 27 bp, Artificial Sequences
  Synthetic
gggttcggggtttttgggcggtaggaa

SEQ ID NO: 16806 - DNA, 27 bp, Artificial Sequences
  Synthetic
acggttttagtttggcgcgtggggttt

SEQ ID NO: 16807 - DNA, 27 bp, Artificial Sequences
  Synthetic
ttgacggttttagtttggcgcgtgggg

SEQ ID NO: 16808 - DNA, 27 bp, Artificial Sequences
  Synthetic
gacggttttagtttggcgcgtggggtt

SEQ ID NO: 16809 - DNA, 27 bp, Artificial Sequences
  Synthetic
ggggtttgacggttttagtttggcgcg

SEQ ID NO: 16810 - DNA, 27 bp, Artificial Sequences
  Synthetic
cggggtttgacggttttagtttggcgc

SEQ ID NO: 16811 - DNA, 27 bp, Artificial Sequences
  Synthetic
aatgaagggcggggtagagggagggta

SEQ ID NO: 16812 - DNA, 27 bp, Artificial Sequences
  Synthetic
taatgaagggcggggtagagggagggt

SEQ ID NO: 16813 - DNA, 27 bp, Artificial Sequences
  Synthetic
gagggagggtaggagggaggtcggttt

SEQ ID NO: 16814 - DNA, 27 bp, Artificial Sequences
  Synthetic
agggagggtaggagggaggtcggtttt

SEQ ID NO: 16815 - DNA, 27 bp, Artificial Sequences
  Synthetic
atgaagggcggggtagagggagggtag

SEQ ID NO: 16816 - DNA, 27 bp, Artificial Sequences
  Synthetic
gtttgggaggggcggagtttgggtaga

SEQ ID NO: 16817 - DNA, 27 bp, Artificial Sequences
  Synthetic
tttttggttcgggtcggttgcgggttt

SEQ ID NO: 16818 - DNA, 27 bp, Artificial Sequences
  Synthetic
ttttggttcgggtcggttgcgggtttc

SEQ ID NO: 16819 - DNA, 27 bp, Artificial Sequences
  Synthetic
gggcggagtttgggtagaggaggatgg

SEQ ID NO: 16820 - DNA, 27 bp, Artificial Sequences
  Synthetic
ggggcggagtttgggtagaggaggatg

SEQ ID NO: 16821 - DNA, 27 bp, Artificial Sequences
  Synthetic
ggaagagggttaggcgtggttgtgtgt

SEQ ID NO: 16822 - DNA, 27 bp, Artificial Sequences
  Synthetic
agggttaggcgtggttgtgtgtttcga

SEQ ID NO: 16823 - DNA, 28 bp, Artificial Sequences
  Synthetic
aggaagagggttaggcgtggttgtgtgt

SEQ ID NO: 16824 - DNA, 27 bp, Artificial Sequences
  Synthetic
aggaagagggttaggcgtggttgtgtg

SEQ ID NO: 16825 - DNA, 28 bp, Artificial Sequences
  Synthetic
tgaggaagagggttaggcgtggttgtgt

SEQ ID NO: 16826 - DNA, 27 bp, Artificial Sequences
  Synthetic
ggaagagggttaggcgtggttgtgtgt

SEQ ID NO: 16827 - DNA, 27 bp, Artificial Sequences
  Synthetic
agggttaggcgtggttgtgtgtttcga

SEQ ID NO: 16828 - DNA, 28 bp, Artificial Sequences
  Synthetic
aggaagagggttaggcgtggttgtgtgt

SEQ ID NO: 16829 - DNA, 27 bp, Artificial Sequences
  Synthetic
aggaagagggttaggcgtggttgtgtg

SEQ ID NO: 16830 - DNA, 28 bp, Artificial Sequences
  Synthetic
tgaggaagagggttaggcgtggttgtgt

SEQ ID NO: 16831 - DNA, 29 bp, Artificial Sequences
  Synthetic
gcgtaggttggttgcgatgtttgtttttt

SEQ ID NO: 16832 - DNA, 30 bp, Artificial Sequences
  Synthetic
gcgtaggttggttgcgatgtttgttttttg

SEQ ID NO: 16833 - DNA, 31 bp, Artificial Sequences
  Synthetic
gcgtaggttggttgcgatgtttgttttttgt

SEQ ID NO: 16834 - DNA, 30 bp, Artificial Sequences
  Synthetic
aggtcgattaggagggtgttatgggttttg

SEQ ID NO: 16835 - DNA, 30 bp, Artificial Sequences
  Synthetic
ggtcgattaggagggtgttatgggttttga

SEQ ID NO: 16836 - DNA, 25 bp, Artificial Sequences
  Synthetic
ggcgttcgggttgcgaggggttttc

SEQ ID NO: 16837 - DNA, 26 bp, Artificial Sequences
  Synthetic
gtttggaggggcgttcgggttgcgag

SEQ ID NO: 16838 - DNA, 26 bp, Artificial Sequences
  Synthetic
gggcgttcgggttgcgaggggttttc

SEQ ID NO: 16839 - DNA, 27 bp, Artificial Sequences
  Synthetic
gtttggaggggcgttcgggttgcgagg

SEQ ID NO: 16840 - DNA, 27 bp, Artificial Sequences
  Synthetic
ggtttggaggggcgttcgggttgcgag

SEQ ID NO: 16841 - DNA, 29 bp, Artificial Sequences
  Synthetic
gcgtaggttggttgcgatgtttgtttttt

SEQ ID NO: 16842 - DNA, 30 bp, Artificial Sequences; identical to SEQ ID NO: 16832
  Synthetic

SEQ ID NO: 16843 - DNA, 31 bp, Artificial Sequences; identical to SEQ ID NO: 16833
  Synthetic

SEQ ID NO: 16844 - DNA, 30 bp, Artificial Sequences
  Synthetic
tgaatttggagttttggaggttgcgtttgt

SEQ ID NO: 16845 - DNA, 31 bp, Artificial Sequences
  Synthetic
tgaatttggagttttggaggttgcgtttgtc

SEQ ID NO: 16846 - DNA, 27 bp, Artificial Sequences
  Synthetic
gggttagtttggcgacgcgttgtttgc

SEQ ID NO: 16847 - DNA, 27 bp, Artificial Sequences
  Synthetic
cgtagggttagtttggcgacgcgttgt

SEQ ID NO: 16848 - DNA, 27 bp, Artificial Sequences
  Synthetic
acgtagggttagtttggcgacgcgttg

SEQ ID NO: 16849 - DNA, 28 bp, Artificial Sequences
  Synthetic
agggttagtttggcgacgcgttgtttgc

SEQ ID NO: 16850 - DNA, 28 bp, Artificial Sequences
  Synthetic
cgtagggttagtttggcgacgcgttgtt

SEQ ID NO: 16851 - DNA, 27 bp, Artificial Sequences
  Synthetic
gaaaattcggaggtggaaggcgaggcg

SEQ ID NO: 16852 - DNA, 27 bp, Artificial Sequences
  Synthetic
gcgtggaaaattcggaggtggaaggcg

SEQ ID NO: 16853 - DNA, 27 bp, Artificial Sequences
  Synthetic
ggaaaattcggaggtggaaggcgaggc

SEQ ID NO: 16854 - DNA, 27 bp, Artificial Sequences
  Synthetic
tgcgtggaaaattcggaggtggaaggc

SEQ ID NO: 16855 - DNA, 27 bp, Artificial Sequences
  Synthetic
cgtggaaaattcggaggtggaaggcga

SEQ ID NO: 16856 - DNA, 27 bp, Artificial Sequences
  Synthetic
gcgggggtggtcgtcgtttttagttcg

SEQ ID NO: 16857 - DNA, 27 bp, Artificial Sequences
  Synthetic
cgcgggggtggtcgtcgtttttagttc

SEQ ID NO: 16858 - DNA, 27 bp, Artificial Sequences
  Synthetic
gggttagtttggcgacgcgttgtttgc

SEQ ID NO: 16859 - DNA, 27 bp, Artificial Sequences
  Synthetic
cgggggtggtcgtcgtttttagttcgg

SEQ ID NO: 16860 - DNA, 27 bp, Artificial Sequences
  Synthetic
cgtagggttagtttggcgacgcgttgt

SEQ ID NO: 16861 - DNA, 27 bp, Artificial Sequences
  Synthetic
gaaaattcggaggtggaaggcgaggcg

SEQ ID NO: 16862 - DNA, 27 bp, Artificial Sequences
  Synthetic
gcgtggaaaattcggaggtggaaggcg

SEQ ID NO: 16863 - DNA, 27 bp, Artificial Sequences
  Synthetic
ggaaaattcggaggtggaaggcgaggc

SEQ ID NO: 16864 - DNA, 27 bp, Artificial Sequences
  Synthetic
tgcgtggaaaattcggaggtggaaggc

SEQ ID NO: 16865 - DNA, 27 bp, Artificial Sequences
  Synthetic
gttttattgagggggtcggtagcggcg

SEQ ID NO: 16866 - DNA, 27 bp, Artificial Sequences
  Synthetic
gcgggggtggtcgtcgtttttagttcg

SEQ ID NO: 16867 - DNA, 27 bp, Artificial Sequences
  Synthetic
cgcgggggtggtcgtcgtttttagttc

SEQ ID NO: 16868 - DNA, 27 bp, Artificial Sequences
  Synthetic
cgggggtggtcgtcgtttttagttcgg

SEQ ID NO: 16869 - DNA, 27 bp, Artificial Sequences
  Synthetic
aatgcgcgggggtggtcgtcgttttta

SEQ ID NO: 16870 - DNA, 27 bp, Artificial Sequences
  Synthetic
gggggtggtcgtcgtttttagttcggt

SEQ ID NO: 16871 - DNA, 27 bp, Artificial Sequences
  Synthetic
gaaaattcggaggtggaaggcgaggcg

SEQ ID NO: 16872 - DNA, 27 bp, Artificial Sequences
  Synthetic
gcgtggaaaattcggaggtggaaggcg

SEQ ID NO: 16873 - DNA, 27 bp, Artificial Sequences
  Synthetic
ggaaaattcggaggtggaaggcgaggc

SEQ ID NO: 16874 - DNA, 27 bp, Artificial Sequences
  Synthetic
tgcgtggaaaattcggaggtggaaggc

SEQ ID NO: 16875 - DNA, 27 bp, Artificial Sequences
  Synthetic
ttttattgagggggtcggtagcggcgg

SEQ ID NO: 16876 - DNA, 27 bp, Artificial Sequences
  Synthetic
gcgggggtggtcgtcgtttttagttcg

SEQ ID NO: 16877 - DNA, 27 bp, Artificial Sequences
  Synthetic
cgcgggggtggtcgtcgtttttagttc

SEQ ID NO: 16878 - DNA, 27 bp, Artificial Sequences
  Synthetic
cgggggtggtcgtcgtttttagttcgg

SEQ ID NO: 16879 - DNA, 27 bp, Artificial Sequences
  Synthetic
aatgcgcgggggtggtcgtcgttttta

SEQ ID NO: 16880 - DNA, 27 bp, Artificial Sequences
  Synthetic
gggggtggtcgtcgtttttagttcggt

SEQ ID NO: 16881 - DNA, 27 bp, Artificial Sequences
  Synthetic
gtcgggttgggggcggcgattattttc

SEQ ID NO: 16882 - DNA, 27 bp, Artificial Sequences
  Synthetic
agtcgggttgggggcggcgattatttt

SEQ ID NO: 16883 - DNA, 27 bp, Artificial Sequences
  Synthetic
gagtcgggttgggggcggcgattattt

SEQ ID NO: 16884 - DNA, 26 bp, Artificial Sequences
  Synthetic
gtcgggttgggggcggcgattatttt

SEQ ID NO: 16885 - DNA, 26 bp, Artificial Sequences
  Synthetic
tcgggttgggggcggcgattattttc

SEQ ID NO: 16886 - DNA, 27 bp, Artificial Sequences
  Synthetic
ggggacggtgagggcgttttttgtttt

SEQ ID NO: 16887 - DNA, 28 bp, Artificial Sequences
  Synthetic
ggggacggtgagggcgttttttgttttt

SEQ ID NO: 16888 - DNA, 26 bp, Artificial Sequences
  Synthetic
ggggacggtgagggcgttttttgttt

SEQ ID NO: 16889 - DNA, 26 bp, Artificial Sequences
  Synthetic
ttttttatttgtcggtcggggcgcgt

SEQ ID NO: 16890 - DNA, 27 bp, Artificial Sequences
  Synthetic
gggacggtgagggcgttttttgttttt

SEQ ID NO: 16891 - DNA, 27 bp, Artificial Sequences
  Synthetic
ggggacgttggagggaggttgttttgg

SEQ ID NO: 16892 - DNA, 28 bp, Artificial Sequences
  Synthetic
ggggacgttggagggaggttgttttgga

SEQ ID NO: 16893 - DNA, 27 bp, Artificial Sequences
  Synthetic
gggacgttggagggaggttgttttgga

SEQ ID NO: 16894 - DNA, 29 bp, Artificial Sequences
  Synthetic
ggggacgttggagggaggttgttttggat

SEQ ID NO: 16895 - DNA, 28 bp, Artificial Sequences
  Synthetic
gggacgttggagggaggttgttttggat

SEQ ID NO: 16896 - DNA, 27 bp, Artificial Sequences
  Synthetic
ttttgggtcggtatttaggtacgcgcg

SEQ ID NO: 16897 - DNA, 28 bp, Artificial Sequences
  Synthetic
tttttgggtcggtatttaggtacgcgcg

SEQ ID NO: 16898 - DNA, 30 bp, Artificial Sequences
  Synthetic
ggtttttgggtcggtatttaggtacgcgcg

SEQ ID NO: 16899 - DNA, 30 bp, Artificial Sequences
  Synthetic
cggtttttgggtcggtatttaggtacgcgc

SEQ ID NO: 16900 - DNA, 26 bp, Artificial Sequences
  Synthetic
tttgggtcggtatttaggtacgcgcg

SEQ ID NO: 16901 - DNA, 27 bp, Artificial Sequences
  Synthetic
cgcgcgtgtttgggtgtcggtttagaa

SEQ ID NO: 16902 - DNA, 27 bp, Artificial Sequences
  Synthetic
gagggtagcgtcggggtttagggaagt

SEQ ID NO: 16903 - DNA, 27 bp, Artificial Sequences
  Synthetic
agagggtagcgtcggggtttagggaag

SEQ ID NO: 16904 - DNA, 27 bp, Artificial Sequences
  Synthetic
agggtagcgtcggggtttagggaagtt

SEQ ID NO: 16905 - DNA, 27 bp, Artificial Sequences
  Synthetic
ttttcgtatagagggcgcggaggttgc

SEQ ID NO: 16906 - DNA, 28 bp, Artificial Sequences
  Synthetic
ggagtcgatgggtattgagggttcgcgt

SEQ ID NO: 16907 - DNA, 27 bp, Artificial Sequences
  Synthetic
ggagtcgatgggtattgagggttcgcg

SEQ ID NO: 16908 - DNA, 28 bp, Artificial Sequences
  Synthetic
gggagtcgatgggtattgagggttcgcg

SEQ ID NO: 16909 - DNA, 27 bp, Artificial Sequences
  Synthetic
gggagtcgatgggtattgagggttcgc

SEQ ID NO: 16910 - DNA, 28 bp, Artificial Sequences
  Synthetic
agggagtcgatgggtattgagggttcgc

SEQ ID NO: 16911 - DNA, 28 bp, Artificial Sequences
  Synthetic
ggtacggtgttgcgcgagtttttagtgt

SEQ ID NO: 16912 - DNA, 27 bp, Artificial Sequences
  Synthetic
ggtacggtgttgcgcgagtttttagtg

SEQ ID NO: 16913 - DNA, 27 bp, Artificial Sequences
  Synthetic
acggtgttgcgcgagtttttagtgttt

SEQ ID NO: 16914 - DNA, 27 bp, Artificial Sequences
  Synthetic
gtacggtgttgcgcgagtttttagtgt

SEQ ID NO: 16915 - DNA, 28 bp, Artificial Sequences
  Synthetic
acgtttttaggcggggaggtatatcggt

SEQ ID NO: 16916 - DNA, 27 bp, Artificial Sequences
  Synthetic
tggggttcggaatgggtaagaaggtgt

SEQ ID NO: 16917 - DNA, 29 bp, Artificial Sequences
  Synthetic
acgttggggttcggaatgggtaagaaggt

SEQ ID NO: 16918 - DNA, 28 bp, Artificial Sequences
  Synthetic
cgttggggttcggaatgggtaagaaggt

SEQ ID NO: 16919 - DNA, 28 bp, Artificial Sequences
  Synthetic
acgttggggttcggaatgggtaagaagg

SEQ ID NO: 16920 - DNA, 27 bp, Artificial Sequences
  Synthetic
cgttggggttcggaatgggtaagaagg

SEQ ID NO: 16921 - DNA, 27 bp, Artificial Sequences
  Synthetic
tagtaggggaggggttttaggtaggcg

SEQ ID NO: 16922 - DNA, 26 bp, Artificial Sequences
  Synthetic
agtaggggaggggttttaggtaggcg

SEQ ID NO: 16923 - DNA, 28 bp, Artificial Sequences
  Synthetic
atagtaggggaggggttttaggtaggcg

SEQ ID NO: 16924 - DNA, 29 bp, Artificial Sequences
  Synthetic
aatagtaggggaggggttttaggtaggcg

SEQ ID NO: 16925 - DNA, 29 bp, Artificial Sequences
  Synthetic
tcgtagcgtttaaatagtaggggaggggt

SEQ ID NO: 16926 - DNA, 29 bp, Artificial Sequences
  Synthetic
tcggttttgtgtgttcgtttgtttggagt

SEQ ID NO: 16927 - DNA, 30 bp, Artificial Sequences
  Synthetic
tcggttttgtgtgttcgtttgtttggagtt

SEQ ID NO: 16928 - DNA, 30 bp, Artificial Sequences
  Synthetic
ttcggttttgtgtgttcgtttgtttggagt

SEQ ID NO: 16929 - DNA, 30 bp, Artificial Sequences
  Synthetic
cggttttgtgtgttcgtttgtttggagttt

SEQ ID NO: 16930 - DNA, 28 bp, Artificial Sequences
  Synthetic
gcgaaggaaggagaggaaattacgcggg

SEQ ID NO: 16931 - DNA, 27 bp, Artificial Sequences
  Synthetic
agtaggggaggggttttaggtaggcga

SEQ ID NO: 16932 - DNA, 27 bp, Artificial Sequences
  Synthetic
atagggtcggggaggtgggaaatttcg

SEQ ID NO: 16933 - DNA, 29 bp, Artificial Sequences
  Synthetic
gcgaaggaaggagaggaaattacgcggga

SEQ ID NO: 16934 - DNA, 27 bp, Artificial Sequences
  Synthetic
gcgaaggaaggagaggaaattacgcgg

SEQ ID NO: 16935 - DNA, 34 bp, Artificial Sequences
  Synthetic
agttttttgtatagtggggatgggattttcgagt

SEQ ID NO: 16936 - DNA, 35 bp, Artificial Sequences
  Synthetic
agttttttgtatagtggggatgggattttcgagtt

SEQ ID NO: 16937 - DNA, 35 bp, Artificial Sequences
  Synthetic
tagttttttgtatagtggggatgggattttcgagt

SEQ ID NO: 16938 - DNA, 35 bp, Artificial Sequences
  Synthetic
gttttttgtatagtggggatgggattttcgagttt

SEQ ID NO: 16939 - DNA, 36 bp, Artificial Sequences
  Synthetic
agttttttgtatagtggggatgggattttcgagttt

SEQ ID NO: 16940 - DNA, 27 bp, Artificial Sequences
  Synthetic
gtgggggagggggcgggtagatttttt

SEQ ID NO: 16941 - DNA, 27 bp, Artificial Sequences
  Synthetic
tgagaggaggtcgtagggttggggtcg

SEQ ID NO: 16942 - DNA, 27 bp, Artificial Sequences
  Synthetic
gttgagaggaggtcgtagggttggggt

SEQ ID NO: 16943 - DNA, 27 bp, Artificial Sequences
  Synthetic
tgttgagaggaggtcgtagggttgggg

SEQ ID NO: 16944 - DNA, 28 bp, Artificial Sequences
  Synthetic
tgttgagaggaggtcgtagggttggggt

SEQ ID NO: 16945 - DNA, 27 bp, Artificial Sequences
  Synthetic
cgtaggtggggtttgtggggattggga

SEQ ID NO: 16946 - DNA, 27 bp, Artificial Sequences
  Synthetic
acgtaggtggggtttgtggggattggg

SEQ ID NO: 16947 - DNA, 27 bp, Artificial Sequences
  Synthetic
aggtggggtttgtggggattgggagtg

SEQ ID NO: 16948 - DNA, 27 bp, Artificial Sequences
  Synthetic
gtggggtttgtggggattgggagtggt

SEQ ID NO: 16949 - DNA, 27 bp, Artificial Sequences
  Synthetic
gcgacgtaggtggggtttgtggggatt

SEQ ID NO: 16950 - DNA, 27 bp, Artificial Sequences
  Synthetic
gggttggagatgaggcgggtttgaggt

SEQ ID NO: 16951 - DNA, 27 bp, Artificial Sequences
  Synthetic
tgagaggaggtcgtagggttggggtcg

SEQ ID NO: 16952 - DNA, 27 bp, Artificial Sequences
  Synthetic
gtcgtagggttggggtcgggagtgatt

SEQ ID NO: 16953 - DNA, 27 bp, Artificial Sequences
  Synthetic
ggggttggagatgaggcgggtttgagg

SEQ ID NO: 16954 - DNA, 27 bp, Artificial Sequences
  Synthetic
gggggttggagatgaggcgggtttgag

SEQ ID NO: 16955 - DNA, 27 bp, Artificial Sequences
  Synthetic
agatttcgggatttcggatttgcgggt

SEQ ID NO: 16956 - DNA, 27 bp, Artificial Sequences
  Synthetic
gatttcgggatttcggatttgcgggtt

SEQ ID NO: 16957 - DNA, 28 bp, Artificial Sequences
  Synthetic
agatttcgggatttcggatttgcgggtt

SEQ ID NO: 16958 - DNA, 28 bp, Artificial Sequences
  Synthetic
tagatttcgggatttcggatttgcgggt

SEQ ID NO: 16959 - DNA, 26 bp, Artificial Sequences
  Synthetic
gatttcgggatttcggatttgcgggt

SEQ ID NO: 16960 - DNA, 34 bp, Artificial Sequences
  Synthetic
ttgaggttgtgtatatgattttggtagtgtcgga

SEQ ID NO: 16961 - DNA, 35 bp, Artificial Sequences
  Synthetic
tgaggttgtgtatatgattttggtagtgtcggatt

SEQ ID NO: 16962 - DNA, 35 bp, Artificial Sequences
  Synthetic
ttgaggttgtgtatatgattttggtagtgtcggat

SEQ ID NO: 16963 - DNA, 35 bp, Artificial Sequences
  Synthetic
attgaggttgtgtatatgattttggtagtgtcgga

SEQ ID NO: 16964 - DNA, 36 bp, Artificial Sequences
  Synthetic
aggttgtgtatatgattttggtagtgtcggatttgt

SEQ ID NO: 16965 - DNA, 27 bp, Artificial Sequences
  Synthetic
tcggtggtgggtagtttggtcggatgg

SEQ ID NO: 16966 - DNA, 27 bp, Artificial Sequences
  Synthetic
agagtcggtggtgggtagtttggtcgg

SEQ ID NO: 16967 - DNA, 27 bp, Artificial Sequences
  Synthetic
gagtcggtggtgggtagtttggtcgga

SEQ ID NO: 16968 - DNA, 27 bp, Artificial Sequences
  Synthetic
agtcggtggtgggtagtttggtcggat

SEQ ID NO: 16969 - DNA, 27 bp, Artificial Sequences
  Synthetic
ggtggtgggtagtttggtcggatggcg

SEQ ID NO: 16970 - DNA, 27 bp, Artificial Sequences
  Synthetic
gcggggtggggggagttttttcgtttt

SEQ ID NO: 16971 - DNA, 27 bp, Artificial Sequences
  Synthetic
tagcggggtggggggagttttttcgtt

SEQ ID NO: 16972 - DNA, 27 bp, Artificial Sequences
  Synthetic
ggtagtagtagcggggtggggggagtt

SEQ ID NO: 16973 - DNA, 27 bp, Artificial Sequences
  Synthetic
agtagcggggtggggggagttttttcg

SEQ ID NO: 16974 - DNA, 27 bp, Artificial Sequences
  Synthetic
gtagcggggtggggggagttttttcgt

SEQ ID NO: 16975 - DNA, 27 bp, Artificial Sequences
  Synthetic
tcggtggtgggtagtttggtcggatgg

SEQ ID NO: 16976 - DNA, 27 bp, Artificial Sequences
  Synthetic
tgggtagtttggtcggatggcggtgat

SEQ ID NO: 16977 - DNA, 27 bp, Artificial Sequences
  Synthetic
gtgggtagtttggtcggatggcggtga

SEQ ID NO: 16978 - DNA, 27 bp, Artificial Sequences
  Synthetic
agagtcggtggtgggtagtttggtcgg

SEQ ID NO: 16979 - DNA, 27 bp, Artificial Sequences
  Synthetic
gagtcggtggtgggtagtttggtcgga

SEQ ID NO: 16980 - DNA, 25 bp, Artificial Sequences
  Synthetic
gggggacgcggggggtagtagtagt

SEQ ID NO: 16981 - DNA, 24 bp, Artificial Sequences
  Synthetic
gggggacgcggggggtagtagtag

SEQ ID NO: 16982 - DNA, 24 bp, Artificial Sequences
  Synthetic
ggggacgcggggggtagtagtagt

SEQ ID NO: 16983 - DNA, 23 bp, Artificial Sequences
  Synthetic
gggggacgcggggggtagtagta

SEQ ID NO: 16984 - DNA, 22 bp, Artificial Sequences
  Synthetic
gggggacgcggggggtagtagt

SEQ ID NO: 16985 - DNA, 27 bp, Artificial Sequences
  Synthetic
cgggaggcggatgggtcgtgatagttt

SEQ ID NO: 16986 - DNA, 27 bp, Artificial Sequences
  Synthetic
tcggtggtgggtagtttggtcggatgg

SEQ ID NO: 16987 - DNA, 27 bp, Artificial Sequences
  Synthetic
tgggtagtttggtcggatggcggtgat

SEQ ID NO: 16988 - DNA, 27 bp, Artificial Sequences
  Synthetic
gtgggtagtttggtcggatggcggtga

SEQ ID NO: 16989 - DNA, 27 bp, Artificial Sequences
  Synthetic
agagtcggtggtgggtagtttggtcgg

SEQ ID NO: 16990 - DNA, 28 bp, Artificial Sequences
  Synthetic
cggtaggaggtgtttttgatcgcgtggt

SEQ ID NO: 16991 - DNA, 27 bp, Artificial Sequences
  Synthetic
cggtaggaggtgtttttgatcgcgtgg

SEQ ID NO: 16992 - DNA, 27 bp, Artificial Sequences
  Synthetic
ggtaggaggtgtttttgatcgcgtggt

SEQ ID NO: 16993 - DNA, 27 bp, Artificial Sequences
  Synthetic
tgatcgcgtggtttgttggaaaggagt

SEQ ID NO: 16994 - DNA, 29 bp, Artificial Sequences
  Synthetic
cggtaggaggtgtttttgatcgcgtggtt

SEQ ID NO: 16995 - DNA, 27 bp, Artificial Sequences
  Synthetic
cgggaggcggatgggtcgtgatagttt

SEQ ID NO: 16996 - DNA, 27 bp, Artificial Sequences
  Synthetic
ggcgttgggagaggttttgagttcggg

SEQ ID NO: 16997 - DNA, 27 bp, Artificial Sequences
  Synthetic
gcgttgggagaggttttgagttcgggt

SEQ ID NO: 16998 - DNA, 27 bp, Artificial Sequences
  Synthetic
tggcgttgggagaggttttgagttcgg

SEQ ID NO: 16999 - DNA, 26 bp, Artificial Sequences
  Synthetic
cgggaggcggatgggtcgtgatagtt

SEQ ID NO: 17000 - DNA, 27 bp, Artificial Sequences
  Synthetic
gggttgggtaggtgttgcggtaggagg

SEQ ID NO: 17001 - DNA, 27 bp, Artificial Sequences
  Synthetic
ggttgggtaggtgttgcggtaggaggt

SEQ ID NO: 17002 - DNA, 27 bp, Artificial Sequences
  Synthetic
agggttgggtaggtgttgcggtaggag

SEQ ID NO: 17003 - DNA, 27 bp, Artificial Sequences
  Synthetic
agagggttgggtaggtgttgcggtagg

SEQ ID NO: 17004 - DNA, 27 bp, Artificial Sequences
  Synthetic
gagggttgggtaggtgttgcggtagga

SEQ ID NO: 17005 - DNA, 27 bp, Artificial Sequences
  Synthetic
tagtagcgagtgtgggggtgcgaggta

SEQ ID NO: 17006 - DNA, 27 bp, Artificial Sequences
  Synthetic
gcgagtgtgggggtgcgaggtagtttt

SEQ ID NO: 17007 - DNA, 27 bp, Artificial Sequences
  Synthetic
tagcgagtgtgggggtgcgaggtagtt

SEQ ID NO: 17008 - DNA, 27 bp, Artificial Sequences
  Synthetic
tagtagtagcgagtgtgggggtgcgag

SEQ ID NO: 17009 - DNA, 27 bp, Artificial Sequences
  Synthetic
agtagcgagtgtgggggtgcgaggtag

SEQ ID NO: 17010 - DNA, 29 bp, Artificial Sequences
  Synthetic
tggttagttgggttcgtggttgattcggt

SEQ ID NO: 17011 - DNA, 28 bp, Artificial Sequences
  Synthetic
ggttagttgggttcgtggttgattcggt

SEQ ID NO: 17012 - DNA, 28 bp, Artificial Sequences
  Synthetic
tggttagttgggttcgtggttgattcgg

SEQ ID NO: 17013 - DNA, 27 bp, Artificial Sequences
  Synthetic
ggttagttgggttcgtggttgattcgg

SEQ ID NO: 17014 - DNA, 29 bp, Artificial Sequences
  Synthetic
ttggttagttgggttcgtggttgattcgg

SEQ ID NO: 17015 - DNA, 28 bp, Artificial Sequences
  Synthetic
gcgggtcgggtatttttaaaggcgtagg

SEQ ID NO: 17016 - DNA, 27 bp, Artificial Sequences
  Synthetic
agcgggtcgggtatttttaaaggcgta

SEQ ID NO: 17017 - DNA, 27 bp, Artificial Sequences
  Synthetic
tagcgggtcgggtatttttaaaggcgt

SEQ ID NO: 17018 - DNA, 29 bp, Artificial Sequences
  Synthetic
agcgggtcgggtatttttaaaggcgtagg

SEQ ID NO: 17019 - DNA, 29 bp, Artificial Sequences
  Synthetic
gcgggtcgggtatttttaaaggcgtagga

SEQ ID NO: 17020 - DNA, 31 bp, Artificial Sequences
  Synthetic
gcgtaggattcgtagggtaaatttcgtttgg

SEQ ID NO: 17021 - DNA, 32 bp, Artificial Sequences
  Synthetic
gcgtaggattcgtagggtaaatttcgtttggt

SEQ ID NO: 17022 - DNA, 33 bp, Artificial Sequences
  Synthetic
gcgtaggattcgtagggtaaatttcgtttggtt

SEQ ID NO: 17023 - DNA, 34 bp, Artificial Sequences
  Synthetic
gcgtaggattcgtagggtaaatttcgtttggttt

SEQ ID NO: 17024 - DNA, 35 bp, Artificial Sequences
  Synthetic
gcgtaggattcgtagggtaaatttcgtttggtttt

SEQ ID NO: 17025 - DNA, 28 bp, Artificial Sequences
  Synthetic
gcgggtcgggtatttttaaaggcgtagg

SEQ ID NO: 17026 - DNA, 27 bp, Artificial Sequences
  Synthetic
agcgggtcgggtatttttaaaggcgta

SEQ ID NO: 17027 - DNA, 27 bp, Artificial Sequences
  Synthetic
tagcgggtcgggtatttttaaaggcgt

SEQ ID NO: 17028 - DNA, 29 bp, Artificial Sequences
  Synthetic
agcgggtcgggtatttttaaaggcgtagg

SEQ ID NO: 17029 - DNA, 29 bp, Artificial Sequences
  Synthetic
gcgggtcgggtatttttaaaggcgtagga

SEQ ID NO: 17030 - DNA, 27 bp, Artificial Sequences
  Synthetic
agtcggggtattggggttttgcgtagg

SEQ ID NO: 17031 - DNA, 27 bp, Artificial Sequences
  Synthetic
gtcggggtattggggttttgcgtagga

SEQ ID NO: 17032 - DNA, 28 bp, Artificial Sequences
  Synthetic
agtcggggtattggggttttgcgtagga

SEQ ID NO: 17033 - DNA, 27 bp, Artificial Sequences
  Synthetic
tcggggtattggggttttgcgtaggat

SEQ ID NO: 17034 - DNA, 27 bp, Artificial Sequences
  Synthetic
tggggttttgcgtaggattcgtagggt

SEQ ID NO: 17035 - DNA, 27 bp, Artificial Sequences
  Synthetic
gggcgtagaggtttggggttaagcgga

SEQ ID NO: 17036 - DNA, 27 bp, Artificial Sequences
  Synthetic
aggggcgtagaggtttggggttaagcg

SEQ ID NO: 17037 - DNA, 27 bp, Artificial Sequences
  Synthetic
gggtagaaggggcgtagaggtttgggg

SEQ ID NO: 17038 - DNA, 27 bp, Artificial Sequences
  Synthetic
ggtagaaggggcgtagaggtttggggt

SEQ ID NO: 17039 - DNA, 27 bp, Artificial Sequences
  Synthetic
tgggtagaaggggcgtagaggtttggg

SEQ ID NO: 17040 - DNA, 27 bp, Artificial Sequences
  Synthetic
ttaagggtcggtggcgttgggtaaggg

SEQ ID NO: 17041 - DNA, 27 bp, Artificial Sequences
  Synthetic
cgttgtttaagggtcggtggcgttggg

SEQ ID NO: 17042 - DNA, 27 bp, Artificial Sequences
  Synthetic
acgttgtttaagggtcggtggcgttgg

SEQ ID NO: 17043 - DNA, 27 bp, Artificial Sequences
  Synthetic
gttgtttaagggtcggtggcgttgggt

SEQ ID NO: 17044 - DNA, 27 bp, Artificial Sequences
  Synthetic
tgacgttgtttaagggtcggtggcgtt

SEQ ID NO: 17045 - DNA, 27 bp, Artificial Sequences
  Synthetic
gggcgtagaggtttggggttaagcgga

SEQ ID NO: 17046 - DNA, 27 bp, Artificial Sequences
  Synthetic
ggcgtagaggtttggggttaagcggag

SEQ ID NO: 17047 - DNA, 28 bp, Artificial Sequences
  Synthetic
ggcgtagaggtttggggttaagcggagt

SEQ ID NO: 17048 - DNA, 27 bp, Artificial Sequences
  Synthetic
gcgtagaggtttggggttaagcggagt

SEQ ID NO: 17049 - DNA, 28 bp, Artificial Sequences
  Synthetic
gggcgtagaggtttggggttaagcggag

SEQ ID NO: 17050 - DNA, 27 bp, Artificial Sequences
  Synthetic
ttttcggcggtttttggggattcgggg

SEQ ID NO: 17051 - DNA, 27 bp, Artificial Sequences
  Synthetic
cggggattttcggcggtttttggggat

SEQ ID NO: 17052 - DNA, 27 bp, Artificial Sequences
  Synthetic
ttaagggtcggtggcgttgggtaaggg

SEQ ID NO: 17053 - DNA, 27 bp, Artificial Sequences
  Synthetic
cgttgtttaagggtcggtggcgttggg

SEQ ID NO: 17054 - DNA, 27 bp, Artificial Sequences
  Synthetic
acgttgtttaagggtcggtggcgttgg

SEQ ID NO: 17055 - DNA, 27 bp, Artificial Sequences
  Synthetic
taggggtcgtcggaggttttcgcgttt

SEQ ID NO: 17056 - DNA, 27 bp, Artificial Sequences
  Synthetic
ttaggggtcgtcggaggttttcgcgtt

SEQ ID NO: 17057 - DNA, 27 bp, Artificial Sequences
  Synthetic
tttaggggtcgtcggaggttttcgcgt

SEQ ID NO: 17058 - DNA, 27 bp, Artificial Sequences
  Synthetic
ggagtcggagggggttgtttcgggttt

SEQ ID NO: 17059 - DNA, 27 bp, Artificial Sequences
  Synthetic
tcgggtttttaggggtcgtcggaggtt

SEQ ID NO: 17060 - DNA, 27 bp, Artificial Sequences
  Synthetic
tcggcggtttttggggattcggggtaa

SEQ ID NO: 17061 - DNA, 27 bp, Artificial Sequences
  Synthetic
cgggttttttagttagaggcgcgggga

SEQ ID NO: 17062 - DNA, 27 bp, Artificial Sequences
  Synthetic
tcgggttttttagttagaggcgcgggg

SEQ ID NO: 17063 - DNA, 26 bp, Artificial Sequences
  Synthetic
cggggattttcggcggtttttgggga

SEQ ID NO: 17064 - DNA, 28 bp, Artificial Sequences
  Synthetic
tcgggttttttagttagaggcgcgggga

SEQ ID NO: 17065 - DNA, 27 bp, Artificial Sequences
  Synthetic
taggggtcgtcggaggttttcgcgttt

SEQ ID NO: 17066 - DNA, 27 bp, Artificial Sequences
  Synthetic
ttaggggtcgtcggaggttttcgcgtt

SEQ ID NO: 17067 - DNA, 27 bp, Artificial Sequences
  Synthetic
tttaggggtcgtcggaggttttcgcgt

SEQ ID NO: 17068 - DNA, 27 bp, Artificial Sequences
  Synthetic
taggaggcggcgggttagataggggtt

SEQ ID NO: 17069 - DNA, 27 bp, Artificial Sequences
  Synthetic
aggaggtaggaggcggcgggttagata

SEQ ID NO: 17070 - DNA, 32 bp, Artificial Sequences
  Synthetic
tttttggggtatttcggtatttttcggggttt

SEQ ID NO: 17071 - DNA, 32 bp, Artificial Sequences
  Synthetic
ttttttggggtatttcggtatttttcggggtt

SEQ ID NO: 17072 - DNA, 33 bp, Artificial Sequences
  Synthetic
ttttttggggtatttcggtatttttcggggttt

SEQ ID NO: 17073 - DNA, 27 bp, Artificial Sequences
  Synthetic
ttggagggggagtttcgggttttcgga

SEQ ID NO: 17074 - DNA, 27 bp, Artificial Sequences
  Synthetic
gttggagggggagtttcgggttttcgg

SEQ ID NO: 17075 - DNA, 28 bp, Artificial Sequences
  Synthetic
gttggagggggagtttcgggttttcgga

SEQ ID NO: 17076 - DNA, 28 bp, Artificial Sequences
  Synthetic
tgttggagggggagtttcgggttttcgg

SEQ ID NO: 17077 - DNA, 26 bp, Artificial Sequences
  Synthetic
tggagggggagtttcgggttttcgga

SEQ ID NO: 17078 - DNA, 30 bp, Artificial Sequences
  Synthetic
cgtagttgtggttttggggtttttgatggt

SEQ ID NO: 17079 - DNA, 31 bp, Artificial Sequences
  Synthetic
cgtagttgtggttttggggtttttgatggta

SEQ ID NO: 17080 - DNA, 32 bp, Artificial Sequences
  Synthetic
cgtagttgtggttttggggtttttgatggtat

SEQ ID NO: 17081 - DNA, 32 bp, Artificial Sequences
  Synthetic
ttgtggttttggggtttttgatggtattacgt

SEQ ID NO: 17082 - DNA, 33 bp, Artificial Sequences
  Synthetic
gttgtggttttggggtttttgatggtattacgt

SEQ ID NO: 17083 - DNA, 30 bp, Artificial Sequences; identical to SEQ ID NO: 17078
  Synthetic

SEQ ID NO: 17084 - DNA, 31 bp, Artificial Sequences; identical to SEQ ID NO: 17079
  Synthetic

SEQ ID NO: 17085 - DNA, 32 bp, Artificial Sequences; identical to SEQ ID NO: 17080
  Synthetic

SEQ ID NO: 17086 - DNA, 32 bp, Artificial Sequences; identical to SEQ ID NO: 17081
  Synthetic

SEQ ID NO: 17087 - DNA, 33 bp, Artificial Sequences; identical to SEQ ID NO: 17082
  Synthetic

SEQ ID NO: 17088 - DNA, 27 bp, Artificial Sequences
  Synthetic
cgtagttaggagcgggattttgggcgc

SEQ ID NO: 17089 - DNA, 27 bp, Artificial Sequences
  Synthetic
gcgtagttaggagcgggattttgggcg

SEQ ID NO: 17090 - DNA, 27 bp, Artificial Sequences
  Synthetic
cgcggaggtgggttcgattcgttaggt

SEQ ID NO: 17091 - DNA, 27 bp, Artificial Sequences
  Synthetic
ggtagggggagagttcgggtttgcgta

SEQ ID NO: 17092 - DNA, 27 bp, Artificial Sequences
  Synthetic
ggaagttgcggtaggggttgggttcgt

SEQ ID NO: 17093 - DNA, 27 bp, Artificial Sequences
  Synthetic
agtagagggttatgggttagcggcgcg

SEQ ID NO: 17094 - DNA, 27 bp, Artificial Sequences
  Synthetic
ggttatgggttagcggcgcgggttttt

SEQ ID NO: 17095 - DNA, 27 bp, Artificial Sequences
  Synthetic
tgggttagcggcgcgggtttttaatgt

SEQ ID NO: 17096 - DNA, 27 bp, Artificial Sequences
  Synthetic
gtagagggttatgggttagcggcgcgg

SEQ ID NO: 17097 - DNA, 26 bp, Artificial Sequences
  Synthetic
ggttatgggttagcggcgcgggtttt

SEQ ID NO: 17098 - DNA, 27 bp, Artificial Sequences
  Synthetic
gaaagggagttttcgggcggttgtggg

SEQ ID NO: 17099 - DNA, 27 bp, Artificial Sequences
  Synthetic
tcggagttagtagttgttggggcggcg

SEQ ID NO: 17100 - DNA, 27 bp, Artificial Sequences
  Synthetic
cgcggggttagaggaggggatttggat

SEQ ID NO: 17101 - DNA, 27 bp, Artificial Sequences
  Synthetic
tagcgcggggttagaggaggggatttg

SEQ ID NO: 17102 - DNA, 27 bp, Artificial Sequences
  Synthetic
cggagttagtagttgttggggcggcgt

SEQ ID NO: 17103 - DNA, 27 bp, Artificial Sequences
  Synthetic
cgatggggaggggtagggaaggaggtt

SEQ ID NO: 17104 - DNA, 27 bp, Artificial Sequences
  Synthetic
gtcgatggggaggggtagggaaggagg

SEQ ID NO: 17105 - DNA, 27 bp, Artificial Sequences
  Synthetic
ggtcgatggggaggggtagggaaggag

SEQ ID NO: 17106 - DNA, 26 bp, Artificial Sequences
  Synthetic
tcgatggggaggggtagggaaggagg

SEQ ID NO: 17107 - DNA, 27 bp, Artificial Sequences
  Synthetic
tcgatggggaggggtagggaaggaggt

SEQ ID NO: 17108 - DNA, 27 bp, Artificial Sequences
  Synthetic
tcggagttagtagttgttggggcggcg

SEQ ID NO: 17109 - DNA, 27 bp, Artificial Sequences
  Synthetic
cggagttagtagttgttggggcggcgt

SEQ ID NO: 17110 - DNA, 27 bp, Artificial Sequences
  Synthetic
ggagttagtagttgttggggcggcgtt

SEQ ID NO: 17111 - DNA, 26 bp, Artificial Sequences
  Synthetic
ggagttttcgggcggttgtgggtgtc

SEQ ID NO: 17112 - DNA, 26 bp, Artificial Sequences
  Synthetic
gagttttcgggcggttgtgggtgtcg

SEQ ID NO: 17113 - DNA, 27 bp, Artificial Sequences
  Synthetic
aattggggatcgggtgagaagggggtg

SEQ ID NO: 17114 - DNA, 27 bp, Artificial Sequences
  Synthetic
cgatggggaggggtagggaaggaggtt

SEQ ID NO: 17115 - DNA, 27 bp, Artificial Sequences
  Synthetic
aaattggggatcgggtgagaagggggt

SEQ ID NO: 17116 - DNA, 27 bp, Artificial Sequences
  Synthetic
gtcgatggggaggggtagggaaggagg

SEQ ID NO: 17117 - DNA, 27 bp, Artificial Sequences
  Synthetic
ggtcgatggggaggggtagggaaggag

SEQ ID NO: 17118 - DNA, 27 bp, Artificial Sequences
  Synthetic
gattcggtttttcggggttgcggcgtt

SEQ ID NO: 17119 - DNA, 27 bp, Artificial Sequences
  Synthetic
gtcgtgcgtaggttcggcgaggatatc

SEQ ID NO: 17120 - DNA, 27 bp, Artificial Sequences
  Synthetic
cgcgttgggttcggttaaagtcgttcg

SEQ ID NO: 17121 - DNA, 28 bp, Artificial Sequences
  Synthetic
cgcgttgggttcggttaaagtcgttcgt

SEQ ID NO: 17122 - DNA, 26 bp, Artificial Sequences
  Synthetic
attcggtttttcggggttgcggcgtt

SEQ ID NO: 17123 - DNA, 27 bp, Artificial Sequences
  Synthetic
gggaggtcgggtttaggtttttggcgc

SEQ ID NO: 17124 - DNA, 27 bp, Artificial Sequences
  Synthetic
cgaggcgtttaggtagtgcggtagggg

SEQ ID NO: 17125 - DNA, 27 bp, Artificial Sequences
  Synthetic
cgggaggtcgggtttaggtttttggcg

SEQ ID NO: 17126 - DNA, 27 bp, Artificial Sequences
  Synthetic
gaggtcgggtttaggtttttggcgcgg

SEQ ID NO: 17127 - DNA, 27 bp, Artificial Sequences
  Synthetic
ggaggtcgggtttaggtttttggcgcg

SEQ ID NO: 17128 - DNA, 27 bp, Artificial Sequences
  Synthetic
tcggtttttcggggttgcggcgttatc

SEQ ID NO: 17129 - DNA, 27 bp, Artificial Sequences
  Synthetic
ttcggtttttcggggttgcggcgttat

SEQ ID NO: 17130 - DNA, 27 bp, Artificial Sequences
  Synthetic
attcggtttttcggggttgcggcgtta

SEQ ID NO: 17131 - DNA, 27 bp, Artificial Sequences
  Synthetic
ttggattcggtttttcggggttgcggc

SEQ ID NO: 17132 - DNA, 27 bp, Artificial Sequences
  Synthetic
gattcggtttttcggggttgcggcgtt

SEQ ID NO: 17133 - DNA, 27 bp, Artificial Sequences
  Synthetic
ggttttcgtaggatagaggcgggcggt

SEQ ID NO: 17134 - DNA, 27 bp, Artificial Sequences
  Synthetic
cggttttcgtaggatagaggcgggcgg

SEQ ID NO: 17135 - DNA, 28 bp, Artificial Sequences
  Synthetic
ggttttcgtaggatagaggcgggcggtt

SEQ ID NO: 17136 - DNA, 27 bp, Artificial Sequences
  Synthetic
agaggcgggcggttatttgttcggatt

SEQ ID NO: 17137 - DNA, 27 bp, Artificial Sequences
  Synthetic
gttttcgtaggatagaggcgggcggtt

SEQ ID NO: 17138 - DNA, 27 bp, Artificial Sequences
  Synthetic
ggttttcgtaggatagaggcgggcggt

SEQ ID NO: 17139 - DNA, 27 bp, Artificial Sequences
  Synthetic
cggttttcgtaggatagaggcgggcgg

SEQ ID NO: 17140 - DNA, 28 bp, Artificial Sequences
  Synthetic
ggttttcgtaggatagaggcgggcggtt

SEQ ID NO: 17141 - DNA, 27 bp, Artificial Sequences
  Synthetic
agaggcgggcggttatttgttcggatt

SEQ ID NO: 17142 - DNA, 27 bp, Artificial Sequences
  Synthetic
gttttcgtaggatagaggcgggcggtt

SEQ ID NO: 17143 - DNA, 27 bp, Artificial Sequences
  Synthetic
ggttttcgtaggatagaggcgggcggt

SEQ ID NO: 17144 - DNA, 27 bp, Artificial Sequences
  Synthetic
cggttttcgtaggatagaggcgggcgg

SEQ ID NO: 17145 - DNA, 28 bp, Artificial Sequences
  Synthetic
ggttttcgtaggatagaggcgggcggtt

SEQ ID NO: 17146 - DNA, 27 bp, Artificial Sequences
  Synthetic
agaggcgggcggttatttgttcggatt

SEQ ID NO: 17147 - DNA, 27 bp, Artificial Sequences
  Synthetic
gttttcgtaggatagaggcgggcggtt

SEQ ID NO: 17148 - DNA, 27 bp, Artificial Sequences
  Synthetic
agcgaagttacggggttgggttaggtt

SEQ ID NO: 17149 - DNA, 27 bp, Artificial Sequences
  Synthetic
tagcgaagttacggggttgggttaggt

SEQ ID NO: 17150 - DNA, 27 bp, Artificial Sequences
  Synthetic
gcgaagttacggggttgggttaggttt

SEQ ID NO: 17151 - DNA, 28 bp, Artificial Sequences
  Synthetic
agcgaagttacggggttgggttaggttt

SEQ ID NO: 17152 - DNA, 27 bp, Artificial Sequences
  Synthetic
gttgtttgggggtattggggtggaagt

SEQ ID NO: 17153 - DNA, 28 bp, Artificial Sequences
  Synthetic
gggtaggggttggaagtttgggtagggg

SEQ ID NO: 17154 - DNA, 27 bp, Artificial Sequences
  Synthetic
tgggtaggggttaggatgaagtggggt

SEQ ID NO: 17155 - DNA, 28 bp, Artificial Sequences
  Synthetic
ggtaggggttggaagtttgggtaggggt

SEQ ID NO: 17156 - DNA, 28 bp, Artificial Sequences
  Synthetic
tgggtaggggttggaagtttgggtaggg

SEQ ID NO: 17157 - DNA, 28 bp, Artificial Sequences
  Synthetic
ggggtagttgtgggtaggggttggaagt

SEQ ID NO: 17158 - DNA, 27 bp, Artificial Sequences
  Synthetic
gggtgttcgtgttatgtgtttcgggcg

SEQ ID NO: 17159 - DNA, 28 bp, Artificial Sequences
  Synthetic
gggtgttcgtgttatgtgtttcgggcgt

SEQ ID NO: 17160 - DNA, 28 bp, Artificial Sequences
  Synthetic
tgggtgttcgtgttatgtgtttcgggcg

SEQ ID NO: 17161 - DNA, 27 bp, Artificial Sequences
  Synthetic
ggtgttcgtgttatgtgtttcgggcgt

SEQ ID NO: 17162 - DNA, 27 bp, Artificial Sequences
  Synthetic
tgggtgttcgtgttatgtgtttcgggc

SEQ ID NO: 17163 - DNA, 27 bp, Artificial Sequences
  Synthetic
cgttttttaggtaggggggcgttcgga

SEQ ID NO: 17164 - DNA, 27 bp, Artificial Sequences
  Synthetic
tcgttttttaggtaggggggcgttcgg

SEQ ID NO: 17165 - DNA, 28 bp, Artificial Sequences
  Synthetic
tcgttttttaggtaggggggcgttcgga

SEQ ID NO: 17166 - DNA, 28 bp, Artificial Sequences
  Synthetic
cgtcgttttttaggtaggggggcgttcg

SEQ ID NO: 17167 - DNA, 28 bp, Artificial Sequences
  Synthetic
gtcgttttttaggtaggggggcgttcgg

SEQ ID NO: 17168 - DNA, 27 bp, Artificial Sequences
  Synthetic
gcggcggcgggagttttttaagaggag

SEQ ID NO: 17169 - DNA, 27 bp, Artificial Sequences
  Synthetic
cggcggcgggagttttttaagaggagg

SEQ ID NO: 17170 - DNA, 27 bp, Artificial Sequences
  Synthetic
ggcggcgggagttttttaagaggagga

SEQ ID NO: 17171 - DNA, 26 bp, Artificial Sequences
  Synthetic
gcggcggcgggagttttttaagagga

SEQ ID NO: 17172 - DNA, 28 bp, Artificial Sequences
  Synthetic
cggcggcgggagttttttaagaggagga

SEQ ID NO: 17173 - DNA, 27 bp, Artificial Sequences
  Synthetic
ggggtggtggttgcggttgttttacgt

SEQ ID NO: 17174 - DNA, 27 bp, Artificial Sequences
  Synthetic
ggggggtggtggttgcggttgttttac

SEQ ID NO: 17175 - DNA, 27 bp, Artificial Sequences
  Synthetic
gttcggtggtagtttcggttcggcgtc

SEQ ID NO: 17176 - DNA, 27 bp, Artificial Sequences
  Synthetic
cggggttttaggtttttcggggggtgg

SEQ ID NO: 17177 - DNA, 27 bp, Artificial Sequences
  Synthetic
cggggtcggggttttaggtttttcggg

SEQ ID NO: 17178 - DNA, 27 bp, Artificial Sequences
  Synthetic
cgtgggcgttcgggaaattcggagttg

SEQ ID NO: 17179 - DNA, 27 bp, Artificial Sequences
  Synthetic
tcgggtcggagttgttatcgggcgttc

SEQ ID NO: 17180 - DNA, 27 bp, Artificial Sequences
  Synthetic
gtgggcgttcgggaaattcggagttgt

SEQ ID NO: 17181 - DNA, 27 bp, Artificial Sequences
  Synthetic
gggtcggagttgttatcgggcgttcgt

SEQ ID NO: 17182 - DNA, 27 bp, Artificial Sequences
  Synthetic
gtcgggtcggagttgttatcgggcgtt

SEQ ID NO: 17183 - DNA, 27 bp, Artificial Sequences
  Synthetic
cggagttcgttcggggattatttgcgc

SEQ ID NO: 17184 - DNA, 25 bp, Artificial Sequences
  Synthetic
cggttcggcggttcgttcggagttc

SEQ ID NO: 17185 - DNA, 26 bp, Artificial Sequences
  Synthetic
acggttcggcggttcgttcggagttc

SEQ ID NO: 17186 - DNA, 25 bp, Artificial Sequences
  Synthetic
acggttcggcggttcgttcggagtt

SEQ ID NO: 17187 - DNA, 24 bp, Artificial Sequences
  Synthetic
cggttcggcggttcgttcggagtt

SEQ ID NO: 17188 - DNA, 27 bp, Artificial Sequences
  Synthetic
gaggtcgggtggtttaggttgtagggt

SEQ ID NO: 17189 - DNA, 28 bp, Artificial Sequences
  Synthetic
cgtagaggaggggtagacgtggattggt

SEQ ID NO: 17190 - DNA, 27 bp, Artificial Sequences
  Synthetic
cgtagaggaggggtagacgtggattgg

SEQ ID NO: 17191 - DNA, 29 bp, Artificial Sequences
  Synthetic
tcgtagaggaggggtagacgtggattggt

SEQ ID NO: 17192 - DNA, 28 bp, Artificial Sequences
  Synthetic
tcgtagaggaggggtagacgtggattgg

SEQ ID NO: 17193 - DNA, 27 bp, Artificial Sequences
  Synthetic
tgcgtgatttgtagggaggtgggtgtg

SEQ ID NO: 17194 - DNA, 28 bp, Artificial Sequences
  Synthetic
tgcgtgatttgtagggaggtgggtgtga

SEQ ID NO: 17195 - DNA, 27 bp, Artificial Sequences
  Synthetic
gcgtgatttgtagggaggtgggtgtga

SEQ ID NO: 17196 - DNA, 27 bp, Artificial Sequences
  Synthetic
ttgcgtgatttgtagggaggtgggtgt

SEQ ID NO: 17197 - DNA, 27 bp, Artificial Sequences
  Synthetic
agttgcgtgatttgtagggaggtgggt

SEQ ID NO: 17198 - DNA, 28 bp, Artificial Sequences
  Synthetic
cgtaggtttcggaattatcggttcggcg

SEQ ID NO: 17199 - DNA, 29 bp, Artificial Sequences
  Synthetic
cgtaggtttcggaattatcggttcggcgt

SEQ ID NO: 17200 - DNA, 29 bp, Artificial Sequences
  Synthetic
tcgtaggtttcggaattatcggttcggcg

SEQ ID NO: 17201 - DNA, 30 bp, Artificial Sequences
  Synthetic
tcgtaggtttcggaattatcggttcggcgt

SEQ ID NO: 17202 - DNA, 27 bp, Artificial Sequences
  Synthetic
aggtttcggaattatcggttcggcgta

SEQ ID NO: 17203 - DNA, 27 bp, Artificial Sequences
  Synthetic
tgtcgttgggttgcgtcggggaagtta

SEQ ID NO: 17204 - DNA, 27 bp, Artificial Sequences
  Synthetic
tttttcgtgtcgttgggttgcgtcggg

SEQ ID NO: 17205 - DNA, 27 bp, Artificial Sequences
  Synthetic
gtcgttgggttgcgtcggggaagttac

SEQ ID NO: 17206 - DNA, 27 bp, Artificial Sequences
  Synthetic
aaagtttggagcgtttcgggggcgtag

SEQ ID NO: 17207 - DNA, 27 bp, Artificial Sequences
  Synthetic
gaaagtttggagcgtttcgggggcgta

SEQ ID NO: 17208 - DNA, 27 bp, Artificial Sequences
  Synthetic
ttcgatcgggcgttttggtattggcgg

SEQ ID NO: 17209 - DNA, 27 bp, Artificial Sequences
  Synthetic
cgttttggtattggcgggcggggattt

SEQ ID NO: 17210 - DNA, 28 bp, Artificial Sequences
  Synthetic
tttcgatcgggcgttttggtattggcgg

SEQ ID NO: 17211 - DNA, 26 bp, Artificial Sequences
  Synthetic
cgttttggtattggcgggcggggatt

SEQ ID NO: 17212 - DNA, 28 bp, Artificial Sequences
  Synthetic
cgttttggtattggcgggcggggatttt

SEQ ID NO: 17213 - DNA, 27 bp, Artificial Sequences
  Synthetic
tcgagggttaagggggttttcgttcgt

SEQ ID NO: 17214 - DNA, 29 bp, Artificial Sequences
  Synthetic
cgttagtgttaaagcgttcggtcggaggc

SEQ ID NO: 17215 - DNA, 27 bp, Artificial Sequences
  Synthetic
ttagtgttaaagcgttcggtcggaggc

SEQ ID NO: 17216 - DNA, 27 bp, Artificial Sequences
  Synthetic
cgagggttaagggggttttcgttcgtt

SEQ ID NO: 17217 - DNA, 27 bp, Artificial Sequences
  Synthetic
ttcgagggttaagggggttttcgttcg

SEQ ID NO: 17218 - DNA, 27 bp, Artificial Sequences
  Synthetic
ttcgatcgggcgttttggtattggcgg

SEQ ID NO: 17219 - DNA, 27 bp, Artificial Sequences
  Synthetic
cgtttgtaggcggggttttcgggttgt

SEQ ID NO: 17220 - DNA, 27 bp, Artificial Sequences
  Synthetic
tcgtttgtaggcggggttttcgggttg

SEQ ID NO: 17221 - DNA, 28 bp, Artificial Sequences
  Synthetic
tttcgatcgggcgttttggtattggcgg

SEQ ID NO: 17222 - DNA, 27 bp, Artificial Sequences
  Synthetic
atcgtttgtaggcggggttttcgggtt

SEQ ID NO: 17223 - DNA, 27 bp, Artificial Sequences
  Synthetic
ttagtgttaaagcgttcggtcggaggc

SEQ ID NO: 17224 - DNA, 28 bp, Artificial Sequences
  Synthetic
gttagtgttaaagcgttcggtcggaggc

SEQ ID NO: 17225 - DNA, 27 bp, Artificial Sequences
  Synthetic
gcggttcggtcggtagttgtagtgtag

SEQ ID NO: 17226 - DNA, 28 bp, Artificial Sequences
  Synthetic
gcggttcggtcggtagttgtagtgtaga

SEQ ID NO: 17227 - DNA, 27 bp, Artificial Sequences
  Synthetic
ggtcggaggcggaaggaagtgatattt

SEQ ID NO: 17228 - DNA, 27 bp, Artificial Sequences
  Synthetic
ggattggggttggggaggttttgaggg

SEQ ID NO: 17229 - DNA, 27 bp, Artificial Sequences
  Synthetic
gggattggggttggggaggttttgagg

SEQ ID NO: 17230 - DNA, 28 bp, Artificial Sequences
  Synthetic
agggattggggttggggaggttttgagg

SEQ ID NO: 17231 - DNA, 28 bp, Artificial Sequences
  Synthetic
ggattggggttggggaggttttgagggt

SEQ ID NO: 17232 - DNA, 27 bp, Artificial Sequences
  Synthetic
gattggggttggggaggttttgagggt

SEQ ID NO: 17233 - DNA, 34 bp, Artificial Sequences
  Synthetic
gagagtttcgtttgtaggcggtgtagatatatgt

SEQ ID NO: 17234 - DNA, 36 bp, Artificial Sequences
  Synthetic
gagagtttcgtttgtaggcggtgtagatatatgtag

SEQ ID NO: 17235 - DNA, 27 bp, Artificial Sequences
  Synthetic
cggtagggattggggttggggaggttt

SEQ ID NO: 17236 - DNA, 27 bp, Artificial Sequences
  Synthetic
tcggtagggattggggttggggaggtt

SEQ ID NO: 17237 - DNA, 27 bp, Artificial Sequences
  Synthetic
agtcggtagggattggggttggggagg

SEQ ID NO: 17238 - DNA, 27 bp, Artificial Sequences
  Synthetic
ggattggggttggggaggttttgaggg

SEQ ID NO: 17239 - DNA, 27 bp, Artificial Sequences
  Synthetic
gggattggggttggggaggttttgagg

SEQ ID NO: 17240 - DNA, 27 bp, Artificial Sequences
  Synthetic
gcgttgggaattttcgggatagcgagt

SEQ ID NO: 17241 - DNA, 28 bp, Artificial Sequences
  Synthetic
gcgttgggaattttcgggatagcgagtt

SEQ ID NO: 17242 - DNA, 29 bp, Artificial Sequences
  Synthetic
gcgttgggaattttcgggatagcgagttc

SEQ ID NO: 17243 - DNA, 26 bp, Artificial Sequences
  Synthetic
gcgttgggaattttcgggatagcgag

SEQ ID NO: 17244 - DNA, 28 bp, Artificial Sequences
  Synthetic
cgttgggaattttcgggatagcgagttc

SEQ ID NO: 17245 - DNA, 27 bp, Artificial Sequences
  Synthetic
acggtgggaaggtggggggagtgtata

SEQ ID NO: 17246 - DNA, 27 bp, Artificial Sequences
  Synthetic
cggagaggggaggggtagtgggagttt

SEQ ID NO: 17247 - DNA, 27 bp, Artificial Sequences
  Synthetic
ggtagagggtaggaggcgtggcggata

SEQ ID NO: 17248 - DNA, 27 bp, Artificial Sequences
  Synthetic
ttatggggcgggtagagggtaggaggc

SEQ ID NO: 17249 - DNA, 27 bp, Artificial Sequences
  Synthetic
cggtgggaaggtggggggagtgtatag

SEQ ID NO: 17250 - DNA, 29 bp, Artificial Sequences
  Synthetic
tggtattttgttggacggagagaggaggt

SEQ ID NO: 17251 - DNA, 28 bp, Artificial Sequences
  Synthetic
ggtattttgttggacggagagaggaggt

SEQ ID NO: 17252 - DNA, 28 bp, Artificial Sequences
  Synthetic
tggtattttgttggacggagagaggagg

SEQ ID NO: 17253 - DNA, 30 bp, Artificial Sequences
  Synthetic
ttggtattttgttggacggagagaggaggt

SEQ ID NO: 17254 - DNA, 29 bp, Artificial Sequences
  Synthetic
ttggtattttgttggacggagagaggagg

SEQ ID NO: 17255 - DNA, 26 bp, Artificial Sequences
  Synthetic
ggcgggggtagtcgggatggttgttt

SEQ ID NO: 17256 - DNA, 27 bp, Artificial Sequences
  Synthetic
gggcgggggtagtcgggatggttgttt

SEQ ID NO: 17257 - DNA, 25 bp, Artificial Sequences
  Synthetic
ggcgggggtagtcgggatggttgtt

SEQ ID NO: 17258 - DNA, 28 bp, Artificial Sequences
  Synthetic
cgtcggttcggttttttgtgtttacgcg

SEQ ID NO: 17259 - DNA, 26 bp, Artificial Sequences
  Synthetic
gggcgggggtagtcgggatggttgtt

SEQ ID NO: 17260 - DNA, 26 bp, Artificial Sequences
  Synthetic
cgcgtgggtataaagggtcgggtcgg

SEQ ID NO: 17261 - DNA, 26 bp, Artificial Sequences
  Synthetic
gcgtgggtataaagggtcgggtcggc

SEQ ID NO: 17262 - DNA, 27 bp, Artificial Sequences
  Synthetic
cgtttcggttcgttaggagaggaggga

SEQ ID NO: 17263 - DNA, 27 bp, Artificial Sequences
  Synthetic
tcgtttcggttcgttaggagaggaggg

SEQ ID NO: 17264 - DNA, 28 bp, Artificial Sequences
  Synthetic
tcgtttcggttcgttaggagaggaggga

SEQ ID NO: 17265 - DNA, 28 bp, Artificial Sequences
  Synthetic
cgtcggttcggttttttgtgtttacgcg

SEQ ID NO: 17266 - DNA, 29 bp, Artificial Sequences
  Synthetic
cgtcggttcggttttttgtgtttacgcgt

SEQ ID NO: 17267 - DNA, 29 bp, Artificial Sequences
  Synthetic
tcgtcggttcggttttttgtgtttacgcg

SEQ ID NO: 17268 - DNA, 27 bp, Artificial Sequences
  Synthetic
tcggttcggttttttgtgtttacgcgt

SEQ ID NO: 17269 - DNA, 30 bp, Artificial Sequences
  Synthetic
tcgtcggttcggttttttgtgtttacgcgt

SEQ ID NO: 17270 - DNA, 25 bp, Artificial Sequences
  Synthetic
ggacgggaaggcggatcggggatac

SEQ ID NO: 17271 - DNA, 26 bp, Artificial Sequences
  Synthetic
gggacgggaaggcggatcggggatac

SEQ ID NO: 17272 - DNA, 24 bp, Artificial Sequences
  Synthetic
ggacgggaaggcggatcggggata

SEQ ID NO: 17273 - DNA, 25 bp, Artificial Sequences
  Synthetic
gggacgggaaggcggatcggggata

SEQ ID NO: 17274 - DNA, 27 bp, Artificial Sequences
  Synthetic
gcgtttattgcgtaggttaggttcggg

SEQ ID NO: 17275 - DNA, 27 bp, Artificial Sequences
  Synthetic
gcggtggggtgttgtggagttggtttt

SEQ ID NO: 17276 - DNA, 27 bp, Artificial Sequences
  Synthetic
atttcgcggtggggtgttgtggagttg

SEQ ID NO: 17277 - DNA, 27 bp, Artificial Sequences
  Synthetic
gatttcgcggtggggtgttgtggagtt

SEQ ID NO: 17278 - DNA, 27 bp, Artificial Sequences
  Synthetic
aaggatttcgcggtggggtgttgtgga

SEQ ID NO: 17279 - DNA, 27 bp, Artificial Sequences
  Synthetic
aggatttcgcggtggggtgttgtggag

SEQ ID NO: 17280 - DNA, 28 bp, Artificial Sequences
  Synthetic
cggaatcggttaagggagtggggttcgt

SEQ ID NO: 17281 - DNA, 27 bp, Artificial Sequences
  Synthetic
cggaatcggttaagggagtggggttcg

SEQ ID NO: 17282 - DNA, 27 bp, Artificial Sequences
  Synthetic
ggaatcggttaagggagtggggttcgt

SEQ ID NO: 17283 - DNA, 25 bp, Artificial Sequences
  Synthetic
ggacgggaaggcggatcggggatac

SEQ ID NO: 17284 - DNA, 29 bp, Artificial Sequences
  Synthetic
cggaatcggttaagggagtggggttcgta

SEQ ID NO: 17285 - DNA, 27 bp, Artificial Sequences
  Synthetic
gcggtggggtgttgtggagttggtttt

SEQ ID NO: 17286 - DNA, 27 bp, Artificial Sequences
  Synthetic
atttcgcggtggggtgttgtggagttg

SEQ ID NO: 17287 - DNA, 27 bp, Artificial Sequences
  Synthetic
gatttcgcggtggggtgttgtggagtt

SEQ ID NO: 17288 - DNA, 27 bp, Artificial Sequences
  Synthetic
aaggatttcgcggtggggtgttgtgga

SEQ ID NO: 17289 - DNA, 27 bp, Artificial Sequences
  Synthetic
aggatttcgcggtggggtgttgtggag

SEQ ID NO: 17290 - DNA, 28 bp, Artificial Sequences
  Synthetic
cggaatcggttaagggagtggggttcgt

SEQ ID NO: 17291 - DNA, 27 bp, Artificial Sequences
  Synthetic
cggaatcggttaagggagtggggttcg

SEQ ID NO: 17292 - DNA, 27 bp, Artificial Sequences
  Synthetic
ggaatcggttaagggagtggggttcgt

SEQ ID NO: 17293 - DNA, 27 bp, Artificial Sequences
  Synthetic
agtttttgtagtgttggggtgtgcggt

SEQ ID NO: 17294 - DNA, 29 bp, Artificial Sequences
  Synthetic
cggaatcggttaagggagtggggttcgta

SEQ ID NO: 17295 - DNA, 27 bp, Artificial Sequences
  Synthetic
ttgcgagttttgagtgcgtaggagtgc

SEQ ID NO: 17296 - DNA, 27 bp, Artificial Sequences
  Synthetic
cgtaggagtgcgtagggggagttgatt

SEQ ID NO: 17297 - DNA, 28 bp, Artificial Sequences
  Synthetic
tttgcgagttttgagtgcgtaggagtgc

SEQ ID NO: 17298 - DNA, 26 bp, Artificial Sequences
  Synthetic
tgcgagttttgagtgcgtaggagtgc

SEQ ID NO: 17299 - DNA, 26 bp, Artificial Sequences
  Synthetic
cgtaggagtgcgtagggggagttgat

SEQ ID NO: 17300 - DNA, 27 bp, Artificial Sequences
  Synthetic
agcgttgcgtttattggtcggcgttgg

SEQ ID NO: 17301 - DNA, 27 bp, Artificial Sequences
  Synthetic
tcgttgatagtcggaggggtcgggttt

SEQ ID NO: 17302 - DNA, 27 bp, Artificial Sequences
  Synthetic
ttcgttgatagtcggaggggtcgggtt

SEQ ID NO: 17303 - DNA, 28 bp, Artificial Sequences
  Synthetic
tagcgttgcgtttattggtcggcgttgg

SEQ ID NO: 17304 - DNA, 27 bp, Artificial Sequences
  Synthetic
attcgttgatagtcggaggggtcgggt

SEQ ID NO: 17305 - DNA, 27 bp, Artificial Sequences
  Synthetic
tcgttgatagtcggaggggtcgggttt

SEQ ID NO: 17306 - DNA, 27 bp, Artificial Sequences
  Synthetic
ttcgttgatagtcggaggggtcgggtt

SEQ ID NO: 17307 - DNA, 27 bp, Artificial Sequences
  Synthetic
attcgttgatagtcggaggggtcgggt

SEQ ID NO: 17308 - DNA, 27 bp, Artificial Sequences
  Synthetic
cgttgatagtcggaggggtcgggtttt

SEQ ID NO: 17309 - DNA, 28 bp, Artificial Sequences
  Synthetic
tcgttgatagtcggaggggtcgggtttt

SEQ ID NO: 17310 - DNA, 27 bp, Artificial Sequences
  Synthetic
gtttggacggggattcgggggtagacg

SEQ ID NO: 17311 - DNA, 27 bp, Artificial Sequences
  Synthetic
aaagatggagtcggtaggcgaggggtc

SEQ ID NO: 17312 - DNA, 27 bp, Artificial Sequences
  Synthetic
aagatggagtcggtaggcgaggggtcg

SEQ ID NO: 17313 - DNA, 27 bp, Artificial Sequences
  Synthetic
gcgggttaaagatggagtcggtaggcg

SEQ ID NO: 17314 - DNA, 26 bp, Artificial Sequences
  Synthetic
tttggacggggattcgggggtagacg

SEQ ID NO: 17315 - DNA, 27 bp, Artificial Sequences
  Synthetic
tcgtttagggttcggttaggacgcgga

SEQ ID NO: 17316 - DNA, 27 bp, Artificial Sequences
  Synthetic
cgtttagggttcggttaggacgcggag

SEQ ID NO: 17317 - DNA, 27 bp, Artificial Sequences
  Synthetic
gtttagggttcggttaggacgcggagg

SEQ ID NO: 17318 - DNA, 28 bp, Artificial Sequences
  Synthetic
tcgtttagggttcggttaggacgcggag

SEQ ID NO: 17319 - DNA, 27 bp, Artificial Sequences
  Synthetic
ttcgtttagggttcggttaggacgcgg

SEQ ID NO: 17320 - DNA, 27 bp, Artificial Sequences
  Synthetic
gggattttgggttgggttgggcggttt

SEQ ID NO: 17321 - DNA, 27 bp, Artificial Sequences
  Synthetic
tgatcgggttttgggcggaagggatgt

SEQ ID NO: 17322 - DNA, 27 bp, Artificial Sequences
  Synthetic
tgggttgggttgggcggttttattcgg

SEQ ID NO: 17323 - DNA, 27 bp, Artificial Sequences
  Synthetic
tcgggttttgggcggaagggatgtttg

SEQ ID NO: 17324 - DNA, 27 bp, Artificial Sequences
  Synthetic
gtttggacggggattcgggggtagacg

SEQ ID NO: 17325 - DNA, 27 bp, Artificial Sequences
  Synthetic
aaagagggttttcgggatttcggtcgc

SEQ ID NO: 17326 - DNA, 28 bp, Artificial Sequences
  Synthetic
cggtcgcgttttttcgtttgattcgtcg

SEQ ID NO: 17327 - DNA, 29 bp, Artificial Sequences
  Synthetic
cggtcgcgttttttcgtttgattcgtcga

SEQ ID NO: 17328 - DNA, 29 bp, Artificial Sequences
  Synthetic
tcggtcgcgttttttcgtttgattcgtcg

SEQ ID NO: 17329 - DNA, 27 bp, Artificial Sequences
  Synthetic
tcggtcgcgttttttcgtttgattcgt

SEQ ID NO: 17330 - DNA, 27 bp, Artificial Sequences
  Synthetic
tggtgttgggtggagggttgttaggga

SEQ ID NO: 17331 - DNA, 27 bp, Artificial Sequences
  Synthetic
ttggtgttgggtggagggttgttaggg

SEQ ID NO: 17332 - DNA, 28 bp, Artificial Sequences
  Synthetic
tggtgttgggtggagggttgttagggaa

SEQ ID NO: 17333 - DNA, 28 bp, Artificial Sequences
  Synthetic
ttggtgttgggtggagggttgttaggga

SEQ ID NO: 17334 - DNA, 27 bp, Artificial Sequences
  Synthetic
ggtgttgggtggagggttgttagggaa

SEQ ID NO: 17335 - DNA, 27 bp, Artificial Sequences
  Synthetic
agggttaagtgtcgtggggtttgggga

SEQ ID NO: 17336 - DNA, 28 bp, Artificial Sequences
  Synthetic
gggttaagtgtcgtggggtttggggagt

SEQ ID NO: 17337 - DNA, 27 bp, Artificial Sequences
  Synthetic
gggttaagtgtcgtggggtttggggag

SEQ ID NO: 17338 - DNA, 28 bp, Artificial Sequences
  Synthetic
agggttaagtgtcgtggggtttggggag

SEQ ID NO: 17339 - DNA, 27 bp, Artificial Sequences
  Synthetic
aagtgtcgtggggtttggggagtttgt

SEQ ID NO: 17340 - DNA, 27 bp, Artificial Sequences
  Synthetic
tggtttttcgggggcggggttgtattt

SEQ ID NO: 17341 - DNA, 27 bp, Artificial Sequences
  Synthetic
tcgggggcggggttgtatttgttttgt

SEQ ID NO: 17342 - DNA, 27 bp, Artificial Sequences
  Synthetic
atggtttttcgggggcggggttgtatt

SEQ ID NO: 17343 - DNA, 27 bp, Artificial Sequences
  Synthetic
aatatggtttttcgggggcggggttgt

SEQ ID NO: 17344 - DNA, 28 bp, Artificial Sequences
  Synthetic
ggtttttcgggggcggggttgtatttgt

SEQ ID NO: 17345 - DNA, 27 bp, Artificial Sequences
  Synthetic
aggaggcggttcggttagggttttggt

SEQ ID NO: 17346 - DNA, 27 bp, Artificial Sequences
  Synthetic
gtggaaggaggcggttcggttagggtt

SEQ ID NO: 17347 - DNA, 27 bp, Artificial Sequences
  Synthetic
agttcgggaggtttttcggtcgttgcg

SEQ ID NO: 17348 - DNA, 27 bp, Artificial Sequences
  Synthetic
tggaaggaggcggttcggttagggttt

SEQ ID NO: 17349 - DNA, 27 bp, Artificial Sequences
  Synthetic
gttcgggaggtttttcggtcgttgcgg

SEQ ID NO: 17350 - DNA, 27 bp, Artificial Sequences
  Synthetic
cgggtcgttaggtttttgggggcgttt

SEQ ID NO: 17351 - DNA, 27 bp, Artificial Sequences
  Synthetic
gtttttgggggcgttttttcgggcgtt

SEQ ID NO: 17352 - DNA, 27 bp, Artificial Sequences
  Synthetic
gtagcgggtcgttaggtttttgggggc

SEQ ID NO: 17353 - DNA, 27 bp, Artificial Sequences
  Synthetic
ggggcgttttttcgggcgtttcggtta

SEQ ID NO: 17354 - DNA, 27 bp, Artificial Sequences
  Synthetic
ttttgggggcgttttttcgggcgtttc

SEQ ID NO: 17355 - DNA, 30 bp, Artificial Sequences
  Synthetic
cgtgggtagatttagtaggcgggttttggc

SEQ ID NO: 17356 - DNA, 28 bp, Artificial Sequences
  Synthetic
tgggtagatttagtaggcgggttttggc

SEQ ID NO: 17357 - DNA, 31 bp, Artificial Sequences
  Synthetic
tcgtgggtagatttagtaggcgggttttggc

SEQ ID NO: 17358 - DNA, 29 bp, Artificial Sequences
  Synthetic
gtgggtagatttagtaggcgggttttggc

SEQ ID NO: 17359 - DNA, 29 bp, Artificial Sequences
  Synthetic
cgtgggtagatttagtaggcgggttttgg

SEQ ID NO: 17360 - DNA, 27 bp, Artificial Sequences
  Synthetic
gggtgtcggtggggagtagaggtattt

SEQ ID NO: 17361 - DNA, 28 bp, Artificial Sequences
  Synthetic
gggtgtcggtggggagtagaggtatttt

SEQ ID NO: 17362 - DNA, 27 bp, Artificial Sequences
  Synthetic
gtcgagaggtgttatttttagcgggcg

SEQ ID NO: 17363 - DNA, 28 bp, Artificial Sequences
  Synthetic
agtcgagaggtgttatttttagcgggcg

SEQ ID NO: 17364 - DNA, 26 bp, Artificial Sequences
  Synthetic
gggtgtcggtggggagtagaggtatt

SEQ ID NO: 17365 - DNA, 27 bp, Artificial Sequences
  Synthetic
gggaggggggagggtaggttttttggg

SEQ ID NO: 17366 - DNA, 27 bp, Artificial Sequences
  Synthetic
ggggaggggggagggtaggttttttgg

SEQ ID NO: 17367 - DNA, 27 bp, Artificial Sequences
  Synthetic
tggggaggggggagggtaggttttttg

SEQ ID NO: 17368 - DNA, 27 bp, Artificial Sequences
  Synthetic
ggaggggggagggtaggttttttggga

SEQ ID NO: 17369 - DNA, 27 bp, Artificial Sequences
  Synthetic
ggatggggaggggggagggtaggtttt

SEQ ID NO: 17370 - DNA, 27 bp, Artificial Sequences
  Synthetic
tcgaagaaaataggaggaggagcgggt

SEQ ID NO: 17371 - DNA, 28 bp, Artificial Sequences
  Synthetic
tcgaagaaaataggaggaggagcgggta

SEQ ID NO: 17372 - DNA, 26 bp, Artificial Sequences
  Synthetic
cgaagaaaataggaggaggagcgggt

SEQ ID NO: 17373 - DNA, 29 bp, Artificial Sequences
  Synthetic
tcgaagaaaataggaggaggagcgggtat

SEQ ID NO: 17374 - DNA, 30 bp, Artificial Sequences
  Synthetic
tcgaagaaaataggaggaggagcgggtata

SEQ ID NO: 17375 - DNA, 30 bp, Artificial Sequences
  Synthetic
aggttgaggtttgtattatttcggtcggga

SEQ ID NO: 17376 - DNA, 31 bp, Artificial Sequences
  Synthetic
aggttgaggtttgtattatttcggtcgggag

SEQ ID NO: 17377 - DNA, 31 bp, Artificial Sequences
  Synthetic
ggttgaggtttgtattatttcggtcgggaga

SEQ ID NO: 17378 - DNA, 32 bp, Artificial Sequences
  Synthetic
aggttgaggtttgtattatttcggtcgggaga

SEQ ID NO: 17379 - DNA, 32 bp, Artificial Sequences
  Synthetic
taggttgaggtttgtattatttcggtcgggag

SEQ ID NO: 17380 - DNA, 27 bp, Artificial Sequences
  Synthetic
gtttttcgggaagatggttgtcgtggt

SEQ ID NO: 17381 - DNA, 28 bp, Artificial Sequences
  Synthetic
agtttttcgggaagatggttgtcgtggt

SEQ ID NO: 17382 - DNA, 28 bp, Artificial Sequences
  Synthetic
gtttttcgggaagatggttgtcgtggtt

SEQ ID NO: 17383 - DNA, 29 bp, Artificial Sequences
  Synthetic
agtttttcgggaagatggttgtcgtggtt

SEQ ID NO: 17384 - DNA, 29 bp, Artificial Sequences
  Synthetic
ggaggaggttattgggaaacgttgttggt

SEQ ID NO: 17385 - DNA, 27 bp, Artificial Sequences
  Synthetic
tttgggagtgggagtggggagagttgc

SEQ ID NO: 17386 - DNA, 27 bp, Artificial Sequences
  Synthetic
cggagtttttgggagtgggagtgggga

SEQ ID NO: 17387 - DNA, 27 bp, Artificial Sequences
  Synthetic
gcgtcgggtaggtagggtagggaggtt

SEQ ID NO: 17388 - DNA, 27 bp, Artificial Sequences
  Synthetic
ggagtgggagtggggagagttgcgtta

SEQ ID NO: 17389 - DNA, 27 bp, Artificial Sequences
  Synthetic
tgcggagtttttgggagtgggagtggg

SEQ ID NO: 17390 - DNA, 27 bp, Artificial Sequences
  Synthetic
tggtagttggtcggttatgggtcgtgt

SEQ ID NO: 17391 - DNA, 27 bp, Artificial Sequences
  Synthetic
tggtatcgaggttgttaggagggcgtt

SEQ ID NO: 17392 - DNA, 27 bp, Artificial Sequences
  Synthetic
ttggtatcgaggttgttaggagggcgt

SEQ ID NO: 17393 - DNA, 28 bp, Artificial Sequences
  Synthetic
tggtatcgaggttgttaggagggcgttg

SEQ ID NO: 17394 - DNA, 27 bp, Artificial Sequences
  Synthetic
ggtatcgaggttgttaggagggcgttg

SEQ ID NO: 17395 - DNA, 27 bp, Artificial Sequences
  Synthetic
gttagcgtttcggggtgatcgggttgg

SEQ ID NO: 17396 - DNA, 27 bp, Artificial Sequences
  Synthetic
ttcggggtgatcgggttgggttgtagt

SEQ ID NO: 17397 - DNA, 27 bp, Artificial Sequences
  Synthetic
ttagcgtttcggggtgatcgggttggg

SEQ ID NO: 17398 - DNA, 27 bp, Artificial Sequences
  Synthetic
tgttagcgtttcggggtgatcgggttg

SEQ ID NO: 17399 - DNA, 27 bp, Artificial Sequences
  Synthetic
cgtttcggggtgatcgggttgggttgt

SEQ ID NO: 17400 - DNA, 27 bp, Artificial Sequences
  Synthetic
tgttgggaggagggttggtttgagggg

SEQ ID NO: 17401 - DNA, 27 bp, Artificial Sequences
  Synthetic
tgaggtttgggattgcggggttagggt

SEQ ID NO: 17402 - DNA, 27 bp, Artificial Sequences
  Synthetic
gttgggaggagggttggtttgagggga

SEQ ID NO: 17403 - DNA, 27 bp, Artificial Sequences
  Synthetic
tgggaggagggttggtttgaggggaaa

SEQ ID NO: 17404 - DNA, 27 bp, Artificial Sequences
  Synthetic
ttgggaggagggttggtttgaggggaa

SEQ ID NO: 17405 - DNA, 27 bp, Artificial Sequences
  Synthetic
gtgttgatcggaagcgggtgagagagt

SEQ ID NO: 17406 - DNA, 28 bp, Artificial Sequences
  Synthetic
agtgttgatcggaagcgggtgagagagt

SEQ ID NO: 17407 - DNA, 27 bp, Artificial Sequences
  Synthetic
agtgttgatcggaagcgggtgagagag

SEQ ID NO: 17408 - DNA, 27 bp, Artificial Sequences
  Synthetic
aagtgttgatcggaagcgggtgagaga

SEQ ID NO: 17409 - DNA, 27 bp, Artificial Sequences
  Synthetic
tgaaagtgttgatcggaagcgggtgag

SEQ ID NO: 17410 - DNA, 27 bp, Artificial Sequences
  Synthetic
tatcggcgttgtggtgggggtttggta

SEQ ID NO: 17411 - DNA, 27 bp, Artificial Sequences
  Synthetic
ggcgttgtggtgggggtttggtagttt

SEQ ID NO: 17412 - DNA, 27 bp, Artificial Sequences
  Synthetic
attatcggcgttgtggtgggggtttgg

SEQ ID NO: 17413 - DNA, 27 bp, Artificial Sequences
  Synthetic
ttatcggcgttgtggtgggggtttggt

SEQ ID NO: 17414 - DNA, 27 bp, Artificial Sequences
  Synthetic
ggtttgttagggttgggtgtggtgggg

SEQ ID NO: 17415 - DNA, 27 bp, Artificial Sequences
  Synthetic
ttcgggtagttggtgttgaggtgggcg

SEQ ID NO: 17416 - DNA, 27 bp, Artificial Sequences
  Synthetic
cgggtagttggtgttgaggtgggcgtt

SEQ ID NO: 17417 - DNA, 27 bp, Artificial Sequences
  Synthetic
gggtagttggtgttgaggtgggcgttt

SEQ ID NO: 17418 - DNA, 27 bp, Artificial Sequences
  Synthetic
tttcgggtagttggtgttgaggtgggc

SEQ ID NO: 17419 - DNA, 26 bp, Artificial Sequences
  Synthetic
tcgggtagttggtgttgaggtgggcg

SEQ ID NO: 17420 - DNA, 27 bp, Artificial Sequences
  Synthetic
ggtaggaggggcggtgttggttacgtt

SEQ ID NO: 17421 - DNA, 27 bp, Artificial Sequences
  Synthetic
gtaggaggcggacgggaaaaaggggtt

SEQ ID NO: 17422 - DNA, 27 bp, Artificial Sequences
  Synthetic
ggagggaatggaggagtaggaggcgga

SEQ ID NO: 17423 - DNA, 27 bp, Artificial Sequences
  Synthetic
ggagcgggtttatgttgttgggcgtgt

SEQ ID NO: 17424 - DNA, 27 bp, Artificial Sequences
  Synthetic
tggagcgggtttatgttgttgggcgtg

SEQ ID NO: 17425 - DNA, 33 bp, Artificial Sequences
  Synthetic
agacgaggtgaatgttatttttgttttggggtt

SEQ ID NO: 17426 - DNA, 34 bp, Artificial Sequences
  Synthetic
acgaggtgaatgttatttttgttttggggttagg

SEQ ID NO: 17427 - DNA, 34 bp, Artificial Sequences
  Synthetic
cgaggtgaatgttatttttgttttggggttagga

SEQ ID NO: 17428 - DNA, 35 bp, Artificial Sequences
  Synthetic
acgaggtgaatgttatttttgttttggggttagga

SEQ ID NO: 17429 - DNA, 35 bp, Artificial Sequences
  Synthetic
gacgaggtgaatgttatttttgttttggggttagg

SEQ ID NO: 17430 - DNA, 27 bp, Artificial Sequences
  Synthetic
tggtttgcgtggggtttgtgagttcgt

SEQ ID NO: 17431 - DNA, 28 bp, Artificial Sequences
  Synthetic
tggtttgcgtggggtttgtgagttcgtt

SEQ ID NO: 17432 - DNA, 27 bp, Artificial Sequences
  Synthetic
ggtttgcgtggggtttgtgagttcgtt

SEQ ID NO: 17433 - DNA, 28 bp, Artificial Sequences
  Synthetic
atggtttgcgtggggtttgtgagttcgt

SEQ ID NO: 17434 - DNA, 27 bp, Artificial Sequences
  Synthetic
atggtttgcgtggggtttgtgagttcg

SEQ ID NO: 17435 - DNA, 27 bp, Artificial Sequences
  Synthetic
ttttgtagaggttcgggggttgggggg

SEQ ID NO: 17436 - DNA, 27 bp, Artificial Sequences
  Synthetic
ggatttttaaggggaggcgtcggggga

SEQ ID NO: 17437 - DNA, 27 bp, Artificial Sequences
  Synthetic
atttttaaggggaggcgtcgggggagg

SEQ ID NO: 17438 - DNA, 27 bp, Artificial Sequences
  Synthetic
ggcggcggttggatttgggtagttgtt

SEQ ID NO: 17439 - DNA, 27 bp, Artificial Sequences
  Synthetic
tcgggggatttttaaggggaggcgtcg

SEQ ID NO: 17440 - DNA, 27 bp, Artificial Sequences
  Synthetic
tagggttcgggagttgggttttcgggg

SEQ ID NO: 17441 - DNA, 27 bp, Artificial Sequences
  Synthetic
tcggtcggttcgtaggttgaggatgcg

SEQ ID NO: 17442 - DNA, 27 bp, Artificial Sequences
  Synthetic
cggttcgtaggttgaggatgcgttcgc

SEQ ID NO: 17443 - DNA, 27 bp, Artificial Sequences
  Synthetic
cggtcggttcgtaggttgaggatgcgt

SEQ ID NO: 17444 - DNA, 27 bp, Artificial Sequences
  Synthetic
gtggcgggttttagggttcgggagttg

SEQ ID NO: 17445 - DNA, 27 bp, Artificial Sequences
  Synthetic
gcgaggagttttttgcggcggtttttg

SEQ ID NO: 17446 - DNA, 28 bp, Artificial Sequences
  Synthetic
gcgaggagttttttgcggcggtttttgt

SEQ ID NO: 17447 - DNA, 29 bp, Artificial Sequences
  Synthetic
gcgaggagttttttgcggcggtttttgtg

SEQ ID NO: 17448 - DNA, 27 bp, Artificial Sequences
  Synthetic
cgaggagttttttgcggcggtttttgt

SEQ ID NO: 17449 - DNA, 28 bp, Artificial Sequences
  Synthetic
cgaggagttttttgcggcggtttttgtg

SEQ ID NO: 17450 - DNA, 29 bp, Artificial Sequences
  Synthetic
gttggagtagacggttttggtatcggagt

SEQ ID NO: 17451 - DNA, 29 bp, Artificial Sequences
  Synthetic
agtagacggttttggtatcggagttacgg

SEQ ID NO: 17452 - DNA, 29 bp, Artificial Sequences
  Synthetic
gtagacggttttggtatcggagttacgga

SEQ ID NO: 17453 - DNA, 31 bp, Artificial Sequences
  Synthetic
ggagtagacggttttggtatcggagttacgg

SEQ ID NO: 17454 - DNA, 30 bp, Artificial Sequences
  Synthetic
agtagacggttttggtatcggagttacgga

SEQ ID NO: 17455 - DNA, 32 bp, Artificial Sequences
  Synthetic
ttgtttacgttttgggagaagtatttgtgcgt

SEQ ID NO: 17456 - DNA, 33 bp, Artificial Sequences
  Synthetic
aggtagacgtgttttagggtttttcgattgagt

SEQ ID NO: 17457 - DNA, 33 bp, Artificial Sequences
  Synthetic
tttgtttacgttttgggagaagtatttgtgcgt

SEQ ID NO: 17458 - DNA, 33 bp, Artificial Sequences
  Synthetic
ggtagacgtgttttagggtttttcgattgagtc

SEQ ID NO: 17459 - DNA, 33 bp, Artificial Sequences
  Synthetic
acgttttgggagaagtatttgtgcgtattttga

SEQ ID NO: 17460 - DNA, 28 bp, Artificial Sequences
  Synthetic
ggatggcggaagtttattaggtcgtggt

SEQ ID NO: 17461 - DNA, 29 bp, Artificial Sequences
  Synthetic
aggatggcggaagtttattaggtcgtggt

SEQ ID NO: 17462 - DNA, 28 bp, Artificial Sequences
  Synthetic
aggatggcggaagtttattaggtcgtgg

SEQ ID NO: 17463 - DNA, 29 bp, Artificial Sequences
  Synthetic
ggatggcggaagtttattaggtcgtggtt

SEQ ID NO: 17464 - DNA, 30 bp, Artificial Sequences
  Synthetic
aggatggcggaagtttattaggtcgtggtt

SEQ ID NO: 17465 - DNA, 27 bp, Artificial Sequences
  Synthetic
ggggttggtcggtatttaggacggggg

SEQ ID NO: 17466 - DNA, 27 bp, Artificial Sequences
  Synthetic
gggggttggtcggtatttaggacgggg

SEQ ID NO: 17467 - DNA, 27 bp, Artificial Sequences
  Synthetic
atttaggacgggggtagatgggtgcgc

SEQ ID NO: 17468 - DNA, 27 bp, Artificial Sequences
  Synthetic
gggttggtcggtatttaggacgggggt

SEQ ID NO: 17469 - DNA, 27 bp, Artificial Sequences
  Synthetic
tgggggttggtcggtatttaggacggg

SEQ ID NO: 17470 - DNA, 27 bp, Artificial Sequences
  Synthetic
attcggaaggttggcgcgaggatttgg

SEQ ID NO: 17471 - DNA, 27 bp, Artificial Sequences
  Synthetic
tgtttattcggaaggttggcgcgagga

SEQ ID NO: 17472 - DNA, 26 bp, Artificial Sequences
  Synthetic
ttcggaaggttggcgcgaggatttgg

SEQ ID NO: 17473 - DNA, 28 bp, Artificial Sequences
  Synthetic
tgtgtttattcggaaggttggcgcgagg

SEQ ID NO: 17474 - DNA, 27 bp, Artificial Sequences
  Synthetic
gtgtttattcggaaggttggcgcgagg

SEQ ID NO: 17475 - DNA, 23 bp, Artificial Sequences
  Synthetic
gcgggcgcgtttaggtcggtttc

SEQ ID NO: 17476 - DNA, 30 bp, Artificial Sequences
  Synthetic
cgggtgggtatagttattgtggtgtagggg

SEQ ID NO: 17477 - DNA, 31 bp, Artificial Sequences
  Synthetic
cgggtgggtatagttattgtggtgtagggga

SEQ ID NO: 17478 - DNA, 31 bp, Artificial Sequences
  Synthetic
tcgggtgggtatagttattgtggtgtagggg

SEQ ID NO: 17479 - DNA, 29 bp, Artificial Sequences
  Synthetic
cgggtgggtatagttattgtggtgtaggg

SEQ ID NO: 17480 - DNA, 27 bp, Artificial Sequences
  Synthetic
attcggaaggttggcgcgaggatttgg

SEQ ID NO: 17481 - DNA, 27 bp, Artificial Sequences
  Synthetic
ggtggggaagggcgggttttcgaattt

SEQ ID NO: 17482 - DNA, 27 bp, Artificial Sequences
  Synthetic
gggtggggaagggcgggttttcgaatt

SEQ ID NO: 17483 - DNA, 28 bp, Artificial Sequences
  Synthetic
ggtggggaagggcgggttttcgaatttt

SEQ ID NO: 17484 - DNA, 27 bp, Artificial Sequences
  Synthetic
tgtttattcggaaggttggcgcgagga

SEQ ID NO: 17485 - DNA, 27 bp, Artificial Sequences
  Synthetic
aagggtagtttggagttggggggcgtt

SEQ ID NO: 17486 - DNA, 27 bp, Artificial Sequences
  Synthetic
gaagggtagtttggagttggggggcgt

SEQ ID NO: 17487 - DNA, 27 bp, Artificial Sequences
  Synthetic
cgggtaggggagagaggcgtttttgga

SEQ ID NO: 17488 - DNA, 27 bp, Artificial Sequences
  Synthetic
acggcgaagggtagtttggagttgggg

SEQ ID NO: 17489 - DNA, 27 bp, Artificial Sequences
  Synthetic
ggcgaagggtagtttggagttgggggg

SEQ ID NO: 17490 - DNA, 27 bp, Artificial Sequences
  Synthetic
cggttcgcgggggtttgggtttttagt

SEQ ID NO: 17491 - DNA, 27 bp, Artificial Sequences
  Synthetic
ggtggggaagggcgggttttcgaattt

SEQ ID NO: 17492 - DNA, 27 bp, Artificial Sequences
  Synthetic
gggtggggaagggcgggttttcgaatt

SEQ ID NO: 17493 - DNA, 28 bp, Artificial Sequences
  Synthetic
cggttcgcgggggtttgggtttttagtt

SEQ ID NO: 17494 - DNA, 28 bp, Artificial Sequences
  Synthetic
ggtggggaagggcgggttttcgaatttt

SEQ ID NO: 17495 - DNA, 27 bp, Artificial Sequences
  Synthetic
aagggtagtttggagttggggggcgtt

SEQ ID NO: 17496 - DNA, 27 bp, Artificial Sequences
  Synthetic
gaagggtagtttggagttggggggcgt

SEQ ID NO: 17497 - DNA, 27 bp, Artificial Sequences
  Synthetic
cgggtaggggagagaggcgtttttgga

SEQ ID NO: 17498 - DNA, 27 bp, Artificial Sequences
  Synthetic
acggcgaagggtagtttggagttgggg

SEQ ID NO: 17499 - DNA, 27 bp, Artificial Sequences
  Synthetic
ggcgaagggtagtttggagttgggggg

SEQ ID NO: 17500 - DNA, 27 bp, Artificial Sequences
  Synthetic
tgtgagtaggggtcggtatagggcggt

SEQ ID NO: 17501 - DNA, 27 bp, Artificial Sequences
  Synthetic
cggttcgcgggggtttgggtttttagt

SEQ ID NO: 17502 - DNA, 27 bp, Artificial Sequences
  Synthetic
gagtaggggtcggtatagggcggttcg

SEQ ID NO: 17503 - DNA, 28 bp, Artificial Sequences
  Synthetic
tgtgagtaggggtcggtatagggcggtt

SEQ ID NO: 17504 - DNA, 28 bp, Artificial Sequences
  Synthetic
ttgtgagtaggggtcggtatagggcggt

SEQ ID NO: 17505 - DNA, 21 bp, Artificial Sequences
  Synthetic
cactctttccctacacgacgc

SEQ ID NO: 17506 - DNA, 32 bp, Artificial Sequences
  Synthetic
agatcggaagagcgtcgtgtagggaaagagtg

SEQ ID NO: 17507 - DNA, 46 bp, Artificial Sequences
  Synthetic
  misc_feature (3)..(14): n is a, c, g, or t
gannnnnnnnnnnnagatcggaagagcgtcgtgtagggaaagagtg

---

The invention claimed is:

1. A panel of isolated polynucleotides comprising, consisting of, or consisting essentially of at least 10 isolated polynucleotides, said 10 isolated polynucleotides having polynucleotide sequences of at least Targets 60, 192, 248, 916, 936, 1349, 1374, 1392, 1435 and 1447, or a complementary sequence thereof, wherein said isolated polynucleotides have a level or concentration from about 1 femtomolar to about 1 millimolar, and wherein said polynucleotide sequence of said Target 60 comprises at least 10 consecutive nucleotides in a polynucleotide sequence that is set forth in, that is complementary with or that hybridizes under stringent conditions to, one or more of polynucleotide sequence(s) set forth in SEQ ID NOs: 562-571, nucleotide sequence that is set forth in, that is complementary with or that hybridizes under stringent conditions to, one or more of polynucleotide sequence(s) set forth in SEQ ID NO: 13140-13149, said polynucleotide sequence of said Target 1435 comprises at least 10 consecutive nucleotides in a polynucleotide sequence that is set forth in, that is complementary with or that hybridizes under stringent conditions to, one or more of polynucleotide sequence(s) set forth in SEQ ID NOs: 13560-13569, and said polynucleotide sequence of said Target 1447 comprises at least 10 consecutive nucleotides in a polynucleotide sequence that is set forth in, that is complementary with or that hybridizes under stringent conditions to, one or more of polynucleotide sequence(s) set forth in SEQ ID NO: 13665-13674.

2. A kit or system, which comprises a panel of claim 1.

3. The kit or system of claim 2, which is configured for assessing methylation status of at least said Targets 60, 192, 248, 916, 936, 1349, 1374, 1392, 1435 and 1447.

4. A kit or system, which comprises reagents for assessing methylation status of at least Targets 60, 192, 248, 916, 936, 1349, 1374, 1392, 1435 and 1447, wherein said reagents comprise, consist essentially of, or consist of probes or primers configured for hybridizing with each of said at least Targets 60, 192, 248, 916, 936, 1349, 1374, 1392, 1435 and 1447, and said probes or primers have a level of concentration from about 1 femtomolar to about 1 millimolar, and wherein said polynucleotide sequence of said Target 60 comprises at least 10 consecutive nucleotides in a polynucleotide sequence that is set forth in, that is complementary with or that hybridizes under stringent conditions to, one or more of polynucleotide sequence(s) set forth in SEQ ID NOs: 562-571, said polynucleotide sequence of said Target 192 comprises at least 10 consecutive nucleotides in a polynucleotide sequence that is set forth in, that is complementary with or that hybridizes under stringent conditions to, one or more of polynucleotide sequence(s) set forth in SEQ ID NOs: 1824-1833, said polynucleotide sequence of said Target 248 comprises at least 10 consecutive nucleotides in a polynucleotide sequence that is set forth in, that is complementary with or that hybridizes under stringent conditions to, one or more of polynucleotide sequence(s) set forth in SEQ ID NOs: 2353-2362, said polynucleotide sequence of said Target 916 comprises at least 10 consecutive nucleotides in a polynucleotide sequence that is set forth in, that is complementary with or that hybridizes under stringent conditions to, one or more of polynucleotide sequence(s) forth set in SEQ ID NOs: 8667-8676, said polynucleotide sequence of said Target 936 comprises at least 10 consecutive nucleotides in a polynucleotide sequence that is set forth in, that is complementary with or that hybridizes under stringent conditions to, one or more of polynucleotide sequence(s) set forth in SEQ ID NOs: 8854-8863, said polynucleotide sequence of said Target 1349 comprises at least 10 consecutive nucleotides in a polynucleotide sequence that is set forth in, that is complementary with or that hybridizes under stringent conditions to, one or more of polynucleotide sequence(s) set forth in SEQ ID NOs: 12722-12731, said polynucleotide sequence of said Target 1374 comprises at least 10 consecutive nucleotides in a polynucleotide sequence that is set forth in, that is complementary with or that hybridizes under stringent conditions to, one or more of polynucleotide sequence(s) set forth in SEQ ID NOs: 12966-12975, said polynucleotide sequence of said Target 1392 comprises at least 10 consecutive nucleotides in a polynucleotide sequence that is set forth in, that is complementary with or that hybridizes under stringent conditions to, one or more of polynucleotide sequence(s) set forth in SEQ ID NO: 13140-13149, said polynucleotide sequence of said Target 1435 comprises at least 10 consecutive nucleotides in a polynucleotide sequence that is set forth in, that is complementary with or that hybridizes under stringent conditions to, one or more of polynucleotide sequence(s) set forth in SEQ ID NOs: 13560-13569, and said polynucleotide sequence of said Target 1447 comprises at least 10 consecutive nucleotides in a polynucleotide sequence that is set forth in, that is complementary with or that hybridizes under stringent conditions to, one or more of polynucleotide sequence(s) set forth in SEQ ID NO: 13665-13674.

5. The kit or system of claim 4, which further comprises a computer readable medium that is configured for obtaining a methylation metric in the form of average methylation frequency, methylation haplotype load, unmethylation haplotype load, percent discordant reads, or a combination thereof.

6. The kit or system of claim 4, which is configured for assessing cancer or neoplasia in a subject.

7. A method for obtaining methylation status of target polynucleotides in a sample of a subject, which method comprises:

a) providing a sample from a subject containing at least 10 target polynucleotides of said subject, said at least 10 target polynucleotides having polynucleotide sequences of at least Targets 60, 192, 248, 916, 936, 1349, 1374, 1392, 1435 and 1447, or a complementary sequence thereof; and b) assessing methylation status of said at least 10 target polynucleotides; and wherein said step b) is conducted using a panel of isolated polynucleotides comprising, consisting of, or consisting essentially of at least 10 isolated polynucleotides, said 10 isolated polynucleotides having polynucleotide sequences of at least Targets 60, 192, 248, 916, 936, 1349, 1374, 1392, 1435 and 1447, or a complementary sequence thereof, and said isolated polynucleotides have a level or concentration from about 1 femtomolar to about 1 millimolar, and wherein said polynucleotide sequence of said Target 60 comprises at least 10 consecutive nucleotides in a polynucleotide sequence that is set forth in, that is complementary with or that hybridizes under stringent conditions to, one or more of polynucleotide sequence(s) set forth in SEQ ID NOs: 562-571, said polynucleotide sequence of said Target 192 comprises at least 10 consecutive nucleotides in a polynucleotide sequence that is set forth in, that is complementary with or that hybridizes under stringent conditions to, one or more of polynucleotide sequence(s) set forth in SEQ ID NOs: 1824-1833, said polynucleotide sequence of said Target 248 comprises at least 10 consecutive nucleotides in a polynucleotide sequence that is set forth in, that is complementary with or that hybridizes under stringent conditions to, one or more of polynucleotide sequence(s) set forth in SEQ ID NOs: 2353-2362, said polynucleotide sequence of said Target 916 comprises at least 10 consecutive nucleotides in a polynucleotide sequence that is set forth in, that is complementary with or that hybridizes under stringent conditions to, one or more of polynucleotide sequence(s) forth set in SEQ ID NOs: 8667-8676, said polynucleotide sequence of said Target 936 comprises at least 10 consecutive nucleotides in a polynucleotide sequence that is set forth in, that is complementary with or that hybridizes under stringent conditions to, one or more of polynucleotide sequence(s) set forth in SEQ ID NOs: 8854-8863,

said polynucleotide sequence of said Target 1349 com-
prises at least 10 consecutive nucleotides in a poly-
nucleotide sequence that is set forth in, that is comple-
mentary with or that hybridizes under stringent
conditions to, one or more of polynucleotide
sequence(s) set forth in SEQ ID NOs: 12722-12731,
said polynucleotide sequence of said Target 1374 com-
prises at least 10 consecutive nucleotides in a poly-
nucleotide sequence that is set forth in, that is comple-
mentary with or that hybridizes under stringent
conditions to, one or more of polynucleotide
sequence(s) set forth in SEQ ID NOs: 12966-12975,
said polynucleotide sequence of said Target 1392 com-
prises at least 10 consecutive nucleotides in a poly-
nucleotide sequence that is set forth in, that is comple-
mentary with or that hybridizes under stringent
conditions to, one or more of polynucleotide
sequence(s) set forth in SEQ ID NO: 13140-13149,
said polynucleotide sequence of said Target 1435 com-
prises at least 10 consecutive nucleotides in a poly-
nucleotide sequence that is set forth in, that is comple-
mentary with or that hybridizes under stringent
conditions to, one or more of polynucleotide
sequence(s) set forth in SEQ ID NOs: 13560-13569,
and
said polynucleotide sequence of said Target 1447 com-
prises at least 10 consecutive nucleotides in a poly-
nucleotide sequence that is set forth in, that is comple-
mentary with or that hybridizes under stringent
conditions to, one or more of polynucleotide
sequence(s) set forth in SEQ ID NO: 13665-13674.

8. The method of claim 7, which further comprises
isolating the target polynucleotides from a sample.

9. The method of claim 7, which further comprises
preparing a library of the target polynucleotides.

10. The method of claim 7, which further comprises
amplifying the target polynucleotides.

11. The method of claim 7, which further comprises
purifying the target polynucleotides, a library of the target
polynucleotides, amplified target polynucleotides or a
library of amplified target polynucleotides.

12. The method of claim 7, wherein the methylation status
of target polynucleotides is assessed using mass spectrom-
etry, methylation-specific PCR (MSP), methylation-sensi-
tive sequencing, e.g., bisulphite sequencing, the HpaII tiny
fragment Enrichment by ligation-mediated PCR assay
(HELP Assay), GlaI hydrolysis and ligation adapter depen-
dent PCR assay (GLAD-PCR assay), restriction landmark
genomic scanning (RLGS), methylated DNA immunopre-
cipitation (MeDIP or mDIP), pyrosequencing, molecular
break light assay for DNA adenine methyltransferase activ-
ity, methyl sensitive Southern blotting or high resolution
Melt (HRM) analysis.

13. The method of claim 7, wherein the methylation status
of target polynucleotides is assessed using methylation-
sensitive sequencing, e.g., bisulphite sequencing.

14. The method of claim 13, which further comprises,
prior to the methylation-sensitive sequencing, e.g., bisul-
phite sequencing, obtaining a library of linear, single-
stranded ligation products, each of the linear, single-
stranded ligation products comprises of a linear, single-
stranded target polynucleotide linked to an adaptor
comprising a unique molecular identifier (UMI) sequence
that earmarks the single-stranded target polynucleotide to
which the adaptor is ligated.

15. The method of claim 7, wherein the methylation status
of each of the target polynucleotides is assessed to obtain a
methylation metric, e.g., in the form of average methylation
frequency, methylation haplotype load, unmethylation hap-
lotype load, percent discordant reads, or a combination
thereof.

16. The method of claim 15, wherein a numerical meth-
ylation matrix is computed using a classification algorithm
from the methylation metrics from each of the target poly-
nucleotides to assess methylation status of a sample.

17. The method of claim 7, which is used for treatment of
cancer or neoplasia in a subject.

18. The method of claim 17, wherein cancer or neoplasia
in multiple subjects are treated.

* * * * *